United States Patent 8,067,671 (METHODS FOR GENETIC CONTROL OF PLANT PEST INFESTATION AND COMPOSITIONS THEREOF) - sequence listing, part 4

SEQ ID NO: 2365 - DNA, 2039 bp, Heterodera glycines
gcccacacttttaaaccaacgtatcgagaaaatccttggaagcaaagattgcacccccctggtgcggaaaaatgacgctttttaaaatgttcctaatgaacgggatattccaaggaaatttcattcattcagaattatgcataactttcaacaagactgcattgaaaagcatattctctgtggcaaattcgacatttccacgcctttctgtctgtaaggcatattaaaattattatttaaattttatcgtataattgcctccacaaattttagagccgtggataacaccgtgctttcttaggtattcggccgttgtaaatttcttttcacaaagtgtacagccgtatggcgcacttaatcaaaggtgttttttatataaatgtattattactattattaattattattactctctgccatgtacgcgcaaatgcgcaccgagaccacgcttagtaaaatttttttcacagaattggcactggatgagtcctgtgacaaaattaaagaagttcatttgaattattttgagttgttgcctaatggtggggctggcaccgcacgttgcgcgagtgctggagcacccgccgcaggttgtacatgcgcgggtgtgtgatcagccgccattggtagtgcttgaacaaccgccgtaggttgcgcgggtgcttgagcacccgccgcagggggtgggtgcacaaccgcaccaggttgtacaggtgtgcgcaagttttgatttcaaccattattgcggtgtgaaccatttgagaaacatatggttgcttcaaaaaaaaactttgtgatatttaaaatagttgaattatacaatatgtgccaaaacaggaggaagaagctggcgcgaaaaggcatcgaagtcgaatgggcgaaattcaaattgccgttgcataataaaccaattttaaatattattattttaaaaaataacattttaaaggagcagaacggtggaaaaacttaatctttctgttggatttacggtttaaatagcaaaatagtgtagtttatgttcaagaaacatcaaaaagtagtccaaatatggaaaagtttcataaatgatacgacaaatcggtggatttccaaaaatggcccgcccaaatgtcaaacagaaaaaattaacatgtatttttaatttatgatgacaacatatgggggccaaaatgacatgagttttctccaccgcaagaaaaacgaagtccgcgccccgccccgactgccaaaatttattgtcataaaattttcaacatctttctgttgcaccgataaatgactgccgcacaaaaaaaaaagtcgtaaaactgtttttcgacagtgcgcagcaaattacatcgttccatgccccccgcccccaccaaccagtcgccaatttgaaacaaaaagcgagatcaatgctttatgaaatgattcaaaatagaaatggctattaaagtcataaatttaaaaatttgtaatctttggtcactaaaaaattttaaaacctaaatttagatttttatcatttgataaattggtcgttgatcattatgaaatagtatttaagtggtatttaagcaagtcttttttctcaaattaaaagcaaaaattacccataaaatttaattttttattattttccgcttttaaaatccgtttcctatccattatcgatgatgcgacaacgttccaaatctctttctaatataaattctgaaattgttcaaaccccaatttgccgtttatatctgcgctatgttgatgctttatatggcagaaggcgtttatcaactcctcatagaaattttttcccaataaaaatgaatttaggtcttttttcattttaattttttatttttaaacctatttttaattttctagaggcaaaacatgatcggatttttttgaagcggaggaaaaacaatgtttgggtgaaaattcgacgggtacagatcatttgtcttgggttaatttatatatttctgtcatttagtcgacacgcctgctggaaaaaaagaaataatattgataataaagtgaaaatgttttccaat

SEQ ID NO: 2366 - DNA, 3456 bp, Heterodera glycines
aacttttatttttagcccgaatctcacagaatctccattaaaaactggtttgattatttaaaatagcacaatttaattctttgtttttcttaaggattgaatttcgggagaaaattcattgtccgttgtgcaataaagaagctgaactgagcaatgtaagcacaggcaatttgtttggtggacttgtaaatttatttattaatgaataaattgtttatttttaattatgccgctggcaaataaatgccactttaggctgacacacattcacacaaactaaaaaaaaattcattcgttaaatttttgcccagttcggccaacttttacccattttctccgctctttcggatgcgcctttggcaatgtacaaaaatcccttggccgagttgtaccgtcgtgcgcaaagtgccgacaacgctttcgtcaaggcccaatcgcaatttgtgttgtcttcgattgttcggcaaatcagccaagttgagggacgagtgcgcaatttgttggccaattttcacattttgatggcacaatttcggcacgatgagtcattgtttggcgttgaccgcggcactttttcggtgaatgccaaattaatgagcttcattcaaactgtgtacaaagacccgcacattatcacaaatcagcgggacagagagcaattcttttacgcgtttgacctgatcaaatgggccgaagtttttcaaagttcggaggcaaacgatgcgttggaaagtatgcaactgatcagtgaggagatggaggaggaggacacggacaaatgaccaaaaccgatgggccagagaagagaccgttttatggattgtgatttagcctcatttcttctgttcattttgtagtcattggattacctggaaagggccatgggcatggagatgaaaagccgaggaaaagcagggccaattggtcattggcatttccatcagtcatttcattgggggaccaaactccaattaaatgcctgaattatatttatttccaagccaattctaggtgaatactgatcagttgacctcggctttatctgtctctacagcggcttctcccaatttacatttcttcaattaatttattttgtaattttttatgttttcctcttcaattacgcacaaccgattaagtaattaattaatgtttaagaaaataaaaaaaccattcaatttattggagagtgataattaaggttgaaagtttgttttgaatgatatcatttgataatcgaacggagatgctcatcaaaaatcaaacatcgatgttcagctatttgtggtagcattggctcaattctcaaattttgaattaaaaaatcaaaaaaattttggcgaaaattgtgccaatttggctgtcatgaaaatgaaatgatcggcaaattttcttattcgttctccactgattatgcatttattccttctgtccacttctgtttcatgcgattggttttgggttttgttgtttgttgaagcgttggagtttcacgaaattctgcaacattagattaatttgtcgcctcattagaatggaatgtattaattatgcaatttccctcaattagtggctgacgatgaattacggtactcttcccccacctgtggcgtcagcgttgtacggtagtaagtgccctttggcacggcaatgaggtccccgcggcgcaacaacactcgggcccacttgtcgtcgtcaaactccacgtcgtagtacatttcgccgtccagcaccagcagcacactgtcctcaacgctttcggacggttcgcacatttctttcaacttaaaaagtggcataaaatgtgcaaaaatagcgcaattttaatttaataataaattaaattttgccagatctttctgtgcccccccaccttctcctccaaatcgcagcccaaccgcttctccaccgtgaccacgtccgccccgctcactttccattcgcttttgatgcgcgtcaatcgcttcttcatcgccattgtgtcgtccaaatccacctgaaatggcccaaattcaaatctaatccatttcattcttcttggacaattccaccttgaacagatggacaccggccatgtcgagcagttgcgtgttcgggatgaatttgggtgggaatacgtggtggggcagacgcatgtcgccgcaggggtacgcctccatctcccagacttgcaacattttttgttcggagaaaatggaaatttgaaattaaattgctaaacaaagatttcaaaatttttaaaataaattaattaaatttgcgcaatttcgtgtgattttatttttgggcatcgaagaatataaatcgcgccgcgccgcaaatgcactttaatattgtgccttttattcagtcattttgtgggtcaaaaacaaaaatccgcataatcacgggcaaaagaaagtgggttattgggcgattattattattattatcacacgaaaaaataaatcgccttagggcgagtggaagggattttggattaaaaaacaaattgtttatttttaacaatttggttgttttcaacttaaaaattagacagaagagggaagaaattgagcctataagtaaatattaattaattaataattaagtatacgaatggttcacgtgaattgccactgagttttggtagggacaattacgtgctgattttttcgcgttgtttcacttatgcaacaaaaattaaaggaaaaataaaaaaattggaaaattccaaatcaaaacaaatcggaaaatgataaaaatctgaattttccatttcaatttccatttttggagtgttaaaaattaaccattcattcattcatttctgctgatcaacaagcaaattgtgaattgtttgttgtcccatcggcgagtggcaacaattgccccggggcaaacgcaaaaataaaaaactaaggacactttttgtgtttgaagggtcactttccgctgattgttctttcgttagcgtagtttttgtatgtagttttaagcctgtttcagacgagggacggtaagggatacagtgtttgatgggtggaaaaagatactgtaggtgagggagggggacggaatgcgaaaaatgcaattcagaagtgtgtaagtgttgccaaaaagtggcaaacattctccactgatcagatggagggggacagggaacaattctaatcattatactgatcggaaattagggggaatagtcctaatcactctactgatcggaaagtaggggggggggaggggattgctgaccagttgaccattttaccgatcagttgcatcagctggtcattttactgatcagtggttggggaagaaggctgctgatcatttcatgacactgatggtgccgggtcgttactcaaaaatcatcaaaataaaaaaactttgacagaaaattattcataacttcgccccaaatgaatcaaattttataatattgatattattcgatagacctaagtgttttct

SEQ ID NO: 2367 - DNA, 6312 bp, Heterodera glycines
aaaaatacaacaacaacgaactctaagggaaaggtcgccttgggatgaagtggattatcctgcctctccccacttccttttttgctacggattctcgactgatttgatttgcgtctcgcgcaattggcccattccttcgaattatcgagtttaaattctcggactcaaaattttgatatttttaaaaagattcaaataaggctataaatacttctgttagttggtaatttggtcaaaaattgccattattggccatttctgtcgcggttcgtccgccggtggcgaatttttgccgcaaattctgattgccataagcgatgtgttggttgaaggtgccaacactgaaatacattcagcataattaatcataaatatttttgttacccgtaagtgccggaggcaacgaaattgtgaccgtacccattgagtacggtagtgccggtgatggcacagtctggcggacgccaatcgtcgtcgtcggactcgcgccctaaaattccaaagctaacgccaaaatacggcacgaaaattgaataaatatttttaaagggaaaaataaattaaaatataaatttattagccaatttattaagcaaaaaaacacaaaaagacaaagcaaaagtaggcaaaatgtaagcaaatcacacaaattttgacatgaaaaatgttttaaagcaaaataaaaagaaagaaagaaaagggaacaaaagtacagtaagtgaccatacagtaagtgttgctagtaaatttacaataagcaaaatgcgtcatttatttaaaaatagcccaaaatatttgcgacacagcctgaaaaactggggaacaaaagcctttttttcatatgcaagtgatatgaaaatttcctttcagcttaataattataagccaattaattttaattgcaccaaatttttgaatggcaaagtgccaaattgtcacccaccacaagcggtgtaagtgaagttgacggggtgcgactgtttggggccacagattacggtaacagaaacgagtgcacttcggttcagctgatggtaggtgggcacagtacacacaatgtgacactgtagagaaagagggaatgacaactgaattttgtcataaaaaatgcaaaaaaaaaatattaatatttgcatttcagaatggcacatatttttgcgtgccaatgacacttttccaaaaaaatggcgcactttggcgaaattaagcactaaattgtatttaaacggatgaaatgcctgatgcacaagtcgttggtcgagctttgcttccgcactccatcccagcaatccgtctgaaaagcattaattaaatgcctaattagtaattacgtaattttgccgttaatttatttttcccctataattattcgttgaaaaattgttcacataaatttggaaattgtgcaaaatttagacatcacaataaaacccgtcgcgcaccgttgttgtactcgcgaaagagcacccgcaaatttttggggttgaaatttcggccaatgataaataattgttggcctccgctggacgaagcctcgagcagcgacattttcagcacgtccggacagccgagctgttgcactgcaattgtggggatcaaaagaatataaaatgccaatttattgcaaaaatttaaaaataaaacatcggaaatttttgtattttttagatgcctactgaacaccactcactttaaattctctaatcgactttcataaaaaccaaaaaatccactcaattcccccgactctcgtcggatttgccaattccattccaaatttcactccaattaaatggcaaaaataaataaataaatttgttggcatttctcccccccccctccgaccgcatcggatggcttccgtttgcgtccgcagcactcgcccctccggcagttgcgcctgtgccacaatgtgcacgtcgttttggcaccttcgttgctccgtccgcttttgctgctcctccctcatgggcattgtttcttcgtcgccgcctcctttcgctttttcttcgttcgtcgtccgtccctttgtgcgccgtctgtgccgaccgtttgcggcggtcgccgcgtttctcgagcagttcggcactgaattggaattggcgctgcttttgctcttgctgctgctgttgtttttgctgttggctgctgctccgtaggcgcatattttcataatgcccacacagtccaatctgacaaatgagtgggacacttctactggcagggattttccatttgttttttggatcgagaaaagacatctcgcaaaagtgatgctcaaatgaatattcgagactctcgagcatcaattacaaattagtccattccacggcccatttccaccggttgttatgaaaattactcatgcgattacaaaatcggaaaagattcctttttttaatttcaattatacatttaaaaatcaaataagaaacttggcgattcattggccgttttttggaaaagcaaccgggggaatattattacggtttttgctgtttcacttacacaacgaccattccgttctcaggtcttagcatgacttcctgcaaaatcaaaaattcattttggcatttgcccttttttcctctctctccccaccaatcgttctgtgccgtgctcagtgactacgcgacggcacggagttgtccaaaaaaaaaaaaatttaatttgtgcattttaatttggaataatttttatttgttctgttaccgtggcggacttgcccgacacgggcaccaatctgtacagattgtgctcaacaaaagtgtttccgtccgtccgttgggcggcaaaaagttcgacgtgagtgggccgaaaatggcccaacagctgaaaaaggcaggggaaagcatttgcagataaaaaacaacaacgagacgaaatccaatcatggcggagttttgaaagtcgggacttcccgacaattccctgaacgccgaagaagctgtcagggcaattaaaaacggaaagctgggattgataagatcaaaaaagggcgaatgtgcctcggtagctcaatggtagagctgctcacggatttggcggatgagtgagatcaatttccacccgtggcctcctaacattttgcccatttcttatttaaattgctatcaaaaagatatgccaatgtgtgaccgataacccggtaaaaaacgaagcgtaaaatcgagaaaaatgtttttccaaaaattttccactcccctctcgggacctgaatggtgcaaaaggaagtcccgcttcggtctttgatcgcgccgcgactgccctccgacgcgtaccgcgcacggtgttgttcctccggctaataagcgatgaaaatgaattttaaaaatttttaaatttccatcgcttttccaccccaatttctttctcacctgtctcaacaccaccaattggcattcgctcggcgactgttcgcaaatgtttccgctgttgttcattagcgacatttgtcgttgtgtttgttgtgccatcgcttcgccgcccatttccattgcaattgttccaaatgccatcggctgcgcttttcgaatttggcgccgggtctcctttagctgcggcgcgcctaggcattgtgtgtccacgagacgcccaattggcccggggcgtgccaatttcatcggaggcgaaagctgcgaaaactggggctcaaggtgttgttgttcagtgcacgaaaggccatttggtgcgattactgatcgaacatgtggcgatagtttgtcatatttaagttatttccattttaattacaaaaaataattattttataatttttataccgtaatccgtcgctgaatttttgccaatcattgactgcggcaccgccatcgtttcataactgtcattggcgggcgacagcacagtcaactcgtgctgctgttgctgaggttggttacggtaggaactaccgtaggaatgggagtcgcaatttccgtaataatcagcaaatactgtgccattgttgttgttgttgctagtgttgtggcacatcgaatgcatttctagcgttggctgttgtggcggtgcccacaaagtgtccatccatccggacgcgtactcatgctaccgtaatgtatcgtagtttaaaacggcaatttaattttgggaatataagtaacatataataatatttgagttaaaagcatgattaaattttgttaacacgtattaattctaatgaataaattgcccattaatttcacaaatattaattaattagcctcattaaacttgcacccaaatgggatttttttcttgttattacctgttgaaaactattgttattgttgtcgttgccattgttattgtacggattcagcttaaatgggctgctgatgacgctgcaatttgttgacgaggacgaagaagacataacatttaggcactaattgaacaaaaaattcaaaaagcaaaaaataaataaacaaaattaattaattaattaaaaatgaaaaacaaagagaggggagtgacaaaacaaagaaaggggattagataattagaagtaattagcaagcactaattaataaaacgcattaaataatgaatgacatggagcatcatcaacggacgaacgaatgaaaggacggcgattggcggtgataagtgataaaaaggggggggggctgtgatcggacggagagtcaaacaaagtcaatgggtgggtggagcgggcgatcagtgtttgtgacaacccaaccgaaattaatgatcgatcaggggagggcgacgaacaaaacaaacaaaacaaaattggggaaaaagaggaaaatttaaatttgaaattatgttgattttaatttaattttaatttagcactcgcaaaatcaattttaaacagtgaaagcatcatttaaaatatcatttttaaacataaacacaaaatttattggctttattgtctgttttaatgatggaattctttgacttttaaaaatttgcaaaaaatgagaaaagcattcattggttttacaattgaaataaaactaattagcgaaaattattagccaattaaaatgaatttaaaacacattttgctgtggaatttatcatcggggccaaattgctgataatgaaatgtaaaaaatgaaaaaaagcggagaaaccctatggacaaattgtggtatcatccgatgggacggcgggaagctatttttgaagcatttttccatccttaaccagtttttgtacaattaattaattacgaatattaaatttggcatttttaaaagagcaaaaataaataatgtgcaaaattatttgtattgattcatttatttcccgtcaatttatcactttttgtcggataattttcgcgtgaatgaatttgccattcgccggtcaaccaataactgttcagcctttgcgtaaatgaaggggaagaagtccttttgaacctctgaaatgggcaaatgagattcacttttacttttaattgggcaaattagagtgattaattaattatatggcaaaattatttgtttattttcggcaccagcaattgtcaattcgcttttgccttcctttgccgctcccttttcttcgtcactttgcggtgaatggcattttcgttccaaactgtcaagcagttggtcaatctaaaacgagtgactttttacaataagttttgtcatcgctaacgtcgagtttaattcgcattgttgccaaattatgattctcaaaatgcaatttttcttttaaatattctctgctcttctgctgctggtcactgaccatttcgacagccattcgatggcaactgaccacgtccaatttgcggtcgagctgtgccctgtgctccgctaatttctgctgaaattacccaagaactcagtttttttttttgaattttcgacttgtgccctggcaaatgcacaaaatgaatttgcaatagtgccctcctcgtcgctgatcacttctgccgttggcagctggttcgattgcggtgatccgtcagctttgactttgatcagtggcgattggggcaccaattcgcggcgcgaattgcagctgctaaccatcgaagtgacgccagaagcggactgaataaagaagcgagtgtaattagtgtacccccccccccctaattttcacctcatcccccgcgccgttcgcctcccctgtgttgcgctttttgctctccattttggacaaaaacagtggcggaagttgcggcgatgcaaaactgaacgcactgcgccttcgcaacaggcggccacagtcgccggtgtcgtcggcacgcgccgaaggcgacgacaaatgcacgggcgaagtcgcgcaaagtggcggcgaagacttcggcacaattag

SEQ ID NO: 2368 - DNA, 2215 bp, Heterodera glycines
gcataattagcagagcgatcaaggtccttttttaatcaattttgcttcataatgtaacatttatgccccaaaaatttcgtcccttgtgacctttttcaaaattttgaggtgtaggcccaaaaccgacaagtacctgaatttgttactatttgaaaaggcaaattaatacttcttctcttgagattagcggcaaaatcctcgttttatttttagccgacttttgacaccgctaaatgcctaaggcgggtgaaatggcggcgttcgctatttcgagaaggtgacacaaacaaatcccagcaacaggtgcaagaagcacacataaactttatgtggattaagccgttaagtgcccccaaagtgccggaatgacagtgataagagagaggattaatttgatattccaatcttacggtaatatactgtaataaattaaatattgtatctttatgtatcatatttgtgaaaaaatggtaagaattgctccgtcacgcatggaaatggagcagtaacagcagcatagccgggtgcgtgcgcggtcgttacccaaagcggaattcattgaccgcgcgtgccgcttcgcgcgccgcctcctcctgccgtcggcgtgcctcgcgcgcctccgtctcgcgtctgtgccgctcctcctccgcctgccgcttgcgctgctcctcacgcgcaaactccgcgttggccgcttcaatgttgacaatgccccgctccagcgcagccaacagtttgtgcagctgcgtgtagaagtcggccgcctgcccgctcttctgcacaatgtccgtgaacacttggtaggcggtgaccaacgtcagcgcgtgcagggcgcgcctgggcaaaaaagaattgaaaaatgaggcaaaaactgaattttaatgtgaatgcttatcgagtcttgggcacgattctggcagatttcttgtgttctcaagactcgtattgaatcttggggtcaaagcctcggcattggataattttttgatcagtttgagaggaattttgagttcactgactaggtagccaaagcgattagtggtgttgaaaatgccaaaaattgtcatggtttttcctcaagattgccaaggccatagcattccattttttctctctcttggatggcaattaaaaatgccgtttcccgccgaccctttggggcatctgttttccatggcaccgcgtccgtacttttcattggcatccaaaatttggcgccgaaagtctgcaaaatccgcgttcgcgtcagtcagcgcacgaaggatgttgtcctgcgcgcgcaggttctgctcgatgagctcgcgctgcgcgtcgtgcttgtgcatctcctgctcgaaaagcttgcgcgggtccaactcgcgctccgccagcgccttcgccgtgatgtcatccgcgtccaggtcggcgcggaacgtctccaccaacttgcagcgctgcttgcgcatctcgtccaccttgtcgatgatccgcttcagctgagcgccctcgggcgaatttcctgtgaaaaaacaacaaacgataaaaaacattggcctattaattagtgcggaaatgccaatgaatttgcctggattttgggcacagtctccgcatatctgtcgggtcagttcgggcaacggttggctgagcagcttcaaattctccgagtgcgcggcaatggcccgctggagttccgcgttgttttctctgcgggggggggaattaattaattaatgtcaattaaattttaattggatttccctccctcccccctccgtcgccttacattgcctttttgtggtgctcagtgagctcgtccaacttccgtccgatggccaaatagccctcgtcacgtgtgaagaatggatttgtgacggcgcggaggcgatgtcgcagggaagtcagccgagtgtccgtctgatgggacgtcgaagtaatgcctgggggggatttttttggattgtctaaaattctaagggttccgaaatgcttccacccccccccccccaattttgtgtattataaaattctaattcattcaaaatgcagacgttggaaattgtccagcaaatcggggaatgcgtccggctgagcgctgaacgcggcgctggcggtgagcaattcgtcggggaggcgaatttgttggtcgacgggttggtcaagcgccaattggtccaacttcagcgagaacaaatagttcctgcaaatgacaaacagttctcggatgttaaattct

SEQ ID NO: 2369 - DNA, 1198 bp, Heterodera glycines
cggctttctgtacccggcaataccctgacccggtattcgctaaaatacccaggcccgtacccctaatttaatatacgattttgaagttttttaaattaaaaataaggctacagaaaaaattgaaaaactctcgcctctcgtcctctcgcctctcgccaactctcgtgtttttggggactctcgcctctcgccaaactctcgctctcgtctttttggggactctcgcctctcgccaaactctcgctctcgtctttttggggactctcgcctctcgccaaactctcgctctcgtcttttctgagacaagtcacacccctgtcctgtacccaaaaagatttgcaactgtggtggtggtttttgtaagacagtaaaggaaaaaagggcgaaggttcaattcctttgcgcaacatgactaggtatttatttaaaatgaacaatttttgaaattttttcataataaaaaaagagttgacccatagtgtctgtctatttaatggttcatttctctttttttgactcattttttccgaggttgggaatgaacaccctgctctgtagacatgatgcaaatttctcccatgtcatatcccattttctcccacactccgtttcctttatgcatcacaattagtgaacgacaaaacgacttttttaacgagaaaacatcgttataaattctattttttaactatgtacatactacttatattattaagaaacgaccataaagtgctgtaattcaaaatttctttcctaattaaacgaattttttcaacaatgggcaaacggctctaccgataaattcagtaaatggccggagttggccaagccgtcactctatcaaatctttgtcagtctcaatttgaatacattcaaattcaaaggcaaacagacgatccatctcgaggtgacttttttctatttttaaaaaataagtatcttcttagattacgaaaccaaccaattatttgaaactccatttcgaatggttttggaggtggagaagggtttctctgaagttagaggatggcaccggtgcgtggttttttgttggctttcttaatttgcgaaatctaatttgaaattgacacagtctttccggacttaaagcgcgaaattgatgcaaaagggacactggctcaccgttcagctggctcaagagatcaaaccgcagaaagccgagttggaatttgtgtac

SEQ ID NO: 2370 - DNA, 5252 bp, Heterodera glycines
  misc_feature (2626)..(2626): n is a, c, g, or t
  misc_feature (2634)..(2634): n is a, c, g, or t
atttaattaaaggggaagtcgaaaacaggcgccaaccttcgcatttacagtgtgccgggcaagaaagaacagggaaattacgcattggaactggtcaccaaatcaattgacttttactctgaatggttcgacttcaaaatgccgttgccaaagtgtgatgtcctcgctatgcctgactttgcaatgggtgaacagcagaaacgaattgcaaaataaaccgaattttaggtgctatggaaaattggggacttatcactgcccgcgagaactgctctctttatgacccaacaaaaagcccttcgacacacaaacagcttctgactttgttattgtcgcacgaagtctcacacttttggttcggaaatctcgtcacaatggtgtttttacatttttatttataaatagcaaaaacatttagaaatggtggtccgatctttggctcaaggagggttttgcttcattcacgcaatatttgttcaccgacaaaaactaccctgaatttaaaatttggtccgatttcgtcgacgcggaagtggtcagagcgatggctttggactctctgcgcagtacgcatccaatcgaggcaatttctgaatattgatatgatattgtaaacacaatattttttaggttcctattgataacccaaatgaacttgaagaaatttacgattcgatcacttacgcaaaatcaaattcaatcattcggatgctcttcaatcatttgggcgaagcgactttccaaaaggccattcgcgattacttgaaaaagcaccaatacgcaaatgcagagaccaacgacctgtggaagagtttgtccgacgcttctgggattgtgagtttaaacaataaattcaatgtcgaagcaaagaatttccgcacattaaatatatttgcaactttatttcaaagaaacaaaaacactaggaaaggaaaatggttttacattttggtttaggatgtcaaagcactgatgtcttcctggacccaacagatgggcttccctttggttactgtcgaggaaaaaattttggatggagaccgtattgaattgcacttaaaacaatctcgctttttggccgatggaggtcatgacgaagcgaaccccgtttggcaagtgccgttcggagtcaccaccgcggcggacctgactcatccaaaggccaaatttttactgatgaaagccgaagacaaattcatcgtggatggagtcaaatcaaatgaatgggtcaaggtgaataatcagatggaagagacaaagattacaaatacaaaccaatttttatgttgaaattactcattacaataattttaggtcaactccaacttctcttcgttttttcgcgtccaatactcaccgaacatgctgcagtctttgctggatggtgtgaaaaaccgcgaactcggagtgttggaccgttaccaactcgccagtgacctctacgccgtgagttgtggcctgttttggatttaacccatgagtatattttgtttggttccttgattcttcatttttagcttgtaaaatcttctcgcgtatccgtttcacactttctcgcgttgctcactgtttgccaggaggaggaggattactttgtgtggtctgcaattgactcgggcattggcagcatcgctcattcactgaaacatttggacgacgaacgcaagctgttggaccgtttcgagcgttttgtgtgcaaaatgattgaacccgtcgctgccaaattgggctgggaacccaaagagggagaaagtctgaattatttctttgaaactcattttgtttttttcataactttctttcctttttagctatacacgttggacgtcttcgtgccctgctcctcagccgtttgtcacattttcgccatcaaccgactattcaaatggcactttccaaattcaatgccctcatcgagaaaggcgtcgatgttgtcccggacttgcgaaagctcattttccgtgccgtaggctctacaaatgatgaaaaaatcattgctgcattgaaaaatttgatggagacatcgggctacgcacaagtggagttgtcatgtgtattaggtatgagatattaggcaaatgtgaggtggtcccttatgacaaaccttttaaggacttggccagtgttcggacttgaaaatgctcgaggacattttcaattatggtgttattcaaggcaaaatccgcgaccaggacctttatcttttgttcgcggcaacggaaatggcaccgatggcgtgctgtggacatttcgcatgggactttttcaaaaacaatttcgcacttttgatcgagaagtacggcagcgtcaacagcaacgtgttcttgcattgttttaactgcgtgacttcgggtttctgttcgaatgccatggccgaagacattatggtgggttaattcacaatcagtggcaaaagcggagattttagacccatttaaatttaggagttttttaaaaaagaattggacgaacattctctgaaaacattggagcggcctcttcgtcaagccgtcgaatccattaaagtcaaagagagtttgctgaagaataacgtgcccgatttggacaaatatttgcagaacgtgggatattaattatgtggccaggcaaacattaagaaatattnaatatgtnggcttggtaaatattacatttaccttttcgtgaggtgacattatatgcaattgttcttcctgttatataaattctgttaaccatttgttttatgtttgatttaaatttaatgacataaattttaaaaccgaaaacattgattgcattgggggggaagtcaatggtaatgatggcaaaagtgcagttttgtggttttgcgaaaaatataaacatttaaaaaccaaattttctatgagaaaagatgtacttcactaccctgagctcattgtcggatgaccattttttgatgttgcaatgatttttgactaatagctaaggtgcagaattgtggtctcaatgggaaaaaattgtaaaattttaaaaagcctttccgggttggataatgtcgtggtctataagtcggggctgaaccctactttcagcaattcccttattatttttcagatgaatgaatgaataagcaagtggttcctattctcttctttcacttttaattaaattttcctgttcgggcctttgcataacatttggggcatcagaatatcagaaaaggtcaaaatcattcattggaatttcatcttactaattgggtagttcgggtgggtaaaggatagaaggaagtggcaatagtagtctatagtaagaaaatatatgctgtatggagtggtgagggtcatagattttgcaaaatcattgattttatctatgatttttcatcaagtaattgattttttccaaaatttaaaaaaaattaaacgagcgtaaaaactcatgcacagatgttgtagagtattgcgtattattatccggttaacaattgacattgtatgtcattattaaataaatgtgcgcaaataaagcacgaacggtcattggctgtcataaaaaataatccgcagccaagcggatttgaaccccagacccgtttcatatgacccctaagggccagtaattaaatttcaaaaaatcatataaaactttaaatttgccttctccataaatttaatagttcattcgaaagctctttttaaacgctacaacatctgcgcatgagtttttacgctcgtttaattttttttaaattttggaaaaaatcaattacttgatgaaaaatcatagataaaatcaatgattttgcaaaatctgagctcagattcgtaatcagcacattttttcaccctagaaaaaactaaaaaaaaatttttaaattaatttttcgtcgggaccgcaattctgaaggattacccggaattccgtgccatccctggtctcatggtattatagttgtcctaataactaagagaaaaactattttttttttgtcaggtattcagtaaagtttttaactataaatttcgttgttaaacctaaggttatcatgacaactatacacaggcaactcgaacaatggcttattgttagactagacctaagcttaggcttttgtaaatttttttcttatattagttgaatttctgttgacatcattaagtgtgcttagagttgcttttgcacatttcgatgatcaaagtatacaaacaagaacaattagactattcggaaggtataatgtttccgattgacagttcgaaaaacattttttgacgcgtaaaatatgatgggacgcgtaaagtgttgttgggacgcgtaaaatgtgatgggacgcgtaaaatgtgatgggacgcgtaaaaccgactagaaccaaaaaatatgctgatcacgaatcttaactctgatttgaaaaatcattgattttatctatgacttttcatcaagctcttgattttttaaaaattttaattttctttttaagtattttctttccaatgagtttaaggtaaaaaataagaacccatgagtgctctatttacacaaaaaatcccattccgaaatcccagggacacatggtcatctccctttgttagcgcacccatacttttttttttgttaaaaggcataaaaaacaagtttccggggctttttggggtcgctgatcacgaatctgacatccatttcgaccatttcaaacccctaacccgaattcgaacaaaggtcgaaaattcaaaactttcacatttctcatttttagactctaaaattgataaactgctaataaaatacaacaatccataaattctacaaagttaaagacgtaatatatataaaataaagtaaagttcaacacaatcaaatacagcaaagtcccaaaatatgcaaattttttaaaattggcgtaataatcttgtgatagacaagcagatggtagtgtgtatgaatgttttctttgtgatgtgaagtttttgggctggtatcgttttggcgccgccgttttggcgccagccaaagttttcggactataacttttttatttgttaaccaaatccaataatcttggtatcattcgaaagcttaacatgattagaagatatttctaagctattgcttctggattagacaattaccaaaaaagctagaacatgaagtagtcaaacagtcgaaaattttgaggttttttcctaataacttttttagaagctaaaatttttgtttgttttttgtaaggctaatagagcttgtgaatggctttcgaatgataccaagattgttagatttagtca

SEQ ID NO: 2371 - DNA, 1445 bp, Heterodera glycines
  misc_feature (36)..(36): n is a, c, g, or t
  misc_feature (107)..(107): n is a, c, g, or t
  misc_feature (153)..(153): n is a, c, g, or t
ggacaaattgaataaaagctatttgaggtcgactgnatcttgaagtaaatggcacgcgtttgacgatttgtgaccgtcaaagaaacggagccgatgcgtccgacgtnttcttcaacgaaagagttttttgaaaggattaaaaagaacaccttngaaaacaagcacgtttctcggggtcgactcgaacaatggcattggtgccgtcccattggaaatgccagaatttgctccattggaaatgctcgactaaatttataaacaattagaaacagacataagtaatcccattgcatttacagatgaatttctttgaagcacctgttgtacagattggcattggtgatgagcttgaatagccacgggttgatcattgttgttactgtcagactgaagaaggaaaatatgtcttaaaagtaaattaatcacaattacagtgaccccatcagtgtcaagattgtaacgagaagcaaatttaagcgccaattccgtgtttttatggtgtttcaatatgaacggaataattgctgacttatcaagaccgacactaatgacctgaatttggtaagtcattaaatataataaattcgtagtcatttttagatttaaaattgcctattatgattgtaaatgtttatatgcatttccgttttgaaatgggacggacctttcccgacccatcgatgcagagcacttcgtcagcctctttcagttctgtcgacaaaagcacggctttgtccgaaatgcgcgtgttgcaaacttttgtaccagtttcgatgtcgaacaaatgaacatacccaagtttggtgaacaaatacaaaagaccagatttggaaggctagaggaaaataatttaaatgggacaaataatttacataaatttccatttatcagatatattttagttctttacctgaattgcgacaggaaaatcgtccgtttcatcggtgtggaaatggaagttgtcagtcttcgactgatagggttgattacccttttgcgtttccgaaagttggactatgtgcaactgatttatgttcactcagcaatttaatatttgcgagttttaaatttgaaagtccaacttttccaacgccatttttgctgcgcaccgcgtaacagaaaaggctgatgggtttcgaattgttctccgctttgaattgggtaaagcacgcggtgtgcccttcaaacagttgcgattttttgctttcattgttgtacaattgtatcgagccaatgacctgttgctcctaaaacatttaatactaaaaatactaatataaaaacaattatttagtcaaccaaaagtacctttgccgaaattccaacaagaaaatggaatttgccttggaaatcagaacggtaattgacaattggctggttgctcaatgtgaaatgtctttcaaaagctttgaatgggtctttgtagccttaaataaacttgttta

SEQ ID NO: 2372 - DNA, 5003 bp, Heterodera glycines
  misc_feature (126)..(126): n is a, c, g, or t
  misc_feature (150)..(150): n is a, c, g, or t
  misc_feature (180)..(180): n is a, c, g, or t
  misc_feature (184)..(184): n is a, c, g, or t
gggggacagggagagagagacggccctttggagagagagaggagggaacgcgggagacagagaaagagggagacagagacggggagaggaggggaaacgacgcaccaaggggggaacagaacacanccccaggcgaagccgccccccaanacacaacccacaccgaaggaaggcggcgcnccanccgcaggacacggcggacgcaagcaagagcgccgcagccccgcacggcccacggagcaaaaacacgaacacatacggcaagggccaaacacccaaagcaccgacaacacaccgaaggcgcagcacactgtaacaaatcattcactgcggcacaaacgcgcggacccgcgtccgttcccagcaaatcgacaagatgaaaactgctgagacacgggcggatcgaggcggactccgtgacattgagcagacacgtgccgaaacggcgctggtctctgctggtgatctgtgaagaaaaaagatggataagaaagaaaatgggagagggagagagagaaacagagagagagagagagagagagagagtgaagcgaagaaaaatcgattcattggcttaaaaagggagcagatcaagggtaatctgagtcattgatcagcaggacagaaagggagcccccaatgatcttgctgacctcacgctcgcagaccgtgtcgtacagagttagtgcggcccctgcggccggctcgggtcggcatttcagtgcctgaatgatgaatcagttgagtgaggcactctacggatcacctccatgcatggcttaaacatcttttggacactgtgacagaatccgtcccattccgattggttgctgatcagtgccaacggacgcggacggaaatgatcgacgtgcgactcgcactccaaataagcgaccaattcctgctcggcacagccggtggagtgttcgatggccaaagagggcatttccaattggcacccgttgccgggaatgatctgagagaattgcaggcagtgagaaaagcgtccaaaaaagcatggcacaccctgggccaaatattcgttgctggcactgaacataaattcaagcgaatcggtgccgcactcggaaaaaacggccggggcaaggcactgaagcgagtaatgttggtactttacaatgaattgtcatttattatttgcctgggtggtgtcgttggccatggcacaaagtgtgccggcgtcgtgctcccccagcgcgtccttttcgagcagttcgtcgacgaccgttccgttttttccactgcttttgttctgcgcttcgcattttcttcccgccacaccctccgtcaccgcctcaacgcaacgcgagagctgtgaaaattccgcgcgtgccgaacaaatggccgtgccgagggcgcggagtgcacgcgcgcggccgtacggttcgtccgcgtcgcagggcgccgtgcgacgcatacactgcgacaaagcagcgaaatcagcggcacagaaggcatccgatgaagggatggacgaagaagcattggacgaattggagatgaggcgcagcagcgaaacggggcggaaagtgtacttggccaaaaggaagtcgcgttgacagccgaggcgaatttgcctggagagggaaatcattggctaattaatggccaattaatggaagagggaaatcatcggctaattaatggaagagggaaatcatcggctaattatggccaattaatggaagagggaaatcatcggctaattatggccaattaatggaagagtgaaattaaatcatcggccaattatggccaattaatggcacttggaaatattgcaaaatggctatgtattcaatcattaaatttctccaagaaccgacttcatctccgctgtgcatgtcgttggcgcaaggagtgccggagatgccattttcccttcctttaaccaatgattttccattgccattctcttccgccctttttcctccgcccaccgattgttccgtcgcttttggcccattcactgggcaaatattgtcctttgaggccaacacgtgcaacacattcaacggaatgggtccgcacgtgcgctggacaatttcgtggacacaatcgacgaattggggcagtgcttggcgaagggaggccaagctgaactgcttgatgggcacgagagtggtgcgcaggcatttgccgaactcaggatcagacacctgaacagacagacagtgctttgctgcttcgtcttttctgctcacttgtttgaacacgcagcccaagtgcgtgtcgatggcttgcgttgcgtccggctgatcgcaaatgccggcgccggctgccacgagacaacttgagacaacgcaacgattggattcattgtcagcagcggaggaggacgacaacaaagacagacactgacggaactcggcaccaagcatacaccctgaggagaagggggaggaggaaatgatcaaaaagggagggattgagtgggagggaaggaaagggaagagggatggataccaacggacgggaagggaagaaaaagggaaaataaggaagacgggggacgcaccttgagcaaaaagaggtgccaatccgttcagattcttcagcacattttggagaccgccctcgaacagttcgcccaactgcgcgtgcagcgcttcgagcggcgcagcacagtgacggaccaactgcttctgctcatcggagcagttcaaagcggcaatagctgaacaattatttttggcattccgtctgccctttcgcttttacttacgtccctttcttccgctctccatccccacttcgatgttttgctcctctttatcgctctgtcctgcgttttctctcatttctaccttttctctcatttcccctttgtctctctgtccaccgttatctctctcttcttctcgtcgtccccccatcagtgcgcaatttgggtccaccgcttttgcaaataccgccacatattcgtgcacaaattgcactgctttctcgccacatcgttcactgagttctggcacggcacagctcaaaagagtgcgcgcggatggacacgcgtctttgggggcgccgtgggaaaaggcgacgacgcattcctaaaaagtgccgggggataaaagcaaatggaaattcgggggggggggggatatcagtggaaaatagcaaaagaatttctaagggaaaagacagtgaatggaaatgaaaatgaccttcatattcggtcgcgcgatgttgcgacggatgcattggcgtaccttaaaaacaaagtgaacaatggcaattcgcatcgtttggccattaattgccaaatttgccacatttgtcagcttttgatccggcaaaagtgttttttacttccgagtaaagcgcgctgccccgtgggccacaggcgaagtcgaacatggcggacattccgcgagcccacaggggaaagcattgggcacgaagacggcactcggagaagttgcgaaatgcttggcaagcttggtcgatcagcttcggctgtttaatgacggccaaagggtgctgagggggggggggggggaaatgccatgccaatccacggggaattggccaatcaatgcttacgggctgaaaggcggtcaacggctgcacgcactcgttgaacagttgctgctgttgctcgtcgcattggttgtccttcggcgtcagtgcgtccgccgttggcaaaggacgcgcttggggcgcggttggcccgcggagtgtcagaagaggcgccgcccccactggcggacggccggcggggaggacgcggcgggagagaagctcttccaaattggacggctcctcggcgggacagccctcctcacggcccagggattccaactgagaaacggcacaaaacgatggcacaaaagggggagggaggagaagcagaaaaggagagcccggcaaaatgtaaacgcatggagggaaaagggtgtggagtgggggacattgccaatgtaaaatcccggaagggcggtgcatccaaattcatttacgcctaattaactcaattagctatccccttcctcgcctataaaactcaccgtccattgcatttcagtcaaatgttcgtccattttttttgccgtttccgtctcttttgcgcatcgttcgcgcattgtctgctgtccgcaacggaatgcagaacgaagagaataaaacgctttgcacatgtgcgcttggccatgtacgccctgaagcattgcgctgaaattgggggaaatgacctcggcgcaatggaatattcccatcatttggcggcgatagtccgccaataattcatcaaaaaatattcacccgactgcgcggccgaccgcttccattggcgcgtgacagtgcgccaacggagagttgagacaggcggaggagcggtcgagcagaaggcgggagcgagacgagcacagcggcgagagtccaattctgttcgggaatgaggcgttagaaggcgacgcgcattaagcggggagtacctggcgagtgcgttgagcggagagttcagcgagcagcgagcgccccgcggccctttcccggcgctgaacactctctcagccaaacactgctcgtaacgggagaacacttcgcaaacggatgcctaagtgattagcaattgcaaaaaacattcattcgaaggcatttaccagcgttgcgttgtccgcgattagcaactgcaacgacccgagtctctggaggcgtccgttcagttcggccaactccaccagacagaccagcgacgactcctcctgaaagcggcacatttgacaccaatttgacattttgtcggcacctgttccgaggagcacttcggatgcacggggttaagcggaaattcgtcgtgcgtttcctccgtcaggacattcgctggcgccgcttcctgcgactgtcgctgggcgaagcattgccgcgcgatggcctcgtcgttcagctgttcctgcaataccaatggtcagtccctccccgcctcttctgctgctctcgccctttttcacctgaatgcccaccaccgcttcttccacttccgc

SEQ ID NO: 2373 - DNA, 1632 bp, Heterodera glycines
  misc_feature (210)..(210): n is a, c, g, or t
  misc_feature (215)..(215): n is a, c, g, or t
  misc_feature (1502)..(1502): n is a, c, g, or t
  misc_feature (1507)..(1507): n is a, c, g, or t
  misc_feature (1526)..(1526): n is a, c, g, or t
  misc_feature (1562)..(1562): n is a, c, g, or t
tttttgttttaaaagtcgcgaaaaatgttttctggggctttttgggtcgctgattatgttccttgaactccccagggggctgaaccccaaaaaattaattgttaagctacttttcgagttattagagcctatcttctaggttttttatttttggagcctaaaaaacttaaaattttgaaaaaaatatttttgactatttttggcgtttgncccanaattattaacaaaaatgcaataaaaatgaaaaataaattttgtcattttacactccgaaatttagattttttagagcctattttccatttttagtgcccatttttggggttttttagcgcctaagcctagcggttttagagcctaaaattggatccctaattatggccattttggccaattcggaatcatcggacccgaactcgaacaagaagtataaattaaattttcgaatttcgccttttgttctaaaaaataactttaaacttggctgggctgtacatactaatttaatttttaaaaatttattaaggtatataatatttatgtaaatgccgatctgaaattgaggctataacactaaaatggattcatacgaagttgagagaacaacgacatcaccagtcgagctaagacatcattttcacattccttctgcattgactgcaaacggcggcgataaatctgaggttaataatcagagcattagaaatttattcggaagttttcaaggctgttcgtttttcactaacacagaaaaaacacaaaagtcggctgaatgagcacacgaatttgacatcattcattccatcgcccggcacttatgtcaatgctgcgtttgaactcgacttggcagaaattccgcatcaaaccaataattcaagagagaactcgtggcaagaagatgacggactcgtttacgcaaatttgtcagaaattacacgacggaaggtctcggcgaaacgattgtaaaatttaattgttatttctctttccaggaaatcgaggagatcgatcgtcagccctttccaccttatcccgatgcatctgcacagcctatgtgagttttggaaaagcaaaattaaaaaaccaatgaaaatttagacggataagtaccaatggttggcgcgaatacagaacattgggaggaaggtgaatttttgaaggatgaatttaaaaaagaccttccttcaggacatattactttcatccggaacaaggcatttgccagtggaaagtttgttcctctctttcgcttttcattgtttatttgttgggtttagccaccaagaagtacggacaattacaaacttggcagaagcagtgcaactaacaaccaacaccacgattgtgtgccttccacttccactgacattgcatcgaccgcattcttcgcggaaattccattgcaccaggaaatgagaaaatccgacaatgaagccacactgaacgaggtcgaaattgaggcgaatgaacagcacaaaaaggcaaataaggttgtcctttanattanagcgttaattgtaagtaanataatactatttatctgttaacaaccctctccatanatatgtaaatgaactgtttctgaaattcagagcataatgtcgcacagtcttgacagcgggatcaaccata

SEQ ID NO: 2374 - DNA, 3470 bp, Heterodera glycines
acagtgccactaacaacaccatttccctggtgcatgagcagcaccaacaaacggcagcaccacagccaccattggacagcgacggagcacattacgacaccccagcgaacatcgcagccgcgcaacagcacagggagacggcgattcgccacggccttttggagaagtgcaaattggcggagaacggagtgcgagtgaaacggagggattgggcaaattcttacgcttatttgttcgttggccatcttctcttttacaaagaccaaaaatcggcagaggtactgaattttcgctgttgatttgtttgaacatccattttttattgatttattttcagaggaccggcaaacactacccacctccaacaggtagttttgatggtgattccactttatttttagttcaaatttttagatgtatgcgatctccgaaatgcctcagtttgctacacggacaacgaaaagcaaaaggacaagcggagaaaacatgtcatttcggtgtgtcataataccattctttttatcctttcatatccctcataatccgtcttatttttccacttaagctcatccttctcactaagactgagtaccttttttgctgtgccggggaggaaattggcgcgtggtttcaggcgattcgtcaggcgatcacttcgacggtccgtcccttgccactgtcttgtccattgtttttcgttgctttagcccatccacaaatttccgcccagtacagtaatcagcgattactgtgggagtctgtcacgtgcttcgctgcgcaacaaacgcgactcgggtccattcgcttccaaaaccaattttcacaactctatcaaatttcgactcaaatcatcttcgacaagcaaaggtatttaaactttttttgtttttttcaagaaacagaattcgcatttgatagctctgtccgaagaccgttcttccgtcattgagggcagtaccgtggagagcaatccgccgacgaaggagtccataattgagaagcttctccgcttcttccgctctcgtccttccatggaatccctgcgagagcgtggaatttacaaacgtaaagtttattattgcgttttttaatttctgccattttctttttgtttagcggagcccgtctttggcagcactctcgcggatatttgcacacgggagaaagcatttgttcccaaattcatctgcgaagtgactcggcttattgaacagaaagggcttgagtccgatgggctttaccgcgtcaacggaaatttgtcggccgtccaaagaatccgatgccaaattgaccaaggtggtgattacaattagtcgtgattttgacttttaatagattcctatgactctttgtatcacgaagaggacattcacgtgctcaccggggctcttaaattatttcttcgtgagctgtccgaaccaacttttcccgtttcaatgcacaaagattttatgtccgccatgagtgagcatttctaataaaaatgcaatattagggccgtgtctttaactaaacaggggaaacgggcattaaaaggctgcgtataatcgacgatttgctcatccgtttgccgcatatcaatcgcgaaactctcagagtgctcatccaacacttgaacaagtttgtttcctttttaaaaactttcattacccatttgttttaagcgttgcgactcattcgggcaaaaatcggatgcaaattcacaatttggccataatttttggaccatccttgttttgttccgaggaaaggccgaaccatcaacgcaaggccagccaagacaaagggaagagcgggcgacgcaaatcatccgacaaacggtcacagaacgaagaccaagtgcagacagagccaacacagaacttggcctaccgaatgattgtctatggacagattgttgaattcattcttaacgagacggacaggtaattcaaatggaaatggtgccgaaaatccgaaatttgtttcgaactttcgccttttagacttgctatcttcaggccctctctgtagctgccgtctccaacttcggcttggcatttgcttatcacaggcattcaatcaatgtgattacagtaaatagttgctttttgcacactttcgttctttcatcgttcgcattcattttcctattcgttcattcatttgtcatcgtttttactgaacccatttccggctcaacaaattactgatccgtttttctcattaattatgtgagttcatccattttcctgcttcactataattatctctaccgctttccacggccaaactccaaatgttttgcatctctttgtgtgtagtatttcatgtgtattttttctattgttaatgaagattttttaaataatattagtaaaaacagacggggaatttcatttacggtttaattgaatatcaacatgtcctattccattttatattatttaatgatggggaataattgctttttgagaatgttcctccgatggatgaatttctgactttcggccggtcaattgctgacccatggaggagagtgggctgcctggcggagcccgtccttttggtcgtcgaattctgtcaagttcaagggcccaggtgtgttgacaagggtatttcgttttcatgtgaaaaaatgcttttcctacatttatgtcccaacaggccgctttactggttccccgatgatgggactgtccctatgcatttgcttgaagaaattgccggttggttaaacccattttactgccttaaaccgtactccagtttggcttatgagttcggagaacgtgcatgcgaatttgtgctgcatgttcaaccagcaactcgccgtccatctgcttgttcagtacagcacaatgttggacatcaccgccagggcttttcaggtcgacccttttaaggccttggcccttcgcacggattgcatttcattttattttagcgtcctttcgccattgcttttctgatgccttctcaacccactgcaaaaaatgtcgaagcgttccaacaagcggcggctgaactgcttatgccaatcatcgcctgcaacaaacgttacgtccattcgattttgcgtcaagcgatgctaatgctttcggaacgggaccagcagaatgtgcagtcatactattccacttcagggaacgcacagcaaattgtgatcgtgtcgaacaaactcaagtccgtggttcaaaaggtaatcaaccgacaattcattcgcaaaaatcttggttcaatatttcatttgcagacaaatgcgtggtttgagcgtgtttcagaccaattgtgtgaaagtgacgggtcggcggatgaatgcttttgcgaatgcgctggccccgaagagtttcgccggttcgttgttttgcttgcgcagaaacactcgtcctgtgcgcttctgaatctcatggaattggcgccttgcgtgggttggcctgggaaaagccttgtttcatggatgagtggtttatattcctttattcactctc

SEQ ID NO: 2375 - DNA, 1703 bp, Heterodera glycines
  misc_feature (1677)..(1677): n is a, c, g, or t
cccattttaactttttaatgtctgttgtttttaaggagcacttttggggcaaattctgaacttccaaggcatgcaaatgaggagctcaacagaacagaggaagaatatattcctattgtcgtggccagagaaagcactcttaaaacactttcatatcgtctattacgggtacaatttatttttccagagtgattctgaggaaattgaaccctgaaatcttaaaaatacgcagaaaaaaacccttattaatattaagtgtgtctatcctttgctgactggtgaacgaatagtaattttggcgtcaaaacagcgcgtttcaaccggggttgaccttctcaacaagttgaactcaatgcgaatttgtcgaaggccagagggcgtaaaatggaatttcgattctgacatcgagtacttccttcgactgcttctcccttttaattttacttttttagcactgaatcaaataccatgtccgacaacaacacacattgtcaattgtttggtatttctcgtgaggcgaacgcgacttcgcagtggattaatggcgagaagtgcgaacattgtactgtcgttgacttgggcaaccaaaaaatgcgggcccatgaatactcgggccgtttgcttgcccaattgcatggcaagcgcaacttcccatcagactctgctgttgcggccttcgttgtatccgttatcactgatttaaatcagctgttggtgctggcgcattacgtcaccccggaggctgtcttcaaacacctaagcctgtccatctccgatcagctgattctcttaaatggtctggccgaattcaacgtcaccaaatattccgtaagaatttcttaaaaggaactatctatcaatattatataatttagcaaatgaataagaagaaattcgatagacaaaagtgcataccatataaaaagatgaaattttgatcaaattgtttattgtataaatttatattatctaataaataaataatttttaatagaaaaacaaaattttagagttatcttttttcaaaagaacataggataacatttatgtcgacatttgtttttttatgaaatttatacgtcggctccaaattccatttgagctcagcaacacattccattccgttcacagtgtcccagtttttggccattttagtgaggaaatttcgagttgtgcttttatgcaaggagaataattttcctcctggcctaagcatacgtaacccggcgagtacaaaagcgacatcggtgcctgaaaagccgtaaattcacaaaggtgaaataatcttacaaaattcacaccctgattgttttttgtaccgaatggtgggtttgtcaggacaacatcaaattttccaatgaatggtacaaattttgtaacatcagccaaaacgagatttgtagttgtcgatccttcgaattcaaatttatcgatattattttttgcaactgacagagcattctgacaacaatcgacgccaacagcaaacctttaaaataaatttccttagttaaaaaaattttacgaaaatccactttgctccgagtaaagtacttccgagaagaagcattcccgtgccacagcccaagtcagccacggcacattcatccaagctgattaagtcattaacgtgttgaagcagcgcaactacagataaaatatacgcaatataaccgnaaaaattttgtaaaaaaagattaaaa

SEQ ID NO: 2376 - DNA, 2817 bp, Heterodera glycines
aaataaaagaaaataattacactgctcgtactcctgcccaattcatctgcatattcttttccaccggacaatttccagacattgatattgacccattagctaatagtcagcacgagcgcatgtcatttatagtggcgaagcgatgattagcacaatccgattccgttgggttccttttttaattcaaatatacttaaccgacagaaagaacaaaaaatacttaaaagtagagccaagcttatccggatgaaaggccaagcagaaccgataaaaggcgctcttcatctccagttgagtttggtcaggaacgaccgttgttcaactgttaacgttgttgaaagagcaatgaggccaggctgggcggcgtttgcgtaaggctcacgtgtgaccaccttgcaggggcacttttgtggtcatacggagcagctgcgtgtcagcattggtctggtgtggccccttcctgcggcagttcatgtagtacaggaatacctaacacacgataaaagttctcatcttcgtccatttcttgagcatctgacccttcattttgctctataatttgctcttaaagtgcatcaagtgcagaagttaattcccaagtggcacggtttaatgcatcaagcacctcattgtttgccgccattaatcctgcggatttttgggcctgtaacatagttacaacttggagaagagttctaatgtttgcagccatattttccatttaaataaataatttgctaaaacattaacttagaagtgctctatctaccataaaatgcattccgaaatatcacggacacttggccagtcaatttttgaaaaattcataaaatatttgaatgatgatatacactcaaatttttaaaaaaagatttatgaaacaattctttataaaaaagcttcataaaaaaaattaaaataattgaaaaaatgctagatggaataaaaattttaataatccataaaaatcatcatttttcaaacggatccaaacccataacaaaatgattagtaaagtttaatttgaagaaagtctatgcattccatcagcttccacaagaaccaaagatgacccagctcatgcagggtggtgcgggcttggtaagtcgccccgttcgtttgcctctttccatgctttcgacaagcctctcgtacttgcgtcttcggcttgcggcccgacatttgcggttatgtccaaaatagggttcaaaattaagttttttcaatccctgatcgcctaatcagctttaaataagtgattgtatcagatcatttgatcgttaatgaatttttgaaaaaaattttttaaacaacagaatgaatgttcttgataaactagaagacagttttttcttaattttagtgctgtttaagctatcagggcttccgcaaatgtcggggctcctttccaccacaccccaaccgaaaatttttcaaaaaaaaatcataccctaagcaactgtttgcggtgttttttcagtgttttttggcctttttcagtgccgtgttgatgtagccttgttggagcagcgcgtaattttccggcgtgcggcgcattcgtgcccatctggggctcgtttcggtcagctgaataaaaaaatttttttttgcgttcaaaatttttttgtttaaagggagggatccggctgtagcacgagagacgaggtgctcctgcccaccccgccccctctctcctcgttcgtcgtagggggccggtttaaaagaggggagagtcaccggtgaagaggggggggggaagtacacaaaagcagcgacaacactcttttcaccgctcactctcatcgtctctcttcctctcattttcaaacaatctttttctttctctccctctttatctcatcttctctctatttgatgttctctttcgttcccctcccttctgccctggcatagcttaagccgtgagggcacggctttcccaggtgtgggggaatgttatgtcttcccttttgtcttgacttcttttcccctatgtctctcacaatttctttttctctgtcgccagtcatcccaatttctgtttgttggcctttttctgtcttggcacccgacccgcccacctgttacccgtataaaatttgaggggagagatcggagtgatcagtctgttgggatttgcgatcggggatctgatcaattgttgccttcttaactttttcctcacattttcattcaacgcaaaataaaccaattgttaattgataacagccttcaattggggaatccgcgctttgggccaatgcccctggcattggcccagggcccaacggattcatgcgcgcacccattttacctctcttttcgaaaagaaaagctattagcaagcgtgtttggaccaattctaaaacaaatcggggtaattaatttaatctgagataaatgggaatttaagcgaaggattcatgcaaaataataatctatagaaattctctaaaaagtagttcctcgcagattcggggaccgtttctataaagctagagacatatgcgctaaccataaaaaagatgaatcattttttgaaaaattatatagttcgactaaatttgcaaatcgatttatggtgtacaggatgtttgtcgaaaaataactcgtcaggcctttaagatagacctgccattgctattcatgcaaatatgcagtctagtcagcccaatcgattgctattcgaatggtttggggtcgttggcccaaacaaaagttgtgctacttcttgcaaagaagacttagccaactgtaaacagcaagccatccaaatgcttcaatgtaaaaaaaaattacatttggatgcaaccttta

SEQ ID NO: 2377 - DNA, 5748 bp, Heterodera glycines
acatttgcgcctcaatccaaaatagggttcaaaattaagttttttcaatccctgatcgcctaatcagctttaaataagcgattgaaagtgattgtatcagatcatttgatcgtaatgaatttttgaaaaaataataaaaattttcaaacaacaattaatgttcttcataaactagaagacagttttttcttaattttagtgctgtttaagctatcagggcttgaaaaaatgcaactttgaatccaattttggacataaccgaaaaagtcgggcaccaaatggcggggctcctttccaccacaccccagccgaaaatttttcaaaaaaaaatcataccttcagcaactgtttgcggtgtttttttagtttttttcagtgccttgccgatgtagccttttcggagcagctcgtaattttccggcgttcggcgcattcgtgcccatctggggctcgtatcggctagctgaataaaaatttttgttttttgcgttcaaaatttttttgtttaaaaggagggatccggctgtagcacgagagacgaggtgctcctgcccacccccgccccctccctcctcgttcgtcgtagggggccggtttaaaagaggggggagtcgccggtgaagaggggggggggaagtagcaaaatttaacagattcaccaaaaaatggtgattttttcaatttcgaaaaaaatgcatgcatttttaaggaaaatttcagcaaaaaattctaattcagtgataaaccttcgcggccaatcgcttccagtcatccctgtccgtgccatcggccacgcatttcgaaaagaaaaccaattccaccgtcttgccaccgatgcacatgaggatttggctttgagttgtctgcgtgtgtagctgggcgcttcggtgtactgcaccgatccttcatttccatcagcgtcttttacaatggtaatctgtttaattataataattaatcctcaaaaaataaatccactttttttgaaatcccaactttataaatgtgtctatgcattccatcagcttccacaagaaccatggtctgcgaagagcagcagcgatccggaacgcggctccggaggacagcaggctgcggtaagtgtcctttgctcatgcagcgcctcgtcgaccgacctgcaccacaggaacggcagcggatgatggcagacgcaatggccctgctccagctgcagccaacaacatcggctcagcagcagccagaaacaccggctgcgtggcagcaaccccagctccgtgtcaacaccacatggagctggtcgatggagctgccgccagaaacgcagccgccagcctcgccactccacttggacatggagccgctcgcgcacagcacgccactgcgcaactgccaaagcggacacaccccactgctcaatcatgccagcaaattgcatcatggcatcctgctaaaaattctagaattttattacgaattcaattaaatttcaaaatttggaaaaaatcgtcacgggttttaaattcaaaaaaaatagctaccaaaaaagtaacaaaattcttcaatattaccaaaatataaaatcattttatttttttaatttttttagcatcaatatatcccgacaattttcgataaaatttgcactttaagtcaaaagactgactaaaaattctgttctcctctcctccacacccctccaatcgttttaccacctccaattgtttattctgcccaacagtcaacatttccccgtcccaccatttttcataaaaagaaattggtgtctcgattgacaaacaaacaaaacacattataatgttgtgtatggaaaatatggctgcaaacactagaactcttctccaagttgtaactatgttacaggcccaaaaatccgcaggattaatggcggcaaacaatgaggtgcttgatgcattaaaccatgccacttgggaattacgttctgcacttgatgcacttaaagagcaaattatagcgcaaaataaagggtcagatgctcaagaaatggacgaagatgagaacctgccacaaataaattatgaaaaccaaccacaccctctcgatgaattatcccacggtcatttgccgaccctcttttgtgagaaacaaacattttattctaaaacaaaatttatttacgtaaatgaaatatgtggaaaagtatgcatataaacattttgatcataaatttcagtaataataaataaaaatacaataaattaagtttaaaatcaaaacatagccaccactgatcgcatgtaagagcacaaattgcagtcaaagatgccctattccgacatggtcaatctgttttaaaaggacaaataacatgcgtcagatttttaaaccgagtacgttttcatcatcaaacggacttgtcgtcagaatattataaattttaaagaattttatggcaattgacatagacaccaaaaggacaaattaatttcatgtatagtggtattggatcccataaattgacccaacttacaacaaaattaagcctttaattattaaattcttatcccatgcacgagtttacacggggaataattcaaacacttagcccgtgtgtttggaagatactggtatctaagtgtgacataattgttaaaaccagtgccatacgggcattgaaaataaagaattttaattattcttaattggaatttcacccatatttttatatatactaacaaaaatgtatcttacagacgaaagctttatgttgttaaaaatgtcctatcgaaatccgctgtataaaaactttcgacagccataactatcaaacaaacattacataaaatagttgtattaaataccgattaatggcccctgccaattcattcaaatgcgcttcagatttatcaaaaaattcaactgaccaaccgtcattggcatccatatctgagtagtgaaaataatattatgcaaaaaattacacaacatattgttaaatataaaggcgcttacataaaacatattccttccaaagatttctattgaaatcatcaagcggaaattccgctggtgcttctaattgatccattgaattaaagcatttatacattttactgattagcattaggcgttcggtggccaaacgttgttcagattgttcccttttttaaacattaaataatcacaatgcgcgataaaaagatagcgttccaaagtattcatgaagaccagaaaaccattgttccagttggaatgaaatcagacccttggccacggcccctgccccaaaaacactttcaaattctgctttatccatgtgacgaacaggcattatttcaaccgaaatttttatataactaaaattaaatagaaaaacttttttaattataaaaaactacaattatttaataggtgaaaaatgcaaaacaatataaaagacggaaaagcgagcaaagaactatcaaaatcaatacctcttcattctatcagagtatagttatcggtttatattttaacaaattttcaaattaaatgcttctcaagcaattataaaatgcaacaaaataagattcccatcaacgttaaaaaatccatagaacacacagagaataacaatgttaagaaccacaaaattgaaattgtttccatcaccaaacaccatgcccctgccaccgagcgtatagctaaaacaaggctcttctgccatgacataaagctctcaagagctacatggctaatctgttttaaaataaaaaaatcaataacaaaaataacaacggcatattcaaaaatactctttcgtggccgcttccaatgcttccagatgcgctttacgttcattagcaaaatcaatagaccatccatcgtaggcatccatatctgaattatattgaaaacatgcaaccccagacagcaaataaataaaagaaaataattacactgctcgtactcctgccaattcatctgcatattcttttccaccggacaatttccagacattgatattgacccattagctaatagccagcacgagcgcatgtcatttatagtggcgaagcgatggttagcacaatccgattccgttgggttccttttttaattcaaatatacttaaccgacagaaagaacaaaaaatacttaaaagtagagccaagcttatccggatgaaaggccaagcagaaccgataaaaggcgctcttcatctccagttgagtttggtcaggaacgaccgttgttcaactgttaacgttgttgaaagggcaatgaggccaggctgggcggcgtttgcgtaaggctcacgtgtgaccaccttgcaggggcacttttgtggtcatacggagcagctgcgtgtcagcattggtctggtgtggccccttcctgcggcagttcatgtagtacaggaataactaacacacgataaaagttctcatcttcgtccatttcttgagcatctgacccttcattttgcgctataatttgctcttaaagtgcatcaagtgcagaacgtaattcccaattggcacgatttaatgcatcaagcacctcattgtttgccgccattaatcctgcggatttttgggcctgtaacatagttacaacttggagaagagttctaatgtttgcagccatattttccatttaaataaataatttgctaaaacattaacttagaagtgctctatctaccataaaatgcattccgaaatatcacggacacttggccagtcaatttttgaaaaattcataaaatatttgaatgatgatagacactcaaattttttaaaaaagatttatgaaacaattctttataaaaaagcttcataaaaaaaattaaaataattgaaaaaatgctagatggaataaaaattttaataatccataaaaatcatcatttgtcaaacggatccaaacccataacaaaatgattagtaaagtttaatttgaagaatgtctatgcattccatcagcttccacaagaaccaaagatgacccagctcatgcagggtggtgcgggcttggtaagtcgccccgttcgtttgcctctttccatgctttcgacaagcctctcgtacttacgtcttcggcttgcggcccgacatttgcggttatgtccaaaatagggttcaaaattaagttttttcaatccctgatcgcctaatcagctttaaataagtgactgtatcagatcatttgatcgttaatgaatttttgaaaaaaaattttcaaacaacagaatgaatgttcttgataaactagaagacagttttttcttaattttagtgctgtttaagctatcagggcttccgcaaatgtcggggctcctttccaccacaccccaaccgaaaatttttcaaaaaaaaatcataccctaagcaactgtgcggtgttttttcagtgttttttggcctttttcagtgccgtgttgatgtagccttgttggagcagcgcgtaattttccggcgtgcggcgcattcgtgcccatctggggctcgtttcggtcagctgaataaaaaaattttttttttgcgttcaaaatttttttgtttaaagggagggatccggctgtagcacgagagacgaggtgctcctgcccacccccgccccctctctcctcgttcgtcgtaaggggccggtttaaaagaggggagagtcaccggtgaagaggggggggggaagtacccaaaagcagcgaaaaaattcttttcaccggtcactctcctcggtctctcttcctctcattttaaaaaaatctttttctttctctccctctttaacctatcttctctc

SEQ ID NO: 2378 - DNA, 9958 bp, Heterodera glycines
  misc_feature (547)..(547): n is a, c, g, or t
  misc_feature (610)..(610): n is a, c, g, or t
  misc_feature (627)..(627): n is a, c, g, or t
gagtgaggcaacaaaggctcatcgacgcccattcgtgaggttattttagcaattttttcgtcgatgaaatcagcgagtctttagatgaaatgggcaaatttctcctcggacatttcattttcgtaaaccaaaaaacaaatggtcgccgatctcacgcgataagcgacctgaacgaaaaagaatttactatagaaaataaaatggtcaaaaacgaataaatatgaacccctatactacttacaagttcataagccgtaagtgacgggttttcagcatcagaatcacacagaaatactttcggaaagaaatgttcgctgagttcgccgtggtaatccatgagcattgacccatcgacaaagaagccataacgagcggattttatgctagccctggctaccaaattttagagggatttaccaattttagaagagaatttatgaaattataaattaatcaatttatttaccttctaaaggcgattgagggggatggagaaacttcgttttggactgccgaagggattaaagtatggatgacaaaacgacanaagagttggcttaaatgattaaacaagaataaaaaaaagaattaaaaacaaaccaaattcttnttttgcaaccgaaaatntgaacaagtctgaaaatccaaagtaaaaacaaatgaagaaaaagaaacccacctttcttgataaaagaacaagccttttttgatgcagtgaaattcattgatacaatttgcgacctgaacggattcaaactaaaaacaaaggttttcagacacaccaaacagtcgatttccagaaagttgacattgccaatggaaaggaaatccactccattgaagagatcgacaaggggaatcttaaacattcaaacgatgcattgtttaattagtttttcagtctgagatttattctcttttgaagtgaataattaattagtgaacttgccttattaactcgatacaaatgcaaaaaaggagtaaaaaatctgtccaatatttctttaaattcattcgattctgcacggaaacgatatgaaaaatatccataatgaagtttataggcattgtaagcattgaaaagcagggaattaatggtgggcaaatgcaaaaagtaatctttcgccgtacaattctttctaatggtgaaatcttattagtaattgaaaattaagtaaattacttgttgaacgaagcaccgataagaaactctccaccctccacaaccaaaacaacttctttggtatttgtggaagttaccttaagagttgggagcgcttttcacctcctccacactttttaaaaaggtaacatttataattattttgatcacatacgtatcgataatcaaaatcgtgttgagccgaaatgttgctttcgcagtctgtgtctccgacagaaattaaaacaaaaaataataacaaaaaaaatatataaaataacaaaatcaaaacaaaattctttttacacattttttggtcggggattagcccaattgtcccacttttcacataaataaatatttgttgctaatttagcccttgcccggccattttgtcgccgctttggtcctcgttcgtttccgttgcctttggccagcattccactgactcaggcccctttttcccttttctgccccccccttttttccctgtgtttaccacagtttgattaagagtctggtgctcttccgactgagacttttttcgggctaaacttgtaaaacaaacgggactaagtactgtaaagggacaaaaccgtcaatttactccttttttactcaaattttttcgctttatctttctttctctcaactatgtcggccataatccggcagcaactccgcgctcttttggccgccatttccgctgactcattacagggggccgattccgatttgttgcctaatgatcccacttccctggagcctatcagcctcgctgctgagaaactctcgcggaaattaagcaaggcccaagcccttctaaaggattggtctataatcctttcctctacgagtaaagaagtcagagagcaggaaaatactctatttgactccttttcggtgggagggcttactccgggtgaaatcctcgccgacggggatgaagtgctgataaagttggaagtaaaaatagatgggatccgggccatgacttcaagggccccaccctcccaatctccggcccctcccacccaaattcggccccaaattaatttgccatcactccaattaccggacctttgatggaaatgagactaattggccttctttttgggcggctttcgcccacaccattcacgataatatgtcgcttaccggctctcaaaagctcacttatctggtcggtcgtctccggggtagcgcccggaccttagtcgacgggttcgacctaactgatcataactacccgatcgttgttgacctcttaaagagtcggttcggggatgatgccaagcgagcggatcgacttcgcagtgagcttttccacctagcaaaacccacggcccattcctcatccctaagggctttttccgaaaatgtggacagaatttgccgtcaattggaaagtttgggcaccaatttagatgacaatccctttctaacggtagcaattaaagagaaattgcctacagaggttaaggcccaattgtttgacaaagaaatggaagctggggggaattggtcctcaaaacagtggagggaaaggttggcaaaggttgtaaggctgaaagaagccgtacatgccccctgggaaacttcccaaagcccggcccacccccaatttcccaagcctccgccgcgcacaactgaacccattcggcgcgcttttcccgtggttgccgaaacccgaaaaagaaatggcaaacccgactgctcactgtgtttaaaagatgggcacaggccatcaaattgtctgacttatcgcacagttgagcaacggaaggcgcgactaatcgcccaagggcgatgttgtttgtgcgctcgcgaaggccatcacacggacgcctgctcagtggcggccaattgcttccggtgcggggaacggcatcatgttttggtctgcccagggccagagagaacaccggcaaggggcagtaattcagtgccattgggcccccgttcccaaaatgaagcacagggcactcggagaagggacactttccctcaatttgcctctccaatcgccgcctcacaaagtgaccaggcggggtcccaacaaatctcatcggcagtcgccaaaaagggcaaatttcctccggcctctgagttaaaccccgaggggcggaaccgaccgacagcatatttaatgataaaggaaattccggttttcaacaataacgggccaaccccggtttcggccccaatcttttttgaccccgggtcccagcctggtttcattgctacagacctcgtttctcaggtcggccctagctgtgtgggaaacgaaaatatggccgtccagggttttattgggaattcaccaacagaaatggtcagattcgcttctccccggttttccgtgcgtcttaaaagaaaggacggcggatgggaaacagttgaactcaaccaaaccgataaaattgtcccacccgtggaattcctgagggaaatggaatggaatccgccggaggcgccaaaaatgggggtgtttacgaaggagcctaaaattctgttgggtgtaagggaattttggaaattctttttggggaaaagggagattctcccgggtttgttccgaatcgaaacggttttcggtcccatttttgggggagaggtggaccatttctttataaagtccctcccatctcccaccgtaagtctcccacttctctgtggagctacggtaaaggcagctaaaccggacgagttggtcaaacagctttggagtttggaagccatcggaatccgggaccctctggacccaaatgacgacgcattggcctcggctcttttcaatgattcagtgcaatttaaggggggcagatacgaagtgggttggccatggcgcccgggaggtagagacaggctgtctagcaatttttctttggctttttcccgtctgtcggctttatctcaaaggctcagggctaatcccgaattaagggaaaaataccaagcggtaattacggaccaaattgaacggggaataatcgaaccagcggttcggacaggggcaggtgagcatttcatcccgcatcatgcggtcataacccctaaaaagctgcgggttgtcttcgatgcttctgctcatgaaaagggaaaggcatcgttgaacgaattgcttcttccttgccctaatttagtcccggaactggcgggaattctgttgcgattccgggcctcggcgtaccccgtccttggggacatcgaaaaggcctttttggccgtcggtcttcgggaggaagaccgggaagtggccaagttcttgtggccaaaagacccttcccaacccctaaaccccgggaatttggaaatttaccgatttaagagaatcgcgttcggcatcaattcgtcgccttttttgctcgcctccgttcttcggcatcatttgtcatccctgggagaccccctggggatggctcgaaatttttacgtagataacttgttaatttgtagcgagacgcccagcgaagcggccgccgccattcaaactgacacattttttcggatgcgggtcctaattcctttgctgccgccgtttacctacgcgccgagcgtaacggtcgggccgaggtttccctcctttttgccaaatctcgcctacggcccaaaaaattcaaaaatgacggcctaaccatcccccgtttggaactgctgggattggtcgccgcaattcgggccaaaaattttgtggccgccaattttgacctgtcttttgagaaaataattttttgggcggattcccaaattgccctttcttggttggccagcaatgccccccaacccgtgtttatagccaatcggctggcagaaattaggagggagaaaaatgccatttttaaatacgtccggtcctgtgacaacccggcagatttgggcaccaggggagcatccccaaacgaactaagggatcttagtctttggcattctgggcctggttggctcaaagggcctgaacaaaaatggcccaatgaatttcgggagattgtttttccgccggatgtgccttctgaggaggaaaatggccatctcccagcgaccatcgcctcggtggtggagtcaccggcagacccgcccttactaaacccgcggcgttttaatagttggtccaaactgctaacaactagcacttttgtccttttcttcctaggcaaaattcttaaagccgaaagtcttaataagttgccatttctgcgtaaatttgagggggtagaaccattatcccggaaggccaaaaaggaggcaaaaaattggctcttaaaaagggagcagaacaaaattgctcaaggcgatggcactattttggatgctgacggaatggtccgcctcaaaacacggctcgcccactccgaccaatcaattgactttataaaccccataattcttcccagggattcgtgggtcactcgcttactcgttttggcattccacagctcattagctcatgctggggtggactttactctatctaaatttctgggtgaattttggtgtccgagagccaggcgtttggtaaaaaccgtactgcggggttgtgtcatttgtaaaaaagacaaggcagtaaaattcgccctcccgccaatgcctcccctcccctcggcacgcaccattcccagccccccattcactttcgtcggacttgactacttgggcccaactcttttcaaaacccctgaagggccaaaaaaggcatgggttttgcttctaacatgcctaagctgtcgagcggtgcacctggaaattgtggactctctcagcgcctctgactttatcgcggcattccgccgttttgtcgcccgtcggggcactccaaaaaggatatggtcggaccacgggacccaattagtcctggggaggcaacttttaatgatttattatgattttcctgtggaatggaagctcatccccccacagagcccctgggcagggggagtttacgaacggatggtaggacttgtgaaaaccgccttccgccggtgtttgggaagggcaaccccgggctggacacacttacaaacactaacatgtgaaattgaagcagtattaaataatcgcccaattacttttgtctcggatgagaaggatggaccgttaccccttcgccccgtagactttttgtcccctcattcacggaataccgtagtcgaaccggaggaaccggaccaaccatttctgccctcctccatcgaaaaattggctcacttatggtacattaccaatgagtctctgcgccaattttggcaaatgtggcggcgggagtatcttttgattttgaggggaagaaccaaggacactcatgcaggccctaggctttttgctcccggccccccgaaaattggggacgtggtcctcgtggaacaagaagaatttccacgaaaccattggccattgggccgaattctcgccctttttcctccagaaaggccccgcagtgcaaaggtgctgatgggaagtggaagagaatgggagcgtcccatcaatcaattagtgcctctggagggcacagcagaatgggcacaggcacccgaccaggaccccctccccgtaagcaatgacggtggcagaggtgtgaaattaagagtgttaaggagtcaaaggagaagggaaggggcaatgaattttaagtgggcggacaggccgcctcccccccgttgaactgcccgtcggtgcagataaagggatacgactcgggctgaaatgggcacttcgccctcccctggtcacagtcctaatcatgttattggcctttgtccatgaagcgcatgccgcgccgcgccctctttcttgtgacgagcaaggaatttgggtgtttcttaaccctaaggccgagaattcgctggtctgttgtgaggggatctgtagtagcaggagccatttaaccccttatttgctcccccttcccccggatttgctagccagtggttttgaatgccacctttcgtactcaattttgggggaaaaaatttcaacgcagattcagtgcgaccccgtggaagggtgtaatctcattaagtgctatttctgttgggagcgggtccttaatccccattgttcacccttcctcctggcctttgccattgggacaattgctggggcaattggtgccgtgattttcatatttctttgtttcttgtggaccgtccaaagaagtgctgtgcggggtcgatggaccgggttattttcaggtattttttggaaaaaccggcgcagtcccgaaccgactgccaaatggaggcggagtcgcgtcataactgaggaagggtcagacgaggacgaagttctatttcagcacgaggacttagcgggcgggatcatccagcagagggaaataggtccggctgaagaaaggccaactcagtcccggactcaaagagacccgactgctcggcctaaactcttaacccgcttcggatatgcactttcccctcctttactcgggctgctattcgccttattttttatcccatgcataaaagcgggactagaagtggtgtccgtgtcagccgacacggaagagtgcgttgtcgatcacggcagcactcagtgacgttttgacagtgtgacttcacttacactgctaccagtcggccaaaagccaatcatccgcaaattaacataacaaaaacaattatgaacaacgacatggcctaccctcctccgcaatatattcctctttatcccctctccggtgcaccaaattacgtcatggctcggccgctcgccgatggaaatttcatggcgcccatccaggccccaatggcccgtgatgcaacgacgcagcaacagcgccttggaccgccacacacaacgccaactgctccaccggcggcggcacaatctgccgcaccggcacactccgttcctcccccccttaatcccccagcacactccgcagcaccgccccttaatcctccttcaaccggtgcggggccggacatggtaagtcgccgtcttttaggaaatgtgaatcgttctctactggagctggtccaagtcgcccattcgcaacgaattgttttggagcgtttgttaatgacggcttccgtcaaccagatgagcagccgcggtgtcgatggtagacgagggaatgggcggtaccgaaagaaggccaagggctcgggccattccttcccgagccaaaagcagggaacagttgggggggcccgtccctctcgttttcaggaagcgacggagaaccccggcccaatagggcttgtggaaaagcccacccttgggaatggaaatgagccggccgttgctgctgttctcccagaatcggattcaaacgccgcatcgtctttggcttcgtcgacgtgatgcacatctgcaccgcaaggggggcgggggagactgtctccgacagaaattaaaacaaaaaataataacaaaaaaatatataaaataacaaaatcaaaacaaaattctttttacacattttttggtcggggattagcccaattgtcccacttttcacataaataaatatttgttgctaatccgtgggctctgcccaccatttcccccttttttcattaatccccacaggcattttggtgacttgtactgattaaatcgggaagtggtttggcgttcttggccctgctcatcgccccccccccacggcccaatggtgcccaactctcgccgttgcccgtccatctgttgcccgttgctcctcccaacactgtcgcccacccaccgcttggccccaccaatcaccactgcccgcccaccaacaatcacccgaacactgtggacccgcccatcccgtttggccgtataaaaagaatgaaggatgctcgacaattacttactcttctgggcgattacttttctcgcctttttctcgatttcgccctttttgctctacctactcgccagcaatcttggctttccccttttgctcttgccctttgctttacctttctcactttggctttaccattttcaccttgcttatccatttcaattttgccttcgctttaaaaataaaaacaaaaaaaaccttttctcttttggctttgcattaaatttttccgcgtttttggcccctgatcatttctggggcatttctcattttttgtgcccttttgaccattgcgtgggcattcccccgtttttggcccttttcatcaccggctactcctgcccgtggtgcctattttgcctttgctttagccattgcccggccattttgtcgccgctttagtcctcgttcgtttccgttgcctttggccagcattccactgactcaggcccctttgtcccttttctggccccccttttttttccctgtgtttaccacagtttgattaagagtcttttgctcttaccagactgaggtctaaccgggcccttttttcgggctaaacttgtaaaacaaacgggactaagtactgtaaaggggcaaaaccgtcactccttttttactcaactttttcgctttatctttttttctctcaactatgtcggccataatccggcagcaactccgcgctcttttgaccgccatttcttctgactcattacagggggccgattccgatttattgccaaacgaccccacttctctggagtccattagccttaccgccgagaagctctcgcggaaactaagcaaggcccaagccctcctgaaagattggacgattatcctttcctcgtcgagtaaagaagtcagagagcaggaaaatgctttgtttgactagggggcggtgggtgggcttactccgggtgaaatccccgcgcggcgggggtgaagttctgacctaaattggaaataaaaatagatgg

SEQ ID NO: 2379 - DNA, 4278 bp, Heterodera glycines
ttttaacaaatttcgcataaactgctgatttgaggggctctaactctttcgcgtatcgctctgcgaagcacaaaaagtgcttaaatttcgtaaatggtcccaccccaaacaactcacttcagcagtttcgtcctgtctaataagtctttcctcggcagaactcacaatctgaaaagggtttccaaaagtgaggcaatcggtcggcattcactcgcctcactatcagcactaagttcgtcagacaggaacagaccctcctcagtttgcaagtcgattatcggaggcataatgtccgattttgaaccgaaaaaagggcgtatcttcgggcggggattgcttactatgctgaaaattctaatttaaaaataaatcacaagaaaatatgtttaccttaatttgtcatcctcaatttcgggtcctgaatcgctgatgttctccaattcttcaaaaatttcttgcaattccaattcagtcggctgcacaatggagccggaagtgtgcggtccctcttcctcttccgccattacctggcatggacgggaaacagatgaaagaattaaatgaaaattcgagtaaaatttgaaaaacaaaaaattttgggggaatgctatcgcccaccccacctcatccggtttgaacttccgcagcagggcaatcactctctgctttatattgcgctgcttcaaaaactttttccgcctccgtccaaggtattcggccgtgccgtggtcgtctgtcgtcgtcctcggtgtgaattccatgtccgattcgctgtcgtcggctgacgagaactcttccgggtcttcctcgctgagtatcattggctctttctcatttaccgtagtcacaatgcgttgtcgacccgatgttccgcacggttcgcccgtcaattcggcaggctttgtgtaacaattcgaaacttcgattttcccagcatgcaattctaaacatttgttttaagtccctaatcgatgtgacaaaattacccctcattgaatggcgcactttctgctgaatgcaagtggtatcccaaatgaccacctcttttgaacctccgaattgtaacacttcgtccaaattcaaatggcccattgcgagcgttttaaacccgggaatttgtctgtttttgtatctcttccgccgctgtatcaaaatttggagaatgttcggtttgcgcttgataaagtgacagtacttaaatttggaaggtgatttaattgacggggcaattcgcacttgtattataaaagaaatgtcaagcggaatgtccaatttcgaaggcggaacattcaaatcattggttcgcagtgtccttttgttgttctgtcataaaatccaatcaaaaaaagaattgtcgaaaacccacctgaagtcggatggctattgtgaacggcgtattttcagttatcgccaaactttttgtcaaacgcaggcgggtgaaaaccatggacagaacccttggggaatgtacattcaattgtaaacacatggagaaacgagacggcacctttgtacagcaattggcgaagacgtacgatcgacgtcccaattggcataaaagcgcattggcaagacggtaaccgaagatgggtgtttggcaggatgcattccaacaaacaacctgatgccagattaatggttatttttatatttattatacatagtagtaaaatggacaaaagaaaatactgcaccgaattaagcatttaaatgtttttaatttcttacgtaaaatgtattcaacgagcaacaataataataccacatcacaacaaaactgggaacaaaaggaacacattttctgaagacaatgacacacaataataccgcagaataaagatgaagtctttcccgaaaaataagccaatattgaagagatgaattgattggggttttgaatgagtacatttaacgcgaaatgtgtccatcggtcgctctctttcgctttttcctcattccttcggcttctcctgagctgttggctgtgttcctgcctcctcctcctttacgccttccttctctttatcctccttttccttccttcgcttcatcttaaacgcctcccggaatttcacgtcaaactcatcggccacttccttcgccactttgcacaatgaatccttggactgggcgatgtagtccaaaccagatgagatttcagtcaacattttctaaaaaggcgctgttttttttgttacatgaatgttcgactaacgttgaaatcgttgatcaaataccactgttcgcccttggtgagtttgtttcttgtacccaatgcgtcaacatcggggtttttccaaaagtcatatgcataggagttgtaatgaatctgtcaacaatggcattttggttatgattaaatgggagtcctttctaattagcactttgactcctcggtggtctttccgtgacaaatgcgtaagaggaaacaaacactcgtccaagatgaattcacttttgaaagccggcacaaagtcaatttggcttctgctcagacattccgctgaaaggccacccaatgcgaaaacggggttctgaaaatgaatggtgtttggcatctcgcaaattttgtatgttaaagttcttccggtacttccaatcgtcggtcattggaagcaaactgaagacatgccaataacagttcatttacttcccgattatgcttctcaatgtgtgcttcgattgactcgtcaagaggaggcaagacaggctgtttatgaataatacatgagaaaagcaatcatttttttaattataccattgactcatttgtcccttgtaaattgacgtaaaatggcaatattttagccgtaaaaatgtgcgccaaaatacaaatccaatcatcctaaaaaatatggtaaaaaatgagacaaaaactcaagatgaacctttgctcgactcagattgtcatgatgaaaaagatcgccatgtttagcaaagtaccgatggaaaatgccttcttgcaacaaactaacgaaaagcaaattgccgggttcgcgttggctcaaatgaagagcgaattgggcaaaaccgtgcaaaaagcactaaaaccaaatgcaagtaaaatgaaaaacagaaaaatggttaccttttcgtcgagcatttgaagacgtctaagaagttgaacattaaaaaatgtaaggcttttgagaattcgcatgaacacaagcgtatcatcggatgattgttcctcaggtgtttgaatatttttgtgtttggttttcaatacaaacggagcttttaataaggtaagtgcagcctaaacggacatccaattgtaaaaaaacaatggataaactaaacgaccttccttcgaaccacttcacttcgaacatcgtttgtgtccactaattgctgtttttttccaagtatagccttcgatttctcagtattcggatcgcttgtttcagatttctcgcgttttccgactgcatccgaatttgcataagcaaaaagacggagtaaaaacgcggctgtaaaaggtgcatttccacggagtgtggccaaactcgcagtcaaaagacgacggattttgctgaagattaatacggattgcatggtaataaagtttatgagactagcctggtgggcaatgacatgaaaatgactgtgcctgctggatcataaccacgccgacccgcacgaccggacatttgccgaaattggagcggtgtcaatttcggagtgtcaattccaaaaatgactgttttacacggcaagttcatactgacaaagaaaatgtttatttgaattggctttaaataaaatgattaaaaaaaagtacccgagtgccaatgttgaagtggagaagacgaccccaagaaaacctcgacgaaacaatgcctccaccgaagatctttcctgattggacagaccgtcgtggtggaaacctattccacgctcgaagagtttcaataacatttccgttgatttcttcgccggatctctggcatatgtttttctcagtctctcaaccactctgttgtatatgtcctcgtcggtccaattcccatgcagtttgaatctaacaataaacagggattgattgatctaagttattgacaattcttatcaccggcccaagtcgtcacgcattcgaatgcgcaaaagtgcgaattggtcggtgtctgtgccggctgtctcgtccttcttctcgtgcctttccacgttcccttcctcgtcagtccgttttgtcttcctttttgccgctcgttcttcctcgtccctttttcgttttgcgagtttttgggctttctgtacccatagagtgaattttat

SEQ ID NO: 2380 - DNA, 2714 bp, Heterodera glycines
  misc_feature (2645)..(2645): n is a, c, g, or t
ctgcatccaatgaacaaatctttcttttaatgctgtctcaaagtggcgcaaatgccccctgttcaaccacattgggtcggccgcagaattacaggtaaaaaatgttttgaaaaaccgacgaggttcaaattcatccctaaaaaggcttattaaaaccacaagaaccaatagtacaaaaaatattcatgactaaccgaactgttttgtcgacatcgctcatcatttggtaaagttcaagcacttgacgagcagtgagacgttggtcagccggaattccaaacatacgcaatttttccaatttatatacggagaacgggttgaaaaactgaaccacgtcattccaagtggctctggataaaacacagtttcccaatctcaattttcataagtcactttgactgttgcgaaatttcgcttggtactggcgaattgttattggacgcccgacttgcgacactcgcccggtcatttgccgcatcctcaccggttccgtcttcaatttcattggatgtcacgctcgatcccctgaaaaatttggtttcgtccgtctcgaattgcacgccttttggacactcctaaaaattaatgcaaaataacttttaataaaaattgagaaatcttactcgaattttatgtagcgcaatttccaattccgaccatctctcgtcataagttatcttttaaaaaatttttaaaattaatttaattaattttatgctttataatttaccaattccactgttcgtgccggtgctccatcaattggtttgagttgttcggcctcttgaagccaatcgcgcaattcttcgatgttaccaatcgtagccgaaagagcaagaaaagggcaacggatcaacaggaaaatgtgttcccaaatatggccaagagaaaggccttgggtgtctttttgactaaagaaacgaactcaaatgaatacaattacagtaattatgtgactaacttaatacagtgaacttcgtcaagaatgacgtatcgaattcgggaaacgaattctcggcatctttcgcttgtggaaaggagaatttgctcaaaacaatcggggttggtgaccagcacttggcaattcaatgggttgttaactgaacaaagtaagcggagtcaatttgccagttttcataaaacccacgaatttcgttggtgtaaattccatagagaacttttccaccggacatgttctttgactgtaaatattatataataaaatgaaatacccaagtaaatttagagaaattacccgaaaacgcgcataaactgagccaacgtactgattggtaagtgcctttgacgggcaaatgtaaacaacgacctcatcgttgctttttcgcaacactttctcgatgcaatagtacgaaatgaatgttttaccggccgaagttggcgcaacaatcaaagcggatttgtcttaacggaagtgagtccttttttaaataggtaaaaaatgatttaaaaaatttgcacttgtaagataaacaattttcatagtaataaatgcccctggttagaattaggtcaaccttggtccaccgcatccaacattttccgctgccaagcatcgggcaaaaatccggtgactctttcgtcctttttagggtctgacaaaatttccaacattcttcccccgtattggagttggtaataaacaagatcaatgtccaagttgtacgccttatccgcacgtcgttttgacgaatcagcaactccaaaacccaacgaaagccaaagggtttgaatctaacgagaaaaaagattaacaaggaaattgggcacgcaaactttgtccttctgctgactgtccaaatggtcataatatttggtcagaatcacttttattgactcgacaagttctgaagagcagagaaattactgtacaataatatgacacggttaacaaattccaatacccaaagccgcgatccgtttgttgtcgatgttttcgaaattctccaaccgttctgaaaatatttcgttgtaccgcaacatcttttgatacatgcacaatgctttggactcgtccaactccaagcggcgcaacaaatcatcgagtgcaaaaattgccttaataaaataaattagttattttgtttgtcagtaccaaataaaggggaattcacttctctcacattggcctttattcctgtggcatattcaattttttgtctgtcgctctcaatttgctctttgtttttcttctcgcgactttctttcagaatttggtcctttttgctcagttgtgaccctccctttcctcctcctgctcccggttttccggcctttttcttgaccccagcatccttttccttcttcacagtttctttttgaactgtcgtttcttttgtttcagaaacattagcttttggcactcttgtgaagtcgaccaacatttgaccttcgagcgaatcggagaaaagttggtacctggaaaaaccatgggaaaattataattttttgcccatttgatctcaaattcgagataagccattaaaatatcttatacattttcgctgttgattttgacttttgtttatgaaaatacggtttggttttccctaaccaactgtaccatttagaaaggtcatggcgctagtgtaagagtcgattcgcctttttcgggtcagaaaggtgcnccttctcccattctctttgcgcttcttctttaaaaggaatgggtcgtagatgctgctgaatatccaacc

SEQ ID NO: 2381 - DNA, 5224 bp, Heterodera glycines
atgaagtgcagcaattcagagaattgctattctgaaaaatgaaagaattcacaaaagaaaacaattaatagtttgtttgttgttttaaaactgactaataacacaaattatcgcaaataaatcctcttatcagtcccagcgcttacctccagaaaatcaggaataaattgacgaagcaattcgttttcgactttgtagaaaatacattgaccagttgtactttgctgttcgaaattttgtggagaaattgggtcaagtaatttgtcctcaagatcagttggaattgccacggtaagtcccacacttttgtgcaattgtgcaaatttctcttgtcgacgtaatggaagaatctttaacaaaatgtcaaccaattaattaaaaatatttcgaacaccttttcgccggacattattttcttgaaacaagtgaaaaccattcggccatcccaaatgtcgtcaagtgagaaaaggatttgctaaaccaaactgttttaaaataaggaattggattattgttcaaccttttcaacagcgcccgacaaaagtttctgggctcgttccaacaatccgcgacgaaaactgttcaccgatggcgaaggccccttattataatcttcttccgtgtccaaataacggcgttttactcccaattcttcgcagattaatgccgacaaaagaacagcgttgcagaatttttgaaattcgtccaatttttctttattcttttcggcctctttgagttcgtcgcgcagaacaacagcccaaaagtcggtgatattttgacatgaaaccaaatcagaattttgtgtctgataagcaacttaaaggtaacagacaaaaatatagacaagtttacgcatactcagcaacttacggcctcgggtttctggccatttttctctgattttctgactaaatccttcgatattcagcggaacagttgataaacggtatgcattaacagatataaagttgatggtgaagccattgaacaaaactaccggtattgcttcgtttatcagggaaaatgctaaaaagaaagcaatcgatttaaagagacaaaaaatggacctaatgaaatgaaacggtcagcaaaattaatgggctctttgattatgtccggggcattctccaatgacaaaagcataaaggatggcgtaagctgatgcagatagtcattccatttctcgtcaagaggagaagtgaaaaactccaaattttcagcccatttgctcttggtaatccaacaaagaataaacgggtgaaggaaggcgagaaaagtgtcgcttttgaacaaaggcgtcaattcagtgaatgtcaccaatttgaactttgcgttgagttcttccaatccgccgaggaattgtttaatcttcaaagacattttttttattagtaatactcgaatagaaagaacctgttcacagagaacgatggtctgtccacccaacacccatttgtggtaacgatgggcacacaactcaagcaaaagcgaatcgagagagatgaggaaaatttcaacatcagcaaattctgaaatgtcgaactgatgatgtaataaaggatgttattctaaagcctgttataatgtcggtgtaagggcaaggaatgagtcgtattgtatccaaatcaagcggtaggtcaccttaaaaaaaatcacaaaaatgaagtattttgctagcaccatcaatcgcagcgttttcattcgtttctgtcggctcttccatcaattttcatatgtggctttggcaatttctaaattctgctaaatgagtttaccaattactttcagtttcggttaatcaggtggtttcaaaaacataatcattcaggtccacaggccatttttcggcaacgtgggttctgttttcagcttttttatggaaaactgctcgttaatttttatggagatttttgttgttaattttgatttaaattaaggatctgggatcggcgatgcggaaaggagcacgcccagagaaagtttttgaaaatttactttaacagattttcaatatttccattccaagttactcttttaaatttgattttatccgagccggaattccatcaaaatttttcggcgtgattttttgatatgcaaagtaagtttgttgggagttgggactcaaactaatagtaaaggcattctcgaaaaccaaactcaaagtaaagacagtctcgaaaatttgaatttatttttcttttgcatttcgtttccataatttttttttgttaacgttgcatctgaaataatgcaattagcattgcacaaaacaaattaggtaggtattttttttaatacaacctttttcatttctcttttttattcacagatatttgacttttttcttctagttcatgtgtctttccaattctgtcagaatgctgagccgcacttggatcgtcgcaatttgtttttatattttctttggcacgattttaccattctctgaagcaattcgtttttatgtggcttctaacgataagaaatgtctgaaggaagaaattcacaaaaatatcgtgttgacgggcgaatatgaattaagcgattctgttgggcacacaacgacagttcatgtcagtgatttaagcagattataacaaattgatattggaatttcaggtcactgatactcgtggtcacactctgtacaagcgtgaaaacttcccagaggcccgtggaaaatttgcatttactgcggacgaatacgacattttcgaaatttgcttccaaatgcatggcccgactcgtaattctttgactgttgctattttcaagtgatgcttttaatttccagaccaacaaaagttaaacagagaagtccatttggtgctaaaacatggagtggaggccaaaaactacgaagacttggccaaagcagaaaaactgaaacccctcgaggtggagctccgtcgtctggaggatttgtcggattcgattgtgcaggactttgcttacatgcgtcagcgggaggaagaaatgcgggacaccaatggtatttacttttcctcccaacataaaaccatcttatttgtctgacaataaacaccattaacattgtcagaatcaaccaacagtcgtgtgctctacctcagcatcttctcaatgttgtgtcttctcgggctcgccacgtggcaggtgatctacctgagaagttacttcaagtcgaagaaactcattgactgatcagtgcgacatatttctttcaagttacggcctcttttggtaatttatttgattcactgttgttgtcggtttttatgggtttatttatgcatatgtaacagattatttcttgagcaatgagtaagtgacttcctgagctataaaaactaacaatttggttaaaaaagtgactagaataatcgaaataattagtgaaaatgggcgaggtcattcaattctcttcactttctctctgattgcctcgagcagcttttccctcgcttgcaacagctccgggtccctcccccttgtcatttgcgctgtgaccactgcgttgactgattccacattttgactgtttgtttctttctccgcggttatttcagtttccatttccctttttatgttgtcctctcgttcagatggaatagtgttttcgcttgttttggtttgcttttggatggtattctgacgcggcagttcctccttttcacaaagagtcgcaattaccgagttgactatattgtccatttgtaatggttcataaactttgctttccgaattacgatgcacatggctaaaaaaaaaattttttttttggagaaaattatatttcaatcctcgagtaccgattcacttgcggctgatgtctctttgttgacggacaaggggaggaaaggcacgaatgagtgccttctctgatgagtgcgtccgctccacggtctctgtttgtctccttcacacgttgattggaagtacgcattttgggcgtcgcaggccgtacttcccttagggcctttcttgcttttaacgcctccctttcttccgtttgtgcgatttcttcctccaatttggcctccctccgcaatgtttcttctttctcgatcgctgccactcgactttcactgtccggttccatttttgtgatttgcatgcaaatctgttccatcggtgatggaagcactgagtcggagcttcgtcgaatatcgataacagaaataagagaagccatttgcgtggcgaacggcttcaattgttgtgccacctaaagaagtgtttttttgtttaaaggtggcgatggacagactttgaatgcccgtttggccaaactccgaagctgaatcaattctcgtgccttgtcacgaaccgccagttgctgattttgaatccgttcaatttctcgtcgccaaaactgtttcagactttggttgacgatgctttccacctgtctattgtgtgtctcgagtcgtttccaggcgtcttcacagctaaaaaaaatccagaaataaattggaataatttattctcttaattattgagacaaaatctgtccatacttggtaatttttgataaaaggtcttccggactgacgacacaccgtctcagtgtcaaatccctctggagatccagcaaaatctttgagatggcagaaatttcataagcaaaatcgttcagaggcgtcgcgatttttctgaactgttctgagaagcgttgttcagataccatcggcggcccgtttaaattcatgctttcgagttgcgatgtaatggcaacggaggagtggttaaactcgattgtgaaatcatcagttaattttttgatggttcctttttcggaagtggagaaattttcaaccgcaacagacggaaaacccttcatctcttcttccgaaagaagcgctggggcagcaatgccagttttgtttggggtggagtcttcggcggaaaattcggccaatgtttttcgtctttgctgggaagagcctgaccaatggggacagaatgcatttgtggtgaatttgttgtttcatactcttcgtatggtcgaatgaagaatgccccattgtgctgctccgcgaatttgggtcacaattcagaaaaatgccatgagagctcgaattatcggcgaatgacagtgtggaaaggcccaacggttgacaaacggagagggcaaattcggaagggaagtcgatgttaaaattgcaatcgaatttcactttttggatcagttccaggccatatgaggagagaaattgctaaaaaaagagcgggaaac

SEQ ID NO: 2382 - DNA, 2192 bp, Heterodera glycines
ttttcataatttctttcttcctcaatcaaaaacttgcacaacaaatttttgatataatttaaaaattcttaactagctcaattagttgtgagaagtggtatatgggggataaagcacatgggtatctcagtcggttagagcatttcacggcatggaaaagccgtgagttcgaatcccaccgggcgcgtaatttttttattttctacatacatattcacccatgaaaataaaattcggttttcatttttaattgctaaaaaattattcaaaattcttgcttaatcttttttatttatttatttttttgccattcttgcttaacgttttctctttttttttgcctacaatttttaaggcccgtttttcgttttttgttttttttgtgaaataaatgtaaatttattgatttaaaatgctccgaataattttaccactattttttttttgaatgaatgaatgcatttgaattgcgcaatccatcaacctcgcaatcccatctcatccattgtcaaaaaaaagaaggaaaattccttcatccaccatctcttttcgcccaaacaatgaaaagcgaatcaaatgtccgtccattttcattttcacgacaaaattttcaaattttatttttaggttttttgaattaaaattaattaggtaattaattgggactgaattcaactcagaaatgaaagcttgaaccaaaaattttttattatcatttttcaaccgaaaagtctcaatcaatttgctaaattaattgtttttctacatcgttagaaaaaaaaagtcgaacataagttaggaaaaaagtcgaacataagttaggaaaaaagtcgaacatatgcactatgttttgaatcggtctaaaacatggttcaaattcaatttcataaaataataaaacatttaaaaacgagtttttctttgctctattttttgatgcccaaaaaaaccacagttatttacagaggcttgaagaaatttcggttgaaaaaatgacaaaaacttttgaccgagaacctagtaaataattgtatcgggactcaaattttttccaaataaacacaacaaattacttaaaattgataaatttaaacacgaaaaataaggagagtctttctttttcgatttctaagattcggaccctctgaaaataaggacaaaactttgaaaaattaaggacacttttgggttccccactgtttcgtaaatattaaatttattttcttttatttctaaaattaattaattttaatttctttttattcaaaaatttcgaaaattaattaaacacattttttcaattggaaatgatttttgatgctattttttccgcgtttaaatgaaggacaaataaataaaaataaatcaaaatttaaaatttttgaaaattactttttttctatttgcatgaatgcattttcatgtgcacaacaatctgtcaaaaaaaaacagtaaaggccacgctctcccaaatatcatcatcattaaatttaatgatgttttcattattaaactaaaggatttttcaacaacaaaaaaatccccgaaaatctaatggtatttcatacaaaaattcttaattgcacaattagtgtcaattaatttaactacgaacgtctctttttttcaaacaaaaattgcacaaaatcagcccatttaattaatgcatttttaatgaatgtgcgcaaaatttgtcaaaaaatcggtcagtcattttgctcatctgccctatctttcgtctgttcacctcctaattcattcgttatcatattttcaaatctaaaagagtgccattgtgggagataatttttgcgaaaaaatgagtcataaaaatgagtcgagaatttaggaccgaccctgaaacctaacccgagacagagaaaaacgactgcgagatagccgagacttagggttgccgcccaaaactcgtaacatgaatcccgatccgaacaattttggctgcctcggttccggatctcgactcgacaattttctcgttcgggagtcgaaaacgcgcctctcgcacaaccctacactttaaccaaccctcaaacccgtaaaatttgcgagtcgaaaaccgagccctacgccttaacctaactcttttaacccgtgaattcgggagtcgaaaacgcgaaactctcgcttaacctacacctcattacctaaccctcctctccctatgctactca

SEQ ID NO: 2383 - DNA, 8439 bp, Heterodera glycines
tgatttatttttctattcgggggtttccaattttggcttgtaaaatttgcataattgaataattttgcacatttaatccatttaaatcattcttgatttggagctaattagtatttctaaacgaaaatttttgaaattttatttttagaaattcgctaaccaatttgaattttgaataaatgaaacattttggtaaataaatataaaatgaaacatttatttctttcactatacattcttatcatcatattatcattattcatcaaaatgagaaaataatgataagtgataacatcatttataaagtctaattaaaataaaagtttatggaaatcaaagtcgagactgagccgggaatttcataaatctccattctgatcacagaaaaagggggtaagggattattggaaaatcggggagggcggtgggagctcgaaattcattgatcacaaaatttcgaatcaaagtattatgatggtgggctggaaacgtgattgcggattacaagttgctggggctctgaatttttcttaaagaccaaattacggattcccaaactcctttattggatgaacccagtcatttccgaccctgactaattatgctaattatgacgcaatccctaaattgtgcgaccaacttatttaattaatcccttttttgtaaaaatgtattctcggcaacgataataataataatacgttaattgtcgagaaatgctaatgcgtcgtatatgatggaccttcttggtctgtttgttttgtcctctctctcctccatcgtccccccattaacatcgttttgccaatttggccacgaaatgactattcctctcggctattttaagcacaaacaagcagcaaaataataaaaacaattaaagccgtgagtgccgagaatagtcacccgtttctctccccattcccccgccacttttggcacttctcgagacaaactctcaaaaatctcggacaacaacaatcattaaatatcacgttattcatttcaatgtacggtaaatagaaagggtgagcagagcaataacaaaaagaaaaagtgtgataaaatggtgacataaatgaatgggggtaaacaaggtgctgccagcagttaattgcttcttattgttagtctgctgaactggagctgctggttaacttgtggtgcctggccagttgagtcccgccgccagttgagccccagggaaaatgctttaattatacagtaaatttaaataattttattatgatttgtgtattgtaattataaacggggttgttgtacagccggaagctgctggttctgagttttgaaagttttttaaaacttggttaaattttgaaaaatggacgaaatggtaaatttgtaaattttgaaaaatggcgaatactgtagatttatcagggctgtggtgatggtgagcgggggggggggaggctctaataaaagttagtaacgtaaatttaaaaatcacattaagcgagccattttccttttcattttacaataattaagcacaccatcataatatgcttttctgtcattatcctaattagcacttaataattttctccgtcttcgtcacatttttaattcgctttttcttctgtcccatcgctgataacttatggccaactcaaagacacaaaaagtcaatagggctggggacatagaagtagttgaatgatgatgaatgtttgttgttccaaattttcggggtgagaaggcttaaggcttttcctctcatttcactttgcacatcaaattagtgtcccgtcttgaaacatttcacccgaaaattgcatttccatcccattttatttgtacaaatataaatttatatatcgggaatgcttagccgatttgctctaaaattgtttaaaaagtcgggactcgaaagaggtataggaggtatgtcgggaatgtcgacaatctcgaattaaaaatcccaaaacgaattttcaatgcctaaatttttggaactcgtattgccttaaaatttggaaatttccattgctaaaaaaattgaaaatcgttgacattcttaaaaattttcattcagttaaatttttatttaaatacatacaaatgatgaattattattataaatatcgcaaatttattgtattcattttttaattcatttattgacaaatttctccttttttaaatgcttttttttatccccgtttaagctttgtttattccattgctttaattttatttttcaaaatattcatttttttcaattttattggaatttacagtcaatgcttaagtaaaaagtaacttaaaatgggatttaaaaaagcacaaattgttctttcatcatctcccaataatcaatcagcagcccatcaacacacatttgtcgtaaaattacatttttttcttcttctccccccgtaaaacatttcccaaaatctttatttttttattaatttaaaaacgagtttttaaagtttgtacaaattactttaaaatatttaaaataatgctttttttattaatatatttatataatgcatttattttaaataaattctaaatcgttatttaaattaactaacgaattaaattacaataattgttaaaaaatttattttataaattctaaatcgttatttaaattaactaaatgacttaaactaaaataataatttgttaaaatttattttaataattaaaattatacataaatcccatctttttcccatttaccattttctctttaatttattttattattgctttattattaattattttatctgctatcaatatttaaagtaatgctatttatttttcgaaaaatgagaattacaatataataatttaaaatatttaatttaactaaatgaattaaattaaagtaattttttaaaaatttatttatacctaattaaaattatacatcccatttttcccacatttccctttaatttattttatttatcattcctttattactatttatttatttatcattttatctgctgctgctatcaaattggacaaacaaattgctttgtgcaaaaatggacggtccaattaagtaattaattatgtttgtgcattttctgcaatttctccaattaaaattttcgtcataaaattgcgattttcttccgatcgattttcccaatgtttgtcctttctcctccaattttcatttgttctcttttctcgccccaaacattcttctttctccgtttccttcaccaattttatgtcatttaatgttcaaaaatgcatttttttttttgttttaaattaaaaactaaatttttattaatttttatttatagaaaatagtatcagtttcaatatgctatttaagcttttcttttctctattagcccatataaaaattcaaaaaatttcataaattttactctattagcctagataattcaaaaattaaaaaatttataaagtaaaagattgtttgaatttggataaaaatttttggaattttgtaagctaatagagaaaactcagggctactaactaccggacatacaacgaatgaatttgtagcacttttataatatgccaagtattcatttggatattttttgatggcaatttagtcgacaaaattggcacttttacgatatgtccaagcatccattaagggatgatttggtgacaattttgtcgacaaaattgaaaaaatgtccaaacattcatggaatgatcattttgccccaacaaaacaggcaaagcatccctaggatattttaaagacaattccgacaaaattagcaattttttactgtatatatccaagcatccatgggatattttggcgacaattttgtcgacaaaactggcacttttataatatgccaagcacccattggatatttggcgacaaaactggcacttttataatatgccaagcacccattggatgttcggcgacaaaactggcacttttacttgtccaagcatccctaggatgttttgatgacaattttatctcacaaaattggcacttttactatatatccaagcatccatgggatatatatatatatatatatattgatgacaatttgtcgacaaaattagcaattttttactgtatatatcccacacccattgagtatgtttataatatctttcctcaactttttaataaaaaaaaattgaacaaagaaaaaaatgtacggaaaattacgacgaggacggcacgcacatttcattcatttccatccattcttccttttttcaaattcatttgtccgcttctttcgtccccccgttttcattcttcttcttctgctgctgttgctcacattttccccgtctttcgtcgtccatttttatcataaataataaataaataaatgggacaaaaacaacaaaaagaaagatttcttcttctctcctattcattaattacttttctttataattatttattttaaatattttatttattaattaattatttaagcttttttctaattttcctccccattttgactttatttcagggggcggggggagggctctatttttcaacctctctcccaacctcaaaaggggggggggctttatttcatggggctctaattcagggaggggggctatattataggaaatattttaaatatttatattttatgtttttttctctaattttcctcccaattttgtctattttcatttgtttttcgttttttccaaatgccaaacagaccaataaaaattgggtaattgttatatggggggaccttctgctggctgctgttttgtggttgggactgttggggcggaacagaacaaaaacatcgacggagtacgaatttttggaccatgtctttttttcttactcaaaaaaattaaaaaacattcttggtactgttcgaacaaacttttgacaaactctattaacctgcaaaagtacaaaatttttgtttatgtacaaaaaaaaaatcaagaacaaaaatgtaagaaaacccaagtttttgagttcttcgggccaaattaacaaaaaaaaaaaaatttgataagatagaataataaaaaacagatagagctatcgaaaaaaaaaaaatttttttgtagctttaaatattttagatgtattgtattgttcggaagcgaatttatagaaaagcctctattaaatttgtcaaaatcaaatcattttttgaaaattaatgaatatattttttaaaccaagcctacttgaattcatttgttttgttttttttgataaaaatggaatttttcttatacttttttttggtttttttaatataatccacaatacaaatttgttatcatcgaaaatttcataaattttatgaatttatcatttggaatgatactttactgaattttttgaatttggcagaataagaaaaaaaaattttatggcgtctcgaatttgttggcgttggcgtcccgccgttccgcccgtttgaatttgctgctttgtcccctcaattataaaagctgtctgtcacacaaccaaatatgtacagaaaatagaatttgattgaagcggggacgagggtgtgggggggctgatgagagagacaacgattaattaaaaatggaaaatataattttaattggatgtaattaagcaaaaagataagtaagggtaattaggggagaataatgaatttgtaattaagaaagatgatgatttgatttgatgtgtgatgattatcaaaaagatgaagacgacggcggagatttgataacacaaatttatagggggaagaaagaagaagacgggctgtagtaattacgaatgtaattattggttgaaccatcatccttttcttatgttgttgggaaaccccatcatcatcatcatcatcatcattagcaaataaaattgccaaattattatgctttttgatgggccaagaaaatgtaagatttgggtcctggaaaatttgcttaacatttttaacaaagcctagacctgggtcaggagatttctggacaaaaatccagaagaatctaggcccaggaagatccaggaaatccatggccagggaaaactaagggaaatagggcccagcaaagccacagagaaattccggccaaataaaaatccatggcaatccaggcctaagaaaaacccagaaaaactcagcccaggaaaaagcaggggaaattcaggtccaagaaaaccagggaaaaatccaggcccaggaaaaatccatataaaaaattttttgaaagttttttgataattttcttttccgttctactgcctttttcctcctctacctaagaagtttacgaattttgccccttttttttgcctcaatcttttttatgataatatttattagcaatttaactgattacgaaaatgtttttaacattataaaaaagaacaaccaaccaaaaggtgggtagacaaaattcagaggccatttaaacaaacaatttgccaaggagataaaattttgtttttgaatttttacgagcttttttggccagagcggattagtttattcagcagatggagctttaccgtttaccattcgagctttttgattttgaatttattctcattttccttacgacaaaaaactgccccgtttttttttctataaagccatcaatttgaaaatcaatttcaaaggccaaattataaattttaattgaaattcaaattcaaatttcagagtccaaatttctgcgtccaacttttttcctcttttttcttttccgaattaattaattattcccgctgccgatatgatgcgtgcctttgaactgtaatgttttaaatttgtttttaccgtaaccaattttatttatttattattttttttaattaattttattttttgtgatccgcttttatttttcatatacataatacataaatctcttaacaatagaacccaaaattcaaaaattctaacggtagcgcttaccaaaaatcttacttaccgtattctatactcaaaaattgcatattttttttcttaaccaaaaatttttcggccaagaattgtgatgtttaaaagtaaaattttgtagattttccccaattgtttggcgcttttccccccgcttcttccccctctctgctgctctgttggactgtttgtttattctctcatcatccgccgaccgaccggctaaatttaaactcagtcggacccctaaaaataaatatttgatgcatatttgtgaatgaatatgaatgaatgttagtgatgatgatgatgaggagtgtttaatttattattatttcccattttcgagtacacaaattttttttcccttttttatgcgcaattttattttatttttttaaatattttaaattgttgttgttgaagaatgaagaacgcttttttccgtgggagaagcgggggggggggggaattttattattaggtatttatgattatatttttaattttgttgttgaagaataaggaatggggaacgctgttttgcgagggggggggctaagatttttatgccaaattttattttaacaacaattggagagctatttttttacgatatttaaaacaaatattttatttaaaattaatattttcatttttgttgttgaagagacgcattttttccggctgggggggggcgggtgagatttttgcgtattttagcaattttattttgaaaacaaatatttaaattaatatttctaattttttgttgttggccgtggtgctgcgattttcatgcgcaattttatttttcaaaacaattattttatacatatatgtatttatttttatgatttctatttttattgttgttgaagaagaagaagaagaagaacacttttttggaggagcagcgccggggggtgagagactgatttttgggaggaaccagttttttgtctttttaatggatcattagtgggcagaggggggggggggggaaattaattaattttatatttgtttgttgtagatttcttgaacggacctgtactgatgcggataattcttttgcagaaaacctgaaaaagaaagggacaaaacaatgggaagagacaaaaaagaaaagacggaccgggattgagaaaagcaaagacggaaaggaaaaggctgagcaaattggagattaggtaaatggaaatgatcagcagcaaagtgttagtcgccgcgcgaatgttccgacggcgaactttcatataatcgtagcccatggtcaattcggtgatcagcaaacgcaacctgttgcacattttgtcgccgtaaccttaacaaatggaatggaatgtgaagatggcacggcaaaaattgtacagaattaatcactcacatgagcacaattccgccgttaaaaaacaccaatgtgccgaatggaatgataacaatgagcaaaattgaagaagttgggaagccattcccggtgggtctttttgtgcggggaatgaaaccacggaaggggccaacggactgt

SEQ ID NO: 2384 - DNA, 1991 bp, Heterodera glycines
cttgaaaaagtcgatttttttgttttcggggcagtcccgccgagccgatgcgcccagatttatggggagtcggaatccttccggaatagcttccgtatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattatgcgttggatttttgctccccataattgtttgagtacccgggggagagaatggtcggaggttgtgttaaggagaaaaatcaatttatggcttaaaaatcattcattcattcacattgtacacatgtgcatgcatttgctatggctatgtatgaattcaccgattcacacaccaaatcatcgaattaaatttgtccattagcaactaattacctaatttatttatttattggccaattaatgtatgtgtgtgtgtgtgtatgtgttttttgtttctttgtggaaatgcaatttttctcaggacttgttccagtttcatttattaagatttttgtttattttaggggttttttaatattaggaattcaaaatttaaattttccccatggcgccgcctattggcatcggtggtcctttgttcattaactaaatttattggtcaattaaagtgcattttttggagatgcaatttgttcagtacagttctaaatctgtttgcttgatttataggatttttgtttattttttatgcgtctaaaaatatttgaaattcaaatttaagttttccctatgacacctattagcatcaacagtcctttgtcattaacaaaattaattggccaattagtgtgcgcgttctttgatttttggtactaataaatatagtttgagtccccctttttggttaactttcacaatttttttaaaataaaaaaataataatttatgtgtttattggatgtaattcagcaatttgtgaccataaatggaaaaaaatattcagccttccatcactgttcaattgtattcatgtgatatattagtactctatttttacgaatttaaattaaattttatttgaagttaacccaaaaaatcctccacaataatgccattttttgaaaatcttttttttcggcactcaatttaattgagtaaatctttttgcttatgtttatcccctaaatctctttatgataaaaactcgggggggggggggcggcagggctaaaaaattctgggccaaaatgaatttaaaatatcaatagatttttctaaaaattcatttttaaggcaaatctctttaatgaaaatggacaaaaaattgcgcacattcttgagaataaaaaaatgtcaaaatctatttggataattttattacagcaaattgcattcattgccaaccgaacgaattttgcgtaaaagaattttataatgtccaaaaataaaaatttaaataattaaaaaaaaatttttttacaataattatttattttgataaaaatttgtcaaatattcatcataaaaacatttaaaattctcttttattttgtagattataaacagaataatgtttttttagctaaatttaagcatttttgcaaatttgaacaacttattgaccttttttgtccatattttcatacaaattttggcatttcgcacatattttgagtgatttgttagcacattattatatttaaattttggctttatttttataaatattaagtttttctaattttggccagacaatttccttatttttattggcattcttttaaacacgaatttaaaaatattttttcctttaatagcaatgatattaaagcccgaatttccactgtaaaaaaaagaaataaaaattattaattttttgagccgaattccactttaactaaaaaatttaaaaaacataaaaattattatttt

SEQ ID NO: 2385 - DNA, 2430 bp, Heterodera glycines
tgcaggtctaaaaaaaaattaaaaattattaattttttgagccgaattcccactttaactaaaaaaatttcaaaaatcataaaaattattattttttagttcctttatcagcaatgatattgaaatgatgagcccgagtttccacttttctgtgccctcctcctcctcctgcgcatctgttgaccaacaacaacaaccgtcaaaatcggcagatgatcagcatcagcaacaatcagtcagcagaacatcatcatcatcttcgtcagcactttgcaccgccgccgcgcattgcacctttgatgaaactgagaccgcaaggtgttgcactgaacttgaacaccccgggcgagactaattaatgatgctcgggaaagaaaattaaatcggaaaagattcttggtccccgagaaactcgagacaggggattgtgctaaaactcgagaccagcaagggttggaccccccgagacttcggtttgatttctaagacccgagagtgagaccgacagtgagattcgagactacgattgaccccgtgaatccgagactaatatttgaccctgaggctcaagactaatgtttgtcctgagacccaagactaagacttgtcgagactaaggttggccctgagatttgagacctaaacctcacagccaacaaatctcatcacatgctttttcaaaaatgccttttcataaacattttatgtttggcagagactccatgtcatcgtttagccatcatcaccaccagcagcagctgcagcagcaccggggctcggccctgtcccttggccatgccatcgccgctccgtcctccgccgaactgatcgtgctcgactcaccaccgccggctcccccaaaaacgccaacgaccacggtgatgatgttcgacagcactgatcatggtggtggtggtgggggcggtcaacgacaacaacagcaacaacagtttgatgtcgttgccagtggttgttgtactgctagcagcgcatcatcttcattcataatcggatcgatggtaagaagcgggagcagtccctttctccgtatcacttatcaccccctccccccccccgccctcctccgaaaaatttttaaaagaaattttctatgttaaaaagttttcacacacacacacaaaattcagcttttgtatcattttcggccgtttaaaaaaatttaaatttagcgagtttgagaaatttactagtcgaaattttaccattgattttgaaaaaaaattatgcatttttacaattatgtgcatagtagtgttttagaaattattttatggtataataaaattttagaaattaccaaatcaaacaataaatagtaatattcaaatcattaaaaaaatttatttatttctttttgataaaaaactatccattgaatggttaattgatacaaaaaaaagtgaaggtcacccattcatcattttgaattccaattcttaattatagaacaaatattacattatttcggtaatgtaattttttaattaatgaattattatattattacattcacaaaaatttttttttgaaaagtggcaaattgaaaaaataaacccaatttatagcaaatgctcacaaaaatatggcattatggcacaaattttgattatcagggcctttgtgatcaatcacacattttttgaatttttaaatgtttgacccaattaatcacattatttggtgtcggattatttatcattcattagtcattcattcagtcacccatcaatcagcaccatcaacatcatgctttcatttaaatttattaaaattctttttacaattccatccaaaatcaattaaaatttggttttttctgacgggtgcacttcgtttcccctcctctgaattttttttttaaatttccagtaaaagtattaattgattaaaattttgaaaaaatgctaggaaatgtttaattttgttttcttcaaattttctttaaaaaagtgtttgtttctccattagcttgcaaatttaaaaaaatttcgttattgttttttccttcccaccgcagggattgcccacaatgcaaccgacgaatatgagcaatgttagtgccgcatctgctgcagtgtccaccacgtcggcatcattaaagaccgcctattcggcaataattgatgtgcttgaacttgacgacgtgctaattgacgaaattagcgccgctccaacaagctttggcggtggcacggacggagcgacaaggacggcgttggcaacgccagccggcggtggcacctgcacgacatcggctgatgagcagtcatcgagcagcggcaccaagcaggcccatgagtgagtttttttgttacaaaattcaaatttcggtgcaattaaacattttgccaatatttccccccccccccaaaaaaaaaaattcatcattagtctccaactctcatcaag

SEQ ID NO: 2386 - DNA, 529 bp, Heterodera glycines
  misc_feature (55)..(58): n is a, c, g, or t
  misc_feature (64)..(64): n is a, c, g, or t
  misc_feature (67)..(69): n is a, c, g, or t
  misc_feature (72)..(76): n is a, c, g, or t
  misc_feature (79)..(80): n is a, c, g, or t
  misc_feature (96)..(96): n is a, c, g, or t
  misc_feature (98)..(98): n is a, c, g, or t
  misc_feature (105)..(105): n is a, c, g, or t
  misc_feature (108)..(108): n is a, c, g, or t
  misc_feature (115)..(115): n is a, c, g, or t
  misc_feature (117)..(117): n is a, c, g, or t
  misc_feature (119)..(120): n is a, c, g, or t
  misc_feature (123)..(126): n is a, c, g, or t
  misc_feature (130)..(132): n is a, c, g, or t
  misc_feature (141)..(141): n is a, c, g, or t
  misc_feature (145)..(145): n is a, c, g, or t
  misc_feature (148)..(149): n is a, c, g, or t
  misc_feature (171)..(171): n is a, c, g, or t
  misc_feature (173)..(173): n is a, c, g, or t
  misc_feature (178)..(178): n is a, c, g, or t
  misc_feature (180)..(180): n is a, c, g, or t
  misc_feature (187)..(187): n is a, c, g, or t
atttcgtaaaattgagaagaaaaaaaactacatgggaggtttcaataaggagcgnnnntttgtntannntgnnnnnganncccctcaaaagaccangnaaaaagnaancaaaaananannaannnnaaannnacaaaaagncaancannaggggagccccaaagacacaancncgagncncgaaaancgagaccgagacaaaaaaaaacttgagacttttctcgagtcgagaccgagagtctcgaacagcactagttattatgcccatccccggcggggatgggtgcgatggatccctgttcccgggacagaaaaatggagacgaaaaatcagaggatttcaacccggtcaccgtaccgcgccgctggtgccaaccctactgtacctgacagcgccactccaaccaaatacatcagtgtgggactcgagcagaaaacgccgccgctcaaactaagccaacgctgaagagcagtttttattgtaaattatcatcataaatagaaagaaaaaaaatttttcaaaatctttt

SEQ ID NO: 2387 - DNA, 2698 bp, Heterodera glycines
atttttcctaaatttttaattaaaaattaagaaagataattcatcatttgaaccagtaaattaccgtatattatactggcctgttacgtgctccaaaatcaacacaaattcgttcaaccatttctatacatttatttggctccgtcaatgctcttgttttgccggtattaaaaaagacccatggtttttaatttcgggatcaatcaaaaaataacgacttgttcataaaatgtaccatttgattgctcaatcctgcacatgaaccgccagtcgggaacacatatttgtcaacatttttggggaaaagcctggaataattttgaaaacgataaaatataattttaaaagacttaaattgagaccgtcacaaaaaatgtcatattcaaataccgttcatattcttcttccgtaggatttggtttgcacaacgaaaaggcgaattgcaaattcggatcggatggctcaagggaatgcgatggttggacaaacttcaaagcataaaattggaccaaatagccaaaatggaaaaatagttgctatttccatatagccataaaaagataaataggtaaatccccaaaaattgtgtcctttttgtctgatttgcctttctttttacccatgcttcaatgaggcatttggagctgcggctgatgaacagctccatcttcagctgttctctttgctcttctgtttggtgtgccatcggcagcatgtcaagtccaagaagccaaaggtcggcataatccgccaaaaacgacagaccatttgaacggaggaaatcattttgcatggcacggccaccgaagtctgagaatggcattttgggaaagccgagaatgccaaattttatatatataaaataatgatttttttaaattctgataccaaaacatttttcattttcaccattttcttccaaagaaaaacgagtgaatcgaacagcagtttgatttgatgcaaaaagcacagaaattttgagttgtcctgcattcaaattatatcttaaaatatttaaaaaattatcttaatacaaatttatttttttgaaaatcaaaaatttaaaaattttcattttcccacttttgcttaaaataattaaaaatattcactgtttttgtgaggaaattgatgactccaaaatgatggcttttcctttgtcatttttggtttgctttggcactgtgcgaattttaatggcgcgccaaattattgtgacatttttgttgccatcttttggcatcttttgcacacattctttttcaatcgaatttccctggggaattaatatgtaattttaattaggtattacccaaatttaccattttagcgccaataatagattttcttttgacttttgaatttccgcttttctccaaatgattgcctcgttgaagcaaggccgtgtaacagatgagaatgctgtcaattcagattctcagtttattaaaaaattcaaattttatccaattcttagtttatttttttacccatcctcgcaatttccgccatcgcgagccatcagacgaaattcaattctgtaagggttcactacggtttcatttgatccattgttggcatggaattgtgccaatggactaaattgcactttcttgaatccaccaccgctatccgtcaaatggacacttaaattataatttgaaaatgaaattaagaaaaaaatttataatttaaatttaaaaatgaaagtaagaaaaaaatttttacgcatgatcagcagttgttggcaattgacaaatgatgcacattaagagaacgattaaaagagaaattactttgacaattaaaaaagtcatttttagtctaaaacaccaaagaacatagacagaaattaaattaaattaaattaagaataatatttatgtatattttttcctttttataataatatttaatgattaatttttatttatttattttacatttttaagagtttttccgtgtgatatagaaaattgttttggaatatttttatggattctgtcgaacatcagtgaaaaggatggggagaatggaaaacggatgaggatgaatcagcagtttaataaatcgtaagtccccatttgcgcctctacatttgcgcctcgcagtattttacactttttcgcccatttgcaaaaaaaaaataataataatcagaaaatattaaagacattccctacaaacgcttaacaaaaaattatttatcaaactgcctccgaataaactcttttaatttaagtaaatttataaaaattttaacaatttttagcgctttcacgcttttcggtggtgccaataggtgccgccggtgaaagtaattcaattattgtaaaaaactttctgcaaaaagtttcggatatttggtaaaaaagtgtcatttgcgtcattactattctagataaattttcaaatttaaaatagttaacctaaaactaaatatctgtggtaaaattagctatgctgttgaaaaaaagtgttcgaaaaattaacgtgtaaatgccgtgggcaaatgtgggaggcgcaaaaatggaggcgcaaaagtggaggcgcaaatgtgggaggcgcaaaaatggaggcgcaaaagtggaggcgcaaatgtgggaggcgcaaaaatggaggcgcaaaagtggaggcgctaatgtgggggcgcaaaagtggaggcgcaaatgtgggaggcgcaaaaatggaggcgcaa

SEQ ID NO: 2388 - DNA, 922 bp, Heterodera glycines
tagtttaatgttatgccttcctaatgagaaaggatatggaagtagcctcattaatttgtacaaaactgaattaattgccagtatgaaagtgagacaaataaaagaatgttacgtgcgtctacaaaatacactcataagaaaaggcccaaatatgtcaactaaaatgcaataaatgatataagaatttttgatgctaaattctttgaagcttaatacagtctttgaccttttcaaatccaattcaaaaaatttgttaatttaaaatttctctttccatctgagctaccaggccattccattcgagaactgaaatataatttaattggccaaatactatgtttgatagggtcaaatttgactgattgatggagctgttcctgtccgtcatgacgaatatgaacggctttacaattgcacggcgtttcccatttactccgtcccattggagcgacgacggcaatttgtggtcggcggaattgccaaatgcgtactgtgcgccatttattatgtgagtaatcaactgcaacaatgttaaaattggcattttggtcatggcgccgaaaagcaccgccgataaaaaatttgaaagtttagttgtgattttgccaatttccaataaattgtcgaaaatttccaatttttctcaaaaaattcggcaatcggaattcagacggcccaaaattttggaaacatgccaatgccaacaaattgccgaaaattgaagactttgccttgataaattcgacaattagaaatcggatttccgacccaaatgcaggaaactagaaattggaaacgaccttccgacacatttctggtaacataacaataaaataccaaaaattgccatagattctgtatgtgccgtgcatgtactcaatttggaagcattttcaccaaaatcttgctataaactgctctt

SEQ ID NO: 2389 - DNA, 2453 bp, Heterodera glycines
ttagtttgagcggcggcgttttctgctcgagtcccacactgatgtatttggttggagtggcgttgacaggtacagtagggttggtgccgggggtgcggtacggtgaccggggtgatgtcctcgggttttttcgtccccatttttctgtcccagtaacagggatccatcgcacccatccccgccggggatgggcataaaaacgatggctaaaagggtgctaggtcgtttcttaaaaactgtcaagttgtaggaaaataaaaatttaaaatttataaattcttatcttggattaatttcaataccaattaatatttcatggtgtaaaacaaaagctctaggggttctctatcagaatattaatttaaattttttttcacaaaattataagaaaattaaggtcataaaatttcaatatgtctttagttaaaattgtttgaccagaacttttttgaaatccagtgattttttgaaattttaaagataaataaagaattttagggctatcgaattatattattaattttggctcaattgtattttaatgacttgaaaattttaaatgtttatgcatgacaatggcaaaaaacatagcatattcaatgtaactttttttcagaagcaatttgatattctttttagagtctcaagttctctatttaatcgaattatctttaaaatttcttaagccaagatacgaatttataaattttacatttttattttcctacaacttgacagtttaagaaacgctcacttggcagtttttaagaaacatcccagcacgatctaaaagaatggtgggctcatcgaccagaaactaaaaaaacttttttttcgaattctccgtgaaccacccctgctgcaaaacccatccatctttccgtcggagtgggtaggtggacagaacaaacaattaatttcaattaattaccaattttctctctctatttaagttttttgggctgctgaaagtgtcgctgatttggtaattaataaaacaagaatatggcagtaataatttagcagattaattaggtgtttacactgaatcgctgtctcgactcgagaaaagtctcgggtttttttggtctcggtgtcgggttttcagtctcagtcttcgagacagtctcgtgaaaattttttgtctcgagcatcactaaaatctctgtctcgaactcggcttcgctaagctgtgccgtcattttttccccggccatcgcatttacgcatggctcttcgcttgttccctgtacgccctaggcagagccgtattcaacaaacccgtcctgtacagcagccttttcttcggctggttctacgacccgccgttcgtcggttatcgcactgctgatcagctacaacaacgcgaggaagtggggattaaagtcaaaaagtgccaaaatatatgcaaatctaaaaaatgcccaaaataaatgctattctaaaaaatccaaatagattcgacaaactaaaaagctttaaccaaatgtaaaaaaggtgtaataaacattatcgaataaaagaagaaattttataaaattttctttcatatgaacaatttcattcaaacaaatttttcattgatttttaaatccctgtttttaaatactatcgaatcagaaattaataattttgggtgcaaaatctgtaaactaacaataaacggctcaaattttcatatttcttatgctattagtgcttattactttgctttgctgtcattttccctaattgaaaacttagcataaaaatttctgcaatgttcggacgagtcgcagagagtttggcgttttggtttccgaattggattcagtacaaatacgggtcaataacatttatcgctttttatagatatactaaatcttaaaccattttctcttatgattttaaaaatttatttaatttttttttcaaatcaatttatcgtattttctctaattatcccccaattctgcttatctcctcaatgaacacattgacttgctctctttacttattctttcaaagccatgaagttgggcaatgggtgattgttcttgagtttatcttgtcaaaaataatgccaatgaaaaagtaaatgccaaattttgaatttaggttacatctgcatggtacggtactttaacgggaaccgctcagtccggcgccttttcttattatcagctaaattaaatatgccttttttgacctttgtgcctttttgatgtcttttcagtatttttttgaaaaatttgccacttttccttcatattttattacaatttccaaaaaatttccggcggcgcctgagggcacctccgaaccctcattttaccttgatatttgaaattttaaccctaaaatgggtaaaatttggcattttttgtgatttgaaaaaaagattgaaccggaaaatgcagattttgcttctttttttgcattacaaccacaaaatctatgattttactattggt

SEQ ID NO: 2390 - DNA, 1398 bp, Heterodera glycines
ggtatggaattgcgttgaaggctacacttaaaaagcactattttagtgaaatatttttgacacttttctattttttaaatatttttttgaagagacgggttccaaacctccggagcgtattccaataaaggcctaatataagttttatataacgtaacccaaatcttagatgatttggatttaattatccgaaacaaagaacgcatacgtaaatacgcattccttgttatttggttaacatgatcggaaaattgtaatttgttatcaatgtttactcctaaatccctaattgtatacacagcgtttattgtatttccatcaaatttataatttttcatttgggttttttgaacccaaataaagtacgaaagttttttgaattgagacttttattttaatacccgggcccggtttttgcccaaatactcgggcccgtgcagccctagtttaaatgagtttatttggttgtactaaattttctcaaaatattttttgttaatcgcttttaaattcggaatctgtctcaatacccagaaaaagactcttttagaatgcaattttgagtttggggacaatgactaatatttgccagcgtgctatgaagttactcaaaaacaccaaaataaagattttttcatataactttgctaaaaagcaaccatattttaactgttaatatcattcggcccctaaatgttttctattatcttgcaaaatttaaaatttcgtaatttgatttattttctggtgaagttcttttattttgatggtttttgagtaacgacccggcaccttagcaagcaagttcccctaggtgtcctctattagcctgcaaaatttcaaaaaatttcgttaggcttcaaaaaagttatggccaaaaatattcgaaaacctggccacatttgtacttatggccataactttgctcaaccttgccaaattttttgaaatttaagtgagctaatagagaaataaatgttagggctatcgaaatgtcttatttgatagactttgacaaaagttacagatagttttttgttcgaaattttcatttgatggtcttttttatactttttgatggcttttttataacggctcagcacctttttaactctttgtcgcggtttcaccaaggcacaacacaacgcaataaaaatgtattggcaaagccaagcatttgatttttgttatttaaaaataatttctataaatttaacaataaattctaaaatgataaaaaaaatatttttttaaagtaaaattaatcgggtaattattaagcatttaaaaaataaaaattttttttatttggtctttttttctttggctttttccttaaaaaaacccaagggcccaaaagggtccgcaaacccccccccctttttccccctattgggg

SEQ ID NO: 2391 - DNA, 1948 bp, Heterodera glycines
  misc_feature (86)..(86): n is a, c, g, or t
  misc_feature (130)..(130): n is a, c, g, or t
  misc_feature (1917)..(1917): n is a, c, g, or t
  misc_feature (1932)..(1932): n is a, c, g, or t
tttaaatttatatttaattttgaggaatcagcagcagggatcatttgaggggatcaccagggatccgggaattattttaaaagcangaattttttgggtcacacaaaaattgattaaattatcaaatatntaaaatagtaaattttctttttgttttttattggctttttaaaaaatgttttaaaacaaaacaattaaaaaaatattattgattctcatgattttaaaacaatcaacatattgaccaataattaaattaataaaaaatcaatttgctttatgttcaaaatttaagggattagcggggatcatttagctggtcaccattgatcaccaaaattatttttacagtaggagggtcacataaatttggtttgcttttaagttaaaattccagggggatcaacgtatttttgtttataaactcataataattttctttctattcaacggggagcatatttctcagaaaagttaaaaaacgaaattttgttttattcagcgtttataattttgtcttaactttggaaagtttgttttttgctgaaaaatttttggatcatatgaaatttgggttgctctgaactgtttaattcctgcgggagaatttattttattttgattttttaagtttccatttcaaccattttattctttttgacaagtgggatactgtagcgtaaagaatgtagaataaataaaagaaaaataaaaaagagcaaaaaggaattaaaaattcagagttggttcttatgattttaaaacaatcttaagatcgaatttaaattgaattttcgcgtcgatactcggtgggtggagggacgcttgctggggaggaggggagtgggcgcactttggggtgtagggcggtgccgtagggtgtaaggcctatgttattttaattaaattttaaattttattttaaataaaattttaattattattttaaattaaataattcccaaataattatttcccatcagtggggggggcgcactcattgagggaagagggaagagatgaactttattatatgaaatgtgaaaaataaataaaaaatgaaaatgataaaacaaagggatcagcaatgagggcaatcactgcggcacttctgcttccaatactcaacaatttgcctcatccttttgtcacggtcgcttcgacgggacgaagtggtggacgaagaagcggaagaggaggaggacaccgagctgaaggcagtgtccggtctattgtcaaacagaattgctcgggcggtcgcgatctgttcggccgagaggcgcttgtaggcagtgcgcacacattctctaggaatgcgacgtgaacacgttggcgtcttattgggtgggggtttacatttataggtaaaagtgggtttaggctaccgtttgcaaaacatcgcacaacggttgaggcgccggggcatcatcgagcgggacaatttggagtgccggagacgcaaattgatgctgttgctgctgctgctgccggtgttgcagatacggttggaaagtgaactgtagcggaggaagtaccaaaggcattgcgaatggtgggaagacgggcagtggtggcatgcgcatttgcaaagtgctgatcgcctgttggacggcagctgaaagcatcggcgatggttgttgctggtgctgtgttgccgggacgcaatgtgtcaattgttggtgttgctggtgctgatcctcctcgacatgttgctgctgctcctcctcctcctcgacatgttgctgctcctcctcatcaacaatggctgcgccgtcgacgacaacctccacgtccggtgatgggacccgggggaaaacctggtcctaaatcatattatttttttaaattttttttttttaaagtttttttcattaatttttttttctaaaagtttttcccagatggggaattggtaanttttttttttttaantttatttaaactgcct

SEQ ID NO: 2392 - DNA, 1679 bp, Heterodera glycines
tgctgatgatattttttaattttctttactttttattcaatatatgcaagttttaacatagaattaattaacaatgatttgtgtattaatttcagaaaattttctgatgggcctgcatggtaaagagagcaccctatatctgatcgattttgggctcgcgcgccgatatcggtctgccattttggcgttcactgatcattaaaattaaaacacaagggcgtagctaatttgtaagggggcgggggcggtaggaccacaaattttgctttctgaactcaattaacaatttttgtaggttcaaaagcgcttgaaaaattctattaacttgctaattaggtaattcattttcgttcatctataaaaaaagtcgggaccaaaatgatttttttctggccatagcattttagtaccgtattcatttttttttttgaaatttaattaaaacccgaaaaagcgctaatttgcagattttcaagaattttcctgggttttttcttagaatttttcttcattcaaatgccaattttattttttatgccaaggatgagtgccttggctgtggctacccccttgaataaataaaaacatttacatacacatttttggggtctgtatcgttttggcgccgccgttttggcgccagcccaagttttcggactataacttttttatttgttaaccaaatccaataatcttggtattattcgaaagcttaacatgtttagaagatatttctaagctattgcttcgcgattagacaattaccaaaaaagttataacatgaaattgcaaaaaagtcgaaaattttgaggttttttcctaataacttttttagaagctaaaatttttgtttgttttttgtaaggctaatagagcttgtgaagggctttcgaatgataccaagattgttagatttggtcaacaatgaaaaaagttgtagtccaaaacttgggctggcaccgaaacgtcctgttccgcgttaaaagccccccccccttagttggccaattgtccttgcaggtgtccttagttggccaattgtcctttcccttgtccttagttggccaattgtccttgcccttgtccttagttggccaattgtccttgctcgtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattgtccttgctggtgtccttagttggccaattaacgggctggtgtccttagtggccaattgtccttgtggt

SEQ ID NO: 2393 - DNA, 5436 bp, Heterodera glycines
ctttttaactctccggattgttatttatatgtctccccattaagatacgttctttgggtgaactgaacttggtcgaacgcgttgtccttcaccaatggcccgagtctttgcgagtcgaattggtaagcgaagaaagaggcataaaagtggagcctcgagagtcacaagtctctctcttttcgatttgactccgagagaataaatttcttgaaccaaattaacccaatattgaattaaattaggactgtaattgccaaatggcagaaaaaggaatttaatttgccagtttattaaattaaattttgatttaggattatttgcgtcgaaaattgtcatggacagagagggaggcatgcgaacagatccgcaaacagcttgttcttgacccagcaacaaaacggggaggcgagaaagacaatcggaggaggaggagaaaatgatcagtaaattgatcagcctcaattaaatgtgattcactcgatgatcacctcgacctctgttgttgatcgaagaatcgcattagggaaagcaattaacgggtggatggaggcgggggtttgtattttataaaaaatttccttgtccaaaattttttgaaatggaaaataaataatgaatagaaattttagttttacaatttttgaatttaatgttaaaaaaattttttgttgtttactgattcaaaaggagggcttccaactgaaaatggaaacaaaaaaattccaaataaaaaattttttatggcgcaactttttccaagaattttttgggaacagagggccggtaggcaccgccaggaaaattttcaaaatttgagtttattttgttaacagattttcacgtaaaatgaacaatttttcgattttgagcatttttaatttaaaaaaaaataagcggggtccggcaagaaatacacttttgttttgttttagtagttgatgaaaaatcacagaaaaatcaatgatatgtaaatccgagctcagattcgtggttcaacgcatttttttaccccagaaaaggtgcttcttaaattattatatttattttctcagaaaccacaaaactttaccattgccaaaattggaaaacactagtgatccaaatagggtgaaatggcgccattaattatgaattattaaaatcttaactaaattggaagaaagaacatcaaaaatattattcctcatgagaaagttgacaagtaaatattaatctgactatttaattttggcaaaatgttttgccaaaaattcaaaaaattccaattcttaccagtgcatttttactcccgttttttgggtaaaatttccaggagcgggatcgggagttcaaaattttccgggacgggagtcccgaacgggaatcccgtaaaaatcccgatcccgtaaaaaatcccgttcacctaaaaaagcgggagtcgggagcgggaatcccgtaaaatcccgcgggagtcccgatcccgccggactctaatttttattttttcaaaccaaatttgtaaaagttaaataacaaataaaaagagaccatttattcagagaaattgtaacaatggtaaatagtgaagataaaagacatgacgcacaaataaatggtgaaatggtggatgccaagaatagcataagaaacatagataacggatgaagcaagaaagaaaaatgtccctggggaaagcgtcaacaaaaccaaaagacgaaggacttggaaaaaattttaataccacgaagaacagaaatcggtgtggccgtacacccgtaaccaatggcagaagacgcaccacttcggcacggggaagcagtctcgcggcctacatgccgttgagaagcacctgggctccgctttcctccaaagttgtgaagaaaaaaaggcacccgtcgagggcagccaaaagtgcgacttaatagcgaagaattcgtcagtgtcttttccaaaaataaaggtgaagacggggtgaagataaatggaaaattgggccccttctatgtttcaagtcgttgtattggataaacaaaaacaccttttgtttgtttatgactgtattaaaaattaatttaatgatttcccttccgttcgtgcttgcgttcgaattgatccccgaacgacatgttcgttgtggatttacgctcatagtaaagcatgcacccgatggtttggctgactttttcggatactccacgagggtgtacgttggactaacagaaaacgaacaataaatttccagaaagctgctcgcgttcgcattgatccccgaacgacatgatcgtcgtggatttgcgtgggaactttcaagcatatacaaagtactatttcataaaaattattaattgtttttaaagttcatggcgttgctgcgcatgttccacgttttttttataaaggaaacacattaaatcaagaaagatacagtgaaaactataatttatgctagcaaaaaattaaactcacaataataataataataataatgaccatatagagaacttcaaaaaacactgcacattttttataaaaaattgttttttgtgtctaagcaaatgcgtttaatagaatgctttaatatcggcgtaacatttccatatatttctgaaggtgcgttaaataaccgttgatatccgaaacattttggctcatgaagaagaagaattatttttaatacatataaaacaatcgctttaaataattttttcttttaaagattttatttaaaattgccgcggagtcccagattgcagcggatcgcggccacagatcacggtcgcgctccacccctgatctgcgcgaatagtgacataattttaagcaaaaaattgagcaaaaataatttgttatattacttgcatttcgcattacaaaaaattaaaaaacaaataataaaatgtctctcgtcatttaagagaaatttatcatttaattcacttgaaatttaattccaatttatgattattattgttattatctgtcggcaatacaatcatcttgttggccttcggtaaacacaaaataataaaaaatcaaaaacagtgaaaaactgagcgggtagaagacgcgacaactgaaaaacaatgaaattattttaaaaaattaacaaaattattccacagtcagtggtttcatttttaaattctggcatatttaaaattcctggtagaaatgaagaaaaaatgtttattaatattagcctaaaaaatttcaaaacgtttcaatataaaacttatggcaataaagtgcgaaaatttagttgtcgattttttcggactcatttcgtgccgaaatgacctcttggccatgagagagtgagggtatattcataattgggcttaatttgaaaaaaaagattgaccactattggatgtttcccataatactctttgcatgagtcggcccacccaccaattgtccaggtaccgtcccagcttgtggtaacgtgccgcccggtcggccatcgcgtcgcgtgcctctcggctcagctccgccttgccaatgcgcttcttcgtcgcccacttgcgcaactgattggcccgcttgtccagcccgatcaccaccagcgtttgtaacagtgtaaggaacacaaagcctgtgatgtagccgaaccacaggtcgatggccttcagataggacacgctgggcaaatgctcgcgtgcgccggccgactcggtggacagagtcagcagaacctttgtttgtttgttttttgaaattatggcatttaaatggtgaagttaaaactaatgttctaaataaatgtaaatccgtatttttttcctgactatggaagctgaaacgttcaaaaaaatatatgtttttagctttgtttgaaccttctaggatggagttctaaattcatattttcccattggcattattcccatattttagtattttaagaccggaaaattcctcaaaaagcaaattttaggaaattatttcgagaatattaaaaaaaatatatgacttactataaaataagaatttatactaagaataaattaaaaatgaaaattgttcgattttttacttaattttcttgctaaattaataatttagctttattacaattttttcttttaaaataatttctaatactaatttagccgttttgaaaattttaagtttaatgaatctgaagaaattttgagaaattgttgccattttattgccatatttagcgatttttggtccgtattttatgtccatattcgctattatatactatggagattaatgatagtgagctaaggttgttcaataaaacaaaataaaaaaaggcttttatccagagctgcgatatctgagtatttttactcattttgtggttttttagagggtcaaaaaggatttttttgaaaaatgaggatttgcgtatttttgtggtcttttgacaaaaaagtgacaaaaatgcatgattttttgaaaaattaggtatatttggcaaaatgttcgaactttttcttcaaatcttaaacattttttcgaaaaatcctcagtcaaaatcattttttttgacaaaatttttaacaaatcgcactcaaaattccaaattttttccggcagcgcctatcggcactgccggaccgaccccctcccccaatgttcccaaaaagttttttggaaaaccacgtcacaaaaagagcaatttaaaagcaaaaaatttaagagatgcacagtgaaagcattggccgaagtgaagtgcaacttcgatttttcgagctcagacttccataaaatgcttataatagggtttgtaattatatggaaattcatatttttttcctgtactgttggaggcctgaaacgcatgaaaaacatgtttttagcttggtttgaagcctctatgaaggagttctatatccatattttccatatcgcaattttatgatgttttaaaaaatgagtatttttcattccaaatgaggattttttgaggtattttagtggcaaatgaggattttttatggctgaaatgtggattttcaaaattttgagatcgcagctctgggatagagtgagtgagaaagggagaaaatacagagagtgagtgagtgagagagaaagaaagaaaaatatggatgagagaagaagaccgagaataggagagaagaaaattgaagccacgatggaaagaagttattttttaaaaaaatttttacatcattttaaaaattaaaatagagcggttggcgcccaaccgctcgttttttaatattttgcaggcaaatgggcttgaacctctgagccgcaaacacaaattttaaccaactgacaaattagcattgtttgaaaaaaaaatttatctccctctccccaataattttacggatatgcaaatccacccaattcagatatttatcttgtgtgtataattaaaaaataaaaaagtttagtaaaagaattttttttaatctgtgtactttaaaatgggatagaccctgccaggcc

SEQ ID NO: 2394 - DNA, 1658 bp, Heterodera glycines
ttttcaaaatttttagattgcagctttctttttatcagtgatcattgtatttttttatgaatgcctctcttgacgtaatgagtcattttgtctaattctggtcttggttcatactgtaataatatttgaaatagtaagcctctggtaaatcttaccgtaatcgctaccccgatgcgcccttccataaattcttcgggtagccaaacgccgacctttagaaaaatttaaaacctgtaatttaaaattaaatgccacacaaacccatgaaaacattagagccaatgaggtggggatgtaagtttgggcaatgtgaaagccgacgtcacgcttcagacggaacacggcacgaagacaggcgaattcgccactctttctggaccgattgcactaattaaatatgggacaaatcagttaattaacgacaattaaattaattgagtagtagatttaaattttgtctatgtatgacttacttttgccggctcgtactggtcaatgtacagctcgggaagtcgcacgtccgggtttttatcaattgcgtccagtcgattcgtgaaccattcaaagcgtaccgtttcagcggcataagcaacttgaataacaacatttagtccacccgagactgatcaaaagtgattagaaaagctaaggttggcaataatcgagactgattggaattgactgtgatcttgggactgattgaaaaagattgacacccgtctagactgatcaggagtgatcagagttttgctaaaattggcattggtcgagaatgagtggaataggggggacaagatcttagcattgttggaaaattattcaaaccctgtcggaactggtcagaatttagaaaatttcaattacaagattttatctgcagctcgcacgtctgcttgtcatgtgggtacttgcatagcaccaaattgcaggccggcttcaatttgatgcgcgtttcgtacaaaattagtccgtcactgaaccattatccattttttaaattcattttacttatttaataatgtttaacagcctttttttttgattgctattttgattttaattttagaaataaatatatctttctgattgtaataatgccaactgctgtaactgacggacctgtagatgcgcatcaggaagttcaggaaggtgacctcgtgaaattcggcctccttcgcgtcaaaaaatgggtcagggcgccaaatcttctccagaatgtcctcctccttgaccagcaccggcttgccaaagttgttcaccagccgcgggtcacgccagcccatgatcaaatagatgtccatgtcgtagtcctgattaattagtagtctcgtgactctcggtctcattatctcagtcttgagtctggggataaatgtcagcaatgacttttccttctctcgggtgttggaacaaattatggccaattctcgagctaattctttcagagtcaggattatttgtcggtctcgaatttcgtcgaggcccaaaacttcagttttgagtttaagtctcgagtggccacgagtaattttcgttccctgacaaagaaccaattcttttctctagtctcgaggtctaacaagaagcccagcttagttacaaaaattcgggatttgggtttaagtgtgagtccaatgtaaaatcatagcagaattaat

SEQ ID NO: 2395 - DNA, 1884 bp, Heterodera glycines
gatttgattcatcaaattcgtttgatatttcattcttgtccatatcactaaataggcaaatgaaacaaatttttttttacaaatttttatttagttaatccgattttctttgattagaccaactcatttatgcttaataaagaaggaaaatcgcgaagtttattaaatggattccaatagttgctcatttaattttatactagaaataaatttaaaattaaaaaaataattttaaaaataaaatatttcatatttttgcttgcctcgttgtgctgctgattttggatggcggaatctgttctgttactgctttatcccctactccatcatccgcttttcgttccttttcctcatcttcatcctgttcttccttcgctttgccgaccgaattgtccatgcccggcttcgcctcaaagtcccaagtgcgcaagccgggccgccgttttgcggagacacaatgtgccaacaatgcgaaagtgagacagagtgtcaacaaaaaatgtgccattttaaactgtgccaaaagccaaaaggatgacgatatcactttctttaggcttggaaccccgattctgagattgaaaacaactcgctccgattctgacatttatgatactcgaaaaactcaaagtccgattgatacaaaaatgaaatggtcgtcgaattttttttttttgttgaataaatttataaaatacactaattgtttcagaaaagtgcacaaaattgtgtgacaaaatgacggctgatcagtcaaatgtaatcattcagtaaattgttttggtacaatcactgcgcaaaataaatcaattagcaaaagggaaaaaccaatgcagcgtaaagggcaccacacaatcagcgccaaaacggaaaactccctcccgccaattcagtcccaaataactctgttccatttgaatggggacttccatatacatatataaaatgcaacggggtaaaaaatacagggccaaaattttaaattttgtttttcccataaatgttttagttagagtttaaggacaaaataaattttgaagaatataaaacgaaattgtttctttcccaagactcagtccgagattcgagatagagtcaaacaaatcacagatttttctcgagccaagagttttccaaaatttttattatgcaattaatttggtaaaaataaattataagtaaaaagtcattttttgatgctttccctaacaaattttgttttttttaaacaagcctatggcgcggagaatacttttgctcagctatgaagatgtagaagattagtcggatgaaacatgaaggaaggggataagagatgtaagcggtaagaatttaccaaatacatttttattgaggaagtcgataattgacggttcatattaggtgacctttgtattttaccgggccatcaacgcaattaaggcagagcttcgatcagaaatctttaaaaataagaacatcggcctgaaaaaaaatataagattttggggtcaaaaagactagaatattttgcaaacaatttcaaatcagttatttttataatttacctattcgatcaaaatgatgccttttttggcgttttttacgaaaaattccattaaaaatgcaataaattcgggaaaatacacccctaagaaatgacccaaaaaatttgagaaaatatatccctaagaattggatttttcctcaaaaattgatcgccaaaatttattatttttttcttgataaaaaattttaggtttaaaaattttccttattcgaaaaaattattaaatattaataatcatttaaatgaccaacattaagttttttgatttagttttacgtattttgatctcaaaaatccttaataaaaaatttaaatgcctattttaatgccttttt

SEQ ID NO: 2396 - DNA, 3237 bp, Heterodera glycines
  misc_feature (1059)..(1059): n is a, c, g, or t
  misc_feature (1100)..(1100): n is a, c, g, or t
tattttatgactataattctaaaaaatgaaaaaaatactctgaagaaaatcaaagacttgacaaaaaaatcaaagattagatgatgtcatatgacaattatgatatcatattcgtgatcagcggcctcgataaccctcgaatagaacgaataatcgtaaaaggccgtctttttatttcctttttttatgggaccagtaaaagtcagtattaccgtaacgtcaacggttttctgatggttcggagtaactgggaaacgccaatttttaatgttcagagtgactggtaaacgacaattttaattttaattgaacgatttttcaaaaaaatttacccaatcaaaagtgccatattgagaaaagcataattgtcattaaatgattcggtggaaaaaatttcgtggggcattttcttggtcttcaacgtctgtccgcccgatcagttgccaccagcttcgcccgcctcaccaccagcctcctgctcatcgccagccgtgtcggatgtccaaagcgtcaagttgtcacgcaacagttgcatgatcagagtggagtccttgtacgagtcctcgttgagcgtgtccagctcagcaatcgcatcatcgaacgcctgacaaaaaaatgaaaaacgtaacgaaaatattctttttttgggggaatttattaatattccaaataatttgaacaaatacgttgtacctaacatgaaccaatgacccaaaaatcaaccgatccaacaaattaaggttttaattaaacccattgatttttttcttttgccaatcgatgcaaaaagttgatgcttcccaacctgtttggcgagttggcacgccttgtccggtgagttcagaatttcatagtagaacacagagaagttcagcgccagaccaagacgaatgggatgggtgggctgcattttgtccttggcaatgtcaaacgcttcctggtacgactgctgcgacttctcgacaacagctaaaaaaaatttgtaacttaaaatgcgataaagcaattcgacacacgcacccgtttcggtcgtcaccggtggcaacctcagccaggtangcggtagtagtcacccttcatcttcaggtagaacacctttngattccgggttgccagcccttcgggatcagatatttgtcgagcaaatccttgaaaatttggtgaatttaccatccaagtttcttataaaattttcgacacaccagcacgtcgtgacagatctctcgcaactcctgctccaccttctcccgatactccttggccatctgctgcttcttctccgagccctcagtcttctgttcaatggacgagataacgcgccacgaggaacgacgcgcaccgaccacatttttgtatgcaaccgacaacaggttgcgctcctcattactcaactccgcacccaattccgtcaccttcaaaatgcgaaccaaaaaattatagaaattccttagttttctttcccccacctttttcatcgactgagccatgtcatcgtagcgctcagcttgctcagccaacttagcccgctgaacgagttcttctttgttgtcagacatttttcgaaaaattaaataggtctagacgattttcaaaagataaaatttcaattctcctgaaagttcaaatctgattgactcctttaaatgcaaacgtaacaatctaatttatatatttaagcacacagcgagcaatgggaatttttattgggaaatagccctgagtcttgacgagggtcgtgagaaagtgggcctaaagttgcgcgagatttgtcacaacgtgctacatgttttttcgttccttttcattcagtttgaggaaagtgaacgatgggggagagcagaaggaagagtgggggcggggggggaaataaaatgaggggcagaggcggccgaagagttttctctttctttgctttcccacctccaaatagagagaaagagagatagagagagagagaaaggaaaagagagacagtgggaaaataaggggaagaaagtggagggcccgtctcgcgatggaaaaaacgctcagcatttgttacgcatgaagggcgaatatgagaaacgcaccaattccgagggatggaccgatgggtggggcgatgcttaaatcgagggaccgattttcaatgcattttgtgctaggaaaagagacaggggaaaaagagaaaaaggaaatttgtagtgaaagagaaaaaggcagaaataaatagtggataacgcacgaattccggggatagacacgagcaacgcacaaagaagcccattttgaaagtgggcaagggaccgttaaacattgacaacgacagaaagtgcgagagatgaatgagtcagcggtggaagaaaatgcgaaaatgcaatgagacgcaccaattccagggatgggtgagcagtggaacgaaatagcgttaattttttggagagtctgtggcggaacaaagtgcaccgatttattggaggtgagagaaaaacagggaatgtctcgcattgccaaacatgaaaggaagaaaagagcacagagaaagaggacgtttgtgtaagcaagaagacgcacgaattcccggggagagcgtcgagattggcacacagcagaagcaagcccttcgagcagcggaagtcgtttatgctatgcttatttgcggtaacgaaggcgagaatgttcaactaggggccgtctctcatttaacaccagtgacaagtgtaagattgtcattctaacaacaatgtaggtacagtatgtataaaatggcttttttggcgccataaaatttttttaatttgtgactatctaatagggttgagcggtaccggtaccggtactggccggtaattaccggtttttttggtaccggtaccggtaccggttttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaatttaattttatttcatttagtcatggaatattcctcacattttctttaccattattttaattaaaatttaaattttaaaaaatattccaacttttttctttcatgttaagcatcctaaaaacccaaaacttaatcaattggtcattttttttacaaattctgttaacaaatcgcattaaaaattacaaaatttttcccggcggcgcctatcggaaaggccggccctcctttccccc

SEQ ID NO: 2397 - DNA, 2500 bp, Heterodera glycines
  misc_feature (758)..(758): n is a, c, g, or t
attttggaccaaaatataaagttaaattaggcaccacaattctgccacattgctagcaattgtattaacatggttctttaaagaaaaatggcttataattatccataaagaaagacaactaaaaaattttctgaaaaattttgggagatttttcaactctggcgcaaaaaaagccattatttatataggcgccaaaaatggcccgcgtcaaaaaccctcgcgccaaaaaacccgcgccaatgacagggcaaagcagtatttttaaatttaatgaaatttatttccatatacatacatactgtacataattagtaattacaagctctagttatggcctatgttaagaaacgcgattgaaagcgcttaaaaataagctaacgagcgcatgaattcctcggtgtgcggacatctcgcctactgtcattttgtgtaatgacatttccaaaatcggacgtttcgcctactaacctaaaatcggacgttttgcctactaaccaaaaagcggacgttttgcctactaagccgattcggacatttcgcccacttaaccaaaaacatcatcaaaaaaatcattgatatgtatagggcaccgaactggctgcgccgaaaaaacccgcgccgaatggcccgtcgaactgggcgattcccgttttcgatcattttcccttgaaatacggtagaaatcagtcatttttgagttgtccaacttctcaccctctcttgctctctgggtataagtcatagacccaccacccaanaaggcaattcggtagagaattttgtgctctttccaatgggtttatttattttctctaaaagaattttcccaacctcctaagaatttttttcgaaaattttcctgatttttagtgtattttagggtaactctttccctatgcaggagtgatcactgatcagataagttggtgtaaaagacttttttgaaagtttagtccgtagtccggggcccaaaacatgataaaaatttgaaagactcgaaacttttttcatatgagttaaattgcttagcattcgcttagagaaagattctcttttcaaaacttttcgaatgatatcaatattcgatttacttggtgggaatgaagtgaattatggctgatctaaataaacaatacaataaatggcaatgatcagtgtaaattttgaaatagcgcacaaaattacgaaaattggcgttatgtatttattcattttgtctattttaattttctgttcctgacaaatgagccttgagcttttgaaatttttgagtttgggtaattttggcaaacaatgctaacccttctgttggccatttgtctttctttgggcccatttttggcctatttgtccattgcacttttctctcaccgttttttgatcgtcgatcgttctcgcaatcggccaatttgcacttcgcccggctgtgtccgatgtaatcggaatgcaaatgtgagttttttggctctattgcgctttaggcattcaatcaatgattgtttttaggccatcttggaatattcgaaaaaaagagaatttaatgtttctcattgtaattttttaaaggggtttttagtttacctaatttattttctaatttctaatttaactttatttttagtttctaatttaatttaaaagtttttccccaggaactcgcttccgccatggaccgctttcaaaaggctcgtttcgccgcccgcgcgcaattcgcacgcgttcggagtgcgctcgagcgcgcgcgttgcgcgtcggtcgacgacgcgcacgaacttttctttcgcatgaaatttgagggtgtgcaacgacccgtttggacgcgttcgcaactgccgatggcttttgtcgcaaaaatggaattatttgaacgccaacacgcggccattgcgaaggaatgcgaaagggtcggcatttggcaagccattttcaatggaaattaaaaatagacttgaaattggcgcctatcgaaaccaccagacgccctatgtttagggttttcaattattgaacaataaactcaaaaaaataactacaacataaatttatcatccaacttttatataattttttcctcatggcgcctctttgcaatgtcgaaccacatcactagctactccgattttttgaaatttttcggatcgttgttttgtttggcaatagttgttcccaagtttttgtttttttttagttcaaacattgataaaattcagattttcacccaaattcaaaattaaaaaaaaatcatttttcttaatccattttccgcatttttcatttttgcccgttaaggcacttgaccaatgcccttatttgtgggcccggaacgaggaaagggcgcccgcactgcacacggacaatggcgcggccttctccgcttggttcgtttttccgctgatcaaccagggcgactggcaggaaaaacagtgtcgcgagtgcccgcgcatcaccgcattactccagaaagttggccaccgacgacggcgtcgttggacaaccgacg

SEQ ID NO: 2398 - DNA, 2459 bp, Heterodera glycines
  misc_feature (26)..(26): n is a, c, g, or t
accaaaaaaaaaaagtgagacaattnagaaacccattgaaaattactcaattttatatgggtgatagggagaggaaattggactgattttttcaaaactgcaacaatactttcccaacccaaatttgttttcaaaaatcacatcgttcttgctgtgattaaataaattacccaattttccaaatttgcccttcagtttctgctgtgtctgactgttcctctgcttctctgctcactgactgtctgttcggcaatgttttcatttctctgctgcccgctggcgccacaattgcggagcaccgcgggctgaccaacgcgcggctgcgcgttcacttcggcgtacgcgtgcccgagggcaaatcggccgagcactgctcaatgaccgtcgggggagaggtgagggacaaggggacgggacaaatctttccgggacaaaaaccgccaaaatttttttttaattttcaaattagagattcttcaagaaaaaaatcttggaaagtttttttagcgttttttcgagatttatgataaattactaatttttttcttgaaatttcttataaaaaaatttcataaatttatttataaaaaattttcataaaataaaataattttttttaatttaaaatcacttaaattttgtttaaaaatgcctttgtccctttcagaagttccattggtccaatggctccgctattgtcatcgacgattcatttccgtaattcttaccattttacttattaatccgttcgttttgccctccttcaggcattcggtcaattcccgtgcctgttccgaggatcggctggtgctcgttctcgacttttggcatcccaatttgcggccccaagaaaggcattgcctccagcgcattttccctccgatttacgtctcatagaattaatttgataatttctttatgcacattttatgcccagagatattcacttttttatttgttgtttatttatctttaagcaatttgaattaaaaattttctaagaaaggaaaatgaccgactgaattatggcaaaaaataagaattgtaaaatacgagatcaaattcatgatcagcacttttccccaaatttgcgcctatgtccaaaatcagattcaaaattaagttttttcagtctcagatagcctaaacagattaattgatagaaagtgattgtgtctgatagtttgattgttagtaaatttttgagaaaagtcattaattattcaaacagaagaattaatacccctaataaacaagaagactgcgttttcttaattctaatgctgtttaggctatcagagattgaacaaattgaaattgaatccgattttggacatatgcgcaaatgtttgggcacgctttttctaccttaaaagacacggcttaggaaatttctatctttatttatttttcagcgggaccacaattcttaacaattacacaattgccattgtttgggcatcagattatcagtccatcacaagtaattagaactatggcatctcgaaaacacaggggtttaattgaaaatgcggaatatttatgaaaatttagaaaatattaatgacaaaatattttttagagaaactcaaatgcccaaatgaggccccaaaatggtcactgacaaatgaattacccttccaaccgttgcatttgccccttcaaattttttgcactaattaatttatttttgaaaccgaaccaaaacggagatcactactgcccaattttcatgtgactgattattatgagtcgagtggcgagtgatctttggttggatcgccgcctcacaaacaaacaaatttttcgaattttaccatatccaatcactttgcaaggccaaagaattagcaattgtgaaggattcaaatgtttattacaacaaagcaaacaaaaaaaagtgatggaaatgggaaaaaggcaaaagagagaatgagagaatgactgtttaaaaggcgccaaaaatggacaaattgtcagccaatcacacccaattacattgcctattagttaataattgtccatcaattaacccaccgatgccttcccccatccgccttttcactcttttctctcttttcctgtttctgcttcttctcctcccatttttgtccttcgccgctttgtccccccgagagaagcgccaattcagcttcaccgatggcttctcaagtggcacaattttgcagccgggcggcggcggacttttgagttggtggcggagatgagccaacggcggaagtgaagcaaaacaatgggaaagattttgggttgtgatttgatttatgacgaatgaatgacccaccgataaaccgacttaccagaccataattcattcattcattcattcattcattatgccgtgccaatatcccccacccatcctttttttgtaaataaaaaatttaattaatttctaatgttttttaagagaagtttttttaaatttatttatcgaa

SEQ ID NO: 2399 - DNA, 4004 bp, Heterodera glycines
atcaattaaccctccgatgcgtcccccatccgccttttcactctttctttcttttcctgtttctgcttcttctctcccattttttgtccttcgctgctttgtccccccgagagaagcgccaattcagcttcaccgatggcttctcaagcggcacaattttgcagccggcgggcggcggacttttgagttggtggcggagatgagccaacggcggaagtgaagcaaaacaatgggaaagattttgggttgtgatttgatttatgacgaatgaatgactcaccgatcaaccgacttaccagaccataattcattcattcattatgccgtgccaatatcccccacccatcctttttttgtaaataaaaaatttaattaatttctaatgttttttaagagagtttttttaaatttatttatcgaacaaaccacaaggtgcttgctatgcactctaacagtggcgtaaaaacaaaataaaatgaaaatcaaataaaaacataaatggtagtcaaaaatcacaaaaatacgtgtcaaatcacaaaataaatgtcaaattaaacaaacaatagatataaatcaaacaagtcacaactctcaatagggaaaatatgcattatttcttaattattccttttgctatttctcggaatttttgggggtcattatttccataatatttttcggtaataaattccatgaattaataaccctattaaaaaaaattattttttgtttttgtaatatatatcctattttgtaataaaaaaggtttgcgaatagcaacagcaaaaaaatgagatgtttaaggtgtgtatgttttttttaagattttaaaagttgttgtaatatcattaattttgctcctaatttccaatgtcttaattccgcaaatgtttaaccgttcttcgtacggcatgggaacaagcccacattttttgaaggcttttcttttaaaaagtttttaactgcttcaattttgcggaccttttcttttttaatggattccaaatctctgtggcgtattctaactgtggtctgatatagtttttatatgccgaaattaatgtttcaagcttccgagtttataacgctcggagaatgttgggtttgtgtttaatatgaaaaccttggcttaattacaattaatttattcccaaataagcatatgaaatgagaatataccactaattgggttttgcatcgtaattattccattattattttttgctaattaccctaatgataatgatgcgtttctttgctttcgactctttcactcattcattcggtcgcaaatcgcatacgcagcacatcaaaaggaaacacaaagcagcgacgccgaaggcggcgcccggcgcccaactggcgacgggaaaaagctccattagatccaaaaggccaacgacgaggctaatgacagagcaaagataaagcagcacacagccgaggcgaggattgcgtcggcgctttcttcgcccgtacgctttaaaagcgatggaatgggcagtgccaacggacgaatcgaaggaaaaagcgatggcattggctaaaaacaaaaagacttagcaagtgatctgacagaatcagtggatacatcggagtaaaaacagtgccatgaatgtttcggcatttcttatttacctttaattgcttcgaaaaaagctttgatcttctcaataacttttccaatatgattttccatattctctttttttgtgccttcgattttgctaattgcagcaaaatcacataacttttcgtaaattttcggctcaatttccaaaatctcatccaattttagcgagggttcgccaatatttcccatcattaggccaatgctttttccattttccatttctcggcaaaatttctttttaatttttgaaattttctctgccttttcttcgtccaaaattccatttccattgtcattttggcagcataaaatgccaaaaacattcatttcgaaccattgcatttgttcaaaagctgagagtccatttttcgtttcacaatttgcccctttttcataagcaatcggtggtgccgaggcacgcaatttctgtgccatttggaaaaagtcttaaaattctgatttgttttttaattttataaatttttctaataccattttgacactttgtttccgaattattttgctcgcttaaattaaaaaataacagaaaaagcgtaaattgtgacaaaatctgcagcattactctgaatatgtattagttaattaagtgattaaaattggatatatttacaaattaatattttaatgttatgtgacatgagaaaagtcactacaaatatgaaaagaaacaatttaattattcatttgggtttacactgatttttgaatatacttaattctgttttaatgcataaaaataataaaatttgttaccaaaatatatatatatatatatattgcattatcgtgcttattattttcattattttaaggaagtaaacgctaatgtattgattcaaaaatggcaagatggcattttaggccagcaattcgaaaagtgccacctaaaaaacagaaaaaatcagctggattagacatgaaaaggaaaattattcaaatagcaaaaaaaaaaagtaaattttaagggaaaggaaatttgacaatttttaaaatttaattgcctttggaaaaaaaagaaataattgccaattgaatttaatgggtggtttttaggggtaatgaacctgtggcttcatctgaaaatgcttgattaattttctctgtatagattttgctaaatctaacaattttgaggatttttttttgtgtgacacctgataatgagtcgaatttggttctatttttggttattgaacttggtttggtttgcggttgttaattaatttgctttccaattaatgggtcattaaaatttgcagcagccaattgaacatttatttgttcatcactttttacagttaactttcagtgatcagaccgaacaaagtcattatcatttgatttcttaattgactgatcttcggttggatcgccgccccttttgggtcggtcggtcgctgctgcgcaatgacaatttctcaccattaattacacttttaattgcactacctttctgcgcaactttaaaagtcatcaaattaatatcaaaaaaatagctgaagtttaatttttgcaaaattaattcatcgatggataaaaaataacaaagcaaacaaaaaaaagtgatggaaatgggaaaaaggcaaaagagggaatgagagaatgactgtttaaaaggcgccaaaaatggacaaattgtcagccaatcacacccaattaccattgcctaattagttaataattgtccatcaattaacccgccgatgccttcccccatccgccttttcactcttttctctcttttcctgtttctgcttcttctcctcccatttttgtccttcgccgctttgtccccccgagagaagcgccaattcagcttcaccgatggcttctcaagtggcacaattttgcagccgggcggcggcggacttttgagttggtggcggagatgagccaacggcggaagtgaagcaaaacaatgggaaagattttgggttgtgatttgatttatgacgaatgaatgacccaccgataaaccgacttaccagaccataattcattcattcattcattcattcattcattatgcccccgctccttttattgtaaataaaataaattcagaagcgatcggccttaacgtctctagcagactttgggctcaattttactaatttttaagttcgactcgattaaaccaagcaaatgtctttgctcgtggttcagactcttcggtagcttcgcctgattctcggtttttcttctacactttctttaccgtattctcttgcaaattcttcacattttctgcaactttttgattagtgatcatcagatgatgtatttgttgatttgtcctttttttctaattatcacttcctttaaattcctctttcgttttcgttgtgtt

SEQ ID NO: 2400 - DNA, 1846 bp, Heterodera glycines
  misc_feature (330)..(330): n is a, c, g, or t
  misc_feature (350)..(350): n is a, c, g, or t
ttttccttttttttggccttccccgggttttttaaaaaaaaaaaaaaaatggtgttggtttctttttccaatgggaacctttttccccaagaattccctggcgccggtgtgcccatgcgaatgtcccaccgaagaaacgtctgaaacgcctccttcgacgggtggggaagggggcactgacgacatcggtccggcccgacccgttcaaaaatcaaaaatattgcttacaattagtgtgcttttaacggcggcctcccttttttagtgacctcgccggaaggagaggagacgaccacgcccgtctccggttgtgtccggggcccgccgggncctccgggccccaccgggcnccagcggggccaaaggggccccagggaaaatgcggcgacaatgcgagcaaacgcaaaagggaagcagcagcagtgccgaaggagtttatggtaaaagatggaaaaacttggcaaatgaatgccatcggtgattggaaaatcaaattaatagtactaaaagatactaattatcttattccgaatcattgttcaaaccttttaatcttaagacgaatttggaaccgaatgtgccagtcaaacgtgcaaaagaaggagaagccgttgcaaagacgcattttgcacgtggccatgtcaaggggggctgtccaccgggtcccccgggggagcctggcactcccgggcctccgggccctcccggagacccggcgccatgcccgaagcacatgaaaagcgaagcgcaaagcgtcgatggcaaacaactggctaacagaaacaaacgtggggagacggtgctgaatgctgcaaaggaggggaccgaagtgaaacgccaaattgtgcgccatgggttcgtttttgggcaaatcgccgtgggcgaaacagtgccgaaagtgcaaaattgagaccattgttttgtatttggcaacactattttcaaactcattgatgagttaattaatcggtcgggttgaggggtacctaacaaaaatattggaatttaagcattggaccgcccggccccgccggaccgccgggagaagcgggcgaagacggagagccgggcccttgcgaatgttacaaagaccaaaaaagtcaatgaacgaacgcaatttatgcgaatagcacacgaaataaaactagcaaatttaatgttttttaaatttattttggtgaaaaaattttttattgctttaaatctgactaacttgaattttgactgcattataaatgaatcaatttcttatttggactcccgccggatattgaaaatgatcgtttcatttccaaagtttagattgcttcattaatgaaataattaattatttaaagggccattacggactggccccgttccaaaaattatttttcatagaggtcccaaacccatgaggggtgggtgtgcccagcaaggagaaggcaagaagaaaataattattactatttggaatggggagtagacaaggctagagttacacgaatggtactttagctctctctttccctctcatttctctggaatcctactctatgtgtactctctctcccaccctttccctctcgtttctcttttcccctacccaaactcactcttcccaaatttaggcagaacattttgtgctctttctaatgtttttttttgttaataaaaaaatgtgttgaaaggtgccgggaagggaaaatcaccaaaatattccttaatttagtacactaatgtttgaaatataaaataaaagtggccgagtgtatttgaattcgggtaatggaacggattattttgggcgtgccattggtaaaagaaaatgccctcgagggattgaagccaatgggaaaagggggaa

SEQ ID NO: 2401 - DNA, 3679 bp, Heterodera glycines
tcctttttcctaccccgattcgatgtctgggtggaatcatgaaagtagagtcaaggaatttcaaatcttttttgacatattttaacttaggaatgttttttttaatttcaggggcttttcaatttcatatattacgaatatgacatccgtttttaccgataacgaaaaaaaagctttttcgaattttcagtttgaaaaatatgtttataagcaaatgaaaagcattcctaagttaaaatatgtcaaaaaagatttgaaattctttcatgtttcgacccaaaaaacgaatcgggatagtaaaaaggagtgggccaaaaacgaatattttttttattctaactcattttttggactggaacgtgaaaatctaggtcaactcggcgatatctttttgactttttggactctttcaattcaggatgctttttaagttatttttacaaaactaaaatttgggtcgtaaactattcaaaatcacttaaaactatataaaaattctcgaattgaaatagaccaaaaatatcctaaaacttcgtcgatttgacctagattttcacgtttcaatccaagaaattagttggaacaataaaaatgagttttgaccaaaaacaagtttaagttttatcctttttcctgtaaaaactaacaaaaaagtcaaaaatgaattaaaaagcaaaaatggtgaaatatggatatatttattcccgaaaacctccaaaatatggatttacatggactaaaaaccttcaccaatgcaaaaaattgctaaagttcgagcccccttggctgcgaattatttttaaatcttttttcaatccaaaggtgtggacctttaactgtgcctatacacaaaaaaacaaaattttttataattacgaaaaaattgttaagaattcgtaaaacatataaatttatcaaatgtgctgaaatgggcaacggaatttgcctacccgtaggacttttttcgaaatttcctatttaaaatatgttgcagttcttgcttgagattcgcctcaaatactgacaaagtcaattacgacgtgatgttaaagcaattaacaccaactttcacacacttttcaggcaagacaaaggtagtgccgaattacaaaatcattcatcagtgatttaactgataagcaaacattaatgagaccaaaattttctattggacatggtccggaatgttttactacaacagaatgacgttgaaagaagaaccctaatcagcatttcccgtagaatgctcttcaaaattttaaagcctattctgatgattacagacactcaaaacattacgaaattttcgacaggctcaaacttagctttagcatctggtctgtcaacaacgtgacgacaacgtgattctatgattcgaattgcatatttcacagcaatatatgctaacagtaaaaggaaattttgaattttttgtcatttcaaatttgaattatcactccataacagtatgttgcactagaataaggacatcccattgttcgagtgttttggcacttctcgtgaaccggttgagctataattttacctatacgtaataatcctgaaaatattaagtgagcaatcgcaatgacgagaagtatgtttttttttctaaaaatagagttttgctagaaaagaaacgatttttcaaaagactgtaacgttgtgaattgagctataaaaaaacaggcctgtaagatatggtgttttatcatcattttgttgattaaaagtggccaatatgattttttgaggtgctggtttctgatttttgagaaatttgctgattcgaaaatcgccaattagtgaaaacctttaatggtcataatttttatggcggcgcctatcgacgccgccggcccccaaaacttttttcttaaaaaatagccaaaaattgatcatgaaaatgtattaacaaattgagccaaaatttgcaaaatttttttcagcagtacctaccggctccgccggcccctattcgcaaaaaaattttggaaaaagcgcaccgcaaaatcagttatgattattttgaaaattttagccctcagccctgataaaaattaattttaaaataactttggtgccaagcaaaaaagtcaattacactattagttcactccttgatggtgatttgcaaatccgaaaatggcttgagtcaggaaaattttcgaaaaaaatttctagcagtttgaaaattttccgcgtaaattattcggctcatccaaacaggcataaaattctctagcaaaatggccgttggataatgactattatgacgcgtatttgcttaggcgcgtttagttaaaaaaactatataatgtagcagaaatgaaggcaaatttgattaaaactagtcattttttgggttgtcgatatttacccaaacgcgcctcagtggagacgcgtcatagagccatcatccaaaggcaattttgtaaagaattttatgcttgtatttttttctgataaagtatttttaaaaattaaaagtttcggcagagaacttcgaaatccaatgaaatttgccaaaccctgaaatatgtgcgattttataagtctctctaaatcaaaattgttcggtgaaaaagctatttttggacttttcttgccataactaattgtaagccgcaaaaaatatgtaaaaacataaaaatccggtctctaattataatttataataatttttcgtggaaaatgttttcaatctgctaaaaaaatattcaaaaaatatgtatgctaaaattttaaattgacccataaaaccttttaacaaggagcaaacgaaaagggtattatatgtaacgatagcataatcaatgggctttcgaatgataacaaatgtatgtaaattcattccattccgccgatatgcatcaggcaaattgtaccttatccctattttgggtggtcatatgtgactgggccaaaaattctgaaaaacacctaattaagctatttttgatgctgaacaaaagtcttacagctcagatcactccttcataatgaccgggataccctaaaatacactgaaaattgggaaatttttcaaaatcctatagaaatttttcaaggaaaaaattcttagaaaatttttaataaaaaatttaaagaaattaaattttcaaaagtttttaagcaatttttttttgaaattttatgataattactgttttttcgaaaattttcaaaaaaacaaattttttttgacaaaaaattttctaagaatttttccttgaaaattttctaagtttgaaaaaatatttttgaaatttctgcggcgaagttttgtcccggcaagatttcgggcagcgaaattttggggtgtactccaatttttgatgctgatcaaaaaagtcttctgaaaaacacctaattaagctattttttgatgctgatcaaaaaagtgttttacagcaacttgatcagatagatcactccttcatagtgatcggtatacctaaatactctgaaaattgggaaattaaaaaaaattcctaggggttggaaatttttctgaaaaaagcattatattcatctgaaagagcacaaaatgcactacaaaatgcaaaatgagcaagtctaggatttatacccgctgagctatgggcattttaatttcggtgtctacaaaaaaggcaaataggtagtaaattttattctttttaatggaccttctcaa

SEQ ID NO: 2402 - DNA, 543 bp, Heterodera glycines
cttagaaaattttcaaggaaaaattcttagaaaattttttatcaaaaaaaatttgttgtttttttgaaaattttcgaaaatcgaaagcccatggattatgctatcgttacatataatacccttttcgtttgctccttgttaaaaggttttatgggtcattaataaaattttagcaatttttagtggtgttaaagcatatgaccatgactgtagtggaattgacctttttttttctcggcatcaaaagttatgttaaatgattttctgatttttatagctcaattccaaaaattactgcttttgaaaatcgtccctcaaaaaaaaatttttgttttaattatttcggcttctcatttattttttcttaatattttaagggttgctacgtatagctaaatctcagctcgatcgatctaagagaagtggtagaactctcaaactacactttattatttttcataaatatttttggtattccagactgcttatgttcaaacattgaaggacttttgtcttgacttagcaagatatgataaagtacag

SEQ ID NO: 2403 - DNA, 5091 bp, Heterodera glycines
gtccggatcgatctacagagaagtgggtagaactctcaaactccacttctcttcatttttcataaataattttcggtattccagactcgcttcacgttcaaacatcgtcgtactttcgtcttgacttagcaagtatacgataaagtacagtagctttttcgaagcgtgtcttcatcttagcaaggaacgctaacgcgcctcaaaccgcatattttcttttttcataaatactcggttcgaatactcggcttatcaaattcaaaagtcgtactcaaacaacatcgcgacagtaaattctcaagtttaataatgattataaaatagtccaccgtcccttctatgatccagcgcaagccagcccatgcatcattcgccaaccaaaaccacacattgtacgtccaatgccaaccattaccaaagcactcagtacacgacagcctaaaataatagaactttaaaaattcaaagaaaaacacttcgaaaacccatgagtgcttgctggtggaataaaaaacaaattaatatatacatacatattacaaaaggttttctgtatataccatatgaaactgggagaaaagggcacaattttgcgtacacaacatcataacttatttcagaaagcaagaaagccaacatttttcgttataatttggaatttcagttttcttttcagattgtaaaaatttcaagtcttttcaatgaaaagttatttgaatgatttagatccataaaaatgaattaaactgaatttggaaattgaattaggaataaattttgaaggttcaaaatcgagatcaaaaaggaggatgaaaagcgttgagaaatgagggggggggggtacagtcaggtttaaagaaaaaatgaagtgttgtgcatagaaaattagagtggagaaatttgtattttatacttgctgatgatgacaaaaaaacgatgagattattaatttttctgtctgtagccgcaaaataaaaatccatttcgaccttccttccggttatttcaacaaatagcagtgctttgatacccgacatcatttgactgctacgtaacattcagaacgcggcgatgttcagtgatggtccgtttgacaaaatgtgagttctaatgcattgtatgagtctaatgctctaatagcattttttagtccaatcacttaatgagtccgatgaagattcgtattcactggctacgaaaacgccctaaaaatgctttttatcaacgtttaaattttgaatttttttctaaaaaaggggatagcacctaaactatgatagaatccaggatagttagtgattggactcataaagtgctttacaacctaaacgcgaataggacaaaaaggaaatggattttcaatttccatgagttctttgtagtacaaatttacatcgactattttgttgctttccctatcttcagtgaaacagattttaccttgaaatattctttcactttgcttcaatcaattcgttacccttgattaactttcgttcaggttaaaacggaatatacagtcaagtgcaaaagcacaaaatttgctacaaaatgaagtaaacaatagtttcataatttatcgactacatatggtcatgcatatacacaatacaatataaaattgggcgttaaaatgggaattgaatatgccggatacagtacagtacatatacaatatacacgtacgtactcaaaaagcatatcaccatcatacaaaacaataataataatatacagaatatacatacatatatgtacaaatcgctatcaaattctttacatccatcagaagcgacgtccaccgaggaaagctgcccgctgcgttcggctgacaaaggagcactgacaatcgcacatcacatcgtattggtgacagtatctgaaaatggggaccagaattaggcgcgtgacactgtatcgtccgactgtatgcccatcacacagtactgtacctgttggccatgtcgcacacccaacttgacaagaagtcgtccatccacgcgaaccagtcagtcaaatagaacagcgttccccgtgacgaaccgagcatgaagtgcaccggtggccaagcccagcggacgcatgcggcggtcatcgcgacagcacactgttccaagaagcccagacagaagtagatggacagaaggacgaaggcaaaacggaaaagctgaaaaacggaagcgggggagacaaattaattcatcgtccgtccccgtgttaattggtatatttgccgctctggttgctcacccgatattgccacaggtgcgcaaagttaaccagcagcgattccatcacagtgccaacagtggtgtacacacggccaaggtcgattgtggacagtgaggcgaccgggctggcttcatcagatatgccatgctcatccgcgttgatggtgctgttgactgactgatggacgatgacattttgttgttgattgcttaaactgtgcgtggggaaagaatcgatcaaaattgcttaaaacatggagtttacccagctttgtccgtctgattgccttcaacccaatcgtaccaattatcactgagcaccgaaattgacctgaaaaggggaaaatggtgagtcacaaattggtactgaatttttttttttttttgcctgcgaagcactccgccatgttcgtcgccggcgccgttgttgatttcttgttgctgttgttgtggttgtttcggttccaccaatgcagagatctgcgaacgccgaacagcttcagcaggtgtcagaccagtcgtcgatttgacttcgttttgttcgttctgttgtggaggaagcggtaaaatgtgtttctgctgttgttgctggtcgttcaccacattcggatcactgaaaatggtgtgaaaattttgcaaagattactgaaatcaatgaaaaatgatgtgaaaatttgccgtaatttttcgattcactgaaattcattaaaaaatgatgcgaaaatttgccgcattttcagttttccagaaaaatgccgtcaattcaaaaacgatttgaaactttgcggttttcacggttataagctgtcaaaaagaactttccggaatgtctgaaaatggcatttacaaaatgctgctaaaagcggtggacggcatcatcatcaaaattaacgggcatcaatcactctaccgttcgttgctcggctccacttttggcggttgcgttgtcgaaatggtggtcgcttgcggcggttgctgctgctgttgttgcgccatgctcggctcatccacttttggcggttgcgttgtcgaaatggtggtcgcttgcggcggttgctgctgctgttgttgcgccatgctcggctcatccacttttggcggttgcgttgtcgagttggtcatttgcggcggttgcgttgacgaattggtagtagtcgcttgcggcggttgctcttcctgttgctgatgttgcgcaaccaccagtgctgttgctgctgccacagttgcgtcgtctgtctgtgttgcggcgatttgtccacgtgtgagcacttgaggcgacggttgcgcttgctgctgttgctgccactgtcccgctgctggtggtggtcgtttgacgggcgtcagaagggccatcatcggcgacgagtgcgagttgcatgagcgacgtggcaaatgatgatggtggtgatgctgctgattttgttgcggcgtgttgttgtcgttgtcattgttgttttgcggcgtgtgtcgttgtcgttgttgctgctgttgtggggttcactttttgatgaagacattgcgcgttattatgagcggcgacggcggtgacgacgaaaatttgggcagaaatgacggaaataattgaattgaatagcgatttgttgaacaaatgatgcgcatttgcgaaaacgcgtccttttataataaaaattttcttgcaaattcgtcgttctcttccatctgaccaaattgaaaaaataagcgaaaattttttgtcttagtagaaaatttagtgttttaaaagttttccaggactcagaatcaaattcgaattctcaagtgcataaaacgaaaaactttctgttaaattcccaaaatttcttgctaaatttcgttttacactgtgttaatttaaaataaagacaccctgttttttgggagtttgaccacttcccatgaaccgatcgagctgaatttttaactgtacgtagcaattctgaaaatattaagattctgaaagtgagaaaccgaaatggtgcgggaaaaaagttttacgatttttttccaaaattggcgtgttaatttaaaatagagacactttggaaaactaagaaaaatctcaacaactaacaaaaagaaactgataaaacaagttaaataagaaagaactaatcttttttcacatttctgtttattttgcatacagaaatatgtcttttggggagagttatgttgaattttctaagttttccgtagaaattaagggccaaaaggcttaatcgcctctaacatttgaccaaccgaataaaactgactgcaaacaactctaaaataatgtacagacatcctataaacattttctattcactttatgtcagaaaaaagtcattaaacacaaaatttttgcgggcgaaaaaatgcgaaaatctgggtaaattcgtaaaaaatttcttatatacatatttcgggatttttttacatattacatatgtacatattttggaatttttagtacgtattttgcaattttttctttttatttttttttgcatattttgggaatttttgagaatttataaaaaatttcataagaaaaattttatatatatattttttaaatttacccctaaaaacgggttttttctaagactgagccgcgccaagccctaccgcgttttaccgggcccggcgattttagggaaaatccgggttgaccgggttttgagaggccgggcccggaacccggcgtttttgaaaatgcaatccggcccggaacccggcgattttttgaccggtttttatcgggttatgatgatgaccgaaaatttgttcggtggctggacgtttcgacgatgaccgtttcgccggataccttttcgacgaatgaccgtttcgacggaccgggtcggttgagtctggc

SEQ ID NO: 2404 - DNA, 2646 bp, Heterodera glycines
  misc_feature (2560)..(2560): n is a, c, g, or t
ttcgtcgttaggatgaagatccttcttttatcaccttttaaattgctttaggtaattttctgtaaaaaattggtataaaaggagcaaattttcagtatttgacacattattccaattcttataatggacgacgacactccaaaccggaaagcgccgaccatcaagaacaaccgcaggacaaccgtgaagcgcaaatcgtcgacgacgcgaagtgtgcggacaaaccggaaagcgccgaccaccaagaacaaccgcaggacaaccgtgaagcgcaaatcgtcgacgacgcgaagtgtgcggacaaaccggaaagcgccgaccaccaagaacaaccgcagggccaccgtgaagcgaaaatcggcgacgacgcgaagtgtgcggacaaaccggaaagcgccgaccaccaagaacaaccgcagggccaccgtgaagcgcaaatcggcgacgacgcgaagtgtgcggacaaaccggaaagcgccgaccaccaagaacaaccgcaggacaaccgtgaagcgcaaatcgtcgacgacgcgaagtgtgcggacaaaccggaaagcgccgaccaccaagaacaaccgcagggccaccgtgaagcgaaaatcgtcgacgacgcgaagtgtgcggacaaaccggaaagcagacagacgatcaattggtgattcgacagcggtcaattcatcgcgttcgggtcagttctcaaagatccaacttccaaaaataacccagtaaatttaaggaattgaggactcgcttggtgcttctacgaccggcaattcatcgcgttcgggtcagttctcaaagatcccacttccaaaaataacccagtaaatttaaggaagtgaggactcaattggtgcttctacgaccggcaattcatcgcgtttgggtcagttctcaaagatcccacttctaaaaataactcagtaaatttaaggaagtgaggactcgagtggtgcttctacgaccggcaattcatctgccgaatccaatgagtgcaacgactccgaccccagctacgccccgccttctactgaatcggaaagtacggacgacgatgccccaaaattgtgctgccgtgctgaagcaaggaccttgccgaaacgtgaccgctaatgtttcctgtgatcaccctttgtggctgttgtatgtaataaatgtctgtgttgtctatcgctatattgtatgtatgtatattcaattctgtgccgaaataattgattgctgttgtatgtatttatattcaattgtgtaccgaaataattgattgctgttcgtataaaaactttcggctattatgcagtttgacccccataaaattttttctaaatttctaagtaaaaaagccggtaatactggagaatctgggctccacccaaaaaattttttttttgttatgaaaagatcaacccggggattttcggggcttctgatcacgaaatatgttatcagatttgcaaaaagcattgattctatcattatttttaaaatcatagatttttaaaattttatcaatatggtcaaatgttgcacccttttttcgaatgaagcaaccatatatgagtagcactttttattagctaattaaatgatcatagaacaatcacacaaaacataaataaaacacttactaccctgccaaaaaccaatttttagaaacatttgcatattggcaaaatttcgaaaatctatgattttcaaagtcaatgatagaatcaatgacttttgcatcataaagtgctttagaacctaaacgcgaataggacaaaaaggaaaattggcaaaaagaaaatggattttcaatttccatgagttctttgtagtacaaattcacatcgactattttgttgctttccctatcttcagtgaaacagattttaccttgaaatattctttcactttgcttcaatcaattcgttacctttgattaactttcgttcaggttaaaacggaatatacagtcaagtgcaaaagcacaaaatttgctacaaaatgaagtaaacaatagtttcataatttatcgactacatatggtcatgcatatacacaatacaatataaaattgggcgttaaaatgggaattgaagatgccggatacaatacagtacatatacaatatatacgtacgtactcaaacagcatatcaccatcatacaaaacaataataataatatacagaatatacatacatatatgtacaaatcgctatcaaattctttacatccatcagaagcgacggccaccgagcaaagctgcccgctgcgttcggctgacaaaggagcactgacaatcgcacatcacatcgtattggtgacagtatctgaaaatggggaccaaaattaggggtgatactgtatcatccgactgtatggccatcacactgtactgtacctgttggccatgtcgcatacccaacttgacaagaagtcgtccatccacgcgaaccagtcagtcaaatagaacagcgttccccgtgacgagccgagcatgaagtgcaccggtggccaagcccagcggacgcatgcggcggtcatcgctacagcacaccgttccaagaagcccnagcagaagtagatggaaagaaagacgaaggcaacgcgaaaaaactgaaaaagggatgggggagacaaattaatcatcgtccgtccc

SEQ ID NO: 2405 - DNA, 3169 bp, Heterodera glycines
caaaagtgcgctttgcgtatttcatccaaaagtttgaatgagcgcttttacttggtcatggaccgactcattgcgacatcggtgttctgtcagtttttatttttttttgttaaattttttcgtattagataaggcaacaaaaatttaaaaaaaaattcttgatttttttttctaaaaaaatattatttttaaatatttgcgatgacgttatgtcccagcgacttttttgtcacggtgctgttttgtcctgctccgcttttttccgcaaaatttttcacagtttttccgtcctaattttcagtttattctcgttgtctgatcacggaggaatggcgtctgaacagtttggcaaatgatcgcttcattgagtactgttgtgagattttgcgctgtgaaatgccaccaaaatgtttggcactcattgacgcggtcaaaacggaagcactcaaaacgttggccagtgtcgtgtttttggaaaaggacaaaaagtgtgtatttctattgccattagtgtactatttcgcatcggcggattgttttcccaccatgaaaaaaatatagaagaaactaaatttaaatttttaaattcgatatttttcgactttttaaattcataaatcgtctccaagaaaagttgaccaaatttcatcccgatatcgacaattttcacccgtcctccctttttagaattcaaatgattgttgaccagcttgaactgcgcacataccatggcttcctgccatcccaaatccgcagttgcattgacagtttgaaggcaggccgtgtggacggcagcggtggcggtgactgttcaattgcatttgtcacttcactgttttcattggtctaccatattgctggctttgaatacggtaaactgttgtatacccgaaaatttaatggaaaaaatttaaaaaaaaaattattttttttgttgttgttgtttaggcggagatgcgctcaatcgctcttcaatgacggctgtactgcttgatgtcgtcaaaaatttctcacttcctgaacagaacatcagctttgtgacccgttcggtacgcatcattgacaatttgacgggcatggacatcaccgagttcaacgcccgaagtggcaccgatgcggtcatcaaacgactgaatgtaagttcaacctttttctccataatccgccgtcgccacccccctctctccccgaattttttttttactaatttttccaaaaatcactaaaaaactaaaatatgccgaagttccattttttccacagcgcttggtgcctttacactggcaaaaaaacttagttacccacattttgttcctttttttagcatgaggtcaacaagtgcaaggagcacattcaaattcgtcagtcttctcaatcccccggcccgttgctttgcaaccagcaacggtcggcgctggtcaagtcgttgctcaactttctgaagcgtgcagtgggcgacgttcatttggcgggccaaatgcgccgaatcatggacaccgacttgcccacgtcgttgatccatgtgtttgagcatccccaatattatgggccgtcgcttttgaattgtgccatctcattggcaacaaattttattttccaagaggtaaaattactattgaaaacttttcaaatggggttgggccaggaaattagtttattaattttttcatggtttggccaaataccgagtttttggccataatatttaataatcaccttgataacagaaggtcattttttatgatacaaccaatttttacgaaaaatgcacattttccgaatttctaaagttaaaaaaagagttaccaataatttatttagataattttcatgcgatttcctacctaattgtttatttgtttagccggctcaattgacaactttgcaaaacaaggggctgaccatggcaataattggactgattttcaatgaaaaagtacgttttttccccgtgttcatgaaatacaacctccccccttctttttttcatttttctctgctttttagttcccaatttcacgtgaattggtctgtgcattgcccaacgtttgctcggcgctgtgcttgaacgagcgtggcctcaacgagttgaaattgttcaacgaaaagaaaccattggagaaaatattccgcatcgttttttcaaacaaattcctccagtcgatgaggaagagaaaaattgaaataagtgagtgatggactgacaaattgcaattaaattaaaaaaaaaaatttttttttttgaatatcaatctgacggcgtaaatttttgtttagttgagacggcacatgtgcttggcacctcatttgatgagctgatccgacaccatccatcgttgcgcaaagatttgatgggcacattggccggggtgagtaatttaaaatggcctgttttgttgaaaattataataattttttaagaaaagtttgtttgattttttgttatgtgggtagcatcttaataacaaaataatttaaataggttttttagaattttaaactaaaaaaggtttaaaattataattaaataaagaaattcttatatattaaaaaaactaattttatctttccaaattatttttaaaggttattcgttttttaattatattcctaaatttatttatccagtatatttcgcaatttcaatcattttgtcatattatcttacaataattaacagatttgtgacgattggttgtcctttgagcaaacgtgtgagaaggagggcaaacagtgtgccatttcatgggctgttggcaaggctgttgttgaggatgagtcggcactgttgttgccgctgggcgacttttccacaatgatgggcagtgagtttttgggcatacaatttacgacaaaaaatgccatccattactttcacacctctcggaaaaatttaaaaaaaacattttttaaaccttaaaaaaatttagatttttttgaaagtttgtgttttttataaattttaaaagtgacatttatttttcatgttgagaacgattaactggtcccattagtattaaaaaaacacattaattattacaattattaagttatacttgaaacaatgttgaccaatcgtggggtgcaggacaatgtgaatgtggccatgactttgaaattcactgcgcatggtcaacttatcacagaggcgaaacaaccggtccaattt

SEQ ID NO: 2406 - DNA, 4500 bp, Heterodera glycines
  misc_feature (9)..(9): n is a, c, g, or t
  misc_feature (40)..(40): n is a, c, g, or t
aagaaaatntagtgtacataattcatcatcataataaatntaaaaaagtctaggaaaattttccaattgtaagattttttcaagagacctttcaaagagtttgaaaaaaatttaaataaaaatttcgcgggggggggggtggaaaaccgtaggtcactcccttccaccctctcattgcgacttgggaagttttaaaatttatttttaactaaatgcaattcaaaaaaatgttcaaacacaatttctgttccgtttaaagacgcacaaacatgacatggacaaggcatttctgcatttgattgaacggagcagtgttgagttgtccgcctacaaacagtgtgaaacggttgcggacgtgaacagtcagcagcgcctttgccaattgacgcgtctctgtgccctgctgatgacgctcaacagtttgatggtgaatcgtgtgaatagagcgagaaagccttgcattttgacaaaaaaaataataattttattctagaaatcgtctctgcattcacaaggcacacatgagtgagttttacgactggagcacagctcgttttttatatatagataattttttaattttcaaatattttgaaaaaatcaccaccatattttccacatttttcatccctcttcattttccagaatgcgttcttacatgcttaaatattttgcaactgatcccaacgcgtgcgccttcatttatgccctttttgatgcgtacaaattaattggaacagaccgattggtgaattttttaaacaccttgaatttgaatatttatcaaaaacaaatattttttgccgcttattaaaatttttgacaatttgaaaaataatattcattttgtttcttaacatccgcacaattttgcttcgcatttgccaggtggtcagttgcaacgcggaacagcagcaggcgacaacttcacaaattgcggaagacacggccaaagtgcgtgaactgttgattgatgatgactcatcatcttcatcaaaccaacatggtgggacaatgccagcaataacaaccgctgcagccggcacagtgccaatgccacaattgatggaaatggacaatggtgccggcacactttatttcggtccaccacaacatcaacaccaaccacaacagcagccccatcggtcggttgattttgccaccaccgctgccaacattttgcggagcaacagcgcaggcagtgccggccgtggtggtctcggtgttggcattggtgtcggtgctggtggcgccattaacatttcaattcttggtggacctactgtcatgatgagaggagcatcgtactcaacaaattctggcactttgtccgcgtccatcagcgatggcattgtggggtcagcaggagggggaagcggtggtggtgggcgcattgctgagcggtccacccattcgattgccattcggacgttgaagcaaatcacggaactgatcacctacattggcaaagcgttttgcaccgtgtcgttgccccgtgtgcgacaacgtgccaacatactaccacaaatggaccaagccacggttcggcaccatgcgcaaaaagtcaccaaaattgtgttcaccggcctgaaacgactgctggaaatggacatgaacaccgataatattgtctacgcatcttccgcctcctcctcctctttgaacaccacgacaatgaacacaattggcctaaggcaaatttggcattttgtttaaaaataattttaaaaatgtttatcattgcatttacagtgcttcttacattcaccattcattgtcaacactgaaaaaattgctggtcgatgatacgcataatttgtcgctgttgttaccatatttttacaagaccgaatgccaccaagccttttttgccctgggcgactatctacggcagaatgttgacaaatgtaattgtttttgccattgtttttttttggtttcaatgacactataattttgtattccccggagaaaaaaaatttaaaaatgcatgttttatagttttttcaattttttagttttttcttaaaaaagttgatcaatttttgaaaaatccctctcggtggaactgttcttgcttatggtctatgccttttgtttcagttgagttgaacacatgcatccaagtttggcttgggatcacccaacgtttggttgctgtccaactgcaagacatgaacacgggcaagagcaacaacgggccacagcagcagcaaaccaagcagcagccgactgttgttgttgaaggatttgagccgaaaaattaccttgccaccttccagaaggcatagttttttaatgcttacaattaatgcaccaattgtttcatcaaaatttttttttcaaaattgctcaaatatcaacaaaaaaaaaactgagttagatggtaccataatcattcgaattcggtcttttgaaactgaaaataaaaaatttaataggcaatttttgtaacaaatagcactcaaatttccaaaaaattttcccggcggcgcctatcggcaccgccggacctccattttccactatttttacaagttttttgccttaaaacggccaaaattgggtcattttttacccagcagtggaaaaaaagttattggttaaatagcaaaaaaaaagtcttcaggtcgggtcccccccccccccccgaaaaatgtttctagatacgcccctgcgtcaaatgatgaaaaatttggcctataatcaccaaaagttgccattgtatttttttaaattctactttcaaaccaacttttaggatacattctctacactcattaccatgttcaagtcgttggtccagcaattgtcttcttcttcgccgcccccctcatccgacacaatgcccccgttggttggccaccgggaggaagacgcattcattttgttggaacgcgtgttgtgcgccatgaaagtgctcatccaaggcgaaatggaactgttggagttcaccgaaggcaaggcggagcagtcgcaggaaatcccagtcagcgaaattgacccggcaaaggtgagaaattttggggtgtatgtacatcggcggaagggggttatagcaatacgcgctagcttaatgggtcctcaattttgggaagaaaagtgtgctaaaaaggctggaaaaaaaatttgtgggctggtttttgaatttttaaaatggcaatattaaataattggcacatggttggctcggggttttccgaaattctggtccagatctccaatttttgaaaggatttctcgaaatcgggatgcgaaaaatccggagattgaaatcccgacaatcctatcccctacctgattcccaatctcgaattctggtcccaattttttaaaaattctcgtctctattgtaaaccataccacttatggacgaattcgttcggagaaccagctgccattattcgtcttgcattttagattttcatatgcttccaaatttgaataaaaatgcatttttttagattgaacaacttgttgaggttggttcgtttgttgtttaattttcttccaaatattatttatattttccattgaatgaatgaatggttgttgaaatacagtttttgtccctgttttttagatgggtttttcacaaagtgacgcggttgatgcactcatgcaatattccagcgttcacgaagcagccggtaaaaatttatttatccaataattgtgaatgtgtaatgcgcccaaaatttccaacatttaatttaccaaaattccagaatacattgtgtccatgctggagcgtgtgaccgttccccccaccgtttcacgaccacctgcagcagctgctgtacaagaacacccggccatcactgtgtcatcatcagcaaccgccgcagctcctcctcctccagcaacaactgttgcagcagcgacaactgtggcggcaaatttggttgccgctgcgaccgccgcagcggtctccgctgaaccaaatggaactggtggtagtgctggtactgctagctacgacaacgcactgcaacatcaacaaccgcaacaagtaggcgatgctgctagtggtggttcaacaacaacaaatgcaacaaccccgatggaacaggagcaaccactgcaacaacgagagcgcgaccagcagcaacagttgcagcagctgaccgcatcgctcgctgatgttcatcaacgcaaccaggaggctgccgaggcggtggaacaactgttgcaagcgcttcggggtgagggcgtacaccaccggggagagatgagcggcacattgccaccacctccagcagcggcagcaacagcgatggaacaggacggaaaatcgtttgacgagttgaagccgttgaagcgagaggaattccaggcaattcgaattgatttttgtgaaataactaatggtcgggtcataacataaaaattaaaaagaccccaaaccgccaattatgttttttgccgcgaaaaattataagttttcctgctctttcaacggcgacattcatttttctttcgtatcaaatttctaacatt

SEQ ID NO: 2407 - DNA, 1683 bp, Heterodera glycines
  misc_feature (1663)..(1663): n is a, c, g, or t
  misc_feature (1676)..(1677): n is a, c, g, or t
gaaatgctcattgaacgggatgcggagccgaagacggcaggccaaaaaggttgcttttaattgtggatgtagggagggaaatcccccggccaaatcggggaagaatccgaaaatcttttttggcaaaaaattttagccattatcatttgttcaaaaatgtttctgcgtcggagagataaaagctggaaatggttgtcgtttgcgtcaagaaaatacaatttttgctattcctgaggctcaaaattttcttcaaaaaaaaaaaatttttttaacccccccccccctcccccatagtaaaacgtgcggtggagacaaccttctacatttcgtttggcctcatctcctgcgccgttctgggcgtgatgacctacctcgtgttcaaggagttcttcgccttcaacacgccccagggcgtttaccgcgatgcggtgaaaagggtgaaggcggacgagcgctgtcgggaaatgttcggcaagcgaatcatgacatttggcgaagagtcgggccggggacggcgacggcacattctccacaacaaatatgtcaaggacgggcaggagcggttgagcgtgatgttccatgttaaggtcggagggtcaacagctcatttcgaccaccaagaaaataatttatagagggtttttcaaagaaaattttaaaaatctgaaaaaaataaaaatatttccaataaatatcttttcaaagaaatttgaaaaataaaaaatacagagcctcaaaatcaggagacaaacccctggtccatactttttcaaagttttgtctctaaaaaataacaaacaacattaaatgccatgaaaatatcaataatgcataattaagggtgacgcgggcattgggaaaacgtacgcggagatttacaagggcgaggacggcaaatgggactatcgctttgtactggtagagagtgacgggtttccgaagaaagccattttcttaattgacaacaggaaaggagactagttagtaattgtgtaggtgtttttccttttttgcttgttctgttttctcaattttttgaatttatatgaaaaatatttaaacccaaaattcttgggcagttgcatggcggagcaggtcgtcctcatccctaatatttttggagttttctaagatttttttcttatgaaagttttttttaaagatttatagggggaaacccactagggccaatgaacggcaatttcggaagtcattttttatgccaagaaaaagagagaaagaaataaatgattataaaatgcgaataaagtgtgtgtttgttgttggtttgatgctaacaataaattgtgtgtgtcaattttccatgttttttttggttagacaaaggtcaatccgtcaatataaaatgtacacattcccaacgagacggctcattcattcatcgttggcactgtcactggtagtacggcggtctgtccatgtgaatgccgtactcctccagcacgggctgaagcagttcagtggtcagacaatatttggcctcacgctggcccttcttcacttggccaagccctttaatacgtgcctgtgggaaaaacaaaatccattttcatccatttccactctttttcggactcaggattcgaaaaaaaattcaatttaatttgaaaagagatattttttgaattttttttttcaatgnggggagggcgacnntctaga

SEQ ID NO: 2408 - DNA, 2663 bp, Heterodera glycines
tccactgtacacataaaaagtattacaaaaactgtcgtactaatactctcgaccattttttttgcaatttttatttgtgtcttgcctgttgcattgcgtccaaacagatgtcggaaatgaatttttgagcagccagcgaaaacaggcgtaccacgcgcacgtccggatttgcaatgccattcttgcgcatgtaatacagtgccaccgagtccgggatggtcggccgataattctccaagtccctgtagaagtcggccaacgaactgcccggacgcacatcactccctgcaaatttagggcgtttttataggcctttatgaacacaattcaggcacaattttccgttttgccgaaaaaggggtaattttaagtgaccaaaccaaaaagaggaaaactgtatgatcgggccaactcggaccgtttcgcagtgcttggatttgctgttcggtcaccggacgtgcgaccaacggacgcgcatattgcacggaagcggatgattgttgctgcaccgtctccgcaccggtggattggtccggcgccccggcaccaagctgttggggctgttcaacgacggcatcgtccccttcatccattggcatgtcgtccatcggtggcaattgcatcaataacaaaaaaggaaaatgtatgacgaataatcaaaataaatgcaaaaaataggaaaatttgttccgtggaacatttaaaattgaaattgttatgcaaaaacggtatgaaaaataacagcatgaaaaccacagagatcgtacaaacaaataacaacgaaaagaaatgcactcagataaatgtgggggggaggggagggtcgaaaaatgaatccaaaaagctcgcctcccccaatttgtttttgacccctcattctatataagtgccaaaaagatttgatttcataattcgccgcactgttcaatgacaattggtattttcggtttgttgttctgaacggtgggcacctggaatgaaaaaaaaatggtaaatgtgactgatagaaagtaatgaatttcgaatacattttctatttttcgcacagtaagcagcccgtcaagaacacgtcctgaaacaaattcaaattcaaaaacaaatattgtttatttgtaaatggggttttaggactttcgttcccaaaagagtgccgaaaaccagggaaacccggacctagccccattaattgtaaaacaatgaacggacggaccaaaaacgacatgtttggcatcaagaaaatcgcacttgttacatgtgatgaaaaattggcagcctaaaaattgaggaagcaaattgtgttaccaagaaagcaatattatttttttataccatttgtgtcagggccagcattagccttaaaaaaacaaattttcaataatttttgttggaaaaattttgcacaccattgaaagaattccaggctcggaatgttttacttcaaaattttcgtccgcaaattttggcccataaattgacgtcattccggttccatcaccctgaaaaaaaaacagagtggttggaaaaacttttcgccacgtctctttttacattgacaaaatcacctccctgcaccataaaatcctaaaatttttaagtttattattgcgaaaacatttaaaaaaattttatactttgataacccggtggaattgcgaattcttatagccaattggaacgccgtccttttttctaaaacattttttattacgcatttttaaattgatttacatatttattggcaatttgtttattttattacaattcgccggtgcaaagctgtcgaaagttttccgccgtctttggcgtcacatccccaaacaattccatcgtaatacgacctgtgacgttaaaaaatgttttatttttgcgtaggcatttgcatttctaaccaatgggtgctccacctgccgcaatgtcctgacgaaattggaatgaaaaaagtggaggcaaaatgaaaaacccacaaaaaagacaattggattttccgggtggcgcaatttctcggacaaacgctcccattcgctcatttttgttgtataaaatagcaattaaaaagagaaagcactaaaaattctaaaaatgtatttctaaaatatttcaagaccaagaaaaaatacgggaattcttcgatcagttgtcgtttctcgattattgggaaaaaaaaattttcccgcgttatgccaatgtttattttatgtgttggcataatgttctttttttgaatatattattttgtttgctttcctgttttcttttgtccggaaccgtccgtctccggatcttttcagcccggtatttgttagggttcttttttgtgaatcttggttggactttaagtctggaaccgtatccgggtccttctctggcttttaattccagaaccatattttggggatccggggtccgaattccaatttttcataagtctgactctatattttgttataccctgtgattcttttactcattttgcttgtacatttgtctacaaaattcttttagaggcatgaatgtgcttctgcttttacgatgcgaagaaagcgcattttaattatgtttgtcctcatattgttttggctgttcatttactcgctcattttcttcctttggttatggcggaataacaataatttgtcatcatccgccaattgggcacagccgag

SEQ ID NO: 2409 - DNA, 2135 bp, Heterodera glycines
ccataacacgctttcattcaaaacaaaaatgaacaaattcttacttcggaaaaaagattttgaaaaggagaatctttttctccgtgaatgctaagcaatttgacatctcagaaaaaagttgtgggaattccaaatttttattacgttataactcaagtcctaggaagatgatttcaaccaaaatgcgaaaactaatcatttttctattggttctaaatgtccaaagtgaatttttacccgtataaccaaaattataggaatttgcaaatttgatgttttttaatgtgttagagacatgaaaatagtacgccaaaatgagaggaaaagaaatgcaaaaattttaatcactccataactttttagttaaccctttttttgttcttaaaaacccttaaattttgttcgtaatttttttctctatcaatatgcaaaatttgaagaaaatctgtaaggcggaaaaaaagttctatagagcgaagtgaatgttgttttttacataattaaaatgaagagatagtacgccaaagtgagagaaataaagataaaaagtgaatgtgacagaacgccaattttttcccataattatccataaaaaagatttattgccgcttttttttcttttttaccgtccatgctacgacttaaacccgctgaggtatgggtagatactgtattttatgaaagttctttatcgaaatggcaagtggtcgtaaacatatgaccatgactgtattttctgggggtttgtgatctttttaataatggtggagggttcggtgaagaggtcaatgaaaaggttctcacacttgcgtccataccatttggagacatcggttagatgctttatactttttacaaatttaaaatatttaatttggtttagtcggcgtaagcattccgttggacaatgaaacgggcaaacacagaagttttgggtaagttgattcattttaagttgaatgttagtctttgctttttgagatttgtcgaatttgaacttccggaggatgcagcggcagcaattgacaatatgaacgactcggaaatttatgggaaaacaatcagagtgaattttgcacgccctccaaaagtgaatgagcgaagtcaacgaccaatttgggcggatgacgagtggttgaagcagtacggccatgggagtggacagggcgaaccaggagaatgccaaaagtttatttgggcatcaaaattggaataaggttggcattttgactctattgcagcagtttacaccgaccataaatcatttttaaaatatataatccgaattaaatattcgagtccttaattagtctgttaaacttcaaatgatttcgttttgtttcaaaaaggttatgactagaaaacgcaaaaacacttctcaacattttagtccgcaaattttgaatcttgaatgattttttcatctttcctagactatgttttcaacaaagattctttggctctaatgcactttatgagtccaatcaattgacaatcccgggtttttatacaataactttttccatgttcgaacaaaccctatctttttggtatcattcgaaagcacacagtctgacgaagctaaaatatataaaattgcagcgttcaggcaattaccaaaaaagattaacacaaatttcgacgacattcaagactgctttttgttaaaatatgaacacatatttaaccggaaataatgaaaggtgtgtgcttgatcagactttatcttctctatttgttacactatcgattgcttatagaaaattgcataagatatatacaattaataaaattacaaaaaaaaattgtttatttaattgaccttttccaaaacataatgaaaataaacaagcctatgattttttaaatgctttgcaatcatagaaaaatgtttgataattattgtttacttaataaagtacatagaaattgaaaaactgaccatagaagagataatctgttatagaagaaaattgagaaattattagtgaaattaagatttctcttaacagggtaggcgaaaaggactgcaatttgttaaaaatattaatacagtttagttccccgtttttagcatagtcgtttagatgtgaaatgcagtgcaattaagaaagtaggtatgaatgcttgggaaa

SEQ ID NO: 2410 - DNA, 4805 bp, Heterodera glycines
ccacacccttaaaattttctttataatttcgaaacattttaaaacatatatttttcttatttttatattaattttatgcctgaaatacgagtattatattatttttattaaaaattcacgaaaattgaatttgccctctcgctttgggaaaccaagttcggagtggtcattttgtggtgccaatgcttactgtgccaatttctgccgaaggtggggattgcgtcggtgccttttgctgtttaattctctgtacatatgccaatatttgttcgccattgaaatttttgacgcgaattttcagcggattcattccaaccgttatgcatttgttcagtcggcatcgcttacataatgcagtatcatctaatatttataataattagaggcaaaaaaagagtgatttttataaaagaatcccattttcccgaatttttagacacaaaaaaaagaattaattcttttcaaaatgaaatattttttgttcaataaatgattgtttctgagcaattgaattgatgattttttgtaattcgaatttttttttcctttgcggttttttaagcttctcatggcaattatgtgagaatgaataaattttaatgaatccaatttcatttttaatctaatattaaatttaatattatttttaattttaaataaaaatgaaattttttgaatgaattttatcacggcaattagcctacgaacaatgcaaagctttaaatgataaaacttcccgaacgaggttaattcaaaaacgccttatctgtgctttaaaatttaatttttttaaaattttatttcttatttgtctttttgattgaatttgtgaagaaatgtaaaataataaatttgggaaaatgttaattttgtaactgcgttcatcgttttcatttttgcagtaaaaatataagggctaacaacctgcagtatttcattataaaatttttcccgaagcctatcggatcgctggattgggcaggatcgttactcaaaaaaccatcaaatggaaaattatagaaaattattaatgacttcgcccaaaatgaaccaaatttaaaatattgatgacttcgaaagcactaaatgttttattttttatagtattttttgcctttttcgacgtcgcactgtccgccatttttgcatttgtattccttcagcagcaaaatggttctgcgaaaaaaatgtttgcatcctgaattataagaaggtattattgaagtattatttttctaaatggattaaataatactattgatatatttagtccaattaagattatacaatggccgaacttaaagctattattagccgcttaactgctattgaaaaattaatttcaaccaacaacaacaacaccttggcaaccgaaatgactgcgcagttcagcgccattgcggaacgcctgggtgaaattgagcgcaaaattaacaacaatggcattgtcagcgcggaggagatagaacgaaaaaggagccttgtgctcatcggtcttccggaatcggaggaggaagtgccatcactgcgtgcgaaggatgacgcgaaaacggtggaggaagtgttggaccggctggacgtggaagtgtgcccgcaaatggtctacaggatgggcaggaggattgacgagaagaggaaaggaccgcgcttggtgaaggtggtcctgccggcttcaaccttccaacgttttgcgctgatgcagtgggggcgtcgtcggacggagctgaagaagagacctggatgggagcgtcttctggtcaggccatccctgacgaaggaggagttggaaattgagcgggaacagcgccaaaagaagtggatggaatttggaaagaagaaaacgggggaaaacatcacgacgcgacgcggaggcaatgaaaaaaacttttgaggtcacctccttttttaaattgttatatttcaatgtacgaagtttggcgaacaaattggacaagttaaggtttttgttattagaaaataggtttaaaatcattgctgtatctgagagttggttgagtaacaaaatagaaaacccccaaattttggaaaatctcccctattctataataagatcagatagacttaacaaaaaaggtggcggggttgctttcataatatcgaatttaattccttttgaaattatcaaaactacaaaaaacaaaaattccgatattctttgtgttgacctattttcacctcttaaccacacaaaaatacgttttattttggtctatagacccacctcccatgaaaaacaagaagatttcgaaaaattggtcgaacaactctctgttttagtctcggcttctgaaaaatgcattttgttgggtgattttaattttcctcttttaaaagcaaaagacttagcatccaacattttgaaaaaagaaacaatcaccttgaatcacttttcatttcatttttagagggatataaattaagactaatggtcaactcccctacacggggaaacaatttattagatttattatttacaaacaacgaaaatctattgaataatgttatagttgaacccccatttggtaatagtgaccataatgcaattcaattcagcataaatttacaggttaatagtaatgcttcaaaaaaattttataacttcaaaaaagcaaattatttggaaataaatgccatactctcaatggttgattggaatttatttttttctgattgcccggacatagagcttatttaccaaaaatttatgtttttcctaaataatttgataaggaattatgttcccatacaaacaacgaaaaaagttgaaaaactaccagaacatattttgaaactaatcatctatcgtaaacagctttggaaggacattcacaaagaccatataaaaatcaaatttttggaagtttcaaaaaaaatcgatgtagaaataaataaattttataaaaatcgtgaaaataagtttttgcggaccttagactctaaaaaacgtttccaatttataaattctttccttaagactaaaaatactatgatacctgcatttactgataaaaatggtctaatcctcttctctgataaaaaaaagtcgaatgcattagcgcaacattttttttccgtttttacagatcaaaatctagaacaatttcaatgcatagaaaatcctgaaaaaaatatcgaatatttcaacataactccatatgaaatttatttctctctttccaaactttcaaatgctaacaacactagtattgatggaattcccaacatttttttgaaaaattgtaaagaaaatttagtccgaccacttttccatatttttagtttctcattgatgactgcccaaattccagaaatatggaaaaagtcaattatttgccctgtcccaaaaattcaaaatccggtaaacccagtcgactttcgtccgatttctctgctatgttctgtttccaaaattttggaagaaaatatagcaggaaaaataaaaaattttgttgaaaaaaataatttgttaccaaattgccaacatggttttcgtaaagcacattctgttaccactcaacttcttgaagtggtggatgattttagttttgctttagaaaataaaaaatcaattgatgtaatttattttgatttggctaaagcattcgacacggttccacataaccggctaatatctaagctaaaaagcattggtataaataattccttattaaaatggattcaaaattacttagaaaaccgaaagtttttcgtcaaaatcgggtctgatttctctgacgaatatccctgtctcagtggtgtgccgcaaggctcaatattgggaccactgttatttcttatttacatttacgatttaccaaaattctgcgaaactgaaaatgttaaaattaaactatttgccgatgatcttaaggcctatcatgttctttcaaatatttccttttctccactccaaaattttattaacaaatttaatcgatactgtaaattaaacggccttaaaatcgcttcaaataaatgtttaactttacatttaggacacaaaaaccaaaaaataaattattttattgatgactttccaattcctaaaaatcccggaaacgaaccagtcagagaccttggcatttattttactaatgatttgaaatgggcacaacatattgaaattatctcgaaaaaagcattacgatctgcttttgctatattaaagtcaatcaaaactggtgatacgaaaatacttgtaaatttgtttaatatttattgcagaccaattttagaattcggatctccaattttcaatccttatttaaaaaaggatatagaaaaattggagaatgttcaaaaaacttttttgagagtaatatttagacgtaacaattatgctgctgatttacctaattatgctgaattgttaaacatttatgatcaaaagtcgcttgagagtcgtaggttaaaaatagacttaaaactttttcatgaaataattttaggtaaaataaatttacaaaataacgaatccttttctttttccaaaaaccctgtaaaaaatgaattcattataagaacagcttattgctcaaccaatgctagatacaattcgttctttattcgaacctctcgtctctatagacttttacctaaagagacgagattactaaatccaaatgagtttgccaaacttcttgaaagatctgatcttaatttgttgatttctttgccaccccaactccaaaagtgaccaattgattgttttgatattattatttcattatttctttatttttcggcatcacgcttttgcgtataaatgattgattgattgaaaa

SEQ ID NO: 2411 - DNA, 1965 bp, Heterodera glycines
  misc_feature (1879)..(1879): n is a, c, g, or t
aatattcgatgaataaccgaccgtcaggaagggaatttcacggccctcggaggttttgccgatggagtcgaatttgatgaaatcggtgactcttttggcattgtcaggcgcggcaaaaaattcggacggttggccaacgaatgggcgaaagttccaaacttcggcacccgaattgggctgaaggccgacatattcgctgaagttgcgaagggcggcgagctgttccaatgtttgtgggatgacacgaagcaatttgaaactgagaaaagccgggggaacgattttgaaagaaaagatgattaatgataaagcgaggagcgaacccatcgtagtgttgaacggcacccgaagcggtagcgaaattggacagtgccaaaagccaaaggacggagagagaaagagattggggaaacattcgatcaaaaagcgatgacttggaaaaggaatgagcgaaagtgtcaacgtaattggccatcagcgaaaccattttttgactgccgggacaacacggatctgcagaaaatacaattaattaactactgttaattataaacaattgtcagctaaaaattttaaagaacaaaatttagaggattaaactccgaagcccttcaagtgctcacctttctcctcctcttgctcgtcaatgttttgctcttgcaggttctgcaacaaattgccgcctccatgctcaaaagggttatgcccccaagtggcttggtaatcaatttctccgtcaatgaaatccatgtcaatatcgtcgaggttaacacctccgccagcaatttctccgtctccctgaccttcgttttggtcattgttggcgttctgctcagcgggctcgctctgccccttgattaagacagcacaaatgatggcacagccgactgacagaagaaacacggtccaccaactgaaaaatgaattaaccggttttgtcgcaaccctggtcaaattttattgtactttagatgcatgaaacgaaagggtaatccttcggaattggtgtcccgacaaggaaaaggaaataaaaattaaacaattacatgatgaaaagcatagcaaaaccaatgattttgcaaaatcccagctcggattcgtgatcagcatattttttccgtcgggacaccaattccgaaaaaattaaggatctattctaagcaaattctcgatgaatgaaatggaaagaaacaaaacagccaaaacgaacatagcagagtggttgccatggttattgtcatcgtccccatcgtccacttgctcaattggactgaaaatgtggggaaaacattaagttgaatttatcatcagcaaatttgagaattagggggatcgtattcaaacaccgacaaattttcggaaacatgcacaaaaatgggaaaaaagtagcgtatttggaataggttaccccacaaaaattgggatttctatttcgaaaatgatgcaatccctggacacgtatggagcaaaaaaatattcgccgagacatgcgaattgcggtcgctttccaccccatccatgccttggatttttgtgtttaattttcatttttttgagtgggagtgcatgtattttaatttttcggatttcaaaattgctgctcatcaaaatcacagcacctgctgctgtcgttgtcttgttgctgatgacaaaagccatagttgagaagcaatgcgacgatgaggagcagaaaaagcaacagagaatttttgttgttggaagccatggcaaaaaataggacgaaaaattggaattccgacaaatttaaaaaaaatgatgatggaaaaaatggatgcgaaaatttgagaaacagaagaattattgtcgaggcattgcggaccacaaaagacaaggaaaataattgtgtgaatgatactanaataaaaattttgccctttatatatacctcgtactttcaattcactcacaaatcagcactgctgagtcagcagttcgacgcctttt

SEQ ID NO: 2412 - DNA, 1596 bp, Heterodera glycines
ttaaaagagcaaatcaaaattcgttcgacaagacaacaatttgagaatacttgtagaagattttgcaaatcgtgatccctttagaatatttacaggcttgttcctatcactcgaattttgatttttttaataatatttggctaggtatacgtatttttacgaattaattttcactgacgaaatcacttactgacgaaatcactcactgacgaaatcaccgggaaccgtaaaatctgttagacatcctatataataaagttgagtgtctggggggggggggggtcggtttagtctggcaagctgtttttgtcacttctggattctaatgttttttgtcgaaaaatttttaatttaatattaaaacatatttatcaatgtattttcaacaaaaaaattacggtggaatttcataaatttcgatataccaacgagaaaaccaatgatgttatcgggattaacatggacattagcatggtaatattgatcattttggttagccgggttatttttgatggcattttactctgtaaaaatcgaagaattctacgaagttcagcgatatgtttcatgtgaaaaattcggccatctttgaacaatcagttgaaccattcatgtgtacatcgcttcacactgaagttagaaggcagtagtaatcggaaacccaattaattcgcctaaattacaaaaaaacgtgaaaaaatggaattctggtggattgagtcccggtgattggaattcaaaagaatcagtgagattgatccccagtgattggaatgacgaaggattgcttagtttgagtcccagtgattagaatgctggtggtttgagtctcggcgattgtaatgcagaagaaatggtgagatagagttcctgattgtaaagccgaaaatacgggtccactgcgtttcggcactctcgttttggcgccgggatgttttcggctacaacttttttctttgccacccaaatccaaaactcttgttatcgaaagcttaacatctttagaaactttttctaagctattgcttcgcgattagataattaccaaaaaagttatacatgaaaattgccaaaaagtcaaaattttcaagttttttctcaataaaacttttcgtttttgataaggctaatagagcatgttaagagctttcgaatgataccaagattgtgggatttggatgccaaagaaaaaagcttaagtggaaaaacgagctggcgccggcgcgcgtgggtcccggaaataccgagggttccaaacgaagaaatagtgcaataattggcattgtgtttttatgccaaaaatttagtggctatttttctcgttttttactggttaatgattagtagtagagtgccacgggaccgggaccgggccgggaattcccggtcatccgaggtcccggtcccggttcccgggttttgaaaagctcaggtcccggtcccggtcccggtcccggtagggcaaccgggaaccgggaaaaacaagcactggtaagaatggggggtctgagtgaaaaattagtgaagaaaattggagtcaaagggaaaaataaaaaataataattaatatattctttaaaagtaacactgcctatg

SEQ ID NO: 2413 - DNA, 1304 bp, Heterodera glycines
  misc_feature (36)..(36): n is a, c, g, or t
ctgatttgcctattttagatcactactaatcagctntattacaaaatttttggcgtccgttacaaaatgatcatttttgaaagtgcaaaatgcggatgccttttggtttcaaaaattttctctttgtgcataatttgcttatcactttgctttgtaattagcgccaattttttattcgacaagctgattgtcttccgtttaattggttcttttcttttttttttgttactatatcttccaaaaagattcgaaccatttttaatttctaaagcccattcacagcaatgggacaatcagcttgtcgtttttgtgtaccattatattgtcccagaacagtaatcacaaattgccttttttatttttgtattcttttttgtacttgaaaatcatttaaccctttcttttattctctacattaaactaaatttaatttaaagaaatttttttatcttttttatttttgtgaaattaacatatttttatgcgcttttccctaaccaaatttagcccatagttagaataaagcgaaaacgcttttttaattcgaaaatgtttgctacaccggaatttatggatgccgaagacagtttgatggagatgaaatcgaatcagttcaaaatggacaaaaatgagttcattgccgcggagaaattgatcgacaaggtaagcaaaataacattttaatgatataatgaaaaatgaaattgcttacatttttaggactactacagggactttggcgatatctttgacccggatgtgaagtaaatgcggctactttttgtgcggaaataagcaaaatgtaatgttgttgtttttgatttttgagacataaaattgtgtatgaggtatatgaaatggaaacaatgaaagcgtagaaattccagataattggagatcacaaatgagaaaataatttccatcgggccgttaaaacatggtgatttaatcttttctgtcgcagtttggcgttcaatcagtcacccaatcgaaaagtgtaaagccatctcttccgtctagttgaactattttgtttggtattaattgagggtaattaagcgacttattaacggttaggcaatgaaacaaattaattttttggggtgtttaatcacgcccaattccgattgaacgtcaaaaaactgcaataggttcaatgtgatcaaaatggtgtctcatatagtgaaataggcattgatagtctctgatagggcactttgtgtgtttgttgtgtctttcctttgtgctccccgcgccgtgccatccctcacatttgccggcatcgaatgacgtgagggccttct

SEQ ID NO: 2414 - DNA, 1768 bp, Heterodera glycines
  misc_feature (1677)..(1677): n is a, c, g, or t
  misc_feature (1680)..(1680): n is a, c, g, or t
  misc_feature (1714)..(1715): n is a, c, g, or t
ctcttcctcttcgcgtgttgagtcgacttggaagaggccaagtccgaccgaattgagcagttgctcccataccaattccggtgttctggcacgacggttttgtctcatcagttcgtacagttcggtgatgtttctatcttccgcgtcctctgggaaattcgcatcagttgcctttttcagttgagtctgaaatcacgcccttttctcgaatatttagtgcgtttgctgagtccgtctacagtttataccctcaacaaaaattcttcaaatgaatttagaagaacattttcccccaatcgttccccccccctccccacgtatttatccctaaattcttttcatttatttaacgaaaagttcaaaaaactgaaacgactaaagttaattgacgaataaatattaaatggtattgtccctttctaaccgatgcgggctcccaaaaacggatcacgtcgtcaatgccagaacttgcgattaggcatcggagagggtgtggttggcaacagttcactgtgtaatggtcgccctaaacgcgtcaaacaaaccattaagaattgttttacacttatttcgggtgaggagagggggtcctaattctttgaattctccacaaaatttagtgcgatttttctaattcatagaaaatttgttagtgagatttttcaagtaccaagtcagtcaaaatgaccttgagtgcattgacgatgcactgactgttccgttcccaaatgaacaatgagccgcaatcgctgcccgccacaatgaattggtcgtcggggccaaaccaattggactctttgatgtccgtgtttatgttcaaatggccggtgtaacgctgcacatagtcacgatggtgggttgtgtactccggggtccacagcttttcccctgtaaattattcctttcccttttttggattataagagattcggcagcaaatccaatttttacaaattaaatcttttcaattcaatcccccccattcattaccttcctcttgctttttgtcgcccaacaattgtttcaattcagttgtgtgctcatcgtcaaaatggtgcaaagtgcagtagtgttcaaaacattcattggccaactaaaaaacgacaaaacccaattctttgggtgtcactttttgggatttgaaaatgcttaccggcagttgttttagagagatcaagcatttaatgagcaaagaatgggcctttttgtgcgaagggcagaagagaagaatggcgaggcaatccctgaccgagtccaattggtccccgtcccaattgcgctccatgaaacaggaagctcggatgaacagacattggacgaaggcattccgatggggaagttgagcaaattgttgtttgaccaaggcactgtcatcagcagatccaagctttgagaacagtttgagacggcgttgaacgaaactgaaatggatggaacagaatgtgtcttttttaagccgtacaatccccccccaccactcaatttttattcattttttgctactcgaccaattagaaatttttccacattttccatttaaattttggccagtaaggatggggtggggattcagcggtgtccgaaaacctcgtttttaccctattatttccgttcaagacctttgcataattaaaatcggttacattttatacaagttttctaacttcaagaggtggnganaattggatttctaacaacaaatcgctttgagagnntaggattgttgaaatacctataaatttgaacgaattttcgtaaggaaataatc

SEQ ID NO: 2415 - DNA, 2556 bp, Heterodera glycines
gattagaaattggtcgaaatggaggcctgattcgtgctcagcgcctcaaaactcccctagaaacgtgttataagaattttcagaaaaaattttaaagaaaaaattttcgggaccaatgatcgacatgattgcccgagtatttaataacttatgttgggtctgtaaacacactgaatatgtaaattactgcatgcaattagctttatatgttttattccatcatttacatgtgtacatagcatacgcgttacaacatcaaatacaattatcgattaacacaaaggatcgatcgcaggggataatggtacagacaattgatcagagatgggatagatcacaaacaaacacagcaaatgttgtacttcgcagagcgcacatcgtccgttcacttcttggcaattcacttgggcttcggaggttgcttaaatgtgaagttgaaagttattgaagtcaaaacccagcccattttcaactcaccgcccaggccgagacttcaattggagttggcgattgtgcaacgcctaaaattgaaagatttagtttaaaaagcaagtaaaatcgacgcccttctctcccacctgcgtaggtcgacaagccgggcatctgcgaatttgccatggtggagccttgcgccgcactctgtcccatcttggaggcgccgccttgtgccgcactctgtcccatttgtgagccctgctttgccacgcttccctgctgcatttggtccccagtcggcgccatctgttgttcggcagcatctttctgaaaagtggaaaattcattagactcaaatgttaaatttcaaaaatgccggcctcaccttcccgcagccgcagcattgcgtgacgatcaccagcacagaagcggcaacgatggacatcagcaggggcactatgggtcaagcccagtgttagacaaaattgctcataacgccaaatagcgtatttggcgtaaatttttgcgcgttaattcaaaatttacactggaaaatgtcttttttgtattttttattttgatctgccataactcgcttcattcccaactaaactgaacaaatttggtatttaaaaaaagtttttgaaaaggtgaatctttttctaagcgaatgctaagcaatttgacatctcagaaaaaagttgtgatactttcaaatttttatcacgttataactcaagtcctaaactgctgatttcaaccaaaatgcgaaaactaatcatttttctattggttctaaatgtccaaagtgaatttgtacccgtataaccaaaattataggaatttgcgaatttgatgttttttcatgtgttagagacttgaaaatagtacgccaaaatgagaggaaaaagaaatacgtttttattattatttacaacttttgagtttgaccatagacaaaattaaattcactatagaaagatgcagaattcttttctctatcgatatgcaaaatttggtgtaggtttaacgtatagaaaaaaagttaaacgtagcgaagtaaatgttactttttacataattaaaatgaagagatagtacgccaaagtgagagaaattacaaagaaaaagagaaacgacgagatagtactaggcttttctctgcacagtggagttgacccatagtgcaggggcagcagttgaagtgaaagggacgcggtgaagaggacgtcgacgagcatcgcagggaattaaataatttgtaattgaggaatgatgaggatgaaaaaaggtgggaaaatcgcaatatttatactcaattttcatttttgagttacaatttctaaacaaaactttttgttgctaccattttcatttaaatatagaaaataacaaaaggaattcctcagtcaatctcaattccttcttcgccgactgttccattctcaaaagcgtcgtaccataacgtcaccctcttcataaccctgtagatttttgtcatttgttttacttatttgttctaatttcaattttttcagcatgaccactccagcaaacgcggcgagggcccggagtgccaaggcgaagctgcgcgatgccaagcggaggagggcggcagttggacgcgcaggatacgtaagttgaacaaacccccaatccaaaaaaacaaacaatgaaatttcccaaatttcagacaagaaaagcgcagcggggcgagcgatgtgccatctgcatgaccaacgtgagcgccatcacgcggacgacgctcggctgcacccatccgttccatcgccgctgcttgtatcgctggatccgctaccacaccaattgccccgtgtgccgctacaacttcacccgcactattccgcgccgtaactaaccgctgtaagatgccatgtgttgtgatcgccatacgatgtcatttgttgtgatcatatttgtatcccattgttaggttatgcgtatgtatttgtacaatggaatgtatgttcttatatgtattctgtatgtatatataatactcgtcagtaaataaaatacgtttctaacccttgtccttttctatttttgaatcttaaagtgtgtatgaagaagctttgttaattaggggagattagaaat

SEQ ID NO: 2416 - DNA, 2443 bp, Heterodera glycines
ataaaaacatgaatccaaaacatgaaattcgaaaaatttgaattttcgactttttgttcgaattcgggtccgggattaggaattggcccaaatggatgtgcattcgtgatcaacgaccccgaaaaccccctaaaacctatcttttaaacacttaatatataggcgctttaagctttcgtttgatatcaatgtaggtattgatcaagtaagaaaaatggatctggcttttggacccagcaacatccagacccggcaatacccgtaccagtataatactattcttttccatcaatatatataaaatattgatattcaaaatttattgctaaaacaatatatgtaagttgaaagaatagcgacggatcgcacataacaaaataaaatggtgaacaaaggcacgtagacacaaaatgacgctgacattggccatcattccatcttcacaacgcccactttggctggtcgaatcggacggtcgtgcaaactgtacccaatgttcaacacatgcgcaatgtgaccggcaggcctatctgactgcaaattgaacatattcattgacttcataccattaaaatgacagaatgccaaatactcctaggcacatataataggaccttttgggaattttgctgattataaattgcaaatatgcccttttgttgcaattcttgcctggtccttcggtatttcatacaccgcttcgtgcaaattcgggtcgaacttctgtccttcgggttgaaccggtacaagcccatgctttttgaacgtcttcagcaacacttccttcgtcattttgatccctttgttcactccactgtccaaggaggcggcaccgtcctccgttttcattttttccaacgaattcaacgccaagtcaagcacatcagccacctggaattttaaaaatcaaagaggactcaatcgtcgtttcgggctttataaaacaaatgtgttgaatatattttcttaactgagtatgaatttcactaacctccagcaaatccttgcaaaatggctgaattgcaaaaagttttgcctcctcaatttgccgctgcgttctcttccgcaagttttccatgtccgcaagtgttcttttgtatttgtcggtcagcatttcgttgtcgctcttcagcttttccatctgctcgatttgctcccgacattcctgactcattccctcgtgttgcgttctgtcggatgagaaggaataggaacggagaaagatgagccctgccccttctagaaacagaaatattccactattttttatcgtccactttgcgcttacctgtaaaaccaaaattatttgtattgttcgacccggtaggcttatcaaatcacgcatttttgtccatgtgattggtcgtccgtccctttctttccctttttttttcaccctccccactcctatctattctaaacccactgattgtttgtaggggaaggcggcgattgtttgtcggacgaagcgctcttcgttgtgccgaactcgatgtgttggttcatcttggagaagtaccttcgcaaattgcagctcaaaattcgactggtcattgccgcttttaaggaaatgaaaaacagaggagagagaagcaaagagaaaattttctggaatttggatatttatagcataagcttccctagggaaagacaatttgagtcaaatcaactctcgtttaattttgctgatctaccaaatttattatctctaatctaacgaaacctcaaattggcataacgcataataattagagagagcagagaaaaatacactctcattttggcatactcctattctttatctggaaaaagcagaattcgcacagtaaatttttttttaacgcatacctatttgagtggaaagttttttatacttaaattaggtaggaagaggcaagaactagggatcttttgtatctaaattcgtcatgatgagtccggggatgaatgaaaaattacaatgttttcctattgtggccattaattattgaaatattttttttgttctaaatcctcaaaataattctttatccgctaaaaatattaatcatttattcattttagcaaatatggatttgaaagggtcaagcgaaaggacaaaaagaagggagaggaaacggcagcgaagctcttcttcctcatcttcatccagttccgagtcaagtgcatctaccgacacatacgacgaaggttcaccgggcagcgaagaaaagtcagccaaagcgcaacactgaatgggccagaaacagagacaaattattagttttagggccaaaaagtcatcgaaaagtgctggacggaggtattcgtcgtccagcaaaggtcggcaccaccacgcgcaacagcagcagacgacgacgcattcccatcgccaccattaccaacatcatcagcatcattcgtcgtcaagaagatatgaaagaaaaatttcttcccatgaaag

SEQ ID NO: 2417 - DNA, 1487 bp, Heterodera glycines
atatgaaagaaaaatttcttcccatgaaaggcatgctttttaaattaaatttaaattgttacctttgttccttttcacagttattgtgcatttttagtttaattatacttttcattgaccttttcctttggaatatccttcaatttattttcgtttttaatcattcctaatttattaacaacaaagcaaaatctgattgttagtttgattgaatgagtttcttttctcgttcgtttgatctactctgacttctttatgtttttgatgttttcagggacaaagaatcaaagcgaactcaaatttcaagttgtaacaaatttacgtcctctcggaaacggttagttgacgagtcggcggatttagcgaaaatagccatcacttacagttagttagctggtattgtattgaaaattgtttgtgttaaagttgatcttttctatctcttctatttgtgtgttatacgaagggctcccaactgaaaattttcaaaaaccagctttgacaccttgaaaagaaaaaatgctgataaatcagcagaattgggagtcctaattacctatacggcatgcaccattgttaaaagtgacattttcgtcatcaaataatttgtagtaagcatccttttggctcacctttgtgtgtattttcgggattggatatggttggccatttctgcgataaaacaattatttcaacaacaattgcaggagtagcagggatcagcagagccatcacgagcacaaaagcaacaaaaacgggcactcgttgtccaccgcaagcagaactcacagccgagcggagacacgtcacagtgacagcaaaaagggcggcagcggcggaagcagcagcagacaccactaccagcagcagcaccaccatcggcaccggagcagaagcagagagcgccggaagaggcggtcggcaacgccaccggcgccggtgacatcgccgccgccgccagtcaccgcttcagcagcagcccgagttgagcacagcaatgacgaagccggagttcgttttgctatgatatgtaaaatgtttgttgatttttgtgagcgtcacaagtagctgatgcagcatttgatttcgacaacttcgaaaactcgcgattttttcttttcttttcgcgttgccttttttattattaatttaaccatttccataacgaaataccgaaattattatactcaatgaaattgctcaagagtttttgtttactttttaatgttttaaggtgtcacattcgcttggttctcttctgaacattcgcaagccatcgaagaaacggcgaagtgaagaaagcgaccaacgaccgctcggagacgacgcattttcggacagcaaaaaagcgccggaacaggtggccacgaaaaccgaacacccaaaatcgacgacatcaacaaatgcaccagcagcggcaccaagtgccactcataccgccgatgttaaaattgattttgattgtttttagttctatcaatcccaaa

SEQ ID NO: 2418 - DNA, 1583 bp, Heterodera glycines
atggcctccgcccccggtcgttcagttaggagccgttgtttgcccacaggcagcgactcaggttcactaccggggtttgaacacggaaaacattttagtaaaaaagaaaccgcacaaaattgaattagatccaattattcatcgggtcacaatgtaccaaaatccgtttgtcatttagaaattcatactattcgaaccattgttgcaaattaaaaatatattgtatgccaatgtaaggtccaacacgtgtcgaacatttcctcgcatccgtacggttcggtttggctgaacatggtcgcgaaccctccgccaccaccaccaccgccgccaattccatcgttcagcggcgataccaccactgcatttcttgctgcaaccggcgcgcctgtcgttgcaccaccgccgccgtcgacgcctccgcctccaccgcccccagagaatgaacatgctggggagaataaaggtttgacgcgccatgcaaaaagggggggggggcagagaaaacaaaaacgattacattattaatttcattttagtgggttccgctggctcaccgccgccgcctcctcctccagtgcccgttcctccgccaaaacgttgcagaccgctgtaagtgtgccaagttcttgattttccaatggcacttgtcaatctatgctaaactggtattattgttctaacagttcggtatatgccaggaatatcggttagcaaaaaacctgactctcttgtccaactttttgtcgtaaatcgtccgcctgaattattaaagcattgagccctctctttttctatggaaccccacttttctttttgctcgaccctttttgtttagtgtgctgaaacctcgcgatttgccaacaatctccgagggctggggcatcggaagtgcggataaattccgcattatcgaacaagtgggcgagggcacgtacggccaagtctacaaggccagcgatggacaaaccgggcgaatggtggcgctgaagaaggtgcgcttggagaacgaaaaggagggttttccgatcaccgccgtgcgtgagatcaaaatcctgcggcaattggaccatccgaacattgtcaaattgttggacattgtcaccgatcggacggggccggcaagtgcagaacagtcgccgcagcagcagtcgccgagcatcggcggcgatttgtccgcacaacgcaagcgacgctcgtccacgctgaccaacagcagcactagcgggggtcaaccagcaggtggtggaggtggtgcgtggtggagtttgatttttaggggttggaaatgagactgattttttttaattatatggaatttatgacagtgccggcttaaatgagtgaaagtaccggctaattgtcagaaatatgaatttaccttgctaaattgtaggtttattctttttactattgtaaaattaattcgtcgtcgctttccgttgtcatcgttctatctgttttttcctccttcagttgcctcctcctttttcctggtgtttgaatatgttgaccacgacctgatgggcctgctcgactcccaatcggtcaatccgtcggagttgcaaattgcctcactgatgaag

SEQ ID NO: 2419 - DNA, 10501 bp, Heterodera glycines
  misc_feature (44)..(44): n is a, c, g, or t
  misc_feature (48)..(49): n is a, c, g, or t
  misc_feature (55)..(55): n is a, c, g, or t
  misc_feature (60)..(60): n is a, c, g, or t
ctctcattggccttcggtggtggtgagagttctcattagggggnaaanngagaangaatnaaaacaactttggccttttgaccctccacggatttttttttggcgaaaaaaggcaacaaatttctgcaaaacacaaatcctaatttggatttcaaaaaaaagaaaagaaaaatacatccccaaaaattgaatttttgaattcagccccccccccccccccgaagccacgggtctggttacgccattggaaaaggggacagagtgagcgatgtgtacaacaaaggaaaatgaaattcaattcacaatttaaggaggagaatggctttgcctttatctgcagactgttgctcctccgtctgctgttgttttgggataagcaccggcggtttcggtggctgtgggaacgaacggatgagcagcggcggtttgggcggaggcggaaattttggtggagtcggagggggcggaaggaaagaaaaagcggagaaaaacaccgggcggaacgggtggatgaattgacaattgagaaataaagaacaggtaaaaactcagcaaatgcaaacaaccttcggcaacaggtcggaccaacgcggcggctaacagcggcacggacagcgactgagaggccataaatgagggctgattgtgaatgtctgcggtggtagtggagggtgtgtcggagcgggccatgggcggaatcatcggaggtggaggtggcgccttgccaagttggagccacggcatggaggacttttgggtggagccctagaaaaacccggggaaatcgaatcggttttatagttggcaaaaacaccgaccgctattttgattttgatttcactgctcaataagcgaagcggctttttgaacggagctgtgccgtcgccgccctccgcctcctcttcgcccgcttctttggccttttgcgtgcgccgcttccaactctcatgacgaccttaaaggcaaaacataatccaatagcggggatcttttttcggtcggtcagcgttttgtcgccccttttgtgaagggggggggggcttcaaagatactctggacatggacaggttattagggatcctaattaggaaatttcaaaatgccgtcttcttacgctggaatcgctcctcctcgtcgccttcctcttcgctgccgctggacactttttgtaacagcaaatagtcatcgtcatcgcccacgggccctccggcgcgatgcattcgcttgggtggtgcgcctccggcgacgccaagtgggaagttcgggttgatccatttggtgaagggcactggacgggcggcctcctcatccgccacctgcttacagagcgctgaaaggaccaatttatttactgctaaatttaattaatggtgctaaaatttttagcatatttcttaagaaataaatccgagattttccatttcccgggcggtgcctccctctcggcaccgtcggacgagttttttttatttttttctcttcttttttttattttggattttttaataaacagaggttttttctgtatacgtctctactccattattattttttatttatggtctaacatacttgccaactgttccactgatttgattttaattgtgtccaccaattcggcccccttgggtaattttccttcctaaattgacattatttacaatgaaagtttttttttttttttttttttgtcagaccatggctaatttggtggcattttcggtggcaatctccaacagttttcgcttgtcaatttgtccacgattgtccaaataatcggcctttggtcgctgagtaaagaaacggaggttcactcggccaccacggccgcgaagacggctgtaaatttgaatgttttactgacaatgaatgaaaatttttgtcccaaattccacatccatgccccccccccggtttttaatgtctcttattgacttaaacactgacccgcgtccgcgtagtcccaaaatggtcgtagttgttgctgtcgttgtcccagacgttgtttccccattgatcgtccttgccaagccgtatgtgctgcgccgtcctgctcctggaatgtacggacgccggagggtggagatgagtttcgggtcgcgcacatgcgcaggcagctaaaaaagattcaaataatgagtcacattcggttcttttttctccccaaatgcacatgggttttgtcacttaatcaaacaagaaattctcgcctgtccacccgctgccaatttcttttgcaaaaattctgcccgtgccttctcatacattcgccacgagctgaaagcagtggaaattaggaaatgttctaaaaaaattggcttgtcaaaaagtgaaattaaacattgcaaaacacctggcatcaggcccgtacgatcggacagtccgtcgttttttcggctcattatcgctatcgtcggcttaaagggaattatctctctgaacaattaatggtcccctttatgtccattaacttacagctgtacgttcggctgccgtcactgctctgtcccgctctgctggcagcggacgaacgccgcgagcgtgtggaggaagaagaactggacgaggaggaagcgctgctgcttccgctgccactggacccacggcaacgtgagcgccgtgtcgacgacgcggcggaggacctaaaattaaatagtttttattttttgaaaattgtatggcaaaaaaggtccctaaattcccaagccgaaatagggcatattagctaggcaaaagcaccttcgagacctgcttctgccgcgtgaaaccgacgacgcaccagcggatgacacggaaactgcccgctctatttgcgtcacacgcgctggcggtagcggcgttggtgggctcagtgagcgcgcgcataacggccgcagagtatcgccgcgtgggcgtgcagcaggcggtggtgacggcgtcagcaacgagcggcggacaacgcgacgtcgatgggtcattgtctgcgactttgagggcagcagcggtcgttttcgtcgcaccggcatgcgcggctgtgggctaacgcgacgcggaggcagcggccggtaggggcgtcgaattcgctcaggcgccggtcgacgaatggacggcgagcgacgcttgacggcatcctcgtctctgcggatgtcagcgaccgagcgcgaagtcgctgaggaggcggcggtccgacgcggggcggcgttattcggcgcggcgacaaaagctgttctgctgacatgaatatatttaaatggtgtttgagtcaccagaggaaccaatcaatttttgttgtgaaaaagcattttaaagagtgaaataaaacgggttttggcgaacgttgcccagaactgacatccttatggcaccaaattggaaaagctgtttgtcataatggctgccgatttgtgtcaaaaataaaaacaaaaaatccttggagtttcaccttttatgagtgaaatatagccactaataaagaaatgtcgaacctttccgccgctcggctcgccccggcggtgtctttcgccgtttcctccgctggcgtcggcggcggagtcaaagactcatgcgaaacttgcttgtcctttttccgctttttactcttctttttcagtcgtttgcgcagctgtttttctgtctgaaatttttgtaaataattttttttttcggtgtgtgccaaattttcgaatctaccaagtgccattttcaactttattttgtctctcatttccacctctgcggtcccttcgtccgcttccgccgcctcttttcgcgcacgtttcgcctccttccgtgcccgcttccgctccttccgctcgcgtttttgccgcttccgctcctcctcctccagatccacaagttgccacatcccatcgtcagtcaccgcctcggcaccaaattccttcagtacaaatagttactctaatcattttcttttgaatacgaacaattaataaccaaagtgcaattccctgttacatagctttttgcagtgattactttattactatatttaaaccccattttggaaaatattacttttcatttttggctttaaaactgtcgggtaataacttccttggtccatgatagcattttccaataaatttgccattgaaacctctgcgagtgccgtagaggcggtccccgcttccgcttcttccccgtcctccctctgctcttcttccgcgtctcccccttccgcctcttcttcttcatcgttttgttgttgcgttgccgcttccgcctcttttcgcgcgcgtttcgcctctttgcgcgcccgcttccgctccttccgctcgcgtttttgctgtcgacgctcctccgcctcagccgctgccgcaaccgcttccaaaaatgtctcgtcatcaatatccataggaatatgtttgcactgagataaaattactgtttatcttaagaaatgcaaaattattgcccagcagaaaacaaaagcgatgcagacaatgtgagtcaaaatctcaaagtctatacacaaatgtatgtgaattgttgttctcatctcagttctcgagagagagagagtgacgactaggaaaggcttaaggccaaaggcatttaaataaaacgccaaaatgttacataagttaaaattttcgttttttcattttttttttctaaaatttttatttgtttcaagacaatttatgcgttttaccattcaattacttcaaaaatcgcaacgttgttataaacttctttttacaaattacaccaaacaagttgcttctgtgtcgccgcttttaattcatagtcaaaatttgataagtttttcggccttccgcaatttttgctcttcaattgagacgaaaaaggaggaaatcggccgaatcaaatcgcaattggcaatcatttttacgtgtaaagtctgttccacgagacaggcatggcttttgctttatataagcaaaccctttcgattatccccaaatttaggggcctaagcaattctcgcgttcagcttatgaaaacggcgttgtgctgatccgatgcgatcactgcagaaatcaccatattattgcggacaatttgggctggttcagcgatttggacggcaaaaagaacatcgaagagattttggcatcgaaaggagaggcgatcaaaaaggggacggcggtgttggagatggaagtgccagcggaggaggagggggacaacgccaaatacagcaaataaaaaagggtgatgatttaatgaaatttgtgaccgaatagactcaaatttgcgtcgaccttgccctcatctccccattctttagacttctcccaacaaatgttcgaccacatcggtgccatcgatgactccccgtcggcgtcctcttcgttgctgattgccatcagcgagttgcagcgggcactgctcggcattggctcggctgtcatgtcactggtggacccaaaacggggcgacatggtcgccacaatgggcgaaacgacggtcagctcaaaaagagaggggcgagggggtcaattcgaatttgtcctttactgaatttgttgaggtgggagctgttcttgtcatttggcgtaagaatgcattttacggaatgtttagatttttgaagaattcatttttttgcttttacctaaaattgttcccaaactttctttttgtacattttcctatttcgtggaaatcccattctatttccgtgttttttcacttttcaggttccccattccttgctgaaacatctccgcgatcggctgagtcgtgacgtgagcggcgctgagcttttgcggaatcggccgcgcatcagtggcgaaaccatcgaccggcgatggttggcgacgcttcccgacggaacgatgggcagggaatatttaaggtaattttcaaaaaatcaatccaatgaaataggaaattgagcccaaaatcaatctcccccaccctcattattttattttcaaaagcagaaattcaattgtttgttatttacaaatagggcatcctttattcgccttttataccacacttccgtttttcggtttctcgattcgctcaacacttccccggacgcgcgaccgcccgttcaatttgttgcggatgaccccgaattggtatacgtaatgcaaaggtcccttttttgcgtttttattccaattttccattttctcgcttattgtcagatatcgcgaaacccacgactttacgcatgttctgttgcaaatgcgcccaaatatgctgggagaggtaaaaaatggcccattttcggtcgataatattagataaatgcacaaaagcaaaagtagcattgtttttaaaagccaattaaatggctttgtctttgcatgggaattgcgaatgcacgcgtttttcaacgttttagcgaataattataaaaacttttttgggaatcttggatggctttatttctttttaatttttgatgctccctgactaattataggatcctggaaaagtcttgtatacagaaccatatcctttccgggctcactgaatgctatcaattttttattttaaacgtaaaaattcttcaaattaccaggtgaccgtcaagtacttcgaggccgttcagcttggctttcccatgtgtgttgctgccgcgattttcggcgcacttcgacttggcccagtgtaaatgaccaattactccctctccccttctcatccttttgaaaaatggcaaataccaatattatggggtgtccatttgacttcaaattccttcactacttctccaaatttccattaaaataatcatttttagccatcgtcgtcagctgatcgaacggaacattccatgggttgtgcaacaggcggagaggggccgttttttgttggcgttggactgggaacgccgttttgagcagaaaatagccgatttgcagagggaatgctccatcgaaccattttcagcagaatgttcaaatgaatgattattcagttaaaaagaaatgctcttttttagaaatatttttttcgcaataaactttctttgtatgttacgcatttcgatccgctccattttctgatcactgtcatttttgcacaaaactttcaaatttgtttcgatttaaattgagcatttttcctctaaattcggcagatattcttttcttaaattgtcacttttttatctgtgcttttaatcgattggtccttttctttcgattttatttatttcctaatttttaaagcaaactttttgagaaaaatttttagatttaaaatagaatggaaaaaatgagtgagttacccattgaacgaatggcaccaaatttccatcggaactacaaaaatgtgaagaacatataaaacaaagttgaaatttccatttgagtgcggagattcgtttcattgatccaactaaaaaagaaaaattagggaacaatttgatgagagaatttagtcaataattaccgaaaatggattaggcttttataattcgaaatgctcattcggttactgtatccaccggttcttctgtacgcaccgttacggtgggtgcctccttccttacctatttattgctgctgttgggccgacctccccacgccgttcgccggagtgaccgttttgggggcggacacggcaacaacgcccaccgagctgatacggtgccgctggaacactttcatgaacaatgagcagctgtccttgcggatggttttgttcagtgccaaataaatgaccggaggaaatccttgggaaaagtggaaaaaaattaaaattcaaaaagaaaagccgacaaaacggacggaccgtgggcatgaaacctgaaaagttaattaggatttagcaaatttgaaaagacacttgggtttacataccaagcaaattcggcgagagtgagcatccattgctggcgcaagtcgttgtgttgcatgtacacgtagagactgccggtcaaagtgttgatcagagagaccaaaaacacttgcagaaaggtcggaaacaatcccaattattaatttatttattttaatttctgtgacccatcaacacctttttttgcattgtgttaaaatcgtaactcgaagcgcaaagaacgagggcaaagatcagataaatgcccgggcacagaaacgccaccaaaatgtcgtggaaagtgtgcagttgaacagcgaactgtaacttaagggaaatgcctttttagatggcacttttaggcctttgtcgagacttatcaaattcatgagaaaggaagagcaatctcgagcatattttcgacttttgtccgtccgtttacctcgtgttgattatcggggcgatagccgacgaatgggaaaaaagaaccagccgaagtaaacactgctgtaaacggtgggtttgacgaacacggcccaatagagggcgtagagggagcagccgaagagccaaagcaaagtgcggtggccggagaacaaaaggcgcgagaaacgggacgagctcagctcgagacagcgattgaaggccaaagcctggcggaaaattggccgatggattgggaggaaagggctcccaggcaaatccgacagcgaaaaaaattttaaaaataattaatccgataaatgcatatgcaaaaaaaatggatgataaatgaatggacaagccacaaaaggacgagaaatgtagcaaatattttgatcagcgaaaatcactcccattgctatgattttctgaatcgatctttcacaagttcctttttattgttttttccttttggcgcttgactttctaactttttgttttctatatgtttttattgcccgaatcaaattaattagactcatttgtcagatatgtttaggaaatgatcgaatattactataaaattaattttttaaatttttattcgctgttggattgtcagtcatggggtaaagctgtgccaatcgctaccatttagcacatttttaattcttcttactcaaaaaattgcccgtcgtggattttttttgtcactttgttaggaattggtcaattcgtaatatttttctggtccaccgcacttgaagaacactcacaaccaaataggccttcactttaataaaacacacaaaacaaaataaaacaaagtcggaagacgaggtgggaaccaacaatcaacaaatccaaaagctggaggaagaccaaacatatatccactttaagagtggagaagatgtgaatgaataaaacaaatatcaataaaaggtcaaaatgccgaaccttgaaactacgttaatgtccacaaaaaaatagtagtaaggcacctttagcgtgattggtctaaggtagcaaattaattagtttttttaatggattcgaggatgaatgttttttttattttttttaataatttattaaaaaattaaaaattattttttttataatcccaattacgcactaatttaaataatatcacaaatttttacccactcaaatttaaaatgattaattgtaattttttgtttctcaatggcacacttttgtccctttgcattttaccaaatcagcagtgctttcagcgatccaaagagcttaaaaattaaagaaatttttttcttaaaaatgagtcaaacataaaacagccacgcccacaaaataattcagagttggaaaggagcagaaaacggctccgtgcaaattgagccatccgctgaagaagccgaggatccacaagttggccaagtcagtgatgccaatgtaaaagagcaatttgtagcaggaattatcgcgtaaatgaagccaaatggagtacatgcagggcacgtacagcacctaattgatcccaattaataaaattaattaattaacttatttatttatttatttgaaagaaattgcttgtaccgtgttctggtttacccgttacagtagcccaagtaatgctcaatacggtaactaattttcaacccaattacataataaatggcgcacaatacgcagatggcgattgactcgggcacaaattgccttttctccaacggaatggcgtcgatgtccaacccagtgcaattgtaaagcctttcgtactccgcgtgacggaacagaaacagttccattgggtcgctttgaaaagaaatgaatgtggcagaagaaggccaccacaactcttaagccacgggagaaagccaaagagaaagtgcgaaaaaggtaattatcgtaattagttgaaatgttgttattacatgctaaacgattgccagtgcatttggcactaattaattatcaattgagttaatataaaatattctaaaaatatttgagtaattcttacaaatttttttagctgttaggcgtaaatgtaaaagaaaaatgacgacgcattgtttaattgcccattgcttttcccattggcacgcattctctccaatttggacaatttgctttttcttcaaatacaaaaaggaccaccccacgcattattaaaaatggtttttgccgtccctcccccctccctttctcattttttcccataaactattaaataatcaaaataatttatagaaagaaaatttaggctcccggacatttggacagtggacatttggacagtggacattacgacagtgaatgc

SEQ ID NO: 2420 - DNA, 1658 bp, Heterodera glycines
atatggatttccatataattacacgccctagtaattattcaactgttgaggattttttaaaatctaaagctgaaaaaagtgaggctgaaattcgaaaaaaagtaattttgtcttcaactttttctggtgacacgaccataaaaaaatacgatcataaatattttggcaacttaataccacataacattccaagaagaattataattaaactttcttattatcatttgatagcaaaaggagtcctctattagtctgcaaaatgataatggcttttatctattctttcttcatcttttaattatgaaattgacatgttttggttttgttttgaaattataataaaaaatattggtgaccggacatttggacagtggacattacgacagtgaatgcaaattttaaaaaaggataaaatacgtaaaatatacaattttgatcctattaatagatgattaaatttttcaaattggatcaggcattctatatgcaattgcgcacaagtacgccaaaaagggcgattgacacggtcaaggtaaatggcgcgaacctaaatcgagatagcaaagaaaaagataatgggcttcaaaccatcagcaatgcgactgtaggcttcatagctgtattcaaagccatatgccatgagtacaggtttttgacggatagtttcaccaagaaagaaacgtttttcataattggcagggtcgggattttgctcttgagcctgaatattttgctggggttcgtggatttccccctcttcagaagatgaggaggaatgcattttggtaagaatgaatgacccataggcattaacgggagagaatataagcgatgttttgcaaatattcttatcaagaaccaaaaaaatcggtgggaaattattaatggtcagttattggaattagcatatgtttgcaaaagttgttatcagtaaaaaatttgcattcactgtcgtaatgtccactgtccaaatgtccacttctgtccaaaagacttcactgtcctaatgtccactgtcgtaatgtccactgtccaaatgtccactgtccacctttgttcattccttcgcctcatttatcattgtttttggcactttgcccggtgccacccatccgccaaatgttcgctcaatctagcgaccaacagcgataagaagggcctcgttgaaatgggaagcgatcagctggacgcccaatggcatatttgtggtcggactcttcggaccgattggtgccgcaagggcagggaggccgagaatgttcggcatgtaaaaataagtcaatttcaattttaaatctcaattttaaatttcttgttttactttgatgtattcgctgttgaacacccccgtgaacggttcctggtgatggtaaccaattgtggtgggccacaatgggagaagcagaaccccgtcactcccgagcagttcagtgagctgccgaccaaacttttcgacttttttcacaacctcaaatttataataaaataattaattatttaattgcttacaaattccttctcttcctcatcttttggcgccacaaaatttcgcaacacttcgaattcccatgaccaaaaggttgcgttgattcgcccgcataaatttggaagaatttgaggagccacagagacaagggctgccaaattaaaataatcaa

SEQ ID NO: 2421 - DNA, 1057 bp, Heterodera glycines
ataataataataataataataataataataataataatcattataataataataataataataataataataataataataataataataataataataataataataataataataatattattattattgttgttgtcagatgatgcatggttcgttctgtgcaaatgtgactttcaaagggaactctacagaaatccaatggtttcaaaaagagattttactgatcgctgttcagatcatggatcacgcgaaaaaatatgtggaaaatgaattggtgagccatttttaacctttactaattgacaatttatgataattttaataacaaaaaaaaatcagtttgtagttataaacagggatgcaaaaaatattcacaaaaatgaccaaaatatgcacctaaatatgcaaataaaattgtcaaatatgtacaaaaacttcaaaattagggggtgaacaaaaatttatttctcataaattttatcggttatttttgtaattgcaaatcaaaaatttctcaagattctcggcagtgaaactcactgttgacccactcgcgcatccatatttggaaataattttaggcctaatcaattttttttcttaagggatattcaaatcggtaaatttttgacgaaaaatggcaaaatatgtatgaaatatgcagaacaacccaatgcatttgcatattttttgtatccctggttataaatgccaaaaacatcattactataaatattaaatactcaaaaaatgataatgttaaaaaatgttttttaaatgtattgaataatgtttgcagaaaataattataaatgttaattatatgataattgtttaacaaaaaacaaaatttcttagtcacaaaaacgggcacggatttaatcaatgaaattgcagtaaaaaaaatctgaacttttctgacatatgctgtaataataaaaaaagaataaatattttttttcattatgcattttgaaattattaaaaatttattacaggaaaaaacatttccgctgattgaaattggattggtcgaaagtaaaaattgatcaaa

SEQ ID NO: 2422 - DNA, 1737 bp, Heterodera glycines
taagcttatgcttgcttggacctaggccaaggcttaggatttttttgttaaatagttattgtacgagtttgcctctgtacaaattaccattgacctctatttcactttacgattccaatcaatgatcatccgcagcttcttagactgtgattttccaagtttaagcccacaaatcccctcgcttgtaataatcaatattactaaatacacccagtttttcacgaaattttaatcaattttaccagcagcacagaatgcttgttacactagagttagacatttagaaaaaagcctggacttgatcctggatttcaaggtttacctgtacctggatttcctggacaaattccaagaaaatccacgcctgggtccggatcatcatggtcgaactctagttaaaactatagaaagcaaaacaaaaaattgaaatcgaaaacaaattggaatgtgtggtcaatcgctcagccaccctaaatttttgaaattttgcccatctttaaagccaacactaatgttatttatttgggtgtttacgcagatattatcggcaaggctttgtgtcgacaaatttgcaaaatgataccgacttcacactgcgctgttcccctgagaattgttttgccgttttggactacaacggtgtccatgttgtgataacccgcttcgacacttacgtcgaccaaggcagagctatcgatgcctacgattggcttttccgcttggatcaggatgctcaaaccatccgcagacagtttttggcgaaataccttcagtatatgagggggggggggaaattttttttgctatttttgctcgattattattattatgtttatctcttttatcgtatttttgggggcttagatccatatattttggcagtttttatcgcatattttcatttaacatatttatttattgcatttttcgatccataacttaatattgtaaatatttattattaatatggcatttaatttagacaatacttcgacattggcaaaatgtctgttgttctggaccgttttgaacgacggcattttccgctcacgaacgaagaccaattccacaatgtggccattctgcgcagaaaatgtgccgttcaatcatcagcattttattacccattaataaattttacggacacatgtacggtcacgtattattttcctggttcctttttgcatgcctgccaatcattcattatttacttttttgtataatattggcaatttttgagaaaaaaattttggaattttccaaaaaattggaaagggaaagttgcaaaaattgtcattaacaaattgaacaatgtcagcattgaattgaatgttttcaattgcattgggtgagcatgagcaaaaaagaatttgtataaaaatacaaaagattaaaaataatataaaattttaaaataaaaattttttacaaaattaacacaaatccacaaattatgaacataattttgctttaagtatttctagttttctattatttattatgactgcatgcgttgaaaagattcaaaatttataaatagtcatttaaaaccataaaatttaatttaattttgtaaattgaattgaagaattttgttgtttcatgtgcttattataatgtatttttactggcattttttataaaaatttctgattacagaattatgacttttataaaattggtaatacgtccgatttcttaaaaaatggcccaaaaattaaatttagcaatctggta

SEQ ID NO: 2423 - DNA, 4521 bp, Heterodera glycines
tcactatttcggactttttgtcactgtttatttactatttcgacattttttggaaaaattccttaacaaaaatgcaataaacgaaaaaatacacccctaagaatcgagctaaaatttttcaaaatatactcctatgaaatgaaaaaaaaattttctcaaaaatttactttcttggcaaaaatttttaattttaaaaacttttttaggtaattattttgggttttttgctcataaaaatcccagtcctactcatttgcaactgcaaatagtgaataaaaattatttttgctcaatttttggctgaaaattatgtcactattcgtcactatttcggactttttgtcactgtttcttcactattttgggatttttactcactattttagttaactatttcggtatttttcgtcactaaaagttgcggccctaataattacgtataaaagaaaaaggattaaccagaggccatcatgccaaaaagcagttgctgatcctaacaaatacaataagtgggattaaataaatgccaaattaaaaattgtagaaaaaataaacaaaatcgaaatgcctatgctttgctaaaaaaatattattttttttcaaaaaaaatatacaataattcagctgaaatggcgaaaatgaaattgatttttaatgtgaatacaaatgacgacagaaaatctaaaatcaattttgaccaattttgcatattaaaaatgtgaattttgatgatcaggaaaaattatatatgttgttttttatttatatttttaaatttaaaagaaaaatttaaatctcggataattcactcccgcacatttggacggaaattggacactaaaaattagacattaatggaaaattggacattatttgatataaataaataaatggagcatattaaaataatatcttttagccaaaccaaaatttttgtttattaatttttaatttattatatttttataagcgtatattgttattattattttaccatcgctataagaaagccatcacttatcattcataaagaaaaaagttttcttttagatagagttcccatttttcgtgcattttttggcacatgacaaatcattgtgcctattgaatgcttgatcaacagaaatcattaattcattaatccatttttcgcgcgaaaagtcaacttgttcctgcatttttgctaattctaaaggctctaaaatcaaatccaaatttgaatggatgcgcgagtgggtcaacagtgagcttcactgccgaaaaccttgagaaattttgatttgcaattgcaaaaacaaccgataaaatttatgaggaataaaattatttaattaatttgcacccataattttcaagtgcataataattaaaaattccaaaatatggtacgcttctgccgatcactacttgaaaaatttgaggaattacattttcattaaaaaaacctaaaataatagggcacaattaaaaatgttataaaatttttaagcaaaataaatgggaagataaattaatcataggttaattctcttgacttaagtatctctgcaaagtttggtgagcatctgatccatggacggtaaaaaacgaaaaaaattgccaaaaaataattggcgtaaaacaaaacgccaacacaatcaaacactttgtcaatccgttcatccgtcccatctccttaatccatccatcaattaggcccattcgccgtgccattgttttgctgttccggtacattttgtgttgccatttcttgatttaaagaaaatggaggacgaatttatttgcataggccgccaattcatgacaagtttcacgatcgtttttaaaataatttacccatatttaaattatctttaccgataaacaattccgaaatgccacaaaacgagatcaagcattaatttgcataatcggaaaaataaatcggtaatatttattgaaattataaattcattaaggtcttaccacggcggcatattggacatgttttatgattgcctccatacctataaaagattttttcttcatatatgcacatgtatgaaaacatagacccgaaaagccttaaaaataccagttttcaatgcactggttgtggaaaatgtgctgaaaatagcgtcattaatttcatgtatttaattatatgattttatcttacgttacacggcaacggtctgacaaatgtctccaaaggaatttgatcgagacaaattgcgcaatcaacacgttgctgatcaatggccataaaatgtatttttggcatcgcgcgatatgcagcaagaagcgctggcaattaaaacataccgtacttatttgtgaatattcccttctccccttctaagggtgtccggataaacataccgtacttcttgtaataccatatttccaggattctaagccacacttcgattagaagcccgcccctcaaatataagccacatttggagggggttgaataatagaagtcccggggattctaatcgaggaaatacggtattttcctttccctactatgccaagacaaaccgtcagtggacaatccgtcagtatggaaaatcgtattattcaatttaaaaaaagaaaaaatagctcaacaaatacaaatattccttctcgcctgcaatttgagcgagatatggaccctgatctgcggatcgccaaaaacaatgacaaaccgtcagtggacaatccgtcagcaatagacaatccgtcaataaatttacaatgataaaagatttgcataaacaaattatttaattaaaaaaaattgtaagaaattcaaaacattttatcactatttgggactttcatactaaaattgttgcatttttactttcgcccaaatttgatttttattaaaaacttgatccacactgttccagcccttgttcattttcccttataatatggataacgtaagatctagtagtctactgtagctcagttttgatggatttggtagactaaaaaaaggtgttgtaaaaacaatgtttgcccgctgacagtccgcgcccctcgtccctcaatcaaatcagcaactgctcctcctcctcctcctcctcctcctcttttacctggaattggttgttggtgctgctgctgctgttgctgcaacgcttcgatgttgataatatggttgtggttgttcaaaacaacttcttccgccgccgccccaactgccggcaacaactcaacattatttgcaccccgttgttgttgttgttgttgttgttgttgttgttgttgttgttgttgttgttgttgttgttgttgctgctgctgctgctgctgctgctgctgctgtggtattcgtatgcagcgataatgtagaaagttaaagaatttaaagatgaatacaatgccaataattacagcacaacaaagcaagaacgtgccgaaatcttttgcatctttgtcggtatatctgctgctggtcggcgacggcgcattccttcgcttccgacgcctctgacgacgacgacgacgacgacgacgacctccaccacttgcatcatccaaaatgatttaggtatattttaaaaattgcatatgctttttaaaaccttttgttgttttaaaattcatttcgaatattttacacaattttgacattttttttgaaaatttatggcttttttggggatttagtccccgattttggtccaaatttggcattttcagatttgctgttaattagtatttatgtcaatgtttggcgaacgtccggaaccggaaatattttatgtttgtttaattgaaaatcatttaaaaatgcatataattaccatcatcgtcgtcctgctgctgctgaccacctgctgaaaatgcatttgcgtcccatttcatttccaatgaatgcgcaacaaattcaagaaagcgtcgttcttttttgccatatttttcttttcctttttgccatttttcttcttttccttttttcccacattctccacaactttttagcaccttatcagcgtccaattgacactcattataaatgtcaattaggccaattaaaatttcttttggctccctttccttctcctctcgtgggctttccagtggaatttggccacgctttgccatgaaaaacacggcatatgccaaactctgtttgagttcattaagctgcgcagatattttgttagcatcgtctgaaaatttccgaaatttcggcctgcgaattattttttaccgtattccaaagctttatttgccgaaatgaccgtagcaaataatgcctctaacaattggctcagtgccggatcgttttgattaatttcaatccaagcatttttgacaaagttgtattcggtttcatccgaacaattgtattcctattaaaaaaattttaaaaattaattttttaatgctttaaaattacaaattttgaaatttacctcagaattttgtgggtaaaaaactgcttccaagagagaatgttttttgctaatctcttcaatgaacttccatttgccttggttttctttgccgagaattcttctaccatattttttaaac

SEQ ID NO: 2424 - DNA, 4074 bp, Heterodera glycines
caaccgggagccgggaaaaacaagcactggtaagaatgggggtctgagtgcaaaaatatatgattcttaatttttttttaattgtattttatcatttttaaagaaatccgtacaaattgagcctagtaatcccaaaaccagccttttttgttgaaaacctgttaacaaatctcactcaaattttcaaaatttcccccggcggcgcctatcggcaccgccggtccccctttcttccgctaagttttttggaaaaagcgcgccgaaaaaatttatgtgaaacgtaaatctgaatttctaataatattcgatcacttagtccaaaaatgattaattgtttgaaagaaatgaagaaaatttgatttgaaaattttcattaatttattagctttaacttttgggttttattaaataaaaaactaaataaaaatttaattttgtattattttcacttgaataaattaaaatttgaatttttttttaattttttaaattttttgaatttttttgaatttttaaaaattcccggttggtcccggttcccggtcccggtcccgaagaaaaatcgaggtcccggtcccggcttctcaggtcccggcaagtcccggtcccggttttgcccaaaattcccggtcccgctctactctactcaaaagtaattcaattaaaaaatttaacttatataatctattaatttattttgcttagaacggaaaaagttatcctgccttaacaataatttacgggtaaaagccgaagtttttattatggcttagaaatctaaaatttatatcaacatcacaaaataagcttttcttaaaggaacaccaaagaaaaaaaataaagcaaaaaaatcgagggacctatttaattatattttaaatatatgaaaatattattgtaataatgttcatttattgtaaatgaaaagaaatgatggatgaaggtgaaaagacagtaaattttatgcagttctattagtttgacgtcatttagttattaattgatttagtttttaattgattattatatttacgcatagaaaatataaacagtaataacaattaataactgagtaaaatattgattttccaactgcttcgtgaaatctcatgctttttccaaccgttcgcatttcccaggtatttcacgtgaaaatcattgtttaagtgtggcgaagtgacaaaagtatacataggagtggtgatttttccgaggaggggtcatttcagtcccaaaaaatgatttgaataaataaaattttaaaaaaataaaaaagggccaaataaagcaattttgcttttttaataaatttccgccacccgagacacagactcgacctcgagtcttgagaactagatcgaagcttgacccgagattttccatattataagggaaatggacccaaaagccgggacagtatatcaattttcacgacccaaatgcaaaaaattcacgatcctctcgacccctggattgtttttggcgatccgcagatcagggtccatatctcgctcaaattgcaggcgagaaggaatatttgtatttgttgagctattttttcttttttttaaattgaataatacgattttccatactgacggattgtccactgacggtttgtcttggcatagtagggaaaggaaaataccgtatttcctcgattagaatccccgggacttctattattcaaccccctccaaatggggcttatatttgaggggcgggcttctaatcgaagtgtggcttagaatcttggaaatacggtattagaagaagtacggtatgtttatccggacacccttagaaggggagaagggaatattcacaaataagtacggtatgttttaattgccagcgcttcttgctgcatatcgcgcgatgccacaaatacattttatggccattgatcagcaacgtgttgattgcgcaatttgtctcgatcaaattcctttggagacatttgtcagaccgttgccgtgtaacgtaagataaaatcatataattaaatacatgaaattaatgacgctattttcagcacattttccacaaccagtgcattgaaaactggtatttttaaggcttttcgggtctatgttttcatacatgtgcatatatgaagaaaaatctttttatattggggtgttgtataagttctgtcaccccgaccaaaaatttcattcaaaaatttataaaaaatcaaataataactcaaaattaatcaaaatatgcccaattattctccacaatcttctcccatttttgagaatttaaaaatgatctgtcgattaaattcaagatagttaaactcaaataaactgatcggtctacttaaaaaagtcgccaaattcaaccactgatttcttggccaagaaaaggataaaggtacaaaacaaattatggttttgtagagcaaagttgggactatttgacaagctgaaaaagagtcaccaagaccgacgggttatttttttaaattgtcctgtctgaaaatgggtgctcaaaagtgccaagattcagcacccactttgtacaacattgttctgaaaggacctaataaaatgaaattgatgttttcatgggcaaaccaaacccggagaatccgaatatcgcctcagatttagtcagttgctgttctatgaccctgtactgcttcaacttcttgtcaacgacatggagcagtacaatgccagagaaaattcagagatcaaatctgaggccagatttggattctccggacttgatttggccataaaaactgcttttaataaattccaactgatcaaagcaaagttttgacccgtacaataaaagtgatcgaatttgtaatttggggacacccattggaaaatttttttaaaaatcaatttgaatggggaagaacgaaaaatggcttttaaccgaagcaaaaatgtctgctctttcctataggacagaaattgatcggctgtcacttgcggttaacggtgcaaaaaattccgattagcatagcataagaagggtgacagaacttatacaacaccccaatatcattttttaaatgaaaatcctaccaattgagcttaataatcgcaaaaaccaacctttttttgttgaaaatctgttaacaaattgcacccaactttttaaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattaaataaaaaaccaaataatttgtattattttcacttgatataaattaaaatttgaatttttttttaaatttttaaaatttttttgaatttttaaaatttcccggttcccggtttttcttgcggtcccggtcccgaaaaaaatctaggtcccggtcccggcttctcaggtcccggcaagtcccggtcccggttttggcaaaaattcccggtcccgtggcactctaattttaagcaaaagaagacttgtaaaatgacaaataaatattctgaaaaataaacaaaaatgataaaacattttgtttcttcacttttttttgaaaatcatcctttaatccaaatttgttaaattacatcaatttggcattcgtcatcaatttcttccgccacttcttcatccgtgtcatcctcgcccttcctttcttcataattctaaagatgagaattcagaaaaggcaaaccttttgaaaaaacaaacccgcttcaattcgtcaatccttccggtgtccagcagccaattgttgacgaaatggtgctccaattgttgcaaaattttttccgcgtcaggcatacatttccaccattgttcgagtcttcgccacaccgaatgaagcgcctcatcaccttgaaaatgaaaatattaaaaatttgtgctaattaagcaatttgtttttccccctgctcatccaaaaggccaatgaattgatgttatagtgcaaatggcacaaagtggagagtagaagatgggcctt

SEQ ID NO: 2425 - DNA, 1401 bp, Heterodera glycines
cccccccccccccctcccaagggaatttttggacttttttgaaaaaggcttagaataaaaatagtctaagccttaaattgtcattttaagccctttcaaaatctttttttgctgatgttgctttaattttaattttttgttttattgtgctgacgagttcctttttctgccaattaattcctttctcgtgccatttacagattctgcatatttctatgagcagccgtcgtccatcacccaaagcatcgacaagtagagctcgatcagagcatgaagtaattgaaatcccgggctttttgcaaatttccaacccaaaaattttttgacattaaatattataatatttcaattctaaatttgtactcaaattttcttgtaattattattttttcagcgcgctcgttctcgctcccgacatgaacgaaggggaatgtttgaaattgttcggcaaggaatgtggtcaaaaattgtcgtcactttgcgaagtatgctgccatcgccaccaatattggaacgtgaatcggtctctaatttggcatttaaaattgaaataaaaaatggatttgataatttaggtttatgacaatcacgcgcaaccatttcgtggaatggccttgattataaataattacatcttccccgatgacagacgagaaggaacaaacgttgatagtgtcaacttgcaggaattatttcagcaattcggctacagagttcaaatttaagaaattaattccaatgatttataatagatttttattattttagttttttttcaacgcatgtggaggacgtaagtgaaagcaaataaatcaaattatttcatttttgagttgttttttaagcaaatgaagaatatggagcctataccggaagcaggacccttgcaaaaccggcaaccggacaaagcagtgatagtgctgactctactgttgggtaaattggactaagtttgagtttgcggtgtagcccctctattgaatcagtcccccgccctccccctgatcagttccctttgattttttaaatccaagttagaaatttttcaaaaaagcttcgattttattttaaataaatttttattaaaaagtttaaagtcaaggttttttggaaaatttgagaaattatttcttcataaaatttataaattcgctgaaattttgcctttcaaaatctttttttgctgatgttgctttattcggctacagagttcaaatttaagaaattaattccaatgatttataagtttttgggggggggggggtgaaaaccccccccccgttgggcctcaagaaatctcaatatacggctgtgacttacggggtggcttctcaagtttcgcagtctactcaaaaggactgacccgagacatgattgttggtaattcgttgagttcgctgc

SEQ ID NO: 2426 - DNA, 1660 bp, Heterodera glycines
  misc_feature (1504)..(1504): n is a, c, g, or t
  misc_feature (1569)..(1569): n is a, c, g, or t
  misc_feature (1580)..(1580): n is a, c, g, or t
ggaatttttgggcttttttggaaaaaaggcttagaataaaaaatagtcctagcctttaaattggtcattttaaagccctttcaaaaatcttttttttgctgatgttgctttaatttttaattttttgtatttattggtgctgacgagttccctttttctgccaatttaatccctttctcgtgccatttacagattctgcatatttctatgagcagccgtcgtccatcacccaaagcatcgacaagtagagctcgatcagagcatgaagtaattgaaatcccgggctttttgcaaatttccaacccaaaaattttttgacattaaatattataatatttcaattctaaatttgtactcaaattttcttgtaattattattttttcagcgcgctcgttctcgctcccgacatgaacgaaggggaatgtttgaaattgttcggcaaggaatgtggtcaaaaattgtcgtcactttgcgaagtatgctgccatcgccaccaatattggaacgtgaatcggtctctaatttggcatttaaaattgaaataaaaaatggatttgataatttaggtttatgacaatcacgcgcaaccatttcgtggaatggccttgattataaataattacatcttccccgatgacagacgagaaggaacaaacgttgatagtgtcaacttgcaggaattatttcagcaattcggctacagagttcaaatttaagaaattaattccaatgatttataatagatttttattattttagttttttttcaacgcatgtggaagacgtaagtgaaagcaaataaatcaaaattatttcatttttgagttgttttttaagcaaatgaagaatatggagcctataccggaagcaggacccttgcaaaaccggcaaccggacaaagcagtgatagtgctgactctactgttgggtaaattggactaagtttgagtttgcggtgtagcccctctattgaatcagtcccccgccctccccctgatcagttccctttgattttttaaatccaagttagaaatttttcaaaaaagcttcgattttattttaaataaattaaagtcaaggttttttggaaaatttgagaaattatttcttcataaaatttataaattcgctgaaattttgccctttcaaaatctttttttgctgatgttgctttattaggctacagagttcaaatttaagaaattaattccaatgatttataatagatttttattattttagttttttttcaacgcatgtggaggacgtaagtgaaagcaaataaatcaaaattatttcatttttgagttgttttttaagcaaatgaagaatatggagcctataccggaagcaggacccttgcaaaaccggcaaccggacaaagcagtgatagtgctgactctactgttgggtaaattggactaagtttgagttgggcggtgtagcccctctatggaatcagtcccccgccctccccctgatcagttccctttgattttttanatccaagttagaaatttttcaaaaagcttcgattttattttaaataaatttttattaaaaagttnaaaagtcaggntttttggaaaatttgagaaatatttctttcataaattataaaatcgctgaaatttgcctttcaaatcttttttgctgatg

SEQ ID NO: 2427 - DNA, 3181 bp, Heterodera glycines
  misc_feature (1888)..(1888): n is a, c, g, or t
caacaacgacgaggggaggggacggaggagaagcgatgccggggagggaggggtccattcttggagatgacagtggcggactgatgaatggacagcgaacggagaaggaaacggaaaggataataaacagagggaggggagtagagagagagggaatggaaaagaggggaggagataagagagagtggagaagaagaggaggaaggattgtaacacagaggaggaagaggaagggaagagatagagggggggggggggaaggaaggaagcaaaagcataatgtgcactttgatattctttcaaataattgtaatttatttgaatatatttttatataaatatttacagtttctgttttattttctggcggtatgtttcgtctgcgtttgaaattgcgcgggttgggccaatgtaagcaaagtgccgctggagaaagggtactgtacctgcgagtactgtttcgtccgtcccttgcgctccctttgctactcacctccgttgggttcgtcgtcgtctgataagtcggtggggcaatggtcctcggaggaaatatgcgcggagcttttcctgctgtgtttccttttgccgccgaagggattcgcctcgggggaaaagcgggcggagccttcggcggcacttttattttacgtccatttgccactttctgaacattctgccggctgtgttcaattggctgcttaaccgcatgttgtcgttggccaaactgacgaccgcgaaaggaattggcaccgttttgggggaaagggccatttcgtacactcaattctttttggggttgcacaaattgactaggccccgaatgaaaattgctgttctgttgctggttgtaagaatacccccccccctcccaagggaatttttggacttttttgaaaaaggcttagaataaaaatagtctaagccttaaattgtcattttaagccctttcaaaatctttttttgctgatgttgctttaattttaattttttgttttattgtgctgacgagttcctttttctgccaattaattcctttctagtgccatttacagattctgcatatttctatgagcagccgtcgtccatcacccaaagcatcgacaagtagagctcgatcagagcatgaagtaattgaaatcccgggctttttgcaaatttccaacccaaaaattttttgacattaaatattataatatttcaattctaaatttgtactcaaattttcttgtaattattattttttcagcgcgctcgttctcgctcccgacatgaacgaaggggaatgtttgaaattgttcggcaaggaatgtggtcaaaaattgtcgtcactttgcgaagtatgctgccatcgccaccaatattggaacgtgaatcggtctctaatttggcatttaaaattgaaataaaaaatggatttgataatttaggtttatgacaatcacgcgcaaccatttcgtggaatggccttgattataaataattacatcttccccgatgacagacgagaaggaacaaacgttgatagtgtcaacttgcaggaattatttcagcaattcggctacagagttcttgtcaatgacaacgagacagcggaggttcttgatcgcccaaatccacctttttttgcttatttgtgtgaaattgcttatagaatggaccgaaccgaataaatttgactcgaatatatttttaggaaatagcccatttatatcgcctaaaaattatttatttttaattttagtttattgacggattgtccgggagccgacatggatagtatttaaagtggtgacaaattcgatgttaaaaaatggaattttgccaaaaaatgcgcaacgtgcccccaaattgatgggacagcccaaccttgtaaggaattaacaaaatntaagaattttaattttattatctaagcgatatcgctgtttttgccctgaaaggctctcgcgagcattaatgttgttaataaaaaaaattgcatctgagtcatttttaattaattgaagaaaaggttgaaaaaagttgataatactaaaaatgagtaaattaacaaaattaatcataagttatgattcataacttacaaaatttgaactcggctctatttcattttttaaacttaaattgtttttgaaagattttttataatattctttttagacccaaattttatttgttatgcttatatgttcatgtttttaaattttcttttgacttttaccgtgttaaatcactccgcttcttcatcaacagcttctaggttatattttgtgaagtagaaaaaaatatttatattattcataaaaccatttcttttttatttgcaaatgattttttgggtttttgcctgttgaattccattaagtaaaatatgagctcatctctcagtttcacattccaataataatttattcgtacaaatgtttttaataaaaagcaatgcttcattcaaaaacccaaaaataaaaataaatcttgctaacaattatagagcggctcaattggtacccgatcttttttgtttttcatttgattttatatcgaaaatgatcaaattggattttgatcgaactttttatactttttgaagttttcaaccatttggatgtttttttatttaatctttaaggagaagcccttttgtaaatcccaatttggtcatttttaaaaacaaacaaattttattagtaggcaaatgcttaacgttccccttgctaatttgatgaatctttttccatttgctcactttccgttgcttttgctcttaattttctccaactgccagcagacatcgcccaaccagtaaattgcttttttggctagtaaattttattataaatttttatagtttccatctgcttctgagcgatgattacactggtggtccagcaaattacattccataccgtaattttcgggatccgtgattctggtccaaaaaactccggaatttgaatccattatttaaggcatcaaatattttcaaaaattttcccataccttcattttgagaggcatattttaaacattagcaaatctgagttttcataaagaaactggaattcggaattacggcacagagcttaggacaatcctttacttgtaacaaagttttttttccaccttcattagcttcacgcgccaaaaaatccgtgcaaaacccatggaaaaacagaagaag

SEQ ID NO: 2428 - DNA, 1651 bp, Heterodera glycines
  misc_feature (1525)..(1525): n is a, c, g, or t
  misc_feature (1542)..(1542): n is a, c, g, or t
  misc_feature (1559)..(1559): n is a, c, g, or t
  misc_feature (1576)..(1576): n is a, c, g, or t
tcttacaaatgaaggtccacgggtgtccgtgggatttccgtatgaaatttggtgaatggtagagcacccatgggttcttaagaaaaatgtttttattttctgcgaaatgagcacgagtgccgagttatgaagtgacaatgtttttagttttttctaataaagaaaggaaataattatttcgctatatttcaagcgtcaaatggtgtagaggtaatgcgttaggcaacaattctttaggcatcaggttcgaatcctctgcatgctaatatattttacaatttttatttgcaaagttaacttttaaaaaattgtttaaaaacaaaattttattaattgactttgcaattacctatatgtaaaaatgatattttatgaatctttaaatgaaaaaaatattgcaataatgcaatatttgctttgagattaaaaacattagtagtaagttgtccaaaaaagtccggattacggtattgatgtcatccaagcctaaaggtattcttttatttatttattgcccatctatgataaaaaatgaatagataatcaaatatttgaaaactctgttctatttaataaatttagtccaacaattttaaattcaactaaatgtttttaccaatgattgtattatttttacttgctacgaaaaatcagttatttatgattaataatataataaaattgatagaaatattattcccacaaatacacttatttaagttgttttgttagaataaaattaattttttatataagataaaattaacttaatcaccacccacgaatgcaaacatgctcttaagcgccacatcgtccatagctgctccaaaactatagatctaaaattaaaaataaatatctacaaatttatcgatgacaaattaatattctaaaaaataaggatttctactttcgagttgatgcacaagttcatattagaaaaatttaatgtcggctaaccgatatcatcataatacgcttgttgatgatattttttaaatttcaattcatttggaattgaaactttatttacctaattattaattgaatataaaccttttttaaagattttattcggccttgcataataaaaattagcttattgagaataatatctaaaatatttgcaagctaagcaattcaaaaatgcttcccataagattaatatggtaaataaaaccaataaagaattttaaattttgaagtttactaaataatagccttaatatttatcttttcgttgtaaagaaaatagttataattgttgttcaaaattaaaattttctatttatttaaaaagaatccattatcattgcgtaataataaaaaggagtgtgtcggaaagcggaggcagaggcccgcttcgaacattggtatgtggtggaacccaacctaccggtttttcgcccgattgcacgatttgaaaggctgacatccaaaaaatagtcagtacatatgaaaaatttgaaaatattaaataaaaattaaaatatctatgcttttaaaaaacaaaagaacgccttanatattcattcgccttanatattcattcgccttanatattcattcgccttanatattcattcgccttaaatattcattcgccttaaatattcattagccttaaatattcattcgccttaaatattca

SEQ ID NO: 2429 - DNA, 6137 bp, Heterodera glycines
atttcaatgcattttttgtgatgggctatagggccaaatgttcacatttttcactttgtgccccatttggccgatttttgcccccctcaatgtccctcccccatttgctcacccatttcggtttaattaccccaagtttgagataaaatttggtggtaatttttctgtgctttctttctgtgcggccccaaatccgaccgttagtcccgtctcgatcgcccccggcccctttgtgctctccctccaacttgtcaaagtcctgcacccaagtgcaggcaattgtcggactccaccgcgcccacacccgcacacaaactcggagtacgataagtggcgaccctggcagggacaaccaagcaacgacaaacagcaacaagtgcgcgacaagccgcggcggtgcactcaacggaaaaggtgtggtgaatttggaaaaattcactcggtgttccaagtgttcgctctccgtggcaaaacttggacacaacaaggaggggggaagcaaaagtgggagttcggggaaatactgatcggtctccgtgccatcagtatttcctaggtcaaattactgctcggtctccgtgccagcagtattttgtcaattactggtcggtctccgtgccgccagtaatcagtaatattactgatcggtctccgtgccatcagtaataggggcaattactggttggtctccgtgccgccagtaatcaagcaaagtactgctcgctctccgtggcaacagtaccggtccttgccaagcaaaggaaggaccgttggcatgaactgctcgctctccgtggcagcagttactccaacccgacgcggacaagtcaaacggtcggaacaacacaagtatactgcttgatctccgtgtcagcagtacttcacgtggaggtggttgtggtattttaatcaaaaatgagatagccttttttgtaaaattttctggtacaaaatttaattgtgaaattttaattattcaattacaaaatctgaaatcaataagatttgcattgatttaccggcctcccaaaaccactttaaaacaaacaaaagaactttttaaatttatacaaacattttggtgtgaaaattataatcttaggagatctaaatttgtcaaatcgagaattggtatggaggcaaggccaaccacacgctataaatcatattggtgaaatattttgcgacttttttaataaatttacatttataaatgccacgaatgagcccactaggggtaaatcatggttggatttgatcttatcagcaaatgataaaattgtaaaacattgtactgttgaaggtggcatattttcatcagatcatttagcacagctttttgtgctgagtgttccagaaataagagcaaagcctaaagaaatttgcctaagacggtttactccgtctaatgtatcacatttaaatgctgtaatttctgctagattaagttctctttctctttcacattttagtataaatgaaaaatgctgtgccttcaatagcgccttgttgaatgccttgaacgagtgtattccaataaaaaaattactaaaaaaagatttagctccaaaatatccacaacatttattggcatccattaaagaaaaggcaaaattatatagacagtgtaaaattgatccaacaaaaaaagcactttatgatagcattactttacatataaaaatccaaaccaaaaaaatacataatttaattgaacataaggctatttcaaagggaaaaaattcaatttttaaatacattcaaaaacacaatgtcaatccctttgaaataccaaatttagtttttgaaaataaatgctatcatgaaagtgaagagaaatcggaattatttgccattttatttgcaaattcatttaataactccgaagttgtcctaaacgatttaagtttggacaactcctatggtaatattcaatgctttatatcggacataaattttaacatcattgagactcaaacactgttaagaaaattgccaaataaaaatggaacttctccggataacatttcttataaagtcctaaaaaattgccatttttcattggcaactgttattactgagttgtttagactatcattagacagtggttctcttccaaacatttggaaggaatcaattgtctttcctctttttaaaaagggggataaattcaatcctgaaaattatagacctatttctttaacctgctcactatgcagagttatggaaagaattctcagcaaaaatatttacaattttctattaaaaaataataaaatttcagagtcccaatttggttttattagaaataggtcaacaacaaatcaattaataacagttgtcgaagattggtatgaagcaattattaatggaaaaaaagttgactgtatttatattgactttcaaaaagcatttgactcggtacctcataatttgcttttatataaattggaaaaaattggtatacggggtaaattgctgaattggataaaagcatttttaatgaacaggacttttcgcgttaaaataggggattctttatcctctattaaaaaagttggctctggcgtcccccaaggctctgtcttgggtcctttattattccttatatatattaacgaccttcctgatgtcataccatcaggagtgaatattaaattatatgctgatgatgttaaaatctatatttgttataaagcaagaacagaaacggaaattatgcataaagcattgcataatttattcgaatgggcaaataaatggcaaataaaagtttcaattcaaaaaacttttgtactttatttgggttcaaaaaacccaaaagaaacttataaatttgatgggaatacaataaatgctgtggatacaattagggatttaggagtaaacattgataacaaattacaattttccgatcatattaatcatataacaaggaatgcgtatttacgtatgcgttccttgttccgaataattaaatccaaatcatctaagatttggattacgttatataaaacttatattaggcctttattggaatacgctccggaggtttggaatccgtctcttcaaaaaaatattaaaaaaatcgaaaagtgtcaaaaatatttcaccaaaagagtattttttaaatgcagccttccgccaattccataccaaaatcgattagaatacctgcaactgccaacacttgagaaaaggcgaaagctatttgatctgttcatggcgcataaaattgtttatggccgaacagatctagatatattaaaaattttcaaaccttctgaacgctttaatgtccccttttataggtttaacacaaaatataaattaggcaaaaaatttattccctttgcggggagggctacaaaattgtggaatcagctggataaagaaatcattaaaataaattctttaaatcaatttaaaactaaaattaaactccttaacgtataaaatgaccggaaaagtgaattatctcttttgattaattaattaaagctatttataattttatatgtgatttggttttattgatcgattgacctcattcttttatttaattttgttgtgatttcttttttttgtttaatttttaatccatattactcgaggacgatttaatctatgacacgtccgcagagtaagtggattactcccttttgtggacttttttctttttttgcataaataaataaataaacaacaatctagaaaaatttctaaaatttgtgcgagttaagaaattcaaaaatacttcccataggattaaaaatgataaataaaactaaaaataatttaaaattttgaagtaacctttttaaatatcataaatgttatcgctcccaacccataaattttgttagtcctgaatttcataattttcaaaaattttcgttaaaagtgaattaaaaaacatctataaaaatagccagcaggtatagatttaagaaaaaataatggttttacgcaactcaaaatcataaatttaaaaatgtaataagaattcaaaatctcaaaaattaaactagaaaatttaataatataagaaaaaatgatagaaatattattcccacacatacatttaattaagttgttttttttcattcaaaattttttcaagaaatttaaacaaaaattgctttaccaataagaaatcaaatcaattaaataacaataaataatatgaaggaaaatgacactaaatgagcaaaatttttatatcattttaaagtcaattgttaatatttcattatatcttacaatggaaaagctaagatttttttgtgaaaatcaaaagatttggtcataaattgtaaaatctaaaattctaacaacggcctttaattgacaccacatcaccaaacttgatcgattgatataaaaaatttatgttaattttttctcaatttaacaatgataatatttacaaaatgcacaaaaataaacgaataaaattagaggaagaaaatttaaatcaaataaatctaacaacaaatatgcatcaacggaaacgaagaattaatcggtaaaacaaaatatttttcacaaatttagtttgaccaaatccaatagataataaactgaagaattaatttttttttggcaaaacaagagaaaaccaaaatttatcaacaaattaaaatccaaattattaccctataactaaatgaaaaaaacataagacaaaactttaaattctataaaattatgagtcaaacgaaaatagcaaaattattaaataaaattttcaacttataggaaatttttttcattaattgatatataaaaaataagaaaatatgataatattttggataactcaaatacaaaaaagaatttttactcaataagtaaattatttatacgatttaaatatttaataaaattcaaattctaaataatttttaaattaaatattttatatttttatcaatttgttgataacaatttattaaaaaatggtcaaaatccccaaaattttaaaatttggggtcggactctgattttaatgccctaacatgcaattcatcaaagttaataaattcaagcattctcaaaaattttcaaaatgttttttggcactaatttgtgtcggtcggtcttttccattccaaataattaaatttattttctgctggtgcagcggatgatggaagaattataaatattatttcttagagaaggcttggatctcctccccttttaaattcgattttctctgtcagtcagcattcaaaaaaaaagttaggatcgaaagaactcaaaaaactttgtttttcgaacattttttgccataactttattgaaacataacgaaattttaaattctaacgccctttattgtgttaacgactcaacaccatggagaagccgtgagatttatacattgatgaaacaataaatgaattattcaaattaaattaatacagtgaaaaaatatttatttaaaattcaaaataaaattgaataattttaaagttatgaaacgggggggggaagtttaggcgccgggaagtttgggcaccaagaagtttgggcaccgtgaagtttgggcaccaggaagcaattttttaataaatcgaaaatatttttcttaatttaaatattatcattgttaattattatgtttatataaaataaaaaataaattatactaaatgaaaaaaaaattaattaaaaagtaaatggctacattattagcatgtattttcttttcattattacataaacaatgtgagataaatactaattaaaataaattgaattggccaacattttgtcaactttttgagatcgttatctttcgtctgcacatctgctgtttacataaacataaacacaaacacaaatgatgaataaaaatattttcataaattacttaagatgggaaattgtccattataatttttttctgtttttgcgtttaattaccaaattttcggtttttacaatttaaatttccttccatcgtcgagcggaagcagcttaacgtgcctaatacaatggcactcctcgaggatggagaatttgtgtcaagcgattcatctgagggggcagcagaaggggcccctcagcacataaattttttggaaattgtttcaaaacgctatggccaggaaggaaaagcgctttta

SEQ ID NO: 2430 - DNA, 4044 bp, Heterodera glycines
  misc_feature (3974)..(3974): n is a, c, g, or t
cgaactgctaatgcccctgatccaaattccctacatggaattttaaactctaaaaaagccaaaattttaaataccccccaattttcactcatttcttgtagccccaggccatttcattaaaaaattctggcgatttcaaaattctgatttagcatttttggattttccggagatagcgaaaccacaattagagccaaatagtttattatttaatttattttcaaataaaaaaaaattaggcggcactgctcgcggcgctcaatctgcgcgaacggcggtttgacaaatttcgcgaaattgcgaccgaacaattaacggtttacatgcgccaacggattccgaaaatgcccgcggatttgttggaccaacgactgcagttcaaacgacaccatgtggtcaacgggttcatccacacgtcagcctatgctcaacggtctgttcatgaaagtgcgtttattgttagtcagtccttttctaaaatttgttagaggattaaaatgttcgaattttgggttaggggttcggaaattcgtaaaaatagagttaaaattcatgatcagcggccccgaaaacccatggaaacacgtttttatcattaaaaacagaaaaaattttttgcgccgcccgcacccgcgcagctgctcgatgcgccgcccgcgcagccgctcgaagcgccgcccgcgcagccgctcgaagcgccgcctgccaactacgagctcattctacagcaaatgacaatgctgagcgacaccctgcaaaacatgaacgacaattttggaggtaaagaatgtcgtccctaacttcttttttattttgggttaaaatcagtttcctagcgtttttgagagtgatggccacgaatatgaaatcgaatttgccaaattccaaatccctgacccgaattcgaacaaaaaataggtgttaaatgaattcgaagcttttacccaagaaaatgcatctttgaaaaagaatttcactttttcgaattcaggtccggggttcggattgggcaagtccaagttcagattcgtaagcagcaagcaccctcgaaacccctaaaaattatttttgatcccaaaattaaaaaaaaaaaaatttccagatcgaatggacagaatggaagtgcgcaacaccatttccatgtgtgcctccattttggcgatcgtgatcagcggcgcagtttttttttgcaaaaagtgatctgaattttttttttttgatgacaattttgttgtaaaattattttgttttggcttatttatttgtcagttccaaaaagcgtaggatttcgcttttcaatattacaaatatttcattattttatcactgccattgatttctgatttgctaatttgtccgtcctgacgaagaggcatgaaatggtgagtcgaagcgtgaagattcttcagaatgctaaaaccaaacttaggctctttgcatgtggcaacatggagaagaggcactggccaaggcgttggtggcatgtcgcatttacaaaagtttggccaatgaggcagcggaggattacttggaagtggaagtatgtgaggaacttaagacgtatgccgaagtgagcaaaagcattcaactccttaaatcacttgcttaattaacaatttgcacgcttttcaggagtttcggcaactttcactggaattgctcgaccattgctataaagaagatgacgcacaaacgcttcagttgctgacatacgaacttagctattggggccaccagacatgcttgtcactggccgtcattgtgaacaacaagcaattcctggcacacccttggtagcagttcttagcattgattgctgctagtaattgtcatgcctttttagctgccaaattttgttggccgacctttggcacggcggtctccgtattcgaagcaactccaacatcaaagtgctcatgggcattctgtttcctccctcaatctttctgctcgaattcaaatcccgcgaagaattgctgcttcagcctcagaccgcagctgaacatcagaaggacatcaacgaatcgtcgtcgtcctcctcagattcctcctcttcgtcctcgtcttctgacagtgaaaacgacggcgacgagtcggacgcgggcgaaagaggcggtgccacagccgaagagcgccgacgcacgtcgcattcgcacggaagcatgcagtcgttgaacttcacctccgtaaaacactccatttgcttacatatggtttatcttcggttatttttcagatctttaaaagtaagcgcaaacgccgtcgtccttcccactcgcgttcttccaccacggccaaagaggacattgagatgagcaaacagaggaaccgaggttggtggttgcctccgagtggtccaatccccgttcgaccacccacaacttctgcttagattgccaatgccttttagtgacgagtcgcagttggaggctttacacgctgttcaatgtggtctactggacttattacatgttcattgccaagtcgacgacgtgaccatacaccaacaccatcagacaacaaatggcaaattaatacacgaagaaatgaaataaatcattacatatcgaaatccgaattgtgtgcctttttatgaagtgaaaattaaagtgatacaaaaaatggcaaaaaatattaattttttggcgaaaaattttgtaaaatagacccccataattcgggatttcaaaaaaccaaaaatacacccctaaaatcgaatttttgacttcagcccccccccaaagccaagggtctggctacgcccttgaatggttataatacttccatctttcgaaaaacctgatttaattcactaattcctcctttgagggttttttctaacaaaacaaacttaatattaaaaaatggcctacggaatgaaaaccattaatcatatttgggttgatgataatatttttcaaatgtctcgtgatttgaatttgattatctttccgcttttccattctcagcgtccgctgggctgtcgcttttcggcacttccgtctcttccgccggcgcttcgtccgccccttcacagccgacatttggcgggttcagcaacacgctcagttcggcaagcagcgggacgctcttcaaaggctcggcacccgccaaatcttttcggcagtaaatgatccaatggccagtccttctatttgttttttttttgttgctgcatttatcccatcaattcttttgtttcatgtttttactttgcggaatattattgtatcactttaattttcacttcataaaaaggcacacaattcggatttcgatatgtaatgatttatttcatttcttcgtgtattaatttgccatttgttgtctgatggtgttggtgtatggtcacgtcgtcgacttggcaatgaacatgtaataagtccagtagaccacattgaacagcgtgtaaattgctgaatcggactgatcagtgatcacatatccctcgcatatttaatcccaaaatgaccgggaaaggcgattctcgagaaatagtccaatttctcgcaagtgacaaatgcgtccgtttttcgtcttccgccccttttgctcagatttttcatacgaagcgtcgtccgtccctcatttctcatctttttttttgaagtgaaatttaatctccaattattgcccactttaaatgttcgaatttgtgtccgagtttcggagttggccgaatggatgccggatttgtgatcagcgacctaagcttttaaattacataattttttcacaatttcttttaatccttgatttgatgtccaaacttcccccgcgagtaaaactatgtaagtataaaaacggcagaagacaagacaattttatttatcctaacacaaaacattttaacaaattatttggtatagtagtcggaaggcacagtgctgatgcccgagctcgtcccatcatcgcacaaatgcgacttcaccgtgttgcgcacttccatcctgtgcattcgatctggaaattgntaaatcatgatttgggtcattgactttatttaaacacaaaaaaaaattaacattttgagacctatcattt

SEQ ID NO: 2431 - DNA, 2417 bp, Heterodera glycines
atttgtagaagaaactgagtgaaaatgctgaaaaaaaacataatgccaaaacaccacgccaaattaacagaaaaaaatttgaaaagccatgaaagcgcggacacttcaacaatgttttttttcacctcggacgcatccataaaccgcgtcaaggtattttggggtgccaaagcattggtcaccgccaaaactgggcggaaatgtgtccaaattcactggcaacacacacctttgacggtgctcacatctgaatacattttttgcttttttgatacttttaaaaattgcgcgagaaaaataatttttaaattaaatattttttatttaaaaaatttagttttttcattgcaatttaaaatccttaaattaatattttgaaataaccattcatcttttcagttctgctaattatattttgctaacagcgccccttcattaatattttggacaattcccttgagacaaaattttggtgtgagctgctgaaacgaacgcacagcagaactaactaatttaaatttaattagtttgtttacacaatgccaaaatgtttggcacttttacaaaaaaggacaaacaaggattttgcgccttcgtttaattattttcttttacaaattaccattttaaatttttttatcaaatttatttttaaaaatttcaattttacaattttcctttagttggtcccctgggggaaggaaactgtcacattcaaaaaatcccatttacattttaggaaaagctttcggcttatgcaataaagcaatgccatgttggcatggagagatgtcccaggagaagccctaattaggagcaatttgcactttacccacccttccccccgggcatttcccctccaaaatgcattagcgttgtgccattttcgccgccattgcgcggatccgttccaatcggatgggctcaaaggccaaaacatttcgccaaatccattaaaggaattggtgggaaatgtcaaaaagcgataacttaatgatgtgcaatgatgtaaaagtcataaaatggaaagaattatgttcaatttacatgagaaaaagagaaaatttcatagtaaattaaaaaaaaaattcatagattaaaaaaatagataaaatatgaataagttatctgcttaaaatgaaaatggtttttttttggcaatttagaagaagaaattatacgcacggagcaatttaagaacaaaaaattttagatttcattatattttggtgaaacaaaattaagttaaaaattttctctggaaatgtatgaaaaataaatttcaaataaaatatatattttttttatcatttatcatttctatagtttccccaatttccgaacccctagcccaaaattcgaacattttgcgctagttgcaaatagtacctttttgaaatttttcgcaccttttttcggcattttagcctcattcgaaccctggatgcgaattcgaaaataaaagtgaattagaaaattttgaatttccgactttttgtacgaattttgggttaatggtttggaaattcgtcaaatagagttcaaattaatgatcagcggcgaccccgaaaaccactggaaaacatgtttttgtaattaaagacaaatttaagttattatttcgaatgaaaagtcatcaactccaaatttttacctcactttcctccacgtcgagcaaattttttggagccgaaatttgtttctttttttcataacattgggcagattggtcagacattttgttgaataatttcttaattttcgagaagggaattaaacattgagtcaacgaacaaaaaataaaaaacaattggtcaaaagatagtcattccgtacagattaaaatacatttaaatgagaattttgaaagttttgaattttcaattttttcgacttctgtcagggactctgaaaaaaccaaagtgaatgtccgagtcgtgatcagagacccagaaaagccacaaccaaaaaagcaattgttgcgtatgaatgaaaaacagaagaaacaactaatttgccaaacacataaattagagaaagggaaaaagtttgtatattgaagagcagacgaaaaggaagagcgaaaaaatgtgacttacaaattaggaacgaaagtgaaaattttgaattgacttgttcgaattctggtccgggattcgaaattggatctgcgaccctgaaaaccccacaaaaatgttttcacgaatttttataacaaaaaatgattgttatttattaggccttttccggttcttattggtttcttctttcattaagattgtgcacaagtgctccgtgcttttttgaacaatgagaaatgacacggacaaatttttttccgtttttgacagactgcaacattttctggcgatgtgttaaaatgtgaaggtttcaaaaaatatcaaagtgattaaaat

SEQ ID NO: 2432 - DNA, 2275 bp, Heterodera glycines
  misc_feature (2228)..(2228): n is a, c, g, or t
  misc_feature (2248)..(2248): n is a, c, g, or t
  misc_feature (2250)..(2251): n is a, c, g, or t
  misc_feature (2257)..(2257): n is a, c, g, or t
gtaattatatcggaaatccatatttttttcctcgtttgtgggaggcctgaaacgcacgaaaaacatgtttttagcttggtttgaagcttctaggaaggatttctatatccatattttccatatttttccatatttcgcgatttatgtccatatttccatattttggcatttttcaaaaaaatctctattagaacggccccagcagctaaattagtctttttgagcccaaaacccgaaaaatttttcaaaaaaatcattttttcgccaaaatttctcgagaatattgaataaatttaaattttcttaaaaattaataaatttatgtcaaaaataagcaaaaaagcgaaaatttcgcttttgttgttgattttgcgctaaaaaaattaataaattttagcttttatgttttttttcatttaaaatgattgcacgtaattgccgaaaaaattcgagaccaatttccgaatgttgaccgactaattgcaaaacgaaagccgtctttgtcaaagcgccttaccgagtcaaaaaatttggaaatgtatttcatatgcaatttcaaccaacaaatttgaagaaattttgcactcaattttgaaaaatttatgtccatattttgacatttttgccatttatttccatattttgagatttttgccattttatgtccatattttgcgatttttagtccatattttatggccatatttcgcgattttatatccatatttttaccatccctagtgatcagagacccagaaaagccacaaccaaaaaagcaattgttgcgtatgaatgaaaaacagaagaaacaactaatttgccaaacacataaattagagaaagggaaaaagtttgtatattgaagagcagacgaaaaggaagagcgaaaaaatgtgacttacaaattaggaacgaaagtgaaaattttgaattgacttgttcgaattctggtccgggattcgaaattggatctgcgaccctgaaaaccccacaaaaatgttttcacgaatttttataacaaaaaatgattgttatttattaggccttttccggttcttattggtttcttctttcattaagattgtgcaccagtgctccgtgcttttttgaacaatgagaaatgacacggacaaatttttttccgtttttgacagactgcaacattttctggcgatgtgttaaaatgtgaaggtttcaaaaaatatcaaagtgattaaaattatacaaaaaaacaagtgtcggacgaaacccaactcgtactgcctcaactcgtagtgtttttcgacaaaaaatcatataacttttgttaaagtcgaccaaattaaaaattcttggtatcattcgatagcccttaaagttctccatctacctgcaaaatcaactttagtgccaaaaaatctcgaaatagttaactataaaatagtgggtaaaaatgccaaaatagtggcaaaaagtccgaaatagtgacataattttcagccaaaaattaagcaaagtaatttttattcactggttgcaattgcaaaggagttggactgagatttttaagggaaaaccccaaaaattcttcactgatttttagacttaaactggtccaagagcttttgaatgataccaaatttgtcaaaattttttatttaaaatgcatttttgacttatttggaggcaaattttcgtgatttaaaccggtttaaacgctttgccgcgcaattatggtttatgcgttttcagaactaagaaaacttacaagtgtgttgttatgcaattttgagtctggtacagggaagggggggcgagtgagggacaagggtggaaacattgtgatcaatgagagaccgtcccatattgtttgggcaaatggactccgtttaaaagaaaaaaagaattcaatgctctggtataaaaaataataatttattaaagaaatatacaaaaagaaacacaaaaaacaatgaaaaattgaatgattttttgttacatcccatgcctatgaaagccatccgccgtgggcggaatgcccgaagaagaagaagaccctgactgcgaaaaatgggagggaaaagaatgttgcgccatcatcgattctggtggagtttgatgatgttctgtcgccgtttgatgagagtgcatctgatagaagagaaatgcataataaatcaaccatttgttggttcttcatttatttgcgcctttacttgatgaggctgaaaacccatagggaagaaagntgccggatggcaaagcctcngnncgatgntgtaggcactgaaccgaa

SEQ ID NO: 2433 - DNA, 2212 bp, Heterodera glycines
tttttggccaaaaaatcatttaacttttggttaaagttgcccaaattaaaaattttttgggttcctttggatagcccttaaagtttctccctttccccgccaaaatcaactttagtgccaaaaaattcttgaaattagttaactataaaatagtgggtaaaaatgccaaaataggggcaaaagttccgaaatagtgccataattttcagccaaaaattaacaaaagtaatttttattcactggttgcaattgcaaaggagttggactgagatttttaagggaaaaccccaaaaattcttcactgatttttaggcttaaactggtccaagagctttggaatgataccaaatttgtcaaaattttttatttaaaatgcatttttgacttatttggaggcaaattttcgtgatttaaaccggtttaaacgctttgccgcgcaattatggtttatgcgttttcagaactaagaaaacttacaagtgtgttgttatgcagttttgagtctggtacagggaagggggggcgagtgagggacaagggtggaaacattgtgatcaatgagagaccgtcccatattgtttgggcaaatggactccatttaaaagaaaaaaagaattcaatgctctggtataaaaaacaataatttattaaagaaatatacaaaaagaaatacaaaaaacaatgaaaaaattgaatgattttttgttacatcccatgcctatgaaagccatccgccgtgggcggaatgcccgaagaagaagaagaccctgactgcgaaaaatgggagggaaaagaatgttgcgccatcatcgattctggtggagtttgatgatgttctgtcgccgtttgatgagagtgcatctgatagaagagaaatccataaacatttattgtctcttcatttatttgcgcctttacttgatgaggctgaaaacccatagggaagaaagtgccggatggcaaagcctcggccgatgtgttaggcactgaaccgaatgaaattggcacgccgccagaggccatttggtgctgttgcagcatttgttgatgttgttgttgttggaattggactgatgagaccatttgttgttggtgatgaagcggcggagctgcgtgtgaatgcacaaccatcgacggattttgcggaaaggaggaggccgaagcggacggaccagcagaagaggcaggaaaagcagcatgagaagggacttaacaggaaataacgacagttagtaaaagaaatatgttcattcggggagagagtactcataactcagagacgggatgagcaagaaaacttactgggcccaacgggtgcttccgacatggccatcggatgcatttggtagggaggcggcggcggaacgccttggtgttgtggatgatgggaaatgaattgcagtggagtggaaggatcaactggggaagaagtggacgggcaggaaaacggaaccatcaaatggggagagagggcagcagaagagacagacgacacggacaagggggcaggcgtggactgctgagcgaacgaaaaagacatgcgaacggaaagcaacgccaaacgacctgttgctgttggtttgcggttgtgttgcttccagcggtgcccatttgttccacttgctgttggttgatttgttgctgcatttgcccagcttggttttgtcgtgattggtgctgctgttgctgcccctcgtcctcgcgactttgcctctgaaacattccgatcaatgccgccggctgctgttgttgttgttgctgttgtgaatggtggaggggcagtacttgttgttgttgatgtgttgctgattccatgggaaatgaaagctgctgacccgccgaagaaaggggagggaatgcgccggaagagaaatggggcggatgggcacctggcggaaggagtacaccgccgctcatcagattgccctgggactgttggtggtgctaaaggggaagggaaattggacataatttggcaaaagcaaatcacggccacgcaaatcctcaaaatttgcaaacatctcccaagttttcggcaccgcctaaaccacaactccgtcaatacaaaaaagtcggacaatcatcatcaaaaatgtggagacaaaatcgaaattcgtgtccgtttccactgaatttccaaagaatggacaagtcaaaaactgaattcacaaatacaaaaccacttaaaacaattttcgcatttcccaacgaa

SEQ ID NO: 2434 - DNA, 3515 bp, Heterodera glycines
tgcgttggggccgcctacgctaacgcggtaccagcactctagtcgctggtacctggcacgggccacacagttggtgaaccagtaggcgctgccaacacacaaggccgccaaggcacccgcgtgcgcctgccatcccgcggcctcaacgcggtggccgtcacccgtgcgcagcacacagttcgtcacgggaagaggcccagctggcgtctgctgtgaagcgcggtgctcaatcgaaacgacgatcaggcacagcgggctaaaaaaactcaacacaatttaatatcgattgattggtaatattaaacatacgtcaatggctgccccaactgggaaacacatccattcaaaaattgaatgttgtgcgtgccatccgtacagaaaggctgctgaaatggcaatttttaaattttaataatgttaaataagaagaaagcaccgcaaaatgctgttgggccgcgtttacgagcattggttccaccaattgagcaacctttaaacaatttaagttatttattatatttatttatttttatttaattattacttggccaaaaggtggcattgaccccaaaagattttgttgttgttgttcagccataacaataaagtacaatttaaattttttcgctgtaaaaaaaagcaatatattaataattatgtatggaataaaagtttgcttttcgtttctttgcttggcttttccttttcatttcttaacttttaaatttctttttcttttgtaaggcttttcatttattttctttttaatactgcagtgtttttcttttgttagctttaaaattatttttattttttatggcttttcgtttaatttgttttctttttaaaactgtgctgtttttcttttcttaacttttaaatttctttttcatggcttttcgtttcctattctttttaatattcgcctacatttcatttcttgactttaaaattatttttatttttcatgacttttcttttcttaacttttaaatttatttttattgttcatggcttttcgttttcattgcttggcttttcgttttattttctttttaatagttcgatgcttttcatttattaacttttaaatcttttttcattgcttggcttttcgtttctttttttaatactctcgctagtttttcttttcttaacttttaaatttctttttcatggcttttcgtttcctattctttttaatattcgcctacatttcatttcttgactttaaaattatttttatttttcatgacttttcttttcttaacttttaaatttatttttattgttcatggcttttcgttttcattgcttggcttttcgttttattttctttttaatagttcgatgcttttcatttattaacttttaaatcttttttcattgcttggcttttcgtttcttttttaatactctcgctagtttttcttttcttaacttttaaatttctttttcatggcttttcgtttcctattctttttaatattcgccgacatttcatttcatgactttaaaattatttttatttttcatggcctttcttttcttaacttataaattttttttattattaatggcttttcgttttcattgcttggcttttcgtttcttttttttaatactctcttggtttttcttttcttgacttaaaagttttttttcatggcttttcgttccttgcttggcttttcgttgtttatcttttttcgctgcttttctttaattagcttaaaatatctttttcatttcttttcgttgcctatcttttttcacctgcttatcttttcctagcgtttaaatttctttttctttttcatggcttttctttcattgattttcttttctttatttttgtttgcttttctttgttaattaattaatttgttagcgagttataataagcaaaaataattaacaaatataaaaatattggacaggacaaataaattaaacggacaacaaatcaatacaaaatggagaaatggaaatgaaaatgatgggttggtggagaacggacagttgcagatgaacaaaagataagaatctaacggatgggaggggaccgcgtcgctgtgcacagtgaagtgagaacagggggggggcatttgaatcgttggagaagttcagacggcacattaggtcgtcaatccaacaccccctaagctgaatggcgaaagaatttcgcctcaggcaccattttgagcgaagttttcccgacgccccgccccctcgcgcacccccgagacctgcgcagtaaaactcgcgcacccctagtccgattgacttcaaatttaacggcccgtcattccaccatcccctaagctgaacggcgaaagaatttcgcctctggcgccattttaagcagtacaatcccgacgccccgccccctcgcgcaccccgagacttgcgcaccaaaactcgcgcaccacttgtccgattcacttcaaattttacgggccgtcattctaccatcccctaagctgaacggcgaaagaatttcgcctcaggcaccagtttgagcggagttttcccgacgcccctccccctcgcgcacccccgagactcgcgcagcaaaactcgcgcaccccttgtccgattcacttcaaattttacggcccgtcattccaccatcccctaagctgaacggcgaaaaaatttcgtctctagcaccatttcgagcagtactttcccgacgccccgccccctccccccatgcgcagcaaaactcgcgcaccacttgtccgattgacttcaaatttaacggcccgtcattccaccatcccctaagttgaacggcaaaagaatttcgcctcaggcaccagtttgagcggagttttcccgacgccccgccccctccccccatgcgcagcaaaactcgcgcaccccttgtccgattcacttcaaattttacggcccgtcattccaccatcccctaagctgaacggcgaaaaaatttcgtctctagcgccatttcgagcagtactttcccgacgccccgccccctccccccatgcgcagcaaaactcgcgcaccacttgtccgattcacttcaaactttacaggccgtcaattcaccaccccctaagctgaacggcgaaaaatttcgcctctggcaccatttcaagcagtacaatcccgacgccccgccccctcccccatgcgcagcaaaactcgcgcgccccttgtccttcgacttcaaattttaaaggccgtcaatcgacaaggcacaaagcggaacggcggggaggggtccgtggaaggagggggtccgcgccgacggacggtgaaatagtggggaggggtccgcggcagtagagaggaggtccgcggcagtggagaggggctcctcgccgtcagtgagaggggctcggcggcgatggagggaagggtccgtggaagggagaggggtccgcggcggtactcatggactttgtatccacattttttttttttcgcatttttcaattttttttacttttttattgtcactaattactttaaatatcaaataa

SEQ ID NO: 2435 - DNA, 1258 bp, Heterodera glycines
ctccctatgactcctccgctcctttgtccccgctctcgtctctacctctttgtcaaagagggatcaaagacattaatgtgcttatggaggatgcggcggtaggtccaacagtccgccgaaaagggaaggatttgaccctcctcgaaacggaggccaaagaggtctccgaacggagacctcctacatgttctcagtgtggagaactgggccacagaaaaggcacaaaaaagtgccccctttacgggaggggttctctgaccccagtcgttcaggagaacgtcccgaaattggagaagtgtggccgaggtgcgcctcggcttcagatcgccgcgagaaagccatctccggtttcgccatctccggtttcggaggtggcaaccacggaatcaagcctcccaggtcttcacacctccggcagcgcggagacaaatccgaaaaaaggttttgcgcgacccaatttgactgaaatgaccgaattatccaatcgatcagtcttagtgaaaccggacctctccggttttacgaggatctccacggaagggagagctggcacgagtgggtacggagtgccgggcgcaactttttccatcgtggaggcagtgcgggcactgcaatcaacagtggacactttggccacaacagtccgtggaagagttgcgggtgttggaggtgcgtgggtgccaatttctcccgttaaaaaggagagaatggacattcttcctccctttttgacgggggggaacaccgaaccactggggcgaagaaagaggtgctgctgccgttgccacaatcactcaccgtcgccatcttcctcatcagatgagccgaagaaacgccgacaccgcaagcattgacggcccccggaatttgtcgccaaagcgaccaaaaattgattaaccgatcaattttgttttgaaataatatttatttgtgatgattcatcccctctcccgcctcctccggggttcgcttataaaaggcagccctagcattcattcggctaatgtaaatgaacaagcagttaatcgatattgttaagcaaaatttgtccctttttccctttgcatttttatgtttttaatttaattttcaaataaatttggattagaatttccctttttgtaagggaattaaggaaagattctttttccttaaaaagcccttttggcttggtccgaactcctggcttttctgggacagaaattctttaaaaatttcccccagttgttgggaaaaacaaattttttgcggcttattt

SEQ ID NO: 2436 - DNA, 6995 bp, Heterodera glycines
atgaagtcacacccccaaggggaagacttgcttatgctatataagcatagtgccatggggcagaggacaattcgccctcccccactcaaaatggacaattcttccccgtccccacgatcaccaagcgaaggagacacgactccctatgactcctccgctcctttgtccccgctctcgcctctccctctttgtcaaagagggatcaaagacattaatgtggaaatggaggatgcggcggtaggtccaacagtccgccgaaaagggaaggatttgaccctcctcgaaacggaggccaaagaggtctccgaacggagacctccaacatgttctcagtgtggggaaccgggccacagaaaaggcacaaaaaagtgccccctttacgggaggggttctctgaccccggtcgttcaggagaacgtcccgaaattggagaagcgtggccgaggtgtgcctcggcttcagatcgccgcgagaaagccatctccggtttcgccatctccggtttcggaggtggcaaccacggaatcaagcctcccgggtcttcacacctccggcagcgcggagacaaaaccgaaaaaaggttttgcgcgccccaatttgactgaaatgaccgaattatccaatcgatcagtcttagtgaaaccggacctctccggttttaccaggatctccacggaagggagagctggcacgagtgggtacggagtgccgggcgccactttttccatcgtggaggcagtgcgggcactgcaatcaacagtggacactttggccacaacagtccgtggaagagctgcgggtgttggaggtgcgtgggtgccaatttctcccgttaaaaaggagagaatggacactcctcctccctttttgactggggggaacaccgaaccactggggcgaagaaagaggtgctgctgccgttgccacaatcactcgtcatcgccatcttcctcatcagatgagccgaagaaacgccgacaccgcaagcattgacggcccccggaatttgtcgccaaagcgaccaaaaattgattaaccgatcaattttgttttgaaataatatttatttgtgatgattcatcccctctcccgcctcctccggggttcgcttataaaaggcagccctaacattcattcaaaaaatgtaaatgaataagcagttaatcgatattgttaagcaaaatttgtcccttttttcccattgcatttttatgttttaaatttaattttcaaataaatttggattagaatttccctttttgtaagggaattaaggaaagattctttttccttaaaaagcctttttggtttggtcgaacttctgtcttttctggacagaaattcttaaaacttccccagtcgttgggaagagcaaatttttgcggcctatttgtcgacaattatgtttgcctcgattttgaaagaaaactcatttggccattgacttttggactttttaagccatattgggccttcccaccataatggatgtgataataattcttcaggggtacatcctctacttccaacatctgctgggttttcttctgtgggtacggctatccgacatttgcggatttaacatttgcggacccgacatttgcggacccgacatttgcggaacccgacatttgcggactcgacacttgcgggcccgacaattgcggataaccccgacatttgcggacccgacatttgcggaacccgacatttgcggacccgacaattgcggataaccccgacatttgcggacccgacacttgcggacccgacaattgcggactcgacacttgggaatcacctttttaataaaatcgtgttaaaataattagaaaaatcatttttgaattcaaaaaaaaattattttttaattaaattaatttaatatggacttttcaaggcaacaaagtcgttgattctttatttgaaaaaaagaaaatgcctttcccaagggccaacgggaaatatcataaaaaatgaaacagaggcagtcgaagatttccagcctcctgaatcaggggcagtcgaagatttccagccgtccttggcttcgggttgcataaagtaaaagaagccccatgtcttcatcactttttttaatctttcgagtcgtttccgaaggagaagctgaatttattatatctttctataataatttaaaccaatttaaaacaaaccaaagcaaaattgctgaacattccggcctagcttttgaaattttttcaaaaatgttgtcgggtgtaaattcctccactgacacagagaactcgtacgagttcaggacgaaggttatgggaaagaaatcttttaacagatcgccacatctgcaatctataatttagaaaataaataagttctaaatatttaaaaacaatatctcacgtttgagcttaacatatacagcgagagacaatgttgtaaatgctgttatcattgatgctgttaatataactccggtgtgcgctaataaatacgccttcaattgtgctaaggcgccaatcaatgcaattgtcactaaggctcttttctgatgcggcttttcattggtgggagagatcagaagaagcaaaacaaatagtttaataaatttgtttaccatcattctgcattaaaatatttatttaatgcatcaaaaaattatcgaaaagaggaatgtaaaaatagaaaaaacgttttcattttatgtcatcgtcaaaatactttttgtgttgtgtaagaattaagaatttaaagtaatgctgaagtgaaaaacaaacggcgcgtgcggctggcacatctttcggaaagcaaaggcgccggctgttttggcaaagtgaaaaacaaacggcgcgtgcggctggcacatctttcggaaagcaaaggcgccggctgttttggcaaagtgaaaaacaaacggcgcgtgcggctggcacatctttcggaaagcaaaggcgccggctgttttggcaaagtgaaaaacaaacggcgcgtgcggctggcacatctttcggaaagcaaaggcgccggtggccttcgccgtttaagaacttaccgtgattgggcttctgatggcaccttcaaaggtagtaactcgtcctgaattagttttaaagctgaagtaaaattgcaaatatttgtttatgagtttttttgacagtcgcatcgcgaaattttctacaagtctatacgattaattgcttgattgaccatagcagtgtcccagctgtgtttgcacttatggcaaataaagccgaagatacttatatccgagttcttcaggtacttattgtttgtattttaatctgaccatgcaataattaacattcaattttaatttaaatttgctattaaaaataggccttggatgcttcacttggtattgcccctaacagtgttatgttagattttgaaagaggtaaataaagttttttgctgagatcgttgcaataccgactgatgcgaaatgattttgaaaattgggatgggcccgatgtggagtaattaactacattttcccgttggcccttgggaaaggcattttctttttttcaaataaagaatcaacgactttgttgccttgaaaagtccatattaaattaatttaattaaaaaataatttttttttgaattcaaaaatgatttttctaattattttaacacgattttattaaaaaggtgattcccaagtgtcgagtccgcaattgtcgggtccgcaagtgtcgggtccgcaaatgtcggggttatccgcaattgtcgggtccgcaagtgtcgagtccgcaaatgtcgggttccgcaaatgtcgggtccgcaaatgtcgggtccgcaagtgtcgggtccgcaaatgtcggggttatccgcaattgtcgggtccgcaagtgtcgagtccgcaaatgtcgggttccgcaaatgtcgggtccgcaaatgtcgggtccgcaagtgtcgggtccgcaaatgtcggggttatccgcaattgtcgggtccgcaaatgtcgggtccgcaaatgtcgggtccgcaaatgtcaaatccgcaaacgtcgcgccacggtgggtacatatcggaattctaaatcttggtattctcgaatttctcttagtctgttttctacaaatcttggctgatcatcctttgatttaatccagaataatactggttttgagtcgcaccataaaatcttttcttttatttctatttttaactccttttccacgtacttaattgctctagtgcctaataatactcccaataattccattcttggaatagtgatttgcacttttcttggttttaatctgcttctcgcatatagcaaattaatttggtttgtatatgattcgattttcaaataaacgcatgccgcatatgcatctttagaggcatcaacaaaaacatgtaaatctgctttttcatatttctctggcacaattctgcgattgcatttgattaccatatttttcaatgacttggtaattaatttccattcactttgtttttcttctgatatttggtcgtcccattttcgatcttcttcccacaaactttggaagaataatttagcaggtaataaacacggagctaaccaaccgcaagggtcaaaaactgagtttaattcttttaaaacttttcttctgctcaaattttcattgtcgataatttttggaaactttataatatatttgtcggtatttatttcccaattcacaccgagtaccttcgggttttccttgattaaacgatcatttttgggtatttctttgtttactttttcagagtttgatatgaattctcttatattcattcgtgcctttttaaatagttcttttaaatttttatatttttcaattgcttcctcaaaattattgcatcccacaaaaacattatcaacaaatgtattatttttgacttcttttgccaaatctgagggttcgttttctaagtgatgtctcaccgttgcccccaataaaaatggtgatgatataacaccaaatggtactcttttaaatcgaaaaacgcataaattgtctttagagattggtttttcgacatctctgacccataggaatttagcataatttctatcattttcttgtaattccaacgtccaaaaggctctttgaatatcaccccaaagagcaattctaggtagtcttgacctcattaataagcctggtaattctggcatataaattggccctctaaatagcatgtcatttaatgattttttgccctttatttttgccgacgcatcatatactactcttgtctttttttcttcaactaatacacaatggtgaggtaaggtaagaagtgttcattgtgaccttttatttcagtttcttccacaatatcttcttttaattgctctttgaaaatttcatcgtattgttttaaaaattcttttgatttctttaatttttcaattattccaatcattcttcggtatgccagaccgaagtttgttggtaattcatcaattggacttttccatggccagctgactacataacgtccgtcttttctgtacacggattctttgaacattttgagtgcaacttcatcatccttttctataggattgtccttaattccaatcatttctaaattccataatttttcgggctccttgtcttctttttctataatcattgcagttagggggcatatatttttcccttttgtaactgtttcgccacaaattattgttccaaaaactgtttctactttaacgagtccttcactgaatggttcaactttttgaaagaatctccaaaattctcttattccgatcaaaatgtcaggtctttcttcgacaaactcaacttttcctgaaataatgttagctctttttattttctttgttataaaatcaatacggcttacaatgatttcttcacatttgccatccaatctctctaattttattacgtatttaggtgagtttaggcgtaccggattgtcttttcgaataggtaatatttctaagtttccttcactaattttttctgggttaattttcttaatcaattcatccgtaattaaagagatttgacttccgttgtcaaaaaatactagaattcttaaatattttgttccatttataattttcacgcgtattgtcattagtaatgcttccttttcactgcccatttctccgatggcagttgctattaaacttgaaatctgcgcttgtctttcgtttcttgagctatttatgaagcgatttgctgctactttttgaatgggttttgaacaaattaatttgttatggtttccgtcgcaattgtaacacatttttcccgtacaatttcgtatttcatgtccttttttcaagcaacgatgacaacgtgcctaatcctccattatttttattcgggtttctctgttcattatctgtttacaatttgaggcccaatgcggcccgtcacataaaaaacatttaggatcaaacggatttgaccgaccatttggtttatttcgcgtttcttgcgccaaaaaaactctctgatgatttctatcgtattaatcaattgttcgacattccattctatggcactatctttttctgcctttaatgcttctaagataattgttcttggaaatttatttttaattgtcatcatcacaaaatctttgtctcccacaaatcctaaattatttaattgtctgacgactctttctatatcttctaagcatactcgaagtgagaaagctgattcattggcctgtggcaaattcaataattcattttggagtgcctcctttatcactttttcattgccaaataatcgctttagagcgtttactaccaattataattttctgcagttggttggtagcctttcattgaacgtgccgcttttccttttagacttaaaagtaaatatgtgcatttttgagcatcagatatcggcttttcgcccatgtttgcttggaatgcctgccaagatactgggcaagctaatggatctccaaaaaatttggccacgggagttttggaaatatactgatggtacttcaac

SEQ ID NO: 2437 - DNA, 2902 bp, Heterodera glycines
acattaagcattcattcacctctttttgccgctccgtttccctttccgtttttgcatttgctgattggatttgaatcttttaaattttgacaatttggccttacgtttggcgttctgttgtccctgccttggtctgtcctcctcatcctccccaatttcttcctccaccgaattgtccattaaacttttgtgcagttcgaattcttggtccaccaactcggggcccggcactctcatcacatatttttgcgtttcgcccattgacgggtccatttggggggcccattttgaggtgctggccgagttgggattgagctgaatatgagcgtgtcctgctgttttgggcttgtcgatgttcgcccaccacttccacaattgtgtctgccgtgctgctctcgcgcattgtgccgcactcgtcgctgtgcgccgggcttggcctcctcctcctccgccacgcattctcttccttttcttcttcctcctcctcctcctcctcttcttcccttccatcccgtcccaactgcacttcttcccctctcctcatcattaaatttgttggtggcaatggccattccgtctcttcgtcgtccaccgattcggtgaaacttcggatggcaaattgctggcgtcgcaactcgtccaagtccatctcatctggccaatgagtgaactaagccgagtcaaagtttgaaattctcaaaaatacaaaaatgagccaaattaagaaacccgaattttaatttaaactttctttaaaacaatggcaatcgatacgaatgagtggacggcagagaaaacaaaagacgaagctaactcaatgggagtgcggcaaagtcccaatttgtggccactgtctttggcttggccaaccaaccaatgtttattattccggcgaagccaagggacacggagagaaggcataaattgaaaataaattccctttttgaggataattggtcaaaacaggcaaaaaatggcagaagattcttcaaagcttttggcattgatttcattagaaaacagaaggaaaagcaggataaatatttgaaaataaaattttaaggaagctgttttgacattatttgagaatgtgctcacaatgtctttttaatttatacccccaattttatttttctcggcaaatgccctcgagggatttctgccgaagggaatgaaagggggggggggagaagagactccgtttcacattttgcgggaaagtcctcaaaattcgcaggaagaatgccacaaataaatgccatggctaacaatttttgctgagaatgaaaaagttgtgccgaattcgcaccgatggccaaaggggcggagaatgagttcgatataaaaatgccattgctacgcactttcctttttaaaactcacccaaatcttttgagatttgccgcgctttttcagacatttgcctaaattaattaagggattttcattttgtttgtgttaatttgcttttattgcttcttttcctccatttgacctgaatgcgtttctgcccgcatgaatatcaaaattctttgccgcttttccatttccatccgcaaaatgcccatttgaatttgtttttttaattttcttatttttgttggaatttgttgacattttttacatatttttaattaataaaaggcaaatattttctgaaagaaaaggtaaatgattttaagcaaataaattcaattaaatgcactgaatatttttaattgatatattcaattattttttagtttattatacgataagaaaatgaaataaaaatttgtttgttggaaaatttaaaaaaaaattttaaatttagttgaactaacggacaaaggaatttgccttttataggaattatacccccgcctatttgtcattgccttccccaccccattttcttgcatttcatctcatttcctttcaaattgggacagtgaaatgaatctcgacgagggacgagagtcgagaattggcacagaagggggggggaaggggagaatgcatggcccttggaactcggaatggattttcttcgcttaatgaaaggaaatggagaatgcggggggggggggaatattattccccttctcaatggaccccccttttccgacagaatttgtcaaatggcaccaatggaaggggaaatgccaaaaagggaatgggcgagggaatcagaggcaaaattcaaacatttaataattatggaaaaagtcaaatcattgaatattatcctcaaatatcaacttcacatttctcatatgtgcgtcattattattggctttcatttgaggatttgtcctttcttccgtccctctctttgttggctaatttttattggcccttgcccgggggcacttcgtttttttccatttttccgtggggtgccaaagcgaacaaatcgattcatttcgaagccaccgaatgttttgtgtgccctcccccgactttttgtgcccttttcactttcagctaataataaagcatagaaaagcagaaaattatcaaagttcgtgacgaaagttgcgaaaagagactttctttgtctaaagccaacgaatctctgaagagattgtccaatgaaagcacacaaaaagcgagaaaagggagagaaaggccatttagagtaataaaaggacgtaaatgggcggaaaagcgaagcgaacgaattccgccccgggcgacgaatttaatgtgaatattttacatataagcagaaaaatttcattgcggaaaaactcatttaacgatttgaaatttggcattacgaaatgccattttctgtggcttttctttcccttttgttttaggggccaaataaataaattgaattgacaagcaaaaaaaagtgttggcattagctggtgaaaaaagttcaattgcctttttttgtcccttttataataaa

SEQ ID NO: 2438 - DNA, 1575 bp, Heterodera glycines
ggcaaagggaaaataaacggcacgggaaaaaggggggggggcaaaagccaaaagtgggccaaaaggcactcattgttgtatcataatatcacatgcgcattctttcttctcttcctctcctcttccttctttcgctccatttgtttctcttttcccatatttaactttctttctccctccctctctccctttttctctctctctataattccttttctcttccaccctttttccctccatctgtctctctcctatttacctctctctctctctgtctttcccctatctctctcttccctctctcgctcttttctttcctcacaattcatctctgtcctctttcatcttcgtctctgacttttctgcgttctcttcgccttcttttgccatacattgtcctccttcttcattgctttcattgcttttgctgcactgtccctctccctcttccttttcttcttcgccctctccttctttctcagctgccttttcatcttcttcctctttctcttcctcctcctcttcttccaattgttcttcaccttctctcatttcttcctcttcttcttcacccattcctcccattaaatcgttcaaatttccgagattcatctgcttaaacatttctttcatctgtgccattatgccatcctcattcagctcctctttcgtggcatttttttctgtaattatttttgatttacatatattttcccccccccctccccctcttctaccctgcattatctttaccttccttcctctctaatcgcttctttatcattccttccattccttccctctccgatctatgctttatcctctctctctctctctctccatctttccctctctgattattactccttcgcaccccccccccctccccaattattattctttctatttgttcattaattaattacccttttccattgtctgaatttgctgttccgcatttttgtaccattctccagcccaatccaagaatgttcggttggccattaatttgctcatcactgtgttcatcaacggatacgcgtcgaacaaactcagcgtcagattcgttttcgcgtcgttgggaaggcgtacaaatgggcccacaacttggcgaacaaaccaatgccaaccgctgtatttcacctatttatgtataaatgaatatttaactcaaataaatgttctgttcccacgcttcaccttctccatgtactgcttcgcctcgtcgtttagcattccgttgaattttgcccaccgttttttgatctgtgcccacgcgtcttcgagcagttcagccgttttaggcgccttttttttcagctcacgccaaacttggtcgccgctttccatgcgttcggcgccggcgtataattcgacgatggcgccgccttcacttgtcattgctttgatcagtttgagtaacaaatctttgggcaatagagctggaaaagatgtttcgccaaaaccagtaaagacattcgtttaacacctcgaaaatgtcagggagccaattagcgataaatgtgtcacattttcgggctaaataaatcagccaaaataccctcctctcctaaa

SEQ ID NO: 2439 - DNA, 3328 bp, Heterodera glycines
ccccccccctccccaattattattctttctatttgttcattaattaattacccttttccattgtctgaatttgctgttccgcatttttgtaccattctccagcccaatccaagaatgttcggttggccattaatttgctcatcactgtgttcatcaacggatacgcgtcgaacaaactcagcgtcagattcgttttcgcgtcgttgggaaggcgtacaaatgggcccacaacttggcgaacaaaccaatgccaaccgctgtctttcacctatttatatatttaactcaaataaatgttctgttcccacgcttcaccttctccatgtactgcttcgcctcgtcgtttagcattccgttgaattttgcccaccgttttttgatctgtgcccacgcgtcttcgagcagttcagccgttttaggcgccttttttttcagctcacgccaaacttggtcgccgctttccatgcgttcggcgccggcgtataattcggcgatggcgccgccttcacttgtcattgctttgatcagtttgagtaacaaatctttgggcaatagagctggaaaaaattgtttcgccaaaaccaggaaagacaattcgtttaacacctcgaaaatgttcagggagccaattagcgataaattgtgtcacattttcgggcttaattagatcagccaaattaccctcctctcctaaattgcaatatttgaattattttacataaataggagggaatgctaatttttgactaaattctcacccatttgcttttgtatctcttctgcccatccgtccttaatccccgctgagaatgcgtccgcgtggctttggaattgctttcggatgtgctcgtccacctcggggtcgggcccatccaacggaatttcatcacaacgaattggcggaattgcgagcagaaacagaaaaataaataataaaaatggcacaaattccatcgcgcaaaaagagcaaaaaaaaaaaaaataaaattgaatcgattaaatgaaataaaatcggagaaagaaatggcagaatgaatgagtaaatgaatgagtgtggaaacagaggccgacttggccaaacattcgccgattatttgttggcccggcacgcgcttcacaaaaggctgacgacgcttcgaaaatgccattggatggccaattttccacaaaaaatatagagaaaatcctataataaatgagaataatattgtatgtacgtttgtattcagctgccataagcatacaaaatgccgcgatgaaaaggcgctttatccacgcataaatttttttgggtgtttaacttaaataagatctttcaaaagttagttttttatctttaaatgaaaaaatgaattaaatttatttaaagtgacaaaagtcgtttaaagtgataaaaacaataataattaaagtaaattatcaaattaataataaaatgaatgaataattgaaaagagatcaaaaaatatacaaacaattaattatttaaaaaatgtccattcatctgcaaaaccgacgttcaacttcacggcggcaaatatcacctgtagagaaaccgatttttaaattaaaatgaaattcatttttaaatattttaattaaatacttaaaattgcgacggaattcgatgggttcgtctcacccccccccccctccccgttttaattcccatgtcatcgcatacatttcacatcgcaacaccacacaaatttgcatcggcacggctcctgtcggatttcgtgccgcgtttcccaccccctgccacagcacaactgttggcattcgatttgtgaaaaactgtcaaaagaaaaccgacataaaagtgccaaaaaagaataatggtaaattgccattctctgccgcttgtcccactgattgttttctgtccattttctgcgtaaagcgaacaataatcaggcgaacgaacctgaaaacaattgaaatgatgcgatgagaaaatgttcaaattttgccagataaacgaggtcagttctgctgggttgagggggcggaaaatgatggggctgatacgactgggcggaggaggcaaagcgatcggagcggacggaagtggcagcggggagggggtcgggcggaggcaaacccaacacgagaagggcactgtccagggccaatgccacctgtgaaacggatgacaaatggtggcgcaattggggaagaaaaagtgccgaaaatgaatgaatattgagtcgattagtgggggatggcatttcaaaatgccaaacaatcccaggcttaatcacccctccccatggcaacttcatcattcccaaccctttctctttgttcacttgtttggcatttgtgtatttctgtttcaaaagtgccgcaaattcttccatcgtcggcaccgttttccaacatgtttttgtcacgcatgaactaaactactcaaatagcctcattaaagtaataaaacattcttcaaacccgctgacgccgtggcatttgcactttttgcgcatatttgtggccaaaaggcgccgtcccacgcgattattgtgcaggttcatcaatgagctaaaagtaaataaaactaaattttaattgatccttggctaattcctaataaatgatcatttttatacagtatctcacccttaccccttttacagtactcccccttcgtagaagaataatcctctcgtttatgtacataattctccccattttgtatcatttcctacagtatctccattcgtttttaccacagtaccccccccccccccctttttccgtttttcataaattgtcccccatttgtttgatttatccccatttttggtcgaatgaataaaagaataatcgtcgacacacaaaaatgggagatggcgtgtgaaaggtcattctcattcctttcattctttcttcaaactttgttcagtttggtgacagcgaatgtcactggccaaataattttaaaaattttgcattttaaatattttaaaattatttttcaattttaccgcgcatcgcttcgctttttttcggcagtgtcaataaatttacgcgtaaactaaaaaaacggtggaatttttacagaatgaaaaatcctcggttcacttgattcccaaagcgaatgttgtcagaacaaccggcccaaatgaacttaacaaatatgtgttcaattataattaattagcgatattaatgaattaattaattattattaaatgcctgctgagggtccgctccggaaaggccttcaacgtctggagaattgatcacctggtaaataaatgctcaataattatgaaaatgtcccttttaaataataataatattttttccaaccgagtacccctcc

SEQ ID NO: 2440 - DNA, 1433 bp, Heterodera glycines
cccccccccccctcccaccgtttgttcccctcccccacagccacactcggggatttccccttgggcgcatgccctcgccacggcggccgaagcaccggccgaagaaatggcgaaaacataagctgtttcaggcgtagaatctaaaagcgaaaacggaatttttggaagattttccattggtatttcgcaccttcttccgaggggactccgacgttaaaagtggcggagcaattccatcgttcctttaattagttcacattatataatttgtactgaaaaggaataattaattaattaccctttcaaattgggcgtggcattcgtcaatcgccgctcgtaggccatctgacaatgggacggatttgtagaaacttcgatttgctcctactgtgttaccgtaccgctaattgatcgcatggcggacggatgtcggacgcaaatgtcgcgttggcgccgtgtcaatcccggctgcatttggcaattgtaatagtcgggcgaggatagagccgaggctaattgagcggccattagccttaattacacaataataacaaaaaacgaaattggagaaatgggcaaaaagacaacacaacaattaccattttatgttatgtgattaggagtgttttaagcttcttaaaattaattagcaattgtcaacatccctttatattttaaatatttttggtatttttaaattattttccctttttaatttattttttgcttttcccatttttttcatgcgcactttcccccccccccccccgtccaatttgtcttgcccataattccgtcccccccaattcacataaatataaattattccatagtgtcgtcgtcgtcttcgaccggctgctgcttccccgctgtgattgcatgttctttacgcacttttcattcaaaacaaacgcataatttgcggtattttaatccaaaagagaaaattgtttaatggcaatgcgcggattaattttaaaaaataagaataaaaacttagtgaattaatttagactcaaaaataaaagttgaattgttagagaggtaaatttttaaaataaaataacaatttgaatgtttattaaaagatggaattataggaagaagaaaacttagacggcataagaaaaaaggagcgatgggggagggggggggatttaagaataacaacacctgacacacttgtcagttcttttgttacaagaataataaatataaataatagaaaaaatataattttttcacaaaaatgcatgtcagattttgatccccaacaagggaattgttctacattctcacaagaattaattcaatatggaggatacaatattattcgtgatgtaccatatcagcgcggtgctggtatccggtcagtatttaaaagcttaatgagatttcttttaccgataggaaaacaaattgaatcttcaatt

SEQ ID NO: 2441 - DNA, 2233 bp, Heterodera glycines
  misc_feature (53)..(53): n is a, c, g, or t
agcagattggtggagcgtgtgttcttctgtttaagctcagtgccgccatttgntggcgtttcgtcggcgggtgccgtcgattccgagctgaacaattgccgaaccccggacaaatggggcgcagtggcaccgcccgtggtgcgcaaatagtccggcatcgcatccatcagaccgttggctgtgcggtcgtcgaaatgactgaaaatgatcaaataattattgcgttttgaagagtgtattcaatttaaataatccgttgctttttgtgtgccatccgccgttaattacctggcaaaaaatgtgctggcactcctcggcaaatgcggccgtccaccgtcgtaaagggagccgaagctgtgcttgggcatgtatctgaaggtgccggtgtcgaacagttgggaagtgacggacaacgagcagcagatggcccaaacggagaacataaaagtaagcggcagcggagaccaattcgaaagtggcgaagaaattggcgaaatgtcccgaaaactcatttttaaaagtatctcctgcaaaatatgtaaatcaagcaaacaaaaacgggagggaaaagaatgggtaggcaaatgaaagtgttgtgttaatttttgtccattgcaaaatgccaaatgcttccgatttacgcattttgggcaatttaaacgaagtgcttacgttaatgaatggttataccctcgcctcattacgaatatcgtccatttgtgagttttaaatgaaatgccattaaaataatgagttggctaatcgcactgctttggtgaccattaaagcgaactgatttaatgggacactaatcggaatgtgcacaattcaattgaacggcactttgggtgacaaaccgactgaagcatttcgaagaacaccaaaaattttatttctcgggtaattaaatttcattctatgaaactttattatttttttataaattttaaactgtttaaatgaatttttaggtgatttaatttaatttaatttcgaacaagccaaaggcacaaagagcctaatccttaagtttataaagaaaataaattagcaaataatttttgcataaatattttctccaaaaaaggaataataaaagtgaagtttcgtgaaggctctatttaaatagaaaatttcgcttttaaaatgccaaattaaagctaaattaacaattgattctgaaaatggcacgcaattgaaattcacatcacttttagcggtattaaaagaaattgtgaaattacattaacgtaagtaagtagcaaaagaaaagaaaagtggcatttgtaattgcaaatttggcacacaaaaaagagcataaaaaccaagaaaaatgaaagaatttaaaaaattaaaaagtacgaaaagaaaaaaacgaaaaaagaatgccgaaaataaattaagagaatgaaatttaaaaaaaaacgaaagaaagaatgccaatgccaatgtcaccaacggatcattggaaatggacaaattaattaaggctactgacgaaacttgtttgtttttcgtgggttttaatcattttttcattatttcgaaagttccggtaaaagttgttgtgtgtcttcgttttgtcttcgtgccaattattactcaaaagagtgccatttgcccggaggggggggggggagtttattggccatccgctgacgaaaagcgaaatgatttgtggggattactcaaaagagctgcgggggggagggcaatggcaaataaaccatagggacgaaaagcggcaaaatgggtaattatccaagtgattgtggcggattagcgttgacatttggggaggaaaaacaatggaaaagccaaaaagtgacgggaaaaaatgaggaaaaagaaaggaatattagcatattttgaataatgactatgtaatatgaaaaagaaaagggaatatttggtgaaattacccaatgtttatttttgtaattacggaaaatcattgggcaattaattcgctcggattggcaaattaagggcccttttggcaatttgcggaaaggaatctccgacggataaaccattcaaagatcgcaaagcatcagtcgtaatgggaataaaaaatgcaaaaatgatgaataaaaaattacttactattaacagacagaaaaaaggcaacgaaagggacggaaaacgcaaaggaaaataaacggggaaaatgcaaggaaaataactttggcactttttgttgagttttgctgttgttccttttcgaattttt

SEQ ID NO: 2442 - DNA, 1860 bp, Heterodera glycines
atctgctaattctaaattattcgttgtgtttttatactgtaaatcgcgacagtttagagtaactcgcctgtataattcatttcacgatcgtaatccaacgcctctgcgtatggtttatttataataaattagaaatatttatattttattatgatatcatatttatcaagttgaaatagtttaaatcctgttatagataatttaggtgcattatttttttttattgcacatttctcttcttcatttcttttttttttatttagtatttaattaatagaattttttatataaaatttttattcgtttttttgtttaacttatatttttttaagaataatgaatttgttttttcatttatttgtgaacaataatcataaatttttaagtattattgtcatttgagctaactttgcgtagtattttcattatattgatattaacatatgtattgcatgtaaattgcaacttttgcttgtggtccatcttgaagtagtgtgattagctttctcaaaattaaataagttctgaaattgaagtaatgattaaaatgtttaaaaattagtttctgtttagaactcaaattcggcctagaatttgtcatcaacggttttaaaaaatataaataaacagaaataaactaattccaattgttgatctgttcttgaagactaccttttttaaattttatattgctttttaaatagaacttttaaattacaaattttatctgaagatcaaaataaaaaattttgaaacaacgaagatttaaaactttttaagtttaagtaaatgaaattatttaaaaatattataaggttgttcttaattaaagattaaataaataagggcataaaaattgcgaaataatgcgaaaaatggtaaaataggagcgaaaatttgaaaatcagtgcgttttttcaatgaaattaaattaaaatcgatgaaaataacttattgagaaaattaattacaaaggaattgaatttcattcttttttcgaagcaaaaaaataattggggtttctaaagaaaattctttttttcagttttttgttagtttgtattcttaatcattttttcatatctttgatgaacctattcaatgttaagattttaatggttaaaaattgaatgtcaatctttgtgactagtaattttttcgaattttcaattagttatttttgccgatggcttatagttttagtaaaacttattgataatagtggaatttttatgaatataatatttttgacagcgcggcgcaaaagtccatttttgctgggcggcgcaaatgtcgcggcgcaaatggcgcggcgcaaatgtctcatcacgttcaaaaccacaatttttatattttagaagaataaagatatttttaaatttacacctaaaagaatataaaattctataatatggaaattctttatttcatgttgtaaaaagaaacaatggtaacagaaaaataacggacaaatgcgctttatttttaaatattaaccaaattaatcttttgaaatttaaaaacgttttacagaaaaactatcaaagcccgcttcaaaagccagaaatcttttattacataaaataaactagccggctccgagggcatgcgcggttcagtttagccagccgcgccctagccgttcgaggcgtagccagtaacggggtagatgcgccaggttgttagtgcagtagcagctcaggcgcagatgcgtgtctggatgttcgtgcagcagcagctaccggcacatgcgcgtggcacccgtgctcagttgaatgagcatgcgtggcgcccgtgctcagttggaacctgtgagcagttggaatgggcatgcgtggcacccgtgaacagttgaaaccc

SEQ ID NO: 2443 - DNA, 4787 bp, Heterodera glycines
gttcgaggcgtagccagtaatggggtgcacagtccaggttgttagtgcagtagcaactcaggcgcagatgcgtgtctggatgttcgtgcagcagcagctaccggcacatgcgcgtggcgcccgtgctcagttggaacccgtgagcagttggaatgggcatgcgtggcacccgttagcagttggaacccgaaagcttggcgaatgggcatgcgtggcacccttgagcagtcggaacacgagggtttggcgaatgagcatgcgtgtaccggaacttggggtgctaacttatccgatatgtacatggtatacaagaataggtcattctggctgggcagtagcatcaaccggaatatgccttatggcaaactgctactccctgttcttcaagttcattttaagagacttttggcttccctgtttaagcacaaacaggtactaacgcctcacaccagcgcgaatgtagtctctactcgtgaggcaaccctcacctgaacgaacacgttcaggatcacagggcgaagaagttataggaacatgcgtgaaacatgctcagatgacaaactgctaccggctgttcgtaagagcaaaaatgacaacgcttggaatcgtaatgtctatacgatggctgttcgtaagagcaaaaggaaaacgctgggcagcgtaatgtctatacgatggctgttcgtaagatcaaaaatgacaacgctcggaatcgtaatgtctatacgatggctgttcgtaagatcaaaaatgacaacgctcggaatcgtaatgtctatacgatggctgttcgtaagatcaaaaatgacaacgctcggaagcgtaatgtccatacgatggctgttagtaagagtaaaaatgacaacgcagggcagtgtattgtctatacgatggctgttcgtaagatcaaacgacaacactgggcagcgtaccgtccaacaccaattcccttgtggtaaacggtttctccatgttcttcatgttcatgttaagagacttttggcttccctgtttgagcacaacaggtactaacgcctcacaccagcgcgaaggtagtctctactcgtgaggcaaccctcacctgaacgaacacgttcaggatcacggggcgaaataatagtgcggcaaaaatacatgagaatgatctctttatttaaacaaaaaccaaaaacacaaacaggtctcagatccttcgctcatcactcgagcagaatttctttgtcggtacaaattcttctgcaaattcttcctctttcatggcaacagaaggccctgcgagagatggcccgacatccatagcatccttaacagatgcgctggagtcatgtactgctggttcgtcacgatgttatgtgcagcagggtagttcagctgttcaggaccctgaaacaccaaatgaactgagctccaattgacatatactgagaaactgaccaagattgtttggaagtggttgagtccattgtaccatatcaaaaccgggttctgtacctgcctttgttgaccttgatggccatgtacagtgaagttttgcagctgatcatgtggaaagtcttgctccattctctgtttttaaaccaatatgaggtaggacttgaaaatatttgtcaccatatgattgccgtctgggaaaaacactccaattgtatggcgaacggtgtcgtcataaaagctcgtagcacggcggacattgtcaggatctacaggtgacacgacaacaattgtctgaccgagtaagacggccgcgatcagagcatcaaatgcgtctgcccaagcagttgcgccttcccgacttgcgatgtaagcgtcaaagttgttgatttgatcgtccaaaaggagtgcttcaataaattgcatgaaacgcgcgcgattggcatagaagcctcgcgggaaacagtttgggtcgtcaacaaattgtcgcaaaagagtaaacatttgctgacgcaagttgaatgcgatgttgacatcgtcacggccaacaatggcgaacacaatggccctacataatggtaacttgtaatttggtagtgcattaatatattcaccggaagaagcaagctccatcgcctcgtacatcaacaattcggacgcgacgctgctgttgaattggaaagtgggggaccggggcgcgactcgttgtaggagtcatggctaggtcgattcgctcaaccgattccgacagcagcgatgttgtcggggaaagctattataacaaacatacaaatgagccttttatcatatacacaccattggaatgcgtaaaggcgtctgcaacgatgttttgggcgttggacgtttgccagcgttcatttggcgtttgacctacgaaaaaaaaaattagaaacgaacatgattgcttatttattactcgttcgcgaatctccttgtacaatttaaagtcgtcgtcactaaatgcgaccaagcggacttcatcgattgccggtgcatccgctggttggtccgcaagccaattcagaattgctctaatggcaatgtgcgcggcatccacacgggggaaattgaaagccccggtggaaatgcttgggaatgcctataattgatggaaagataagtcaacgaataaattccaattgcactaacaattgatctcggctgggggtttgctatatccatgtgcatgctcgcaagatggtccaatgcattggtgtagcactttgccagggacctgcggtggtgctcattgagcgctgcactgacttttggaccgacagcatgcaaaatgtctacaaaatgtgggactaagactaacacgcgattagcactggcatacattggacgttgttggccaagtctccaaacgcgggcgtgtccacgaccccgccgtccgcaattggtccaccatttgacaaaatcttgatgttgagcagttgtttgagctctttttgacgaggagaacacgcgcgatggattgcgtcgtctactccaccgcctttgaccaaatccgagttggcggcattgacgatcatccaaatttgttgtttggtgatgtcgcctttcaccaccgtcaacttgtccagatgttgtttggacactgtgttatccaactcaattggcgttgtctttgggtgctgtgcccttgtggatggcgtgggtgttttgaacaccgcctcattcggcatcccaattggcttgtcatcatcgggttcactgtccgccggtggatggcgtggaaacttgaaaaatttcttcaaaaaatccctttattcaaatcataccggatcgcttgggtcatcgggcagcgccgccaacgccatttcctcctcctcttcgtccaggagctcccgaatcacgacattcttcacacgaaggtcactgcgtgtggtgcagactctgatgttgtccgagtctcgcaccctcgacaaagcgacgtaaagttggccgtgagcgaagcactgagaggtgtccaacagcactccgactcgcgcaagcgtctgacctgcaatcaaaaaacactatacaaaagaaggaaaaggaacaattctgaccctgcgatttattaatcgtcatcacgctgccaggacgaagcgggtattggatccgctcgcacttgatcgggccctcgtgcggtgccttcgggtcaccaccaaagacgaagcgggcggcatggaggtcgtgttcattgccaacatgggtgccggtcagaatgcggcaccggatgatgttgtcgaagagttccatgacttgaactcgggtgccgttgcacaggccctcttccagagagatgttcctggtgaccatcatgaccgcgcccacccgaacacgaagaatgtgttcagggactcctggtggagtcatcctgcacaagttctcatggttggcgtcggcggcgatgttctccaagtccgcttcgcctgtcttgtccaccacggggagagttaccgcgtggtaaactcgttccaccgttgtcagccggtcctttaagaagaaaaataggattctcgtttgacaataatatccctttaccatgatggtctcgttcagttgaagcgtgtccctgttcagagggcaaagaattgcgcgctccgacagctgctgccaactcgcaagcgggttgttcagtagctcggcagggaaaatttcctcgatgagcgcacaacggctcggctgaaccatcatgggcggcagcttgacgcggctttccatgttgttcagcgcgccaataccgatgcgtttaagaaacgcacggtagtgctgctggccggacttcagtctgtgattcgcccgcaaccgcactgttttgaagtcggcaaacaacggcgaatttttgacagacgcctcgagttgttctcgatcggctccaccagggatgaccggtgccagctgtttccagtcgccaccaattatgacaacctattgcaaaaagttcaaacgttgaaaaagcaatgatcaaatttagccaccttcccagcaaaaggcaagtccttgaactgttgcgtggcaacagaacgcagaagccggtcgacaaactcgaggacatccctgtgctgcatgctgatctcgtcgatcaggatgccgtggatgttgcggagcatgttggcaaagttgctctcgttgtcaacattcggcgacgttgacgaatcgacttgcttaagtcggcaaagccgcttgtgcacagtctgaccttcgtacaacagttcggcagcaatgccggtcgaagccatgggaaggaagttgatgccagcggacttggcgcgagcaatgatcttctacaaaggaaaaggaattagtgtggaaaaataaggaagtgatctcacattatacgtgaa

SEQ ID NO: 2444 - DNA, 1712 bp, Heterodera glycines
ttccagtcgccaccaatgatgacaacctattgcaaaaagttcaaacgttgaaaaagcaatgatcaaatttagccaccttcccagcaaaagacaagtccttgaactgttgcgtggcaacagaacgcagcagccgatcgacaaactcgagcacgtccctgtgctgcatgctgatctcgtcgatcaggatgccgtggatgttgcggagcatgttggcaaagttgctctcgttgtcaacattgggcgaagttgatgaatcaacttgcttaagccggcaaagccgcttgtgcacagtctggccctcgtacagcagttcggcagcaatgccggtcgacgccatgggcaggaagttgatgccagcggacttggcgcgagcaatgatcttctacaaagaaaaaggaatttatgtggaaaaataaggatgagatctcacattatacgtaaacgttttgcccgcgccaccttcaccggtgaccatgaagagacgctggatgtctggcgaaaagtctgggcattgtccatcgatgacttgttggacgtgctccagtgcagtttgcacagcatcaatcagctgttgttgctcttcattgggcttgggaccggagatgtacttttgaaggtagtcttgtcgcattgcaccgcgtcgttgaccgtccggaaggaagtccacatgaagatgctcgttaagcgcatcatcacggaagaaggcaagctaataaaggcatatggttttcacataattggtaacagtttcagtaccttcatgaaaatgtccttgctgagcacaaggccctgaggacgtggcagaccaatgtgttcgcaagcggactcataggtgccatcctccctcggctccgagtcgggcgttatgccattggcgagcaggaaccattccatggcattcaggacgtattgcttctgctcttcggccgaggctctctctacgcttgtgtgcaccagccacttgtccgcagttacaagaaccttgtccaaaattgtgcaaggactggcgaggttcgctgtcgcaaagaagactgcaagccatcgaatgcgctgccggatggacttcttcattctgaacgcatcatcgatggtcttcatccagaggtcttcgtcagtgaggagaccacgtgctcccgcagcttcaacaaaggtagggaacacgttgccgttgacggtgcgcaatgactcccatccctttgggtcaagcacaaccaacagaagcagtcgaattgcctgtaatagaaaaaatgatcaaattggtaatgtgcttggcgttctaccaagagttcgcggttgctgggcgaaacggtcttgagccggcagaacttaggcactggcgcatcaacattcagcttccactgcttcttggctcggtcatagcgcaacttcttgtagcagttggcatacgaaaggccaattggcgggttcgcttcgttgtacgcgaagtatgcggtcagctgagtgacgcgctcttcgcccctttgccttcgctcttcttcggcctgggccgcctcgcaaatggcgttcaaattttcctcttcgtccttgaagccctgctcaacggcaatccggtgaccgctcggaccgtgcacgtccaattcgtccaccttaaatgagcaatcccataacatgtgggtgtaataaccaaactccgtacctcatgagagcgtcccacaagctttgtgccccaaagcgagaggatcgcttccatg

SEQ ID NO: 2445 - DNA, 1577 bp, Heterodera glycines
ctttttcctctcttcgtttgctttttttaatatttgttttgccttttccgatcggtttcatttttcgctttttctctcattttaatttttttcgctaatttaatttcacttggcccaccatttccatttaagtgcataaaaagtttaagtctctgatgagaaagggcaaacattctctcgtcccccccccctccctcaaattgcattatttcgcttattacgcctacggcatggaaatccaaatgaaatcccagaataaaatatagagccattaggggaagaaaattagcggccatctcaaattgcgtgcaaataaataaataaacgcttttacgatatctccacgccccaaaataaattgaaatttctgataattatctcaaaatggacacttttcagaatgttcccatttggctctttctaatttgttttctcttttcaaagatgcgttttctcactgtggacgaactcaacagaaaatgcccccgggagggattggcaatggcaccatttgccaaaaatggcaacggcagcacaacggaggagcaacgacggtggctgaaccaaccgttcgacgaaacttgcattagggtgggagaaggggaaggaaacccagcgattgattatgctcatgctttgatcatatgaagctcttttttaatccatctctctctctaatccactttatccgcttatccttttcctccctctatttcatcctttttcacttctctctctctctctcgctctcgctctctctctctcgctctctctctctctctcatcccttttcacgcttcatccctctctctcatcctctttatcctattatcctttttcattcctctccctctatttaacccttttcactcctttctcttctctctctctctctcttatccgcttcatccctcactctcatcggctttatccgcttatcttttttcattcctctatttcatcccctttcattcccctctctctctctcgctctctctctctctcgctctctctctctctctcatcccttttcacgcttcatccctctctctcatcctctttatcctattatcctttttcattcctctccctctatttaacccttttcactcctttctcttctctctctctctctcttatccgcttcatccctcactctcatcggctttatccgcttatcttttttcattcctctatttcatcccctttcattcccctctctctctctctcttatcacattttattctctcctcattattcgttcagtctttcttcctcggactgagtgcccaattgcgtcgttatgagccttgggaagagtggttctacactgtcatgtacacgctgatctctgcgctcgctctgctcggcaatggaatggttattcttgcggtgattcgtaagcgcggcatgcgaactgcgcgaaatgttctgatcgtcaacttggcactttccaatctgatgttggcactgacaacggtcagttgctgatcggctgtttctgatcttttcctccacttttaatgcttttcctcactttgaggtgccattcctttggctaccatccatcgatttc

SEQ ID NO: 2446 - DNA, 1856 bp, Heterodera glycines
ccatcatccccccccccctcctttcttcaggtcatggccattgatcgctattactccgtccgttccctcaacatcaattccccttccggccgatcgggccaatgccttcgtgccgtgctcatttccctgctcatttgggttggcatttgtttaattgcttccgcccttctttcattaacttttctctttcagcttttctcctttttgctttcatttcctttgcttgtttattatcgggtccatgtgctctatgtgattaaagtacattaattacaacatttttaattaatccgaatttaataaatttgacaattaaggatatttatgtgcacgaagaaatcgcgtgggcaaaggaaacgaatgccgatttgattgtattgcgcagttacgggtggcgacagtgtcggctcagtaccggccaatttgaggagggaaaagcacaaattgaaatggttgaagggaggaaggctggggtgtcctttcaaatattataattacccctcgggcattggtttgggcattgtcttttcccttaattaacagtttggctttggtttggctattaatcactttattaacccattagggtattggttcgttatctgatcgtcgtctattaaacccttaaaggcttccccagcaaatgcacaaaattcgtcctctctgatcgctgtcgacgatcgcatggtccaacttggcatggccgcgatgcaaggggcgatgctttacgctgttccgcttgtcgtcctttccattttcaatgtcattttgtgtttggaatttttgaaaaacccttacaatgaagatgaaactgacgcgattcctgaagatgaacaccaaacagctgaaacacaatacggaaagagaaggggacagcgtaattgtgacgacggaacgacgacagaggggcgggtcgaagacatcgtcgatgggaggagtcactcaacgggtacaacagacgaacggggggattaattagccaaatgaggagaatggggaaaggaaacgggaaaacaaaagttgaaaggggtaattagggagaggcaattaattagacaaatgaggacaattggtcaaggggaagcgatttgcaaagagaagttcgaacttattggttccgtttgttcagtccagcatcgccactgccgatttgatgctgccccggcaagtgtccattgttacggtcggaacttcgacgagggcagcggaaaagcgcaggaaccgaacgacagtgagcaaatgccaatgccaaattgcaaattggcatgcgatcgcgcccttcccctccttcttgaggtgcttctgatcgccatggccggctcctacgccgtcctttggcttccctttacgttcgtttccattctgatcgacttggattggcttggcgtggtccgtccctttgcttcaaaaagtgaccgattaacagcaacacttttcaggagagtggctctccaattgtcgaacgcattgatcaaacttgcaaattggtaggcattcgctgaatctgatcagttgggtttccgcttctcttctccttcagttgtccatcacctcaatttgcgtcaatccctttctgtacggctttttgaacaccaatttccggcacgaattcaatgagattttcctttattgcttcgcttggcttcccgcggtgaaggaaagacggcaaagtgaaatttcaagtgggaaaaccaaaatacgatgggatttgataaagtgcgattgatgggccgagtttaggctcactcggcggcggtgggggaagccatcggagaagcattccgcaatattcggcaattgtcagtacgtaagtggcaaaaacaacgacaaactccccaatgtataaaggcaaaacg

SEQ ID NO: 2447 - DNA, 3898 bp, Heterodera glycines
ataatatttaaatgaaaaatttaaattttactcaattttcttgtttttttcatcataataaatttgcacatatttacaattgtaaaattaaaaaagcaaataaaatgagtgttgcctggcaatttccccgattcgaacttacagacccgggaaaccagaggctcgaaacagatcgaatgccgtcgtaatgattcaataagtgaagaaaaatgggaaagttcaaacccgacagcgaaaagtgacaaaagaggggggggggtgaaccaatttaattaatggaggataaatgacgaaagagttaattaagtgagtgatttgacggaatggcattggaagtgtaataagaaatgtaaaaaataatggaaaatgccaatgggacaataccataacgagacaaacccaaaatggcaattatttcccgaggaatgtcagccgatttgtcaattgaaatgtgtttgctgaagtgtgaagaaagcgggtgccgtcggttccgcggcggatgtcttccgctgggcctttgtctcttcccgcgtgccccgcggcacattcttccgcggtgacgcgctgttccgcgaattggcctccgccgcttctctcgcgcccctcgccggcgcccctccccgcctcccgttatccctcgcgccctctctcgtcgtctgcttgtcctcactcgtccccactctgtttttcctcccttcctctctcgtcgccgtcccattttccaaattcaccgaaagtcttttcgccacttttgctgctgttctcaatggtgacgaacttttggtccggcttttcctcttctccttttgctggttatttctgcgtcgcttttcctctttcccattgccgctgaaatcagcgaacatccacaaattttcactaattaattacccaaaattcggcgccgaatggtcccccatttgcgttgctaattgacccgtggattggttctgttgttgctctcgaaaacgcctttccctccgttccgctcgcgcaattcgtcgttcttcccttcggagtaaaaatcgctgataatcgatttgacgggccaaacattgggagagaaacacggccatacactgaacaaaactaagcgttggaatgcacaaaacaacgtcagtaactgacaaatcattaagactcacgagaagagaagaacgaattaatcgaattaaatttgactgaccacgggcaaaaccaccgacacaacggcaaatccgatatgaaacgcgtggtcgtcgaaaagtgttcggagcggttggagacatccggcgacgtaaatgtcctcaaaacgaattaatcacttcaatgattagtcttagtcagcatagacaaacggcaaaccgagtcgagctgttgctcacgcttcttctgtgcattttgccaacattgaagcgatcgaatggcaggcacaagcggattctgaccaccattggcaccgccggcgacagaacggcgacagcacgaaaaagggacaccgcaactgatcagagggacaaaaagcaataaaccaaaaaaggaaatggacgtcaaatagaagagacggaaaacgagcggaaaatgggaaaagcaatggccaatgatcaaaatggaaaaggaaagcaatgtgcaaacaaacgcccaccgttcgggatacggattggaggaattgcatttgaactgctcgctgatgttccaatctctgaaggatgtgctgccacaacactcaagctaaacaaatgtcaaaagaatgatgcttcggatgaaattcagctgccatttcacctgttcctgcatataatccacgaaatccgcgatgtttcgattgatgtgataacggcggatggaataacggagaagaaactgagcggaaatgccttaacgtacgatgggtaatcggataaaaaggacgggcatttgcccaatctgatcagatcggtcattagctaaaacaacagccaattatttaattattttgcctttttcgtccccggaggcgtcggaataaaaaaggaggaacagaaaacaggtgaacaccaccagaacgaggtaagagaggaagacgaacagagcgaactgaacgaagagaaggggtgaatttggaggggaaaagccgggcaaaaaaggggggaggggaaaagcgaaccaatttgagaagacaaacgttgtccctgagggcgccgaaaaggccgaaaagggcgacggtgcccgagaagagaccggcggaagtgagcagcacagccgggttgagcaaaacgtcgacaaactcatcgatgggacgagggtcggtcagaaagagataaacgccaagcgcaaggcaagcgacggaagcgagctggcaagaacttggggattatgatgaccaggaatatcgtaaaagattatgcgactgactgagctaaggccgtcccttttagagcccccgccccatatcctttatcccatttatcccactttttatccgttatcccattttttgccacactaattccaacgggaagagagtgtcagataaaatttgggatataaaattattattacaattaatgcagaagatgtcacttttcttgctggaattaatccttcagtcatttccctccccagcgccccaaattatttgttaattaatcattcatccgctgattggctctgattgtcattttgtcatatatctatttgttcctgctgctcgcattaacatcgcttatcaatcaaaatcctttgccttggggaggaaaattaaggccatcagagaggggggggggggggggggataattggggattaggaggatttggtgaagatttgtcgtcagtttccatttgggaagagaaagcccattcattatttactgtccatttcaaggacaaatgctaattatggataagcaaatgaaaaatatgattttcatttgagtgttttgggtgcattttctgtgccaattttctaacaaagtaagccaaaatgtgaacaaaaacaaaaagtcaaactcacaaaaatgaaaaaattgacggcgaaacagagccatttcaggggcccacagatttcctggcgcggcttttccccccgccgtggtgccattcgctgtccatttctcgtcggtcctcaaaagtaccaatggattcacaatcgttccccattttatttcattgcttcacctccaattttgatggctatttcgccgacttttctcgccgtttgttcggcatttgctgctcggccggtcgcattttggcgaatgccaccggccggtcgatgggcaaccatcgccccggggatttggggttaaaaggcacaacgaaacaaaaaatggctgaattatctgtaggatggcattaataaaattattgacaaagaaggcttaaaatagaaccatattaaaataccaatatcaatcagttgcccattaaaaatacaaagaaagtgacactatcgaacaataaatgccaccgcagtcgcttaataattatcgctaattgccctttccaatcaatactttatgaatgggaatgaatgaatggattaattggattaatggctttgatcgccccccttttttccatttcattcattcttttcaatccgttcttcgtccgccccttctgctgctctggtcagatcactcataataaaagaaacattgcccaatgtgttgtcttatcgcgcgaaaagaaaaacgaacgaatgaatgggcgacaatcgttgcgcgacggagtcggaaaagaatggaaaacagcgaatgatcaaaagcggaggagagattggtgaaagatggcacaaaaagcggaataatacagaagaagaaagaagaagcaaaaggaagacgaaaaggagaggaagggaaagaagggaaagaaggaagaaaagagaaaagagaaaaaggagagcaaaagataaggggaggaagagaagagagaaa

SEQ ID NO: 2448 - DNA, 1344 bp, Heterodera glycines
caaagttacggttcaaaatgtcttctgtcgacgtttcggccgacgacgttttggggtgccccggcagcagaacgcgtcggttgggcatttggattctcccccccccccccccccataaaccatttatggcggcggaggatcacttccataaaaccactggtacattctgatcgtgttcaccttttcaaatgacatttgccagtgaaaagagcgaaatgggaaacattgggggaaatcgagcacaacgaaagcgaatttccggttttgcatctgtcagaggaaaaggaaatgaaagcgaattgatggaagagacaacggataaaagcggcgagaaaaaaagaaaaagcgaattgaattgaaagggataaatacggcggaagagaaatgtcaaaaaagggaaggcaagcggaaaaaaaaaattcggaaagtaaagcatttgatagtgctgagaaatggacaaagaaaggggatgggtacagggaggggaagagggaacagaggaaaaaggaggtatagaggagaaagacagggaaaaggaggagaggaagagaacaaggtgaaaaaggaaggaaagagagacaaagggaagaggaaaatgggcacaggggaaaaaggaagagagaggagacgaatagaggaaaagggcaaaggaggaacgggaaggaacacagagagaagctaaagtagagaaagggaagagaaggtatcataattcactcgctgcgcaaaacactccaaaattgcacttaacctccaccttaccccctccccctccccatatctctctctctctctatatctctatctctctaatctcttctctctcttgtctctctctctctctctttttctctgcgaggaaaagcatagaaatggaaaacatttggagaaggaatcggagattagtgcaaatgtatggtaatttgacttttaaattgcaataaattcaatttagataatttaaataaatgaattatttttgatgctaaatgaagggatttgagttggtatttggtccgaaatattctcaactgcaaattaacggatcaaaagaattatcagcgcaagaaaattggagccgaatgaattgagcgcatgagcaaattttgctccctgctgctgttgcttgagttgatggtcatcgttgcccattttcattttcctgaataaatttccgtagccgtggcaaccaatggaaagaagagagaaaagcagaagagagaaagagaggagtaagatagtgggtatgagaagaaagagaagagagagaaagagaggagtaagatagtgggtatgagaagaaagagaagagagagagagagagagagagagagcggagaggga

SEQ ID NO: 2449 - DNA, 856 bp, Heterodera glycines
gggggaaggggaggtcaatcactcctaaattcggaagaagcgggggcgggggggggtgaaaggagccgaaaacggaattctccaaatatggtggaggacgaagaaaaatgtgatgacggatgaaaagggaagggcggaagagaacggaggagaaagagaagaaacgaatgagagaaggaagggaagcatagacagagagagaagagagagagagaaaagaaggagagagatggagagagaggagagggcgagagacaacgagagttttctcttatttattagccaattttctgtcaaattgcgttaatcaaaacgaggaacatttgtgggcagtgtctctctttcgcgcaattttcagctttctctttcggtcgccacctttcacaaaatgatcagcaaagtgtctgttctgctactgcttttggtggctgatttgtgagcgggggattcctttcgattggctttgtgttgatgaccctcctcttcccccctccccctctcttcccaaggtcattcccagcgaatggccggggggcggacggagttttgctctgttgggcattcttttgcttaaataagccgccctttttcggctttgttttctttttagcataaaaatatttaatagggaacgaaaaccgaaagaagcaaaagacgaacgaagcagcataagtaagtaccagcaatgaccttattttattccgtgtgccttatttgtgaacactcaaacggtttaatgggattacaaaaccgagcgaattagcaaagaatggagagagaataaattcgtggtattgggggggggggatgaagagtcttttgttaagacaaatttggcgttgagaaggataaaagt

SEQ ID NO: 2450 - DNA, 3863 bp, Heterodera glycines
aatacgagaaaatcttagaaaaatcaaaaaagaaaatttcaagaaaattcaaggaaataaaatcgatccctgtttaatccaatggtatataacacatacgcatttccgatttccagttcgggtgggtccattgttagattttcaaaaaagataaaatagtgttttttctttaaatgttttaatttttttggcggcggcgttatgtcccggcgtcgttttgtcggggatgtgattgtcctgttccggagccctccttaaatttttaaataaaaatctccgccccttcccccgcggcggaatttccatgccccgggcggtggcattctcagaaaaccttccagcgccctttgcccctctgctgccatcccaaaggatttgtttgcctctctctctctctctccgctgtctttggcacaattcgccccattcttttcccgccctttcgctcgataagtgaattccaaatttggcaccaccaattgctattcattgcgacacgaacggacaaatgtgggcaacacgcggacagacaaatcggaggaacagaagcaacacatttgtcaaaaaggacatccaattgtcataccaatcattagcactaattacatttaatttcgatcatttatttcattaatttggacagagcaatcaattaaagggggaacacaaaagggatgaaaaatgtcaattgaatggtttaaagagcagaaaagcgagcacaaatgatgaatgagttggaatgccgaatcggtttatcaattatggtaaaagcacagaaacagctaaattggaaacacaaaagagtcacgtgcgacccaaagagcggaaaaaagccattggcagaagaccatggaaaacgaattatcatggaaaagacaacgggtacaaaggccgcccatttgtggtcatttctgaaggaaatgtcagcaggcgaaaaggccacgccattcaaagtgaagtgaaaatgttttcccaattaaattttaatttgctttttaattattcaatgttttgttaaagtgaaaacaaattgacactttaaatttaattttatcacttcgccgtgcccattttccagcaaaagcgtcggccattcgccgcccccgcaggcgctgcccaaaggaaaagagcgatggaaaacggaggggggggggacgggggatcgatggaccgagtgacttttgccccttcttttgcctcatttcattcttttattccacgcattcattatctgctcctgctgcaacatatccacctctttttggctctaagttcagtttaggcatccaatcaatgagaccatctttagtttctttgcccataatttttatggtattcaattgattgtgcttctcatgcgactaccaatagaaaaaaataaacatgcaaaaatgtaaaaacataaaatctgtgcctaatttcttttttaaatttaaatattagtacgtaaattaatttgtgctctttttggcgcgaaatttaaatgaaataaaataaaacataattcgattgcgttgcctttcctttcatttttctttcattttcgttttcttaattattacgcttttctttttttattcgaatcaaaaacaattgtgtatgcttttgcctttgcttcattcatcgttctctccccccccccctttttttcggatcgatgcaccgaaattccatcgaattgctaaaacaaacattttgtttattttttttgatttgaacatcattcgctttctcttcctttcacagtcatttctctgttccctttcccatctttattttgccttaaattttacccttcgaaatgcaaataaaaaatgttgcccctttccattccccttcctttccaatctctttggctgtaatggctttgttatgtatttcatccattgaccttttccaccatttcattctttgccgtgtagccattagtcttttattacaagagcattcactccctccctaccttttgctgtttatttgcagattttataaaaaaacaagagctactgcattttacgcgtaatcaatgaccatcatcagttttttaggccataatctttccatacctggtcaaagcataagtaggacttcattcagctgaaaccactaggcatttaccaagtaagaaaacctaaggaaactcaggatgatcatttgttggacgcgtaaacagcagtagagccaaaataaaaatgtttcttacctaattcatagagatcatcatttattttcatatttacagtaaaaatgagcttcacttttcctggtggtgccaggcggccggtcatcgacatcaatagtgaaaatctgatgttcgtttggaaccttccaagatggatcgatatcggtgaaattaagaggtcggttacattttatccaatttgtcttttttgctaaacatttcattaatttttcagaagcctgcagccaaaatatggaagggttcgtccttttgaccgtattcaaaatacttagacaaagcgtttctcattctgttactttttcagatcaaatttgtggagacgtttgaggcgtggagagaggggaggcgcatgggacaaatcattctcgacttcggcacgtacagttctctctcagcgttcactaaggcactctccaacaaggaggagttcaactacgagggcgtcgagttcatgtgttttgattcgaaagtgatttgattgccatgccctatttttcatttgctttttcccttttcagattggtcagaagccgtttttcaacttcgtccgtcagcagaccggggtcgacttgttggcatgcgaaggagtgccgccaacattcgaatacaagcgaaaggtcagcctgatcagaatcgagtgatttgctccaccaacttccgcactgtttcttatttatattccttttctgaagtgctcaaataaattcttatttttcttttctccgttttgtctttgtttttccattctttacaattagtgcgactttttctagggatcttccttcgaaagagaacagcaaaaccccaacaccatttctctgcgacctcgtgttagggacagggatagtccgaggggcaccgaacgcagtcgctacaaccgtgacgacgacgacggcaacaacggacgacccaatggtgcggcacaggccgtgccttctctgcggggtgtgggccgtggatttggacagattggctcccgatttggcaaccgcgaattgccaccgccatcggacgaatcgaagcgaacggcggcatttgagaagattggctcccgatttggcaaccgcgaattgccaccgccatcggacgaatcgaagcgaacggcggcatttgagaagattggctcccgatttggcaaccgcgaattgccaccgccatcggacgaatcgaagcgaacggcggcatttgagaagattggctcccgatttggcaaccgcgaattgccaccgccatcggacgaatcgaagcgaacggcggcagacgaaaatgagtctgagcagagaaatggaaggggcgacgagaatcgtcgcgttcattcgattgttgaacagggaaatgataaagtcgaagatgaacaaactcaccggaccgattcgccgcttggagacttcggaagtaatccaccgagtcgaaactttgcccggcgaatcagtcgcccgaagccgtcatttctcggcgaaaaacgctcggagggattctttgctgctggtaaaattagcgggacgcggaagcgtcgagcaattcgaaattgaatttgggttttagttgacggaatcgaagaaaatggaggccatgtcgagaaagtcacacaatcagaaacaaccgccgtggatgacactttgttgggaatggacgaagactgtacggaagatgccgaagt

SEQ ID NO: 2451 - DNA, 2370 bp, Heterodera glycines
  misc_feature (2176)..(2176): n is a, c, g, or t
gcatttggagggcccaatgaggagaatgacgacgaaattggacaagaaaatgacgatgaagttggacaagagcagcagcagggaaaggaggagggtgaagagagagacgatggcaaggggacgccatcagccgacgacgacggggagggcgcgaacaaatcggacggacgcaccacggactcgtctttcacacagtacagggagaagtcgcggtcgcgcgaggactccgtttctgaggatcgggacggacatggcggcgccggggtgaaaaacacgctgaaaataacgcaggcgagtgacatggggaggggaaaggaataaaccacaacactccacggttcagctggacttcggttttgacatttcgaagattctcgaagcactgcaaactgtcggggaagtcgtccgcttcgaacgccttgggaaagttggtaccttttgaatttccgacaagcaatttcacgtacaatcagtgtcttcccttttcagactagcgccgctttcactttcgacgacgcggctgaggcggccaacgcgagtgttttggtggtggacgacttggcggcaccgaatgcctattttcaactgatgacagccgaagaggcgtaccaataccaataatgaaggcaaagtcggaaaaagggtcaccgatttgatttgtgtcttcgccatgccttttatgtatttgcttttgagtatttgttgatcatttttgcctttatttgcatttgcatgtctctctctttctttgcttcgctctgaatgcgttctcaccaatctctctcacaatcttacattttatatggtctcagccctaaattgttttttgttttcaaagtttacgcacaaaaggtttgtattctgaatttatatgataaataacaccgagctgctctctcttttcgactatgtcttctcattttgcaaaattcgcgtggattaaacataaatttaatggacaaatcaattttttgtgatggaaaatttgtaataaattaaaaatggtttaaaacaattaacaattcgcttggggaagggaagcaagtgaaaaattcacagctcaaatatcatcacaacaattgaaagcgatcggtcagttaagccgatggaggaggggcggcagaaggatgatatgctcattataataattaattgattttgattgagaaagcaaattgggggtaattaaagggaaaggaaaggaatgatttgctttaatatcacagagagtgaaggcattgctcatcaacagaaagggtagagggggggagagatatgtatggacagacaaataaacaaaagaaagagaaaaggcaaataatgggagatagagtggggaaaaggaagagacggacagagagagaatgggaaaaaagggagacggatagagagagaaaagggacgagagagtggggaaaagaagagccggatagagagagaaaagggacgagagagtggggaaaagaagagccggatagagagagaaaagggacgagagagtggggaaaagaagagccggatagagagagaaaagggacgagagagtggggaaaagaagagccggatagagaaaagggcactgtttttgttttggcactttcgcttttcgctttttttttcttttcgtctcgctttgaggagagaggaggagcaagaatcctatgcgctttgtattgccaccatttctcacgtcgattgttgcgcaattgccgccgccgctccgatttccgtcggtccgaccgtcgccgagggcgtgaaactgaccaccgccggcgccgtgccgttcgctgtgatcgaatgcgccggcgcgccgccattgacgaacggcgccaacgaatggtggcgatgggcgaagggcagtagaggtgcgggcggggcggcgaacgacggcgccgcaagtgcggcggcgccgtttcgcagtgcggcaaagttgcgcagccaaaagtcggcggggagtgccgaatgggcggcggacgcgtcggagggcggcgggaaaagttgggcgagctgaaaaacgcggacaaattcgatggcggaacgatcagcggaaggaaaaggcatcattctcacgtggccggcgaactgtccgggaacggtgacaaacacatggccaagcgacgggtcaccgccgctggtggtggacacggcgacgggcgaagggaatgggaagaattgnggcggcatgggaaaagcggccaaaagcggcgaatgggacggaagggcggcggacacgacggggttcagcgcagttggaatggaaaaactggggaattgtggggtgaatttgaaaagaatgtggcgaaatgtcctccccctctcacagtgccggcggtgcgcccgtcggagtcagcggcggcggtggcagcaaac

SEQ ID NO: 2452 - DNA, 2228 bp, Heterodera glycines
acaaacggaaggaagtaattggacggaccacagaaaatgggcacaattcggccattccatcggttgtgccaaatcacttgcgcctaatcgctacgaaactttcccccctctcttttcccctttgcttccccccccctttcctccttctccccttttttcctcctttctctcccccattcacttcctttgcccacccaccgtctctttttgcccaattccatgtatttgttgtgcatttcttgcgccgcgttggccgccgcctgttcactgtccatttgaatgaacgcttcgccgctcggatgacccgccgaattgtaaatcatatggacaccctggaaaatttggaattctagcaaaaaaaagtgggacttttccttttacctgaaacatcactcgctgcgcgtgggggcccaaaaattcgatgacctaaaaattgggaaaataaactcaaaaaaggagtgaaatgtgaaataatgggcagcaaattatgcaaatggacacaaaaatggacaaagtgacgaaaaaaagtgagcaaaaaaagggacaaatcaccgcaaaataatttatgcgattcgacggagataacgcggccaattaaataaatatattctctttttgcaattccaaaccaaaggaatttggtcagcagcaaaagcaaacacggaaaacattatgtaatattttctaaatcaccgactgattttttttgtaattttatgccaaaagactcatttattactgtattacagtatataagacagttttggcatgccacctgctgcacttgcgcctcatagggcagtccgcgcagtctcagacagtccctttgccgctgtgccgcccgttgttgcagcggcgggtgggcggcggcgacggcgccgcccgaattcgccagcggcgtcagaacggcgccgttggcggtggtgggcgaaccgggcgacaaaacattctgacaaatgagagcacaggggaattcgacttttgcatcgtaattgatcaaaattatgcaaagttgatcaaattgcctgtggcactgtcgtcaacggaccgacggcaccgcccaatttgttaattgtcagtgccgcggcgacggccgcgttttgttgagcaactcgcgcattgaacagttgcagaacttcatgctgcattttgaaaaatcataatcaacaaatcaaacgcaaacgaaagatcttttgcgggaggaaattcgaattcggcgactcaaaagccaaacaacaaaatgccaatgccaatgtaatttaaataatttattcccccccggcattgaactgctccgacctgtgtggtcctgaacagttcgatgtatcgtccgcccattcgattgcggttttttgtgatcagcgccttccgtgcgctttgctcgtcgccgaacagcacgaaagcgtcgccggaggggcgcccgtcggggcggtggaggaaaaggatggagccgggctgatccaacagtccgctggactgtccgtcggcgtaggagaaaaagtcacgcacctaagaggagaaaaggacggaaaatggacgaacaaaaccgcaaaattcagtacaaaagaatgcgtaataattgtggaaaagatttttgaattttaattaaatattttaaatgggaaatgcaaatgttataaaaatatagaattaatcgaaattcgtgccatttatcggcctccaccgcaacaataatttgttcacctgctgttcagttgctgtgaaggggaggccgcgcattcgcataatcattgccatcgcactttccgctcgaagggcaaaacgaaccgattgactgtcagtgcctggaaaaccagaagagaattcgataggaattggaaaaagtgccaatggaaggaatggccaagggaatgccaaaaagcaaaaacacaaaaaagtgaagggaagaggaagaagggatcggaataaaggcaatttgaaattaatcaatggaaaaatgaggtaatccactaacaatggcatctgagcaattggcgggggggggaagtgagtggggggagtaggagaaggagacgacggcattgggggcggggggggggaggagaggcaaacaacgcttggcaataggcgatcatctgcagccgatcacttgggggaggggcatcagagaaaacgagaagaataagtaaaagcaatgggtgggcgtggggcaacaatgccaaaattggagtgaatggacaaagaaagatacggcagtgaatgggcgt

SEQ ID NO: 2453 - DNA, 1778 bp, Heterodera glycines
  misc_feature (19)..(19): n is a, c, g, or t
caagagttcaacgatattnttcaattggtgcggcggcctaaacaaacgaagccgctccggggcgaatttggacggcacgtcatttaaaaatttaaatttaaaagcgaaagcaaagaaaaaaaaaagagaagaattttgggccataaaaatgctaataaaaaagaattccttaattatttattcatttcgttgtccaaaaatcgatctgtgagcatttatttcccttttgagaataagcaaagcaattttaactttgaattggaggaaattcaggcgaagtcccaaaaaaaacaaaaaacaaacaaaaagaaacaatttaatgaattaattggttttgctaatttgccaattccctttcctttttccctcactcaccgacggcgtgtttcacaaattcgtcccccgaggcgcggtacacttcgatgtaccgcgcgtgcaaatgccgccggtggcgttgcagtgccaagtcgcgttggtccgcgcgcgcgaagcgcaccaacgcttcgccactgcgccgtccttccggccccaaacagagggcgacgccaccgctggaaaggggaaaggcaccgaaatcagaaggatacggtaatacggggtggaagaggtacggtgggatgtcgaggccggcgaaaaacatcgccacgtccaagtccgagacgtgccaaggcaacccgcgggctcgcaccacacagcgtgagtcgacgtgcaactcggaactatttttggtccatcgattagccgcttcaaagcgtctcgccccccgctttttctaccaaactgccggagcatagccttgggcgatgcgctccaaccgtgacaaaatggccacggcactctctgaaatagcctttggcactcaaaaggcgtctgcgctcgccccgccgctcaaaaggcgcgctgacctcccttctcgcacagtttgccgtacatccgtcgcactctctcctccaactgtctgcgcacctcgccgtctccgccgctgtccattggctctgtcggcgtctcttctcctccgctccattcggcaccattggcggacaccgcgtgggatgacgacacagcgccgccgggagaagagaaagggacaaacgcgtggaaaaggggcggcagcggaagacgggcggagaacagttgcggctgacaaagcaatggacggacataattcaagaccaactcttgacttcccttaagcacttttctcccgccgttcttccctccttgctcccctcgctctcttttatatttctctctctctcacactccctctctccccaactttgtctctctcccctttcacctctctctcatctctgttgcccctctcccccctctccccatctctctcctctctcgtcccctctccacctccccatatctctctctttctcccatctctctcctctctcttcctctccctctctctctcccccatctctcttcctctccctctctctctcctctccccctctccgcatatcttctcttctctccacctgtacgtcttgcgcttgttgccccatttcgccgcatcggtccgtttcctccgccgccatttgcgcaatcatcgcattagcacacagcggataaatggactggcggattgcctcgcgagagcagaacaaaacgccacgtggtgggacagaattggccacctgcgtagggtgggaaaaacaaccaatggggattccccaaaaattaaaaaaaaaatcaaaaattcccgaaaaatctcccgcttttgtcggtctcttttgcccccccctccttttcccaccttt

SEQ ID NO: 2454 - DNA, 2303 bp, Heterodera glycines
cagatataaggactgcctcgctgcttcccggtatgccctttcctctgatgcatggaaagagactcagccgtttcatattccttcacacaaatttctccgtcgtccaacggcaaaccgacttaacaaatgagcctatcattaacaaaatttaatgaacaaaattttacgcatacaatgtgaatgtgttcctccgccatttttaagcagacgtaatttttgtgcgctaaaaaaggaaaacaaaaaaaaatacaaaagaaattaatcaaaatagacacatcaaattaaaaatgattgtaatgcatatattacgaaaatgaacaaaattatcgtcaaaattatcaagaaaaaggaattaaaatatttgtcattgtaaggattagagaccggcgcaggacaggatgctgcgcaggattttgcaggatcccagtccgcaatcctgcatattttggaaaatacaggatttgcaggattcgcaggatttgcaggattaatcctggatcctgtcctgcaaaaaattttcaattccaatcctgcaacaggacccgcaaatttgatttttatgcaggattcagcaggatcctgcattgattttttgaaaatttttaaaaatagaatgccaaatattcagaaactttcttttttcaaaaatttttttcttaataaaaatttttcgtttaaaaacttatccttattcgaaaaaagtttatacaattgaattttttatgtgttttgctacctaaaaagcgttaataaaattttttttttgctattttcgtgcctattttaggatttttctgcctttttaagtgcctatttcgccattttttgtgcctaaaaatcccatccctattcataatggattatggcttttttgcaaagaaatttaaataaaaattattttactttaatttaagctattattatgagccacccaatttggcaaatcggtcttttaaaacgcattaaagaagattcagtcgattgcttggagtgcaagcaaaaaaacattattaatttttcatcttcatcattttttggtttaaaaatatatttgaatacttttttatactttgaaagacttttttattaatacagaattttttgaaatttcctaaaatccgcaatcctgcgcaggatcctgcagattttaaatgcaggattgcaggattaatcctgccggatcctgtcctgtaaaaaattttgaattccaatcctgcaacaggatccgcaaatttgaaatttccggtctctagtcccactgcgggattggaattcaaaaattttcacgggctgggatcccgtgagattacctaatcccgtaaatcacgcatttaatttgcgggatcccgcgcagaattaaggaattttgaaagctcgaaaaatatgactaaaatttagttaagaaagagatattttttttatctcgttttggtgtactattttcatatcttaaccaatgaaaaatattattttcctggtttttattttggctgtaagtatacgaaatcattttgatcggatcggggtcgcttcgtcgcgtccaaatcgccgctgagccaactcgccgccacttcgccatatctgctttgtgcctgctgtcgaatcagctcccgaaaattcaataaatttccataaaacgtttcccgttttcatataatttctcttgttttattaaaaaaatggacgtttttctcgttaacctaagcacatccatcgaaaacagtgaattaaattggttgttttgataattgagggaaaagtgaaagaatttgtgacggcagagaaatacaaaacggcgagaatcgcccagcagaaaatgctaatcactttcccccacagtgagaataatcgtcggtacatttcactctatttccaccgcccctcacgcgcccaccgcacaaagcagcaaaagattattgggggtttggactcgtactgtcgctacagcccaaaataaaatcaaatcatttcaattgttgtgatttggctggttaatttcactttggtcatttgtgtgttttatcgcttctaatgattaattattgtttcatttactacagtttttttctgagtgtttttccactaattgcatcaatttgattattaattagaccaattcctcaactggttttatgatatgcttttgattggttagagtgattgatcagttttgagcacaaacaaacatttattgtccgactcggcttcatcagcacattccatcacataacaaataaaatcaaaaagaccaccggcagaataaaaaattggttttttgaactcattcgtccgttcgttgcccc

SEQ ID NO: 2455 - DNA, 1963 bp, Heterodera glycines
tcggatcaaatcgaatgcgacgcgttgttctctgctggtgctcgacgaagagagcgtccaatggtagcgaaacgcactcattttcaaatatttcacgcttttaggttcaaagagcgaaatgtgcctttgtctaatgagggcatcggatcattggcggcaaccctttccaaaaatgggggccaaatcacaggagaggtggggatatgttggggcgcggggagtagagtgaaagaggggagagagagcgaggtgagagggggagagagcgagggagggtgagagagaatgagagagacagaaaagggagggaagtagggagcaagaggatgggagaggaagagggatcaggaggatagaaaggaagaagtgatttagcggtgggaagagagaatagagcgaggcgagagatgatcgatcggacatcagatcatgttcattaattagaattgtaaaaaggagaagccccaatcgaatgaggaaagtagctcctgtcgaagcgcaagtgacgcgtcggtcgccgacccgacgcctttccccgcggcacaaatcatcgcccaatcgcaggaagaggtaggaaaggatttgttttttgatacgtcaaattgtgtttcttagggctcccataataaaattttatgaagcctaattaatttaaaattattcaaacgtaaaatcgcatggaaagggaaggaatagaaaaagaaatacccaacaccaaacaaatacatgcaaatgaccttctccatttccaatattttctgtttgatattttataatttgtgaaacattagaaatgccggggttaattagagaaacgtttatggaattaattaacgcagaaaaagaaaaaaggctgattaaactgaccctttgaatagattcactgtttattattttcttttcctcccgctcactctcttccctctccccactctctctctctctctgtccgtccgctgtctccaatctctcccctttaatctgtccccctcccccttttttctcatccctcccaatgctctttacgcttcttccaaatgcaaattccctttggacagtccaacaaatatttattgtaaatacaatgtcgacacattcattcattctcctctttcggcccttctctttccaaatattttgtttatgctaaacctttaaaaaataataaataaaaattaattaaaatttgctcagcttttcctttcttccgcttcttctctctttgcctttcgtttgttcagcatttgcttttccttttcttcgcttttccttttatccgcttttcccttgccattgttttgctttttcactttgccaatttgaacaattcttcgccctcccccgacaaaacaaatcacttttttgtaaaatgatttcccactaatttacgcatggaaacgaacgatcgatgggcgatttcttcagttgctcattttcaatatttcttattaaatgttcagcttcgactgctggacaaaataaccttttattaccgtatcactttctctctctctttattttgtctcttcgatcgaattaatgccgcggatttgtcaatattaatcacattcaatcattattatctgctacctactaaatggtttttttaactttttccgagtattttcttttttacttggcttttcctccatcgttttatgcttctcatctcatttaatttgtaccccctccctcccttttctcctcatatttatttctaaacttctcctttactctccccctgtaaagccattgcattgggcgcactatttgatattattacataatattccctcattttttatatattttttgtccatcattctttcgtctgtctcaaccaaagtccattttcaccatcgtgcgaattggattcaatttattgaatgaatggatggatgggcattccccccccccccccccccgtggacagaaatggtgagatgagcgaggaggggggggg

SEQ ID NO: 2456 - DNA, 4345 bp, Heterodera glycines
  misc_feature (55)..(55): n is a, c, g, or t
  misc_feature (4291)..(4291): n is a, c, g, or t
tgctctttacgcttcttccaaatgcaaattccctttggacagtccaacaaatatntattgtaaatacaatgtcgacacattcattcattctcctctttcggcccttctctttccaaatattttgcttatgctaaacctttaaaaaataataaataaaaattaattaaaataattgctcagcttttcctttcttccgcttcttctctctttgcctttcgtttgttcagcatttgcttttccttttcttcgcttttccttttcttcgcttttccttttcttcgcttttccttttatccgcttttcccttgccattgttttgctttttcactttgccaatttgaacaattcttcgccctccccccccccccgacaaaacaaatcacttttttgtaaaaatgatttcccactaatttacgcgtggaaacgaacgatcgatgggcgatttcttcgagttgctcattttcaatatttcttattaaatgttcagcttcgactgctggacaaaataaccttttattaccgtatcactttctctctctctctttattttgtctcttcgatcggattaatgccgcggatttgtcaatattaatcacgattcaatcgattattatctgctacctactaaatggtttttttaactttttccgagtattttcttttttacttggcttttcctccgatcgttttatgcttctcgatctcgatttaatttgtaccccctccctcccttttctcctcatatttatttctaaacttctcctttactctccccctgtaaagccattgcattgggcgcactatttgatattattacatattccctcattttttatatcttttttgtccatcattctttcgtctgtctcaaccaaagtccattttcaccatcgtgcgaattggattcaatttattgaatgaatggatggatgggcattcccccccccccgtggacagaaatggtgagatgagcgaggagggggggggagggtgttgcgtaaaagcgtaaaatctgcgggataaatttcggtcgagtatcgatcccctccatccattgaaagttcgcatcagccgcctttcccaaaaaaggccaaaaaagcatgttttccaattggaaaatggcaaatgatgcgaaaggacagcggagtttctgccgaagagagtttattctaatggccttcaatgctttcttcctttcttctgtgtctccttggtgaggagagattgaaagagccgtgccaacaaaagttgggggcgggggggggacgcggaatttgtctccccggcacggcacagccgcacttaaagtgccgaccgacggatgagctttgtgatcgcaattggcattttttttttattcttttctcattttgttaacaattttgtttgaccaatttttagtcgctttgtctttcgtttgttaatcttttttaattaattttatttaatttttagtccttcccctccgaatattcctcgccttcacccctcctccccgtgctttcctctgctgctaatttcagtacggcaacaattccgcgccatcaccaaactccaattgaggcaccaacttcagcacagcttaaggtcctaaaaataaaggccataatttaataaatgaattaacaataattaggccgccggaccgaagccgcgactttgcgcacttatcaaaaaaaggtgaaattggagtgaatctgacaatgaaagagtttcgaattcatttgtcacggccaatgtttgcttttgaagcaacagtttaatttgctctccttcagtcccattgacgaattcggcttcaatttgcacgccgaaaggggcaaaggtcacttcgtcggtgccgttgacaaaggcggcatcgccgatgagttcgtccaattgactgtttccgttctttgcgttttattcgatttgttcagtgccggcctcgaaacggggcaaagaattgtcggcgttaacggccgtttggtgtccgcgcaaacgccacataaggtgaactcggaaaagcaacaaaaacccaacgatcggacaatcccaaaacaggaaatagtgaaattgatcaaaagcgacccattgaaaaccgttttattggtggcctccgaagaagcggacagattttatgccgaaaaaggacttggtgaagcgactgacaaagctggcattttgaaaaagcatttttattttcagcattttcctatgatcatttgctcgtgttcgatcattctccgcaaaatggccgaaattggacgaattccgacgcattaaaagtgggggggggcaaaaggcaaccaatcggccatcgttttattatcgcccctttcctttgctcaatttgtccatttattcaataaaattgggggggggaggtgcagaaaatgtaattctttcgagaatcccgtacaatttaattgatcgaaatttgcacaaattaataattaaagagcccatcgcaaaggctgtcgaatatgcgccaacggaaggaatttgtgacggagcagcaacaaaaagtgggtgccaaaggaggaggaaggggaaacagagaatgaatttagctataaaatgatattttgatagttttggctcttgaccatcttgggggggggggggtgaactcggtacgaattcgtttagtaatttaaaggacggagtgccggggttggcactgagcagtcgcccgcccactccaaccagtacttatacggtcggtgttaacaaaccgagtctcggaattgcagttttcgatccttctctttgctaattcgttctcctttcactccgttcgttctgtctgtttctctgcgctttccacccattcactcttttcgttttttttcgttttgcacaatgccaacgcccttaggcatttccgtcgcctgcggtggccgttcaaatcaaagtccgcgcggacaatcggacggacatccaaatcaaagaggcattttgtgagcagaaaaccaatgaaatggcaatgccaaaagtggaacattatgccgaacattcgtccgccgatgttttttccaccgacggaaagcaaacatttggccaaaatgagtcggaaaagcgacagaatggggtaaaagccgaaattgcatttgtttttttttgctttttttttgcgctttcactttctttgagttccttcctaatggaatgaataattgtcgccaaatgtccttttacgcctttccttttcagaagtacgttttgtccggcctttcccccgaaatttccccgccgccgtaccaaaaaatggcaattgaaaattgaaaagcaaattcaaataattcaaattcagaatatgtcacactcttcacgaacaaattcacccgaagaacaaaaaggcaacaaacacattggaattgtttagccttttaacaattttttaaggaaatttccacgagattttcgcgctgagtgcgcaagaggcgcgccaacggatgaaggggaggaaaagggacccgcggaaggagggcaaaatgacattgggtggggcaaaggggggaagacaaattgtgccaaaggagggggagggggcgaaacttcgaaacgcggaaaagtgtcagcagttttttaccattctatttttttggaaattattaattagggaaagcattcgtcccatttaggggggattcattttgaaattaaaaagatttcactttaagaagagaagcaccggcttatactgaacttataagcagtttattcaacaatccgtccgaacttcttcccgttgctgtccaagtcaaacattctcactagtccactctctctccctccctctctctcttttagtccactctctcatccgattttctctccctccctctctctcttttagtccactctctcatccgattttctctccctccctctctctcttttagtccactctctcatccgattttctctccctccctctctctcttttagtccactctctctccctccctctctctcttttagtccactctctctccctccctctctctcttttagtccactctctctccctccctctctctcttttagtccactctctctccctccctctctctcttttagtccactctctctccctccctctctctcttttagtccactctctcatccgattttctctccctccctctctctcttttagttcactctcttttctctacatctctctctctctctctccctttttaattcctttgaaaatactttgttttacttttcccgaaatttaaatattttcattttatttgagaaattattttagttttgcaaaatattatgtataaaaaantaaattcaaaagtatggcgattattttgaccataaattaaaatttgtttattaa

SEQ ID NO: 2457 - DNA, 3398 bp, Heterodera glycines
ttttctctccctccctctctctcttttagtccactctctcatccgattttctctccctccctctctctcttttagtccactctctctccctccctctcccccctttatctcactctctctacctccttttatctcatttagttctacctttccccaaacttaaatatcttcattttatttcacaaattattttatttttgcaaaatattatgtataaaaaataaattcaaaagtatggcaattattttgaccataaattaaaatttgtttattaaactgtcaaagtgtcaaccttactgcaaaattaataaaatcacagaaatgctcaattggtaaaggacaaaaagacatttccgaggacaaaattaacaacgaatgaataggcatgtgatttcatcaaaaataataatttcatataaaaagatacgatactcgttgtagataatactgtattttgaaaattaaaaaatcggtgggagagcccgcagtatgtccaattgggtgaagtagagctggttgaggcgagaagcgatcacaataaagagcgagcggatgggagagagcgatagacagagagacaacacagagagagagagagagaaacagagagagaaagcacccctaaccgccggagggggggggcaagggttggtttttggaattcatttgaaaaacttcatggataactttttttgaagcataatcaattttttaaaattttacatactttgggctaatttgttttctcaatttgatcaaaccgaattttcgcattgtttttagaatgaattaattgggtcaaaagacggcgagtgaaggataaaaccaattttaaaaaagaaaaaggactaaatggaggagaagggcaaacgccgagaagagaacggcacaacggagaagtgccaagtcggccgttgtcgccccgggcgattcgcagcttcgactccgaattgggcacaattccgaaggaacgccgctaaaaaaggcaattcaattgctccatcgctttcactcactttctcctccttttacgaatgcgacccttttgaactcttccaaaagttcgctgttggcattccatcctaaaataaattataaattttagaaggaaaaaatgagaagggcacgacttttcaggcattttcagccaacacgaagaggaggagcacagacagcaatggctgatggagaaagagcaggaggaggaggagagcggagagtggcagaaagagtccccccggggcattctctgtaaagttcgaaaattgaccgaaattgggaggatgagtccgaccagaactggctttggcacagcaggcaaagtgcggaatcttacgcaatttttggtgcctttttgcgactttgccaatgtgcaattcgcacgactcaaagcggacgaccaaaaaagcggcgaattgcgcgataaatcagctaaattcctcttaagtattataaaacgcgttaaactgctgtctgaccatggcattgctcgtcgccttcggcgggggaggacaattgttcccgagaagtaaaggcaccgccagcagaagtgccgagttggaagtaagggaccaatgcaagacaattgccgctgctaattgccaaattaaccgaaaaactcaaaggaaaggcacacttcggttgttttgtcgaaacatttctcggagttttcggcgcgacaagcacaggaatttgcgatttttggcgcaattttaaacttttgtccattggcttgagaaaggccgaggcgctgcaaaagtttaagacgaaatcctcttcagcacatttcgaagtgacagaacaaatcgccggcgggggcgaagacaaagtccgaatgccctccggagatccctcgcggcaaaggcgggagcagtgccgacaaagggcgaaatcggcagggaaatctgccgaggatggcacctcttcttgcccattttcgcaattttgctccgactttctcagcttcttcaatccccatttgctcttcctccgaccaatcctcgtgcctttggaaatgccatttccaattgactcccttcgattgtgccaatgtttcttttctctcctccaaccgtttgctctcttcggactccgttttggttgcgtattgcttttgtctgcttaaacctttgtcttttcatttgtttttgttattttcaatgctttgcctctgtccgtcccgtggccaatgccatgcgatccgacgctgagctgaacacactgcgggctcttccattttttggaatttgatgggcattttgggaatgttgctgatgtgggaagagaatggcactccgtgcaattgaattgcgacgaattctaaaaaattgagaaatgatggggacataggaagaatccatattgacaacaaaagtaaacggaaaaaggtaaagcaatgttggcattggcttgtcatttcgcatgcctttcccttttttccgtttgatctcagcccatttcagtcctggcggtcgccttaccccgaggctgacccgggccggccaccgttggaagcgcgtcgatgggtcagcacgggaattcgagaggcatccaacacaatccgttgcgggtccgaaacggacgaagcgcggggggaagagacggaggggcgggggaaatcagacgaaacggaggggaaaaagagaagagaatggaaagtgagcctaaacaaaggcaaattgaaaaagtattcaaacacaacaatcatttacaagttttcgcagccaaatcgaagcatttcctcgtgaattctcagctcgggcggcgattttggcgaatcgacggaatgtttttgcccaattttgggcctttgtcggcccaatctctggcgaagctgtgccattgagcacagctcagaagcacaggtcggacgtcgcaaaaagggaaaggcaatctgagaaaggaaagtgaattgccaacggcacctttcgcccttttctttggcattttgtccttccgtccgtcccttccccaccggtcttttcagttccaatggcacttttgtggtttgtccctcagtggctgagtatatgttttgctgttcgtcatcctccggaaccgatgggccataactgccgccgttgctgctcccgaggcctgagtcgaccattgccgcttgagggttcggactcaatgccaaattaagccgatcaattgtactaaaattgactgatttgccaaaaatataaacacaggtgaaaatgttgaccgttttccagcaattccatcggatgaaagtgtactgctcgaagtgcccgggtggccttggcccctcaggcgccactgctgctcgccctcgtcaaagttggcttctcttcgaacatattccgccactgccgacggcacgaaactgtcgatgatcagccatttcagtgccaactctttgttcatctccaaca

SEQ ID NO: 2458 - DNA, 6661 bp, Heterodera glycines
  misc_feature (6644)..(6644): n is a, c, g, or t
ttgggcttttcacgtgtcggaaatccgaacgcccatttcaatttgttgctggattgggacatatatcaaatgtcctttcatacggaatttcgattttcctccactgcattcgattgtgcagtttgtgtcgatttccgcctggtcaaaggataatatcacgttctgatcttccgcttttgaccggcatggtaccgtgaaacgtgttccatcaacacagtagacatctgccaatgctgaaccgtattccgtccaacatctaagcttcaattgggctcccgactgacacttataacaacctttaagtgtttttgtttgtgcccaacacttggtgaagtcttcctcgatgccaagacggagaccctcgaattgcaccatcacttgtattggtgtgtagtgggtttccgagaaaatttcgccatctttgtatcggatattcaaattgcgcagacttaacggtagccttttttccgggttgttgaattccttctcaaggattgagtcgcggcattggcaatcaactctctgggcctcttcatcgacccaacatttcgggcacgcttctttcgacaaagtacagccggaaaaattgcttgctatttctctatcttggcagagaagatttgtattaacttggtccaccattgagaaagatgttccatctgacaggaacttatgccctaagataggaactggtgcttgtgataccgcaactggtgtcagtttcacctccttccatttgaaggtaatccctggtatcaacgacatctccatttcacccttaaagtttcctccggattcggctttaagtttcgcattgattcgatactcccacgttggacacgaaattaattcgtatataattttcgactcaggcacagcgtgtactctgtagaatatgcaactcgcagtcggaagtttgcatccacagttccaaaatgaacacgattctcggcaacttgtaaatccaggacctttttgaacacttcccagttcttgtacaaatgcactgtatcctttcatgtaatcctcatgcactctctggcaaaatttgccaaagcaactgccttctcgtgggcagctcttcactgatgtggtccgaacggtatatgaccgtaaccatctctcagtttttgggatacatacaatgctgagtgacagtaatttcatctcaacgactcccatgactcgctcttccgggtctctaaggataagtcgaactggttgtcctactggcagtagagtgacatctgtcgagctttcaatccggcattccgagccatttgcctttctcagacagttttctgctactgcgcttatcgaaacaacacgggctgagcctgcagcatgctcaattagcagtgagcttgccgccaatgcgagtaagctcatgcccattttcgaaagttttttggctctgttcggggtcatcttccgcttattcggttccctttggactactctggcatcatctctttgtagcctttttccaatgccttggatgaccatttttattggagttatgatgatccatcgaataagccaaaatagatttgaggtaacttgccgcagtattgaaagtatcctacagagtgcgattatcccagtgaaagtgaacaatccatacactcctgtggacacatctggacggcagtccgggttggctatcctttcaatacaaaaccaacagtcaatcaatgtgcatgggtcctgtggtgggcattccacttctccaatgttgacttttccatctcttagccaatacgttgccccgcactggtaatccgcgattagttgctctcgaggcagctcataaataagtttatccggagtatatcggtgtaccaaacagctgctggttgcaccacaacatacttcgaatttggtcacttttcttggtacagtgactttaatgcctctctcagcacactctaacttgcacattttacaaggaggaaattgtcttcccctatgtaacttcgggatatccggtgggtttggaacaaatcgagtttctacaaatgttgtccaaatcaccagcatgaacattaatcccaagatggaagctgctttcgtcatggaccgggtcaccattccgtggtttctgatctgtccttgttggacatctctcggtctttccgcctgcttcccatccttttttgggattggcccttgaagtcctatttttccgttcggaacttcttcttcttcttggtcttcagactcgtcaacttttggtacttcgagcctatacagacggtttatcggacgcgaaatttcacgccatgaaattcgctcgccatttgcctttggtattttgagtttggcacttcgcacaatattgtccgatccttggagttcaacaattctgcccaacggccagcagttcctcggagttttttcttcttcgataattactacctctccgatttttggttggtccgccaggcaacttcttggtcctttatgctcccattgtaatctgttccggagcattaacaggtactcttttttccatctggtccagaattcatccaatgtggctagagtaccttcccagcgcatctgcaattgcttctggagatttttaggttcattttcgaactccgtgtccgacgattgttggttcctccggacatccaaactcaatatggcctttggcattatgaaatcgaccggtctcaatggctggacagcatttggtccttcatcaacgtaggtgatcggtctttgatttattgtcgcttcaacttctgcgacaaacgttctcaattggtcatagggcaaaattcgacgcccaaggactcttttgaaggccgcttttactccagcgacttggcgttcaagaaatccattactccaaggtcttagtgatggattaaatcgccatttgattccttcgttggccaggtgctcttcgagcggacatgtgggtgtcttcccagcttctaatgctgcaactactttagctgccagtacaaattgtgtgccattgtcagtgatgattctttttggagttcctctcctactagtgaatcgacggaacacttgaaggaatgcctcagcgcttaagtcaagcactggttccaaataaatagccctcgtacttaggcaagtgaacaaagcaatccatgccttctgaagcttaccattaattttggtattcgttggtccaagataatcgatcccaatgctttcaaatggtgccgtccgcctcacgcggtcctcaggaagaggaggcatcgttggcaatttatatgccgggcattggatcctgcgacaacgaccgcatgctcgaatgaccttctttatggtcagtctcgctctgggtgtccaatattttcccataaattctgtcaaagtggattcaactccagaatgggcaagggactcatgtaccgactgtgcaattagtcgggttattggacaattctcaggaaggataatgggattaaccatatcttctgatgcattgctcattgcgagccgtgttgacagtcggacaagaccatctttcctcgatgtctttacaagttcttgtgattgctttttccacattggccaacatttttgtgccatttttacaagtaagatctcggcgtactggtaatcttcactgctcataggaacaccctctgaaatctcgaatattcgagtcttcctcatcttgtttattgcacggagaaaccaaaccacagtgcggcgtagtttagtccaactgctaaatcgacaagggtcaatccatggattgtcttcactcgttgttgctggcactgcaactacattgtccaattctgaactttcttgtccatcattcatggctccctttggggtgacctcgaagtcgatcggccaacttttcattggttctcggagccatgttggtccattccaccaaagatgatgggatctcagctcttctggagtgcatcctcttgatgctacatccgctggattttcgtgcgttctgatatgcagaaatctggcattttctgatatcctccggatttctctcaaccgattctccacaaatctgggctgggaatcttttgactcaatccagctcaagacgggttttgaatctccccaaataaatttttcatttattgggattctcagctgattttccgcaaatttcagcatcctcgccccaattagcattgccaagagttccattcttggaattgttacttcagctttccggggcttgattctactctttgcatagagtaactgtacattggtttcttctcctttctgagaccttatgaaaagtgccgctgcataagcgtccttgctcgcgtccacaaatgcatggagttggaccatttcaccttgcagcacggatcgtctcggaaatttgaatggttcggtcttccattctctgatgacagcaaaccattctgctgtttcatcagctggtaaaatttcgtcccatccaagggttctgtcccacaatcgttgtaggaacaattttgcttggagaaggcaaggtgcgaccattcccaatgggtcaaatatgcttgctaatgttttcaaaacaatgcgttttgaaatcttcccggcttcattcgtcggtgggaatccaatgctcaattcgtccttttgaatgtcccaagggatgccaagtactttagtccctggtttattaagccggtcctcttcgggaatttgctccatcgctttcattgagttgcaaataaattccctcaggttcatttgtgcttcagcaaacaatgctttcccttctcgatacttctttaagacttctccagcgtctttgcatgaagtcattagattgtctacaaaggcattcccagcgaattccaacgccaagggggaagctttctccttcagatgcttctggacaactgcagccaaaataaatggcgaagaaattactccgaacggaaggaatctgagcccaacggaagatctgtaaattgtctgtcgacaatttcttcttagggtctttcacccaaaggaatttcacaaattccctgtcttcattgtccaaagatatggcattggaggccttttctaagtccgcccataatgcaattattgggagacgaaatcttagaaggattctcacgagatcgggaatcatcacgggtcctctgaacatacactcgttcaaagatttctctccccgtgggtgtgctgaagcatcaaaaacaattcgaagtttatgagttactactccatgatgtggcaggaagtgttcaggaaaaccctcccttctttcgccaagttcaaagaatccgagattgaactctctcgagattgactcgtggtatttgtccaataactcgggagtcttgcgcagtttttcaaggaggttgaccaatctcctatatgccatattgtaattcgatggcaaatcgggcgggaactctttccatggccatcccgaactataacgtccatcagcgagtctcttggctttcttttcgaagatttccatcgctgtgtcgtcatcattttcttttgggtcgtcttttattcctatcagttgtaggtcccaaaagttttttgcagtgtcgatgcctgtttctgcaaattcacaatcagcttttgcttacatgactgcgcaaatttgtctcgtttctccgatttcctgtgggatatcttttccacatacgataggtcccactgaagtgtaaatgcggaataagttccgatttatctgttcgcaccgctggaaaaatcgccagaattcggccataccaatgagtaaatcgggttcctcatcggttatttccacatttccggtcttccattcggctcgacggatagatttgactatccaatctgcccgataagctactattttttcagatttgccgttttccaatgcgacatgtagctcatactgcggggcatccagcctgaccggtgaatcgatgtggaaaccgctaacttctagctgcccatctttcaatttatataagcttaaggctcgcactacagcacttttgatcatggttacttgcgaacctgggtcaaagaagaccaaaatcctaattttctttgtaggatttcttctggagaaaattgtgacgtatttcgccattaggagcactctttttgttttttttggcataatataataattgcaatttgcagtaaaaatatccccttttttgattttagacaccttttttaatagtaatttttgtaggtttattttattttttaaaaattaatgcaaaatatcgtgaaattaatgaacagaatttgcaagtatttaattagttcgattaagaaaaaattttctttttctttttactcaagaataggctatttagatattcattaaattgctaatgctttaaaaaatatatatttttaatttttttctcccaatttccgtcaatatttaccattcacaaatcagaccccccccattcctgccaatgcttgtttttctcgcttccggtttgggaatttagattcctgtcgtagtgaattatttaaaattaaatttataaaaattataataatataaagaaccttaaataaattttgttttttccagctctcaaaccgcgtcaccgaaaaaagaaattgttggagaaggaaatatacacgtgatattttaaaaaagggtcaagtctaaattatcaaaattttttagatacttnggaccgacttaactgac

SEQ ID NO: 2459 - DNA, 2990 bp, Heterodera glycines
gatgcgatttttaggcacaaaaatcgcgaaataggcacctaaaaaggcagaaaaaatatgtagcatccctattcattactctattatattttaccaaaattgttttgatcttgtctctgttccacccgcaggaatggagtattcatcaataacaatcattctatttttcccgtttgacgcacatttgaacaaactgacaaattattatagaaggtgaccacccgcaagaaagaaaaaaaaagttaagaaaattgttcgagttcgggttcgggattcgaaaaatgaatgttcggcacatatccgacaaatttcagtcctaaacaggcactcacgcgaaaacggccctcacgcgaaaaggccacgcgaaaacgtcctggcccgacaatatttggcaaaatatcgtaattttttcaattcaaaagcttttaaatttaaaaatgttttccttacaaggtgactgaacatttgttctggtcgccattgtttttgctttattatactattaatgcaaatttcattggtttttcgaccataatgttgtgagattttcccaaaaaataatggcctggaaggctttcactccagctttaacaagcgattttcggctcctaatccacctatggcaacgtaatttagataaaaataccaaaacagaaaaaaattaaagatttattagtcgaatcaaagatgaagatgagaaccaacgaaatcggatgataccccatgaacttgatccaactaggcctatatctgaagtatctcgttctaaaaaatatcttgaaaaagaccgtgcaattcgagacttggttgtccgttttgatgagcaagatccaaatgatcgcaatgaacagcattggctacgacatctccacgcaatttcatttcgtctgacaacgaaaggaattgataattagattgaataaacaaaacaatcatattaatctcccgttagcccttgggaaaggcaaatttcatgaatacattttttttgttcacaatcgggccgcaaatgcaaggggcgcaaatgtatggggcgcaaatgtaggggcgcaaatgtaggggcgcaaatgtttggggcgcaaatgtaggggcgcaaatgtaggggcgcaaatgtaggggcgcaaatgtaggggcacaaatgtaggggcgcaaatgtaggggcgcaaatgtaggggggcaaatgtttggggcgcaaatgtaggggcgcaaatgtagcagcaccccttacaaaggaaggtccccaggtgtccgtgggagttccgaatgaagccaaagttttttaatgaataaacaaatggaataattgttgttcggttacgtcgtcacagtggtgcagaggtagtgcgccagtcaccgtttcttaagccccaggttcgattcccctgcatgcaattttttttgctttttatgccaaagtaaattataaaaagttgtttataatacaagactttatttttaatttttttaaattcatactcaataaaaatattagataaaaatatttattttcaaattgacatgatatttagtgtatctattgcatcgcatctttatattaatttattttttaaattttaactcaataaaattaaaaattttacaccattagatgcctgtaatatagcgaaagaattgtttcttttcattaattataaaaagctaaaaagtttggcacgttataactcggcactcgtgcttatttggcagaaaataaaaacatttttcttaagaacccatgggtgctctatcaaccgaccaagtttcattcggaaatcccacggacatctgggcaccttcctttgttagcaaattgatgcattttgatgtttattaaaatccaaaagttaaagctaaattaattaattaatgaaaattttcaaatcaaattttcttcaattatttcaaacaattaaccattttgggctaaatgatcgaacttcaacaattaaaaggctgattcttgtgattagtatccctcaatttgtacggattttctttaaaaattatttaaaaaatgtgtcacttaaaaaagaatatgtaaggactaatattttgtcaataggaaacccatgaataaaaataaaattaaaatatttttgtttctgtagagggatcaaaccatgggaaagaagaagggaaagtcaaggagactagccactaggccatttgcacaattgtcagtgttactttattgttatatttaattattatttctaaattttttcctttcactccaattttctcactaatttttgcactcagaaccccattcttaccagtgcttgtttttcccggttcccctaccgggaccgggaaatatattttcaaaatccgggaaccgggacctcggaggaccgggaattcccgtcccggtcccgctctactctagtatgttcaattaatacacaaaatattattttttaaatacatattaaaagaagtaatccgttcaagaaacattttcatcaaaatcttttcaaaaaaatcccaaaatttcattacccaaacttttgaacaaatcgaaaaatttgccatatttaccctttaatcggaaaaatgctaaatctttgcaggatcctggtccaggaattttgaaattccgttctctgatcgccccacttttgcttctctaatgtccttctgtctgcttaccccatggtatttcagtcgctggatccattccaacggcactttgcgcaccgaaatgtcgtaggttttgcagctgggttggtgaagaaccacgtacgtcttggccgtggtgattgttttgaatgtgtgcggtttgaagccgtggcattgcacctcaacaaagtaaacattctcctcctccttcggaaggggcggctcaatttgaagtaggaaatgtttgcgcagtgaaatttgaaaattctccgcgtttcctttcgattcgcacacaaaataggcaatgggacgacccaagagctgaaatgggacaaaaaaacatttgggcaaaaaaggaaatcgcatta

SEQ ID NO: 2460 - DNA, 999 bp, Heterodera glycines
cccccatttttgtggcggtatttttttacattttaaataatatttattttttaatatttaaaagcattgaaatgcgcttttgggtcaacggagttaaggtcgttcctttcgaagtcagagaatgcaaatcatcactttattgtctcaggagcaattgttcagccggtaaaagcactttcaaatccgtgccgggggaccttccataaaaatcgaggacattggcttttcattaacctgtcacttttctaaattcatttttattaattttgaaacatttagtaaaaaaatgaaaaacataaacataataatactgtaattgaatactgtgcgtttattcgcataccttgtcccgggtcatccgaatccagaatcccaactcgatatttttctcgtcccggaacaacgctgatgccgcgcactttcaaattggccccttacaaattagcctcgaaaaaaaacaataaaatattgaattttattttcatttagcttcaaccaatgaacactactttgttttgggctgcaccttaacgaacaatgaaacaattaacaaggaatggctgattagtgattatatcaagccaaattctagcaccaaagattggaagtgccatttcgaattcggcaaacgcgaccagccaatgccattcccattgcctgaaggtgcaattttgccaaaaactgaaaatactcaaccttggcaataaattacaaaaatttcaaagcttaattaatttaatttaggtataaaaaacggaaaaaaaatattataaaaagataacaattaatttgtgcattttaatttgttttgcattgtttttgagcagaatatctcaatgtaaattaaaaatattctaccaattaagtgaaaaacttttcattttaatttagaaaatccattcattaattaggtaatttgagaatttggttccttattttaaactactttccaaaggccagcaggccttaacaaattaaaaattttcaatttaatccatt

SEQ ID NO: 2461 - DNA, 938 bp, Heterodera glycines
aaataatagagagctcaggaaaaatagataaaaaactaaaaattgcatctccatttatgacttcgccattccacctcctcaaagataaataaatgtttaaaaattacgggaaataaggcggctgggcataagcactggcagtttttcatgcaacaatctattggccaataaaaagtagtgccaaaattaggggcactcgaaaattggctaaattttgaaatttatcacaaaaaaataacatgagagtgtttatcaaacattcaaaatgggactttgataaggagagtctaaggattaagtaaatcattcaaaacgaaaaatacctttgaatatattttatattcataatcaattgggtccgaaatctgccattttccaattgcgcttcaatcgatcatttaaaaaaataatttttattcattttaatttaataaaaatttaattaattaaatttaatgtaatgccaacataaacagtaccttcctatcatacgagcctaattaaagtttaaaaacaaaacaattgcgtgctgaatgagcaaaagtcgcttctaaacgtgcataaattagtgaacgtacggctgaattcactcctttctctctctgttacctttttgcgcacgcgttttgttaattttagaaaaattaattaattgaatctggaccatagcaggaaattaccaataaaactactcaatgagctgaacaattcgagaatttttagttttattaatttagtttttctttttttggcatgccattggaatttctattaaaaaaatttcatttgtttctattgcttcattcataatcaaaatttaaggcttccaattcgctagtggatttcaaatatcgatggatatatccgatggggttgtacctttacaggatttccctatctgtgctcctttgttgccattcgtcccattaaaatgcatt

SEQ ID NO: 2462 - DNA, 1132 bp, Heterodera glycines
aaaaaccgaagattattttttgcggcgatttttcaaaaaaacttttggagaacaagggggccggcggtgccgatagacgccgctgggagaaattttgcgatttttaatacgatttgttaacagatttgtctacaagaatggccaaaaacaacatgccaacttatcaaaataatcaaaatttaaaaaatctgacgaattttccacaaaaacatcaaaaatcttcaaaatttctcaaaagaccacaaaaagcctcaaagcctcattttccaaaaaaaaaacctcattgacctacaaaaaaccacaaaatgaggctaaagtctcacatctgggagccctggggccttatgctcgtctcgcggtttagtaaaccacggttaacgcattaaccacggtttcgttaaccgtggttaacgaccgaccttaaccggtatgctcgtctttaaccatggttaagtaaaccatggttaactcaaccgtggttaagagaatttatcttgaaattgaaaaataattaatattaaaaaaatataattaaattattataataattattttttgtttatattatcaatattagcatagattttattaaaaaaccccgaaaaactattaaatcaagaattggttttctaaaaatttttggccataacttttttaaacacagcaattttttttttaattttgcaaattaatagaggactcttggggctatagaatgataccaagaatgtttaatttggatgcttcaagaaaaagtttgctgcattaaaattgtcaaattatttttttatggccgtgtgaactgcaatggagccaacatttcttggtaatagtgcattacaaacaattacgttgttatgcaacatgctacaaacagcagcaattgagtcggggtcgttttggcgcccacgttttggcgccgacgttttggcgcccacgttttggcgccaaggtcgttttggcgcccacgttttggcgccagggtcaggtttttaaattttgtctatgtttgaataaatgaaaatatgtattcttcagttttctgaatccctaatcacgaatattgtattcatcttgacaattgctaaccccggactcaatttaatggaatacaatttttgaacatattaga

SEQ ID NO: 2463 - DNA, 2977 bp, Heterodera glycines
  misc_feature (2928)..(2928): n is a, c, g, or t
ccagattcaaacagtagttgtacagtgtaaaaaaacggcctgtccctaaattttttcaccttttttaaaagctattttagcggtttgggcgtgtggcaaaatttttgatgaaataacactaatccgtcaataatttatatcatagacaaaaataaaagtcagattctttttctgcatgtaaaattaccctagaaaaaatgtatttatttattttactatttaaattattaaataaatttacgttaaccacaactcgagttgtggttaagattccttaagaaagattaaaccacggttagatgagcataccggttggaaataaaccacggttaacttgcgttaaccgtggttaagaagggagtaaaccacggttaactcaaccgtggtttatccttaaccacggttaaaaagggaaggacgagcataccggttaaggatttttaaccacggttaacgccgttaaccgtggtttagctctaaaccgcgagacgagcataaggcccctgggtaattcgcctgtccacctttgcatttctttctttctctgcctttgaatttttgtgtcttgcgtttgtgcacttttcttttttcttttctctgccgcacaaaaaaaaagagcaaagaaaaaaaaaatgtttttcctttgaattttcgtgggtccgaaacatgaaatgtttgatcctcccttttgtacattacatgcgcattttattgtattaatttgtttgctattgactcggcggaataaaattttcaaatgactataataataaaaaaaaacaatttttattgtattttgaaaagcaaaaatcccaaaatttaccgccatagttttcagatttttttcccactaaaatggtgtcacacatggatgaggaactttcatttgaagatgaggaacaagaacctactccgaacggtgcgccggccggttcagtgtctgtcacaatgtcggaagacaatgtaaaaacattcaaaacttgggacaattcaaatcgcttaaaatgaccaagggggtaccaagttgagaggccagcatttggtctttaaagtcttggtaacaaaaaacgaattcagaaccaaccgattccatggaaaaattgcaaatttttgccattttcaattgcaaaattgtttttttaggattttgacgacatcaatgagaagctgcaacagatgagcaagaggcgcaaaaaattcgtgaaatgcaaaacgaaatggagaagcaattccagtccggcactgccgtgaccggcaccggcagtccggtgataccgaatccgatgtccctggaggagaagcaattggtggacgcacgttccatttacgttggcaatgtatgtaatgggtttgtgagtggcgccccaaaactgaacaattttcatatctttggtacattaaaatttgtcagcaaaattggggttagtccttttgaagccgcactttcaaaaatgtgccgccattaattccgaaaaatcaaattgcatttgtttttctttcatgagtcaaatttgtctaatgggttatgtttagttagacttttggtaatattttcggatgcaaatgaacaccctctaatataaaaggatcgaaaattggtaggacaatttcaaattgaattttcatcacccggaaatcgcttaggaccgacacctgcaaaatttttcatttttttttttttttgctcatttaagtgcgaggttcttttttttgaacagtttatcctattatacgaataaaagtattcttataccatctatcaatcttgtggttttgatgactaaaaaaatgtgtaaaatcttcgaaaaatattcaaaaaattataggtattgcaaaatagcaattgtcccaacaacaatttatacaggtggactacagcgcaacaccggaccaattggaggaacacttccgcggttgcggtgccatcgaacgcgtgaccattctgacagacaaattcactggccatcccaaggggtaattaattgctgttttcttggtccattcactcttaccaagaaagggagaggagattaaagttacatataaacaaaaatttttccatttttttaccgttggatttcgcatttttgcgcttttaagagtcaacaattttcattattcaaaagctcattgtgagatcgaaaattgatacaaaagagttaaaaatgagacctaagacgttcgacaaaatttatcgagttcaaaaaccgggacgcaaaaaaaattttaaaaaagttttaaatttcgggaagtgggggaaccgcgggggttggtaactgattgtgagtcttgaaacatatatcttaaaaacgaagtacatcccattttctaacacattttgctattttctggcttcattcactcttgccaagaagggtatggaagagccatgagttcgcataaaaaaacaagaattcccccacttttcaaccgtttggtttcgctttttgcgactttgaaagttgaaaaagtttcgaattttcgagacctgattatgaggcagagaattgacaccaataatcttaaacgagacatcgcccgtgaaatttctcgagtcaaaacccgaaacgaattttttttttttttgaaaaatttctgaaatttttttttaaattttcggggaagaaaagcggaagggggcgggcgggactgattataataatgagaggggtacattactaattatagcccttttgctaacacattttcatatgtttgccacatttcctccagtttcgcgtacatccaattcgcggacgtggacgcggtgaacacgtccacctcgttgaacgactcgctgttcctgggccgtcagatcaaggtggtgccgaagcgtaccaatgtgcccgggctgtcctccaccaatcggcccccgcgcggcatgcgcggcggccgtggcagcgggcgcgcgcgtgtgattgtcaagtncatttattcggaaaggcgctcgcgcggacgcccgcccaggtggcagaca

SEQ ID NO: 2464 - DNA, 5082 bp, Heterodera glycines
ttcaatcccggggaaaaatcaccagggatttatagcccgtttttttttagaaaaacttaagttttggagtcaaattttcaaaaagaaaatagggtaaatggggccagatggggtgagagttttgaaaattttaatgaaatttgttgagggaatttcatgaaaattttgcccctccttggttacatgggcctaaaggaattgatcagcaggggctttacagtgggcatgatcaacgaaatcgatccatgactcgtcagtgaatttctcgagatgtatcagtcccgggcagcttcttctcgagtgtactatgtgccgggtcgtcttcagagcgagcagatgctctctcccattcaacggattccttggtcgcggacagtcatgacaacgtgctatatccaatcacggcaaattttcgccggttttccaacccctttcggggaaggacaagcacgctgattttgccagtgtagcgcgcgtgcacccccggacatctaagggcatcacaggcctgttattgctcaatttcgtgcggctgagcgccgacactccctctaagaagttgtgcccacagaagcaatgagccagctatttagtaggctagagtctcgctcgttatcggaataagccagacaactcgctccacgcactaagatcggccatgcaccaccatcctccgaatcatgaaaaagctatcaatctgtcaatccttacggtgtccgggccgggtgagtttcgcccgtgttgagtcaaattaatccgcaggctccactcctggtggccctcctttttttcgagaaaatttttttaagaaaatcacaccccccccccctccaaaaaaatcttgaaaaattttttagtgattttttttttcattttttgaaacaaaaaaacttaaattcattatcttaccattagatatagtactgtatcttcattaattgtataattctattcttttaatgtcattttttaaaaacaaatttaattttttatttttctccgtgttaagacggcgcggtggcttctacacgccctactgatgcggagcagaggagggaggagtaggaggaagaagtgtgaaccgcgcgcaccaatcggagcggatgctattgaaaaaaaattgttggacgggcggatggatggattgatcttttcttttttgcttaaatttatttggttgtttttaaattggaagccgtttttttcgcttgtcccgccaatttgatttgccataaaagtgaattttattagaaaaaaaattaaaaaaaaaaatttatggcacaatttgctggacaaccgatggcattttgatcgatttccgcctgtgttctctctctgttctgtttttgcgaaacttcgtccatggcattcattatttactacacatacacacacactaagccggagaagataaaaaaaaagtggcaaattgttggaaaaaaaataaagaaaaaaagtaaatgaaaagaaaataaaaagagaaaaaaaaataaagaaaaaaaaattgtttatttatttgttgcaataacaatttgattctcttctttttacttaacgataaaattttacatttattatgtgaacttatttctgttttgggttttggagtttatataatatttttttgccatatttgctaaaacaaaggcccagaaatatttaggtcaaactaatcattaggaaagtagtcaggctttgtttcttaatcgcaaaaacaaaaatattctaagggcgtgggggtccaaccttattagcagggatgggaattatatggatattaaatcgcaaaatatttccataaaatatgcaccaaaaatcgcgaatggacataaattttccgaatagagggtgtaatttcttcaaattcattaaatttagtaaaataggtacaaagtttgcggaatacagaattaaaatttgtttagaataacttttcgatttatggttgggtttttttattcaaagaaaccacttaaaatgacacatacatatgattatggaatacaacaaaataacacgcaggatcattcacttctgaacataacatttacgctgaccatttgggtcgcttggatcagcagaagtgccatcgataagactaaaaccaaaaaaatgggaaatttcaatggcaatctttcgttcattggtcggtcccgaatttttttttcaaataaaattctggacacacattgttaaggctaatttgagccgcgagtacgaatatgaccaccttttcgaccaatttcgaactcgaacatttaaaaaaaaaatttaaatttcatcaaataagtacgcctggatgtccggacaacgcgccaattgttgcccagttatttggacgaagatatatggcgatagttcaacggaaaaaaaagttgtcagtgcttattgctaggcgtgcatatgtaagcatttttggattgaaatttttgaattttttaaatgttcgaattcgggactcgaaattggtcaaaaaggtggtcagattcgtactcagcagctcaaaatagccttagaatgcgtttccataattttgtttaaaaagaaaattcggagccaatgaaccgaaagattgccaatttcaagctgaccattctccggtttcttcctcaacaattgcaatttcaattatgttccattggtcccaaaatctcaactcaagcgcttccttctcccaatttgtccatttgttctcatctcgtgaaatcggacaacgaatcaacaaataatgtctgtacttgtttttggcagtattcagcgtcaatcgctccccagtcaattcattggtcaaattaaacggcacattgaaagcatcaatagcagacgaataggcaatgccaatgatgaaattaacaggagatgaagcagtggaaaatgcctaaaaaaagtgaaaaaaaaacattgtgaatcccaaaatgagctggttttaattaccgctattagtccattgatttttgtcgaccattgctcctcatcaaattcaaatgagcacttgagcaccttcggcacagcgtccggacgaggcaaaaaaagccatttggccaacgcttggccatccgacgcatcggcacaatcatcgggcggaaatttgaggtaaacgccgagataggaaaagatgtctcgtaattgggaaatatgcccccaaatttgactcaaactttggacggcaaaatcacgagaatttattgtcactgagtaaaaatgggaaaaaggtgtgagcgataaaaattcatgaagtcagcagcaaaaaaccaaggaatggcgaaaagcgatcgccgcacgacatcatcccaacgaacggggcggggcggggggatattaatataccacacgaagtgatcattggaagcgggggagagcgtgcgaaaatccggccaagctgatggctggtgattgtggcaaaagaacaatactgggaaattgtgaaatgtttggttgaggaaaaatttgggaatgggaggggggattcatgggataactttcgcaaattgcgacactccgcgcggcggaggacttcgggggagaatcgaatctgatcgagtttaatggcactggacttccttcgatttgtcgcgcgattttcttccatccggttcgctgagtgctcattggaaagtgctgcaattggccatgcgatccgactctggtacgagagatgatgcgaggacgacgaggacgagcacggcgagcaattgtgggagaatgaaagggggggggcgccggacttttcgacagcggacctttcgacagaaggacttttcgacagcggacttttcgacagtaaaggacttttcgacagaaaaaatttttgtttaaggggaggacttttcgacagtggacttttcgacagtaaatggtagttttaaaaaagacaatgctatttcatttagtaagcaaaataattatttttgtttcgaattatttccgtttttatggaaaagttaaattgggtccggcattcgataggccacagctcttaaatattggtagggatggcgctgttcacgtgtgttgtaaagcgcgagcaaattttcgtcttgttcaacataaatttgccaagctgaactgacatgcactctcccagggcaatacggggggcgattgatacagcgccaaaattcgatccctaatttggggtttggacaaaaaattccaagttttgcaccttcttgaagtccgctgtccgcttcaaaggcatattcaaaaccgccgcttctgattaactctcggccacgcttgctttctgcttgaaaaaattggacaagaccagctggttcctctgcttcttcaaaggcttcatttgcaaagagttcggccccaatttcaccttcttcgggaccactagaaccagaagacatttttcacagcaattcaaaaatattttcagtaatagttatgaatggcatggtcactcttttttgggccggtcgagaaacggaggtcaaacaaataaattatttattattgataagaaaaccattcatgagaactccaaaaatgcagtgcaataaactaaaatgccttcttaaaccccgctaaattaagatattttataaaccagtaatttataaaaatatattttttaattaaaaattcttatttcacaaataataaaataaaaaaacaagattaattattagaaattatttgtttttaatgaaaaatttgatttgttagtgtactgtcgaaaagtccttcactgtcgaaaagtcctttacagtcgaaaagtccttctgtcgaaaggtccgctgtcgaaaagtccttcactgtcgaaaagtcctttacagtcgaaaagtccgctgtcgaaaagtccttctgtcgaaaggtccgctgtcgaaaagtccttcactgtcgaaaagtcctttacagtcgaaaagtccttctgtcgaaaggtccgctgtcgaaaagtccttcactgtcgaaaagtcctttacagtcgaaaagtccgctgtcgaaaagtccttctgtcgaaaggtccgctgtcgaaaagtccttcactgtcgaaaagtcctttacagtcgaaaagtccgctgtcgaaaagtccttctgtcgaaaggtccgctgtcgaaaagtcctagcgcc

SEQ ID NO: 2465 - DNA, 2946 bp, Heterodera glycines
  misc_feature (2718)..(2718): n is a, c, g, or t
tagagatcggaccggtcggttttttttcggtttcggtttttgaccgaaaaaaccgaccgggagaaatttttgactttttcggtttttttcgggtttttaaccgaaaccgaccgaccgaaataatcaaaaaaccgaaacaaccgaccgacttttatgaaaaaccgaaaaaaaccgaatcaaattggagcgatataacctgttaataataataaatttattgcttttttgtgctctttttcattttgaagaattttttgtaaaatattttctgctattttgaaaaaaattattaacaaaaatgcaataaaaacgaaaaatacacccctgagaaatggaaaattttatcaaacaaaattctcttaacaaattatactcattttcaaaaattttcccgacggcgcctatcggcaccgccggacacccccctccccaaccccaagttttcaaaaagtttttgaaaagccgtcgtaacacacagaaaggcttcggcggtgaattggcgagaagaagcaattaccgcacacacaattagccaaatggggatggagaattgtatcccgaatccaaaatccaaacaatttacttttacaattaaagtccgaggcagcaaattaaattcacagcagaaaacaaaaacgaataatatcataaaacaaaaaccgaatggaatgagaagggaatgacgtggctgctggtcagcagcagaaacacaatcgatattacagtaatatagaattggcgggaaatacaaattcaaagcaaagggagatgaaaaattgagaaggaaacaaccaaattaaataagtcaaaaatgggaaataaataaattaattatataagcacatcttcgccctttgaaaagcgatgtccacagagcttgcttggcgaatcgggagtgcaattggcttcacgaaaggcgatggcgaggtcaagatcaacggcgatcagctccaaaacgagaacgactcggaaaggactgcgcgaactgacggcgatacgggtggtgctggtgaacatgctgagctccacgcgaccctgactggttgaactgtccacgtcctcttccaattctgcttgtccctccatttggcccctcttcactcttctttttcggttctgactcttcttttttgtcctcctttggcatccctttgatttgggacatgacccaggccctcaaaaccaataagcccttttccgtcattttgccatcgtttgacacatggtcggtattgaaaccggagccatagcgccacagttccagcactgatcgtcccgccggcgttgtcgttttacaaatttgacattgccttgtgccgtcccaaaatgttccttcattcgtatgatcagttcttcgtattcaatcattttctctttgatgaaaggaggtcgcagccaaaacacaggggcatggctaaagcgcttcaacagctgttcgagtcgccccacacgttccagcacattttcgatcgtttcttcacctctgatcgaatctcttccgatcatcacaatgacggccttcacttttgatgatagaattgcgccataaaaagctctgatcacttcggtgattgtgccttcttcagtgccaatgaattgggattttggccacatttttaacaattgtttggccgatgagtcgcctacgatgactcttggcttctcgacgaacaatggcttgcggtggatcgtcgttgcgcgtacttttcctagtacgaagctggccttctttagcacctcgttccatccgagtttttccgattccggcaattcggcaacgacatttggcattggcacttcgatcggagtgtagccagtcttcagcaatttgtcccttgtcactgcgcatctttcgacccacgccgtaaaggcactttcgatgtcattttccgttgggaaattgccgattttcacttggtcttcgcgtgcgccggagtaagtgatcagttcaaagccaaccggagcactgacgatcagctgtgtcaatttccgaccgccggcgactgatgaaacggcattcgattttagcaagaaattgctaagaagggctttcattggggtgccgatcaccttaaaatcgccacattcatccccattttggatctttttccattttctgatcactttgaggccaagaccggctctttcaagcactgggtcgaggtcggctgctgtcatttgtacgcagtttcggtgttcgatgccgagtccaccgcattgcgtgtcccaaagcaaaggcccgcagctgttttccgtctccatcacttttccaccaactgaatttgcaattgtcctcaattgcccaattaaatgacggcccaagtgttccaatttttgagaattgcccaaatttgtggtttcattttcggtttcccgatctttgatcttttccatggccgcactttttccacacggttcattttccatttcgcgactgatcaaacacacgacacttatcagcgcatttaactgatttttgaaggggtttttaccccggggaagtgtactaatgtttggtacaccttcaggcacttttacaaggcgttctattgggacctttataggctcaaaattcggtttatcgattggtatgactgacgctgtcgaatcagtgagatccaaaattttaaatgggccaaagtgattccaaagaagtttccggtgagctgaacgggtattaactcccggataaatgaccattgctaaaaatcgatatanttggtgggagaaaagcctgcagagatgaagacagaaaagaaggatttctatatccatatttttccatatttcgcgatttatgtccatatttccatattttggcattttggtccatattttatgtccatattttggcatttttcaaaaaaccctctattagaaacgcccccagcagctaaattagcctttttgagcccaaacccgaaaaattttcaaaaaatcattttt

SEQ ID NO: 2466 - DNA, 6063 bp, Heterodera glycines
acctatgattcccttcccccagactcattccaaaatcttttaatgtctgataatggtccccacccttcatttaacacacttacattctctgaccaagtccaacaacccgttactgcctcaccatctcaaatcaaagaacagctcgtgtgctctggctcagctgataagcaaccaaatctcacggatgctttaaaatccgaaccaaagcctgtttcccccactcctattgtcacaaattgggaaccacacccgcgcagctcaaatttttcaatagctccctttctaactcgttttaattttatcttgtgtatcattactctttctctaagtgcttctttggtatcatcctctcacagtcaatcatccttaaaagtcctccctatggtttgtcagacacacgttgagggcacaatttggtctcttcccatttggctaccatgtccaaaattaaagcatactccttctgacaccccgatcaaacaacctattcgccttttccgaccgaacccattcgaacaaaaatccaaggcatgggtgtgcaggaaggtaaagaaatccctgattgagtacaccaatccatggaatgatgtaatcattaagcaactcccgtccgaaaatctcccagtattattagatgaatgtaagcaaatggttcaggaaaagtcatgttccgaagggattctaatccaaagtggggagctccttttctccaataatccaatcagctatgaaaaacggtatcccttccttggctggtcctggaaagcacacaattccacaaattgtttcgcttttcaaactgagatttttgtgcatcattccgaagatcatatcagaacatctctaggacacccaaattgtaaatatacagcagggaattgccgcctcgacgataattccatcctcatgtggattccctctcccaagaaactctgtcaattcattaacctcggaaaatttttaggaacttttctgtccaacatttgggttgcagaagaaaatgatcttgctctttcctttccccaaaccaaaactttgatcgaggactgtaatcaaactctctctctctcatatcaaaattttgccgttcaatttcttcccacggatcaacctcgttcaaagagaagtgctgacagtcttgtcaccacatctcaattagcttctcaactcacttttcttgaccatgaagttaagacttctctcatttttcaattttcccattccctcacccagctatgtaactttattgatgaaaataaacactggacctcttctgccctcctctcaaatccaactgctctagcacgcagtattttctcaaatccctacctttttgccaaacaattaacaattgactcaatcaaaatatggccctgcgtaccaataaacagctctagctaccaatttaaggcaactgagcttcaaacttgttttgatcttctcccaatccaattttccactaattctggcccaaaatcagcatttttaaaccccatttcaatgattgtcactccagaggcccgaactgctccctgctctgagtaccgcaacattcccattcttatcaacggctccctagtccaagtggaccaaattactgggtccgtcactcctctcaaagttaacaatcttccactagaatctaattcattgtttgaaattcccaaaatcaaaactcatgcatttcatcacttagcacttaccaatttgtctgacattatttcccattctttcgcagcaaatattttccaggttagtaaacttacttacctgattgaatttgatgactccaaagtgaagggagtcctctcctctgactggaaagaagttagagatgaaatggtcaaacaaataactggagattggtcccaattaagggattggtttattctaattatttgtgccctctctgcctgtgatattcttattcgtatccttgcacttgttttggaaaagtattttaacaatctttccttattacaaaccttctttggtcttacaacaaataacacaaatcaatcacgccctccgcctccccctcctcctccttccccttccaatacgtgctctgtgcaatcacccaatttttcgaatcatcatgttgttcttgaattaggtgaaacatctgaaggaaacccaacccaatggcctccctcaattacccgcttttctctccttcccaaatttgagtcaaataattcccctaggcttctcaatgctatgtttccattaaattccaaatcctttgtcacaacaattcccgcccacgcagatacaattcctctcattgcattaattgactctgctgcctcttcttccattgctccgattaaacttaaggacaaattcatctgtcaaaatcttaactcatcggaagtttctatcactactgccgttgggatcccaatacctgtcacgggctcagtcccgttctccttacacatggcaaatatgctgtgcagtgcacatgttcatttcgctcccgattatttggatatttgggatatttgtgatatcattatagggactgaaactcttgaaagattcccaccaattctcttcgattttcataataaattcctaacctttggctatggtcctcctactcttttccaatcaaaatcacaaaacatttctgactgtcaatcttccccttcaaagaaccttctcatctatcaaaacaaagttcattttcatccacatattccttctcaaatcaattcctcaatttctccgtgcatactttcacaaacttgtgaaaactctcaacatttcaacgttccacctccatccagtaatttttgggctgatattaaccctccctcttcattatgccattactgcaaaaaggacaaacatcatataacggaatgtccctttgttcccaaactctcaaaaccaaccatattcagaaattcttataaaaagtccattatgcctacccttcttcttcttatagcgctattcccctctgtacatgcttcattatccaacgaaaatgttaacaattttgaacagtattctcccatatctttcattagcatttcatttatattcactctcatggtcatttcaattataattattctgttcatctatccattacaaatattttttcctcctggaacatcatttcgtagctttaaaaaacaagtaactcaaagccctcctttcccagtcatccaacttaaagtcaactctgttttaattaactgcaaaattgacctaaaatctgacatctcatttactcatgtccgaatggcatgttatcaaaagtccaaattttactccttccccaaacccctatgtgttggtgtgtctttccttccattgcaaactatcggcgaaatttcaactaacattgaaatagcgtctcaaactcactccttaaaattactcatcacagaagaagactcatgggtctcggaaaataactttgatgttgtattgggttctgactttctttccaaattcccagcaatcttatttgatcctcttctttttaacatacaaatcggtgaccataattatcccatgatctcgtccaaccgagattatattttcacacaatataacccacataaaccgaaacttgacgcaataatctctgcctccctcaattccgttgagctccgctctcttgtagacacgggagcaacgctcacagctgcccctatctcccttgctgagacaattgggtgctctcctagaaaaaccaatcttcgagctataagcgcctcgggtcaccaaatccccataattgcacaagccgaggccttcttgtctattggtaccataaaagaaaaagttttaataaattttgttgatgattctcgcttcatcagacccgactatgccctcattattggttgtgattctcttgcctgtcttcctcctgtaactttcaactttcagaatctcactctttcccttgccaacatttcagtccctatgggaaaattttccaaactccaatcgaatattccaatttttgccttacgttctataacattagcccctggctcgcaaacaattgtccccataaaaattacaactctcccaaaaatacgttttgcagtaattgactcattaaataacagactcaccagagatgacttgggctggaacccaactcttatcgaacccattaatggcatttctgccatcccaatttccaatccctcacaatccccaaaaactatttttgctaatatgacaatagccacagctaatgaggtgagtgaagaccctgacttacatttcttttatgaggacccagaccatgctctcttcagtatttccccccaaagtgatgaaggtataatccctgacccctcattcaaaattgacttttctaaatcttccgttagtggacctgatcttcaaaatctcaaaaatttatgtgaagagttctctgacattttcagcaaatctcaatatgatctggggtccagcacagctggagcccatgaaattgtcacctcaacgcaggaacctattacctgtaagccacatagaacccctttcaaatatcgggatgagctcaaaaagcacatagaacaactccttaagtctggtgtcatggtccaatctgacactccgtgggtgtctaacatcgttcttgtccagaagaaagatggtggactctgtccatgcattgatttccggaagctcaatgaaataactatccctgaccattatctccttccccgtctcgacacaattatggagaaaattggccactgccatttttactcttctcttgacctttcttccggttatttccaaatccccctcacaaaagaagcctcacgaaaatgtggactaatcatagaagaaggtgttttccaaatgacacatctcccttttggtcttagaaatgccacttctgcttttgccagaaccatggcccatgtcctctccggacttgatgggtttgtcgttgcctacgtggatgacattcttgtcttcaccaaacccccctcattttctgaccatctctccgcccttcaaaccatttttgaaagatttcaacgattcaatctaaaactctctcccaaaaaatgtacttttgctgcctcttccatgaactttcttggtcatactgtctcatcaaaaggttactccccatcactctcacgcatcgaagtgatcaaaaatattcccactccccaaaatctaaaacaagtaaaacgaattgttggcatggccagcttttatcgtcgtcacattcccaatttttcaactattgttgagcccttaacttctctcaccaaaaaagaaaagaaatttatttgggacaaggcacaagaagatgctttgaccagaattaaggaacttctctctcaaaatcccattctcacttttccggattattctcaaccttttcacattttcactgacgcatcagtcattggtcaaggcgctgctctcatgcaaaagaaaaatgatctattttctgctgtagcatatgcctctcgcactctatcagcccccgaacgtcggtggccccctgtccaaatcgaactcggagctattgtctatgccctcagaactttcaaaccatatatttatatgtctgaaattgagctccacactgaccaccgtcctttggcatacctccaagcaaaggcacaacaacatgcccacctggcccgttggctaatagaactccaaaattttaacattaaaattgttcatatttccggtaagaaaaacgcacttgctgatgctctttctagactttccgaatctgatcctcctcagattccaagtgactctcaagagttacaagacatcattgaatttcctgtatgtctctctcttgtcccttttgatcgcattgtccataactttgacccaattctatcttcccttactattcgtaccaaggatggtattcctcataaagtagaccttttttcagaacaaagaaatgacccccaagttctttctcacattaaatttttagtagatggttctcatccagatctctctgaaactgatttacaaaaaatttctttcagaatcaaaaacatttagttatctcttccgacatactat

SEQ ID NO: 2467 - DNA, 2078 bp, Heterodera glycines
  misc_feature (5)..(5): n is a, c, g, or t
tcccnttccgtccatctaccactccctcacaatgacttagctgagttcaaaaccctccttgtcctttccctaagaaaagcctggaattctgcagctgactcaattaaataggctcaaaataaatcaaaagtgcaatatgataagaaatttaggaatcctaacatttccattggagaccgtgttctgttacggaattatactggaaaaccgggcacttcccaaaaatttcacaatccatggaagggcgttttcagagttattaacatagaagaactccatgtcaccatcgtcagttgttcctccccacaatccaacccatttaaagtccatattaatcaaccgaagaaactttttgagatttccggtcctcccagcacctcccccgtcctctcttcgctgaaaaagctgctttagaagcagctgaagccaccgagataccaaacacaataggcttcaatcatattcctgatatttcacaaaaaaccctccctcttgatacccagaaattcgatgagccccaaattttacctacttcaattgacaaagaacaagccgttttccctcagcgggatctcttgcataaaagtaaatacaatctccgctctcgcacaaggtctaacagttctaaacaataacaaatagcacttttctccttacccatttttatactcacaattaatttttaacttctcacaccactttttacaacatttttcccctttttgttttcattccttcacaccgccttgcacccaaaatttttatgattaattctcgtttccctcccttccccaacagaatgatccccttcctgtccaacatccccgaacacaaatacctctccaacttctaacccgccctcttcttctaccctccctcctcctgtcacttcctttcgtcagaacaatgttaccaatccacaaaagcaacattcttccaaagatacgacatagacaccgaaatcctgaaagccacctccccagtcgtagcaaaacgactcggggctcgtgcccaaaatgaagctgaccccgcagcagtaaaagtgtggcacagaacgaagcagtcaaagatggaagagattctcttccacaagttcgaccagaaccccgccatggcagagtgcctcatttcaactggggagaaatttttggtgaagcgagtcactctgaccgattctggggcgctggtgccaccattgacgacattcgtcaatggaactttactgggcgaaacaccatgggccaactgctaatggaacttcgtgaaaaattaaaaggttttaggattcctcattccccagcgtcccttctcaaataaacatcataagtctcacacctttattcccccccatcttcctctttcccttccaaaattatcgacccctcctttgcactccaagttctccttaaatgctttgttttgtttgttttattaacaatgctttaccatacttccacattgctgtgttgttttctaatctcgtttttgtcctctcctcgaatatctcttcactgccacattaagtatgccgaaacgacaatcgaaatcctggattccgaagacgaaatgccccagactccttccgacaactcctcttgaagaatcgctccaagctctgacaactaatgctgattcaaccatcactccggcagcatctcctactgaacctgctgactcttttgatcctctctcacattctgttgtcccttcatctcctctatcctctatggagactcttttggcccttatccggtttcttctccttctgaaaatcagaatttgtccaacaatagtccggctccttccccaccacgaactgaaaatcaacccatgtcttcttccttggacccggatataatctttttggaagaaatctcacccccccccccaaaatctaagaaaatgctccccttgccaaagtcaaatttgaaaatgttaatcccttaaattgggatgaaattatggaagctgctaacaccatctctgattctcccatccctagcccaaaatataatgtttctcatgccccatttccccatgcccaatctcagcagtttcaggaaacttttgaccaaatc

SEQ ID NO: 2468 - DNA, 2369 bp, Heterodera glycines
tctaaaagccttccataaagcatcatcaatccccaacttccttgctgtcaatatccccttcatctcgtccaaggaattgccgttgggcataaaattttcaaaacatctcagggtaaaaacataatttttaccctggtgaccggataaggacttattacccccaattttattccgacaccccatctcaatcatcccctcataaaaggtgtgagacttaatatttatgtcaaacaaattgccctggggacccaaatttctgagttttacacctttccccaaaactttccaacaaacaaccttccagcatcgtcaggtgacaacaacttcgccatttcgatggactccacatcaccgcccaggtacatctttcctttcaatccctccctcacaaaaaatgacaatattaactctcttaaagccatttccgtagccttaaaagcacaggctcattttttgtcctcttcacaccaaaccacctctgtttatacaaaattaaaattggtccctcataatccaaaaaatgaagagatctgctcatccgtcaatccctcaaacccttcctgttcctcttctaatgcctcccaaacgattcgaatccaaaaagtatttccatatttcttcacccactctctctcttcattatctgaattcataaagtttaacaatacctggaaacccgactccctcctgattggttccgtcaacaaaaacatttgtgcccaaggcaccgttaaaaacgttaaacttactgaccctcataacttttctgttgaaatcacagttaatttatccgagacagaaggtcacagctttgatttggaggacctaatcctcttggagatccctatgtcccagactcaattgaaaaataggtctgccttcttttcctcctccattcccctcgctactgcttccaatgaaagccctcaaggacaaattctctcccaaatccttggtttatccactctcccaaaaattctcccctcctctgatctgtcattttcctcattctcccaaaaactctttccgagacccaatcagggacaacttgaaaccctggacctccttttcaacccctcccccagtgcaatcatcaccgaagccggaccaggcactggaaaatccaaaattatcattatgtccatccaaaaattcttagaattagggaaaaacatccttatcaccacccacagcatgtagccatctgtcgtttagcttagaccataattcaaaaggccttctcatcctctctgcctccgcaaaagaaaagtattttcccctttttgagccttttatgaaaaatcttttaataaaaactttagctgactttaatttgcaaaaattaacccgaaaagaagccaaaatcattaataaatataaaatgaatgctctaaaaaaaccacaaaaagcagatgaacgttcttctgcagaaatctttatcagagacgttgggactgaaattcccatcatctttatcaccctcagtatgttagaagatattccctccatgctaagtcttataaatatcatattcattgacgaggcaggtcaggcacctaccaatcagattcttcacattctctccctggccccaaatttagaaaaaatccttgctgctggtgatccaaaacagctacaagtttgctgctctgagcttcctgaggaattgctccaatacggatttaattcctttctttctcatttaatttccattcctaacattcccaacacaaaactcacaatttcctaccgaggacacccaattctcacccagtgtcttgctgattctctttatcatggagatattgttgccagagtaacggccgaacaacgctccatgattacctcttccaattttcccttacccaatcaaaatgcccctcttcttctcgttgatcttccaaatcctgattatagagaattaacctctttttcacgtttaaactctgcccaaacccacattgcccactcaactctttctcttttctctctcattttacctccatctgcctcaattacttgtctttgtctgtattcggcacaggcaaagctttcaaaactcttccgcccttaaaaaacgtcactattttgacggttgattccttccaagcccaagaatcagatgccattgtccttatcaccacccgatccctccccatcactccctacgagatgagcagatccctatattttttaaaagaccccaacatagtttcggtcgctgtttcccgggccagacattttttgtttaattggaaattttggtaccctaaaagcatgtaagtcctggtctaactatttaaactcggcttcttctttctcccctataatcggtcagcattatatttttaataaaattgaccccctaa

SEQ ID NO: 2469 - DNA, 1033 bp, Heterodera glycines
tggccaaaaagaagaaaagaccaggaacggtcttctggtcggccgggaggtgttaattttcgctcagaaacatttggaactcggatcgttttcatctcttattaatttcacatttaattcacatttccgccgtcacccattccacatttcaattcacaaccattttccatttttaagtaaataaatcgatcagaccgattggataatggagaagtcaaagaaaaggatatggaaatataaagagcggagaataatttaaggggaattgggcaattaaaatggaatgggaaattgggaaaaatcacatcccgggtcagggaaaatcctttttcgaggaacccaaaatttgggaagaattccatttatttttcgggcgcggcacacaacttccctttctttaacgagaaaagattaataatacaataatattaataaacaaatgaaaattttaattttaaattggaattatattttattaacagccacatcaatgataaattaaaaaacctattaaatatgaatattaattaacattatcataaatttacgaagggaaaatataataatttaaattatcaaacctttgcaaaaattaagaagaatttatcggaaaaaatcgttataaaaataaaaaagatcgaataaataattagaatttaaaaaagctaagagaaattttaatttatgatttttaaaatattaaattgcttcaataatgacaaaagcgtatttcttttcaacatacttgacaacttgacataattggaaatggcgatcaaggatattgttatattaaaatgtggaactgatttatccaaataccacaaaatagttgaaatttaaatgaaaataaattatatataacgaagacaatttcaacaagttacaaaaatattttattttaaaaattcgaatataaaaattaagaataaaattaaaaataaaactatcaatgcttgagtgtatggtctataaattttgatacttgtaagtatttgcattttaatgtatttattttggaaattaaaaataa

SEQ ID NO: 2470 - DNA, 4626 bp, Heterodera glycines
gaacaaaaaataaataaaaataagctaacgtggaatgttctcgaacctgcgcccattttctcgtttatttcttacaaaatcaacttacccacatttaacaagtcttttaggtaccgattctcattttcaagacttcaaacaaaaaatatataaatttatatttttaaaatctaagtttggtgccgcattttcagggagccatgtatcactcgaaagcttaagtgcttagaatatatttctgatttgtaggtgataaatagggtcgctacttttagtgacgaaaaatatcgaaatagttaactaaaatagtgagtaaaaatgccaaaatagtggcaaaaaatccgaaatagtgacatattttcagccaaaattttgtcaagagaaaaaaatttgggggaagattttttaagaaaattttccaattctcagtggtattttttgaaaaatttttaagtcgattcttaggagtgtattttttgggtttattgcatttttgttaaggaattttccaaaaatttcgaaatagtgaaaaaaagaaatgcgtttttgagctcttttcttcaaaacaatcgagcaagaaaaaagaagttaaataactaaaagtagcgaccctagtgataaagcagcacacaaaaaaagttatctcttaaaaccgcaaaaaatgtagaattttcgaagttttttgttcactatctttcgttacagttcgacaatttagttcgttagcttagcccttaagtttctctctattttaatgaaaattttcaaaaaatgagaccaattaaaaaaaattatggacgagaatcgtaaaaaaattttcatccatattattcaaaacataatcaaattttatgggctattaaatgacaccaaaaaattataattttgtcaactttttcaaaagttatgacgattttttgtcgaaaataacgtacgcagtgtatgtttttatgtgcattttacaatacatatttattttaacatttttttctcatctttttcgggtgtctcttcttcttctgacttctctgctgaccagagctggccgtgatcacgggaatcacggggtttttggtgtgccgtgatctcggatcacggattttttctatttttccgtgattttcatccgtaattggcattttatataggggaatttttattgagacgaaaatatgaaattgatgggaaaagagaaaatttttgagaaaaaaattaaataaataaatcatttctgttaaaaattaagacatgtatatgtagcttaatggttaagccttctgtctttcgttatttatcccttgagttcaattccacattggtacagtaggcttttttcatattttctttaaattactttaattgaaattaaattaaaagaaaattttcttacattaaaaatattttctttattttttaaaacattagctccataaattaacaaatgattgtacattttttggacaaatctgttaacaaattcattcaaaatttttcctggcggcgcctatcggcaccaccggaccgccattttacataattttctgaaatttggaccacaaaatggcaaaaaatagcccctttttggcgcaaaaacggctaaaaatccctattttttctctccgtcgatgataatgttggtccaaaagacttttgttcaacatcaaaaattagcttatttgttaaaagaatttttttttctatataaaatagagttttgattaaatttaagaaaagtttgaaaaattttcttaggaaatttacttaaaaattaaaatttttccttagagatttctataaattgctctaatttcctcaaaaaattggctcaatattgtaaattttgacatttttggacaaaatctgcggcaaatcgcattaaaaattacaaattttttcccggcggcacctattggcgccattgttccctgtactcgaaaaattttttggaaaaaacacgccgtaaagaagcggtttatatggtttgttttctttaaaatatattttgtttatttttccagcgattaaattcccgttttttattaataaattgaaattaaaaaaatcattcagaaaactttttacaatcacggctcacggatcacgggaatcacggggtttttggggtgtcatgatcacggatcacgggaatcacggggtttttggggtgtcgtgatcacggttcacggctcacggatttttttgaaagccccgtgatcacggctcacggatttgcgtgattggaaactcaatcagggccagctctgctgctgacacattcctccgtcttttttaattccaatctacagtactaccttatcgtaccaacccatcaagtttgttgacaatatttgtactttaaagcatttaaattcgaattgaaaaacgtacaaaatgttattaaaaatcatttgaaaaaaacaagaaattgtttctaataaatcgttgcttttttaaagataaatatatatatatatatatatatatatattcaatttgcaaattaataaaactaatcaaatgaaaaagcatcgaatttagcaaattttgcacttttcctcgtttttacaaagcatcttattcaagacccaaattcccttgtgggaaaatcaaaaacatttaattaaaaggcattggaacaggtgtccttatttctaagattttgtacttattttgagggtcctgaaaaagtgcaaatgcagtgagagcgaaacaatttgaaaaaatgaagagacggcattcgaaagtccgaagaccgaatccaactatcttgatatcatgacgaaatgagaacaattggggccaagtgggagaagaaagccaaagagtgggacttcgatgagtaatttattttgctttccatttgtgtgtatattttttgatcagaagattttttaaattttgatgcattttacttttctaaaagcgcaaataatttttatcttcttttaacaacaaaaagaatatttaaaattggtttatcatttgctaaaaaatgattaagaaaaggtgccattttaggcgttccattttgtcattcgttatattattgattaagcaccacaaaagaaggggataattagccccgggctatgccccgtaattgcccactgcagtggagttaattattctggttaattaacttttaactttacataacataatatatagattgaacaattccgtttttacatacacatattcctttagatttattatattttttgaaattttcctaattttttggccataaaatgtcggaaagtccaaaaaagtgggaaaacaaatggaaaaagcaatgtaaattttgatagaatcaattttcaattaattcattaattccgcgttcgtttagcttcatcactggcgacaattggctttcggtgttccatttggtccccccttttcagctgggccttggcattgcgttgctcagtcaccggtttgaccgattggtggacgaacacttcaaatcgcggcgttgggcgttggacgaaattggaattcgtcgcacatatgaaaaggatggccaaataaaagatgagatgacaattaccaattcaaaattggatccgtcggcaattgagacaaatgtgtccatcttttgcctaaggtgccggaaatggttgacattctatcagagagttcggcacttacagatggaaacaatcggcgccaattccgcaaaagccggtgccgcacaaagtcatcgcattcaaaagcatttgcataaagtagagccgaacagcaaaagggaatgggaattaatgggttgaaagccggccataattcataactcccaaacagtttgaattggcttttgtttcagattcatggaccataatgtcatcaattttctccgtctttttcaacgacttttcacttcttgtggccaattgtccgtcttcgttagcttgagtcgaaaattggagttcacttttcacgaaatttggccaatgatcagtgccaacatttttgcaattcatttgttgtgcccaatgcgcgattgtcgtcaggtggcaccgtcctttctcaaagattgtccatcgcttcgattgatcgcatactcacgtatggctgtcggatcggatagggcttataaaattcattgactgggatcgcctccccaaaaaagagaaaatcctatccaaaatttggttttcgtgcccttaatgcttataaatgtatttgatttcccgacaagggaatttgggtgttgaatagtactgtacgatgatgaatccatgaaagcgaaaatcccaatcaaagcttttcgtgcctctctttatttcaaatactattttaattaaatgtttttgattttccctttttcggcttttgcctccgcttcttcgcccgtctgcttcatcatcgtcttccgctttttacgtccgttcattaataagacatctctgttttacgttacgttggaagatgtgtccgttttggcctttgatctgatcaatgatcggaccggggagcgattgacgatgaaacaggtggacaatttgcacttgctgatcgtccgttctccgattgggcgcgatgagagcaaatgggccaaatgggagaaggaggccaccgagtgggacttcgatgagcagtggaaccagattatgatttcctatt

SEQ ID NO: 2471 - DNA, 4759 bp, Heterodera glycines
atcccaatcaaagcttttcgtgcccctctttatttcaaacacttttttaattaaatgtttttgattttcccattttcggcttttgcctccgcttcttcgcccgtctgcttcatcatcgtcttccgctttttacgtccgttctttaataagacgacatctctgttttacgttacgttggaagatgtgtccgttttggcctttgatctgatcaatgatcggaccggggagcgattgacgatgaaacagatggacaatttgcacttgctgatcgtccgttctccgattgggcgcgatgagagcaaatgggccaaatgggagaaggaggccaccgagtgggacttcgatgaacagtggaaccgaattattttttcctattggtaggaaaactataaccccttttttattttattttgcggcgaatttggcattttccaccattaataattgtaccaattaatgtttaatccccatcatttgcccaacttgcattttgcctttgtaataattatttgtgcccttttataatttgttcttttatttttttcaaaaaaatatatcaaaaagcatatgcatgttaactaaggcaaatacgttctcaatttttgaatttagcactctaaaaaattaaattaagatgcaaaaattgaaataaacccaaaaaatgcaagttcaaaatctgttacaaaatttattttctaaaattaacttttcgaaaaatacttatttttttgtattctgctaaattttgctaattttttccaaaaaatccttaaaattaaaattttgtatgaaaatctgttaaaacatgttattccaattttttttcctggcggtgccggtcggcactgtcggaaccctttccgttcccaaaagtttttttaaaaatgctgcaaaagggccatgcccaaattgacatcatctggatcatcggaaattgtaggaaaacattgagaaagtgatgatcaatgaggttttaatctcaattatcaatcaatcaatttatacgcaaaagcgtgacaccgacataaataacaatataaataaatttggtcactgaatgagatgaggtggtttcaaaagtaaagaatcaacatcataggtgtcaagaagtttagcaaagtcaatggaattaagtaacctcgcctctttaggcaaacacctatagaggcgagaggtacgaataaaaaacgaatgataccgaacattggttgaacaataagcggttttaataataaaatcatttttcagttctgaatatgtttttgaaaaggaatcattatgctgaatatggatcttttccaaaattatatcatggaagagttttaaatctatttttattctgcgttttaagagggattcttgtttaaagagttggaggagttcgttatacccgggtatatcatccttattattattacgtctaaaaacaatacgtaaaaatgttttttgaacattttcaagagcatcaatgtcttttttcatgtatggattaaaaatcggagaaccaaattccaaaatggatcgacaataaacattgaatatatttatgagaatttttgggcttttagttttaagtgacttgagtaaagcaaaagatgttcttattgcttttttagtaataaattctatatgtttttcccattttaagttatttgaaaaataaatgccaaggtctctaactggttcaccttcttcattttttaaaattggaatattatttattaagtaacattcattagggtttttaggcccaagatgtgaaactaagcatttattaggagcgattttaaggccatttaattcacaataattcagaaatttattaatgaaagaatggagtggagaaatagtattttttgatagtatagaataggccttaagatcgtcggcaaaaagcttaatttcaacgttttcagttttacaaaaattaggaagatctgaaatataaattaaaaacaaaagcggacccaaatttgatccctgcggaacaccacttaagcatgggaattcatcagaaaacgcagagccaactctaacgaaaaatgtacgattttgtagataattttgaagccattttagtaaagtaccatttataccaatatttttgagtttagaaactaatctttcgtgcggaacagtatcaaatgccttcgctagatcaaaatatataacatcaattgattttttgttttccaaagctaaactaaagtcatcaatgacttccaaaagttgagttgtaacagagtgttttctcctaaagccatgttggcaattcggaagtacattatttgtctcaacaaaattagtttttctgggtaatattttcttctagaatttttgaaattgagcataaaagtgaaattggccgaaaatcaacaggatttattggattgggtattttcggtactggataaataattgattttttccaaatgtttgggacttggccagtcatcattgaaaaacaaaaaatatgaaatagcggataaaccaaattttctttacaatttttgagaaaaatattcgggatgctgtcaatggaagtattattattgttttctagtttattaagagccaaataaatttcattaagtgtcattgtgaaaaagtcaatattttttttaggggtgacttcacaggaaacaggaattttttgatcagtgaagactgaataaaattgttcggctaataaattggatttagctttttcggaaaaggcaatcttgttttcgttatttttaagagggggaattttcgcgtttttagtttttaaaaaagagccaatatatcgaaatcgttgtttagggtctaaaccacttaaaaatttattttcacgatttgtaaggtatttctttatttcatattcaagttttttagaggtttctataaatttttctctagttttttcttttttaatgtctttccaaagttgccgtcgataaatcataatttttttaatatggtctgggaaattatgtttaaaatttgatactgttaatggaacatatttcgatactaaaaaatgtaaaaatgctgcgaatttgttataaatttggtcaatttctatacagtccgaaaaaaaggtaacccaatcagtagaagagagcatggcatttatttccaagtaactagcttttttaaagttaaagtgtttaaattttctacaaggaaaaacatttagtcttaagtcgaattttacagtgttgtgatcactaagtgagaatggggggccaattgaaatgtcttttatgagaaatttattatttgttaaaattaaatccaaaaaattgcattccctggtgggttctttaatcatttgattaagtcgtaaaccttcaacaaaaccaaggaaattactttcataatttgtcaaattattttggacagagaaagggccattttggttccagtgaatattagtaaaattaaaatctccaagaatgacaaaattttctgttgagactgttagtgacgaaattaattctacaagttgcataaaattttcgagtgtttccgtagttacaggtctataaaccaaaataagacggatttttgattctgtaatgggcgaaaaaacatcgatacaaagtatatcagaattttgtatttttggagtttttataatttcaaacggtatttcattagaaatgacaaacgctacccctcctccctttttattttttctatcttttcttattaaagaaaaaggaaaattttctaaaatttgcgagtcgcttattttattgttcaaccagctttcggttattgcgataattttatacctattttctaaaagtaaaagcctaaactcatccattttgtttactaaacttcttgagttaaagtaaaaacaattgagaaagttttgtgacctcaaaagtttttttccattttgcctccacgccgcgtcgtcaccatttcgttctttttgctttcttcataattcatccgcctttgttcacgtgtctcccgctcagccgccaattcttccttcgtcaaggagggtctgacgagcagtcgctgccaaccgacacgctgtttcagttccgtccggttgcgcccccattgtgccagtgcaaaacgttggaacgtcgtcgctggcaagacaactttgaccaaacgcggcccctttcgcttctcatcaatccgccgccccattctatacaccatctgtgggcaaacctccacatccaaagcgtccaacacttccgcaactgtttccgcgtcctctttggcgcgttctgatggcttttcggccacagcctccggaagtccgatcaaaacgaggctccgttttcgttctttctcttccgcgctgtcattggcattgttgttgctgttgattttgcgctcaatttcactgaggcgttcagcaattgcgttgaattgttcagccatttgggatgccaatgtgttgttgttgttgtttgataataaggtttcaattgaagacagtcgatttaagatgtttttaatatcggttgccattataatcttaattggacaattacttgtctccaaatatgacggttaaattctttcgaatccggttgcattttttgaaaatttgtcatgtgcctgccgaattggaatcattttacccgatttgcctgttttttccattttgctttggtccaaatgaatcctaatgtgatgtgaccgtacaccatttttcagataatgaaaaaacgaattggatattgagtaaaaaacaaaaatagatttggagaaaaacaattaattaaagaattatacataa

SEQ ID NO: 2472 - DNA, 2062 bp, Heterodera glycines
  misc_feature (24)..(24): n is a, c, g, or t
tttataacaaatatacaatttaancatcatcggcatataaattttattttcactcctgatggcaaagcatcaggaagatcgttaatataaatcaaaaataataaaggtccaaggacagagccctgggggacgccagagccaacttttttactggaggataaatcatccccaattttaacacgaaaagtcctattactcaaaaagtcctttatccacatcaaaagtttgccccttatacctattttttccaatttgtataaaaataattcatggggcactgagtcaaatgctttttgaaaatcaatataaatacagtcaacattttttccatttattattgcctcgtaccaatcttccacaactgttattagttgactcgttgtagacctattcctaacaaaaccaaattgaaattccgaaatttttttgttttttaatagaaaattgtaaatatttttgcttaaaattctttccataaccctgcatagtgagcaggttaatgaaattggcctatagttttcgggattatttttgtcaccctttttaaaaagcggaaaaacaattgattctttccagatgtctggaagtgaaccaatgtctaatgagatcctaaacaagtcagtaataacagttgacagagaagaatggcaaatttttaaaattttatagctaatgttatcgggagaagtgccatttttattcggaagttttttcagaagattttggggctcgatgatgttaaaatttatatccgatataaagcattgatcaatttctataatattacccaagcatggattgcttgggtcggtttcactattattaaatgaattggcaaataaggtggcaaataattcagatttctcagcactattatgatagcatttattttcataaattagattaggtatttcaaagggattgacattgaatttttgtatatatttataaattgaatttcttccctttgaaatagcctttttctcaatttggctatggtatttatttgtttgtatttttatatgtaaagaaatgctatcgtatagtgctgttttggatgggtcagttttagcttgcctgaataatttagccttttctttgatggatgctaataaatgttgtgggtatttaggagtcaaatcattcttggttaaacgctttattggaatacactcatttaaaatttttaacaacatactgttaaaggcggaatatttttgatttatgctaaagcattcatatgacaaggcatttagccttgatgctatgactatattaaaatgtaacacattcgatggacaaaaccaacgaaagtttacgatcgttgttttcggttttgttttaggagtaattaatgtaaaaaattgtgttaaatgatccgatgaaaatatgcctcctttaacagtacaatcagtaataattttttcattggccgaaaaaatcaaatctagcctccttggtcatgctctcgcggactgctaattttatgtaagaaatttgcgaattatgtaaataaaatatgtataaaaaatggtaaaatatgtatgaaatatgtacaaaaatcctcaaatatgtaggaaaatatgtaaataaaattttttaatggttattttttggaaaaaaattcttcgtaaaaagtgaaataggcacaaaatgccataaaaatgaccaaaataggcttagaatcacatttgaatattttacaaattaatttttgatatatcattttttgaaaaaaatcgatttttagggatacattttcaaaaaaaattttttaattttttacaaaaaatttctataattctcaaaaatcctcaaaatatgtaaaaaaaaatgaaaaatatgtacgaaaaattgcgaaatatgtacgaaaaagtccaaaatatgtataaaaatatgtacatatttaatatgtagaaaaatcccaaaatatgtaaaaatatgtaaataaaagtcccgggttttgttcgcaaacacaaaaaagaaagtgtttttcctactatttagagcatggagaaaccaggaaaaaaatatatatttacataaaattagcagccctact

SEQ ID NO: 2473 - DNA, 5530 bp, Heterodera glycines
agcgatttgctttgtgagaagggtcgggacaagggggagggggactgaaaacttttagggacaaagaaaatgtacgacggttattgtggacaatggaagtgatcggaatgtgagtatgggaaggggtgggttgggcttattcggctatagccacgggcatttgccatcatttttcatattagttctgtgctctttttctatgcattttctaatttttccaattgctttagtccaactgatcacctttttctgtcatgagcatcattcagcctgtcgccacccaccccaccaatttgacctggatggtcctcgagggctgcgtgtgtccccggccggatgcggtttgcatccggccggtggactacacaaagccagttgagtgcatccacgtgtcacacgtgggtgatttttctgcgcacctgatgagcaaaccctgcgacaacaccgacaacatgaacatcaccgagctaatcaacggactgtgcttcaaaggggccggatgtgtcaactccatgaattttgtgttcttccttttcattttcatgggcccaagtaattttcatttaattttttgatggaaaattgtatattataatttctataattttgaggtctgtattttttgggcaattttgctcaatgtaccagcgcgcttgcgccgcatcgagcgccttcgtccgcgtcgtccgcctgtttacaacaatgatgagggccacccgcgtacgcttcgccttcttgtccgtcgtgaggtgagtgtgaacgcacccccccccccccccattttttcatttccttccttttggataatctttggcaattcagcgttcgtttgatcatcgattgccggccaagagttccgggcgagagcgcccaattggaacggtgggggagggggatgggaggggatgacaaacaaaacaaataaataaaatcacaaattttcacaggcttcaacggaatttgtcggtggtagattgtccccaattgaggaggtggcaaattttaaaaatatcaatttataaattaaatttttttatttctaaggcagacgagtccgttgagaattgagaagtgaagagaacaagagaagagaagaggagaagaaaatatgaaaagagaataggagcacaaaggaaaaatttttaaaagaaataatcagggatcattataagtttgtccatttatttaaataatttggtgaaggtcatttaaataaacagttaaatcgaagggttcaaaatttattattgaaattttatcaatattcctcggtccttctctttcaatgttggtatatctcaacatttccagagtttggtcattccctaaaaattaaaattaatcaaacatttaaaaaatagtaaaaattacaatttaaattaccaaataagccaaaaaatgaaaatgaatgcagcagcgatcaacgatcgctgccataaattattgtagaactgcggcttggaattttcataaaaaatcatctaaatagtgaataaaaataaataaattataatgaatataaaaattatttaattagctaaaaataaagaaaaaacaaacatacataaaataggcaaatgatgagtcgatcgaacagagccatcgttctctgctggtcactcattcgagaatggcatatgtaatgtgaatgtaggtcacacttacgaccgaaacaaataagagggaccatcttattaaatgataaataaataaataaataaattacggatgtataaattaaagaggtgtatataaaaggtggcaattttttggatagattcattttgctattttcttgaaaaatgagcattaaccttcgtgacaaaaaatcccttatggaaaatattttgcccgctgtcgacatcagccacaccattaatggaattactgtgagcagcgaacgcattgccgtggcaagaacaattcctttcgacattgtcggcaagtgcaaggagtgcaaggcaaccgaatgcgagacggaatggtgtatctcaaaggagggtgtgacaatttggtgcactcgatttaaaatcagcccccgttttgtgccttttgatgtcatttacgagcttcccggttatacctttttcaaggtattttcaacaatttttcttaccacactacattttttaaatttgtagatccgtaacaagagccgagtttttaacgttgaccatggcagtcgcagcgatgcttgcactcagacgcccacaccgctctaccacttaccgcctccaccacccccaccaaaactcccaaaaagaaaacaggaacagcaacaagcggacgccccggcgttcttttccgctctttcggcagcagtagtatagaaccccaaaagcgcactttcgcatgggtgtttaccgcacaatcccgtgcctatgggaggggtgcagccctttgatgttgccgcacgagcccgtgcctatgggaggggtgcagccctttgatgttgccgcacgaacccatgcctatgggaggggtgcagtcctttgatgttgccgcccgtggacccatgcctatgggagggtgctgccctttgatgttgccgcccgtggacccgtgcctatgggaggggcgcattcctttgatgttgccgcccaaaacccaaacctattggaccactttcaagttgccgcccagaaccaaaatctattggaccactttgaagttgccgcccacccaaatccgatttcccaaaaccgcacgggtgctttttttttgcccaacccatccctcccggccgatgcatcgccgcgcaaattaatcgataatgacaccgccctaccctccccatcgatgtcgccgccgcgcaaaaaaaaaatcgataaaattaatcgataatgacaccgccactctcatccgctccgtcgatgtgcagcgattccgagtcgtgaaaaaatcgataagcaccaaaattgttaatgaaattcaattaattctaagatataggaatattaattgtacaatagttgaataaataaaaattcattaaattaatgaaattgaatttttctgaaataattgatggtcttttatttttcttccattatttcgcaatctgcacgtgactttacgattcgcaatatggaccaaattaggtcacctgtcaatcaaattttttatttcgcaatttccccatcgatttcgcaatctacacgtgacttttttttgttgcatatttcgcaatagacacgtgactttctgccattgcgtcgaaaatataacatttgtcaacgaaatattcctccatgtcaatgaaaaacagtcacgtgccaggtgtcagctgacacgaggcattctgcggccactataaaagccccacaaactcacttctccattcagttcaaccaaaaagttggattttgctaaaataaaaattgtgcgctcttatttaaaaaaaaatattaaatttaattaaaaatgacttcaaaacgcaacgggactttgcaaaaaggcggtccgtcgaccaaaaaatgggattttcgagctatagggtaagcaatttttaataatatatttaagagacaagtgtaatcaataatttttcaggaacaattttactgaggaaatggaaaattataaattaattgacgaacggtcgacgatttgcgaaaaatttggattcacgaagaacattacggaatttcggatcaattcggatgtgagacgtcctgacgaagcgatgagggacgcaatcgacacaatgattaaggcggcttttaagactacggaagaaaggatgaagcggaaagtgcggatgtttggtatggcaataacgggtgccgggcttgcttccccggtttgggtaccgtacagggcgtacccgcagaataatgcggatgttattatgcaggagattaataagttggggcagagcggggacggagatgaaaataagaaaacgcttttgttgtcggagcctattatgatgaaaattacttgcgtgacactgcccagtggagaagggccgaggaatgtacataaatttgatttcggatttaaggaacaccaacggataaggtaagttttttgagaaaaaaaaagaaaaaaaaggaaaacagaaaaaaaaagaaaaaattataattatttattaaggatttcgaatgtggataaattttgtttgttttatgctttggtggcgtcaaagctttatttggaagtgcatcggaatatttttaatcgatttatgaatagcatcgtgagacaacgagaggcagcatacggacttttaagaaattgtggaattgatattaacgaatatagctatggagtggagcacttatcgagggttcagaattatttggtgggttctaaaatttgggaaaacgtaaaattaatggatttttaggatgagatttaccccggtaaataccgggttgtggcatttgaaaagtctgcggatccgcggaaatcgatccgtgttttatggaagggccctatgggacgcgaaaatgtagtgccgatatttttggagaatggccattgggatggtctgaagaattatgtctgctttttcaaccgtgggagaaaattctgtattgattgcgagtgcttttacgacaaagatatttaccatactttcgactgccgggcaaggtgttattattgtaacaaagtaggaggagtaccatgccaaaaggagagtggagtgaagattgagtgcccgaagtgttgtcgttacttttacaatttggagtgttataattaccatcaggaacatcagacttgtaaattatggaggctttgcgttatctgtgacaagacttatcgatttaacccgaagaaggaccatgaatgtggagagacttattgccaactttgtagtgtgagccatgaccccaagcggggttgttatattatgccgatcgaggagaaagaggaaaagtccgtctaccgaattgtcgtttgggtaagatttaataaagaaaaagacaaaataaaacctaactttcaggattcggaaacatcgcaggattcgatttataagggggaccagaaagagcatgtgatcaattatatttcggtgagagttacgtgtacggagtgctgtgatgacaaaaataggacgaattgcaaaatatgcggggaggagaggaccaaggattggagcgaggctgaggggcatgagccgacgaaggcatttgtggagtggattttaacggcattttcaaattacgatacgtacatatttgcgcacaatgctgggcgttttgatggtaatgaaaaaaaaaattaatctaaatttttaaatcctaaaatttttaggtcattttgtgtttaactacctctgccgtaccgggaagaacccgataccgcttatcaatggactcaaaatttatgaattcaaagtgcgaaactcgaagaaacattcaatgctgatatggagagactcatgcttattaatgccggtgaaactcgagtcgcttaaggcgaccttcaatttgggctgtgaggacaagccctttttcccctactactacaataagaaagaaaattatggaatacgtttggaacatctgccatcgat

SEQ ID NO: 2474 - DNA, 2184 bp, Heterodera glycines
atgaaccggttccttcttcctctctctatgctaatagacaaagaagaagaaaactgccttcagactcacggcgaagagaagaacaacaaattcccgctgacattcagcaggaagaaccctttcaaccagccccacagccttctattcctatacatccacaacttaacagaaaacggaaggcacagtatgctttgaatgatgttcaagaatcaaaaaagagtcttattggcttggaagagctaagacctccatcgcttcaacaagaggcatcccttcgtttcaaacaaaaaaggacaaacaaatcccgagtaaccctaccacagcactcgaattcattgtccttggcaaaactgcataatcctccgagggacttactggccgaggcagcctctgcccctttaccggatgatgatgccgatgattttgaactctcacaaaaccacgggagcgcttctcaggtccaacctcccccacctgcacctccgttgcctagtaaagccaaaaagcgaaaaagcaataaagttgatgaagatatcgaacgaaaaagaattagaattggttctcgaaagagggatttactggcagaagcagcctctgcccctttgcctgttgatgatggtggcgatgattttgaacctccacagaaacccggaacgtcagctcaggtccatcctctcccacctggacctccattgccaagtaaaaccaaaaagcggaaaagcaacaaagttgaagaagataccgaaagaaaaagaaccagaattggttcccgaaagagactgtcatcaccaactgttcccaaaaatcaaccaaaacgtcaaaagaattcgggaaccgaaagacaatcagaagaacagcgtcgtcagtttgcggatgatcaactccttttcagcatcccaaattctcagcttaccaatgaacaaaagagaaggcggctccaattcgtatttaaccgaaacccggtcaagtatggcgtacgcgaagacaccattttaaacaacgctggaaatccagtaacggacagcagtgtgacacaagcacttgaatacattattgaacgcagagcggggagagtcccacggtttagacagccgccggggacaaaattgattcgagaccggattaatcgagaccttattctacgaacatggacagccccaccggtaccaccgaggggagccaagcggaaattgccacaaacagaccaagaggaggaattaaaccaaaaatcacaaaaaatcagaggaacagtacagccgagaggcagagcacaggaaggactgatgcttccgtttccaacgagaggagtcaagcggaaaacaacggccccaccagaagcaacaatagaaatacctccgaaaactcaacgcctgagaccacagaaatggaaaaatcaatagaaaatgtgttggaacgactctacaatgacccaaaatcgcctgccgcattcgctggcgtagaccgattatggttggaagccaaaaaggaacttggccataaagtttctaaaaaggatgtaaaacactatttggaggggcatcgcacatacactttaatgcgtccaagacgtattaacttccctcgttcacgaacaacagctgctggctttatgacagactgtcaggtggatttggcggattttcaatcgctttctcgacacaacagcggcaatcgatacttaatggttgtaattgatgtgctttctaagcgaatatttgttacaccacttcgcacaaagaaggccgatgacatggttgagggctttaagagtgttttttccaaaatgccgatgaaaccccaccgaattttctcagacaagggcaccgagtttaaaaatcagcagttgaaaaagctatttgatgaagaggaagtcgagaaatatgagagcacacactctgagaaaaaggcagcattggccgagcgtgctattcgacaaattaaaaatcgtgtctatcgttattttgctcaactcaaaactctcaactgggtgaatgtaatcgacaaaattgttagtggaatcaacaattcaccgagtcgtgtacatggcatgcgaccaatcgatgtaaactttaaaaattctcaaaaagtgtgggaaagaatgtttggtgcagaccagcacagagcactttttggtaagcacagaaaaagaccaaaatttatgcccgaccagacggtgagaatgag

SEQ ID NO: 2475 - DNA, 6304 bp, Heterodera glycines
atcgttgatgaaaaatggtatgcgattacgatgtgtttgatcacttgaatgcatttcttgtgattcgtcctcttgatcactatcatattctttttcatcttcatcttcttcttctccggcttcttcatcatcgttttcttgctcttcatcaattgattcattctcttggtcggattctgaaggggaatttggtttgagcgctttcagccttctttttacctccaaatttatatccttaattgtgtcaaggatttcgtcaatttccttaattgtttttaaataattatgcttttcccggaatattttttgtagtttccattcactgttccattctgttttattcatttgccttattaaattttgccatttttggtgcaaaatttttaatttttcaaaatttggttcaattctttgaatgatttctttagttttattaaaaattcgagaacagtcatcaaaattatttttatcatactcgaaattcccatcttctatttttgacttaattttctgtatttcttttattaacactcggttaagtaacggtatttttgctctgagttgacccgacatatttaaaaaatatacttatgagttgaaagtacaagaattggatgatagcaatatggaccccactgttttttaatctgcttagatattcgattttctattctcttgagaaattttgttaatttgatttttctttggtccgttttgattgagtcaattatggtttgttctgttgtgtgtaaaaagtctgatagtatactatttgttacttcttcagaaattgtttgacagaaaatttctatattacggtgtgacaaatttttgtgtacatgcacagtgagagcaatagtaattttaaatatatatttagaaggattaaatttaaattttttgactttggtaatatagtcttgattaatggtaaaataatttgacaatggttcagtgattaaagccccgtagaaatttccaaaaattaaatcgtcttgatttgttatttgttcaatttcgttaggttcaaatatttcgatattctgattttcgttctctataattattggttcctcaaattccggtaatatttcaatattctcgatctgatttaactgatcgggttgatttgacaagtcaattgaatttaaatcgattatatttttaggacacagtttgaaattttgttaaataccgtaatttaaaataataaatgaaatgaaccttttattactcaaaaaaggaattaacagaattgttttatcacaggttaaatgctaatcacaatttattgattatggaattaacaattattatcacaattttaaaaatttgatcacagattagaactagttgattgggtcgtagtgtcggaatcgttgttcgattttaatttctgttcagttggtaagccaaaagtcttctttaaataatgtgtcgtcctttcttgggcggtaaggtagcgtctttggtgcttcaaattgttttcaattttgcgtaggctgataagtgcttggtcttgaccagcttttgttgagtagcctgttgactgaattagacgaactaatttttctatcagagttcggttaaactcttcccctttcacagcttttgtagttgcctccaatatgttgttggtttgcgtttccacactgtcaattcttttctgttcaagttttttggcgtggcgaattgcttgatcccaaatttctttgtgatcaacctcccagctcttcaatttttgaaaaaaacttccgtcagtctctggatcgacggagtcgtggaaatttggacactccggtgttttttcgcgaatgtcgtttagcttttctatcgctttttcactttgaataatatcgtccgtctggttggcacgaacagttgattttactgtttttatcgccttttttaattgtttgctctgagctattttttcagccctttttagctcaattaattttttttgtgtctcgctcgacagtgttaatgccgagtcaattgccgactcggtttgtggcgatttggttggtgtaactgagcgagttacttaagggatatcggtacgatcagaaaatgatttaattttgatcactttttatgggtgggacttcttcgttcgccacttcttgattcaatttgctcactggtgggcgagaacttgcgcgggtcactcgtttcactgaagtattttggaatttattttttgtttattggtttgcttgtttggtttaattgggcttggtgacccgtgtgttttttttgattgatttggtttatttttgtttgattttgtcaactgtttcagctcactcgtgttttgttgttaggttgaatgtttgacggacgtttggtcaggttttgatgagcaaatggacgaatttctgttggtcccgggtcgtggcaccacttttgtcgttctgatgacggcaaaaaagtttgaatgggctgggcggacgtattcagagcgagttgacaaaaattaaagaccaaaggcgccaaaaattcactttattttgtaccctcaaacttgggtaattaaaccataattaattaatgaacaaatataatccgacatgataaaatgggcacaaaggggaatggtaaggggaaggcgcagggcacggcacagggaaggcgcagggcacggcacggggaaggagcagggcacggggcaggcgcacgggcacggcacgggaaaggcgcacgggcacggcacggggaaggcgcagggcacggcacgggaaaggcggacgggcacggcacggggaaggcgcagggcacggcacagggaaggcgcagagcacggcacggggaaggaatggaaacttcggagggaaccaatgagcgatctgaaatcactgaaaacccagccccttttatacggcttttttgaaaccatagtacgctccaatttataatttttaattaaaatctgtttttgttatatccgtttgggttttgccattttcccattaattgtttgttttccactttttcctttgcaattccaattcctttaatatatttaattaattattaataatttgtttacgaacgcaatccttaacagaattcgccatttaatatcaattaattttcgttcctttcattcctgaggaaatgcacttttccttttcaaacaattttccgttattcatttcaaaaggttttcccattttttataattatatttttgatagttttttctaatatgtttttccaaattaaatgaaaaattatttttgtttatgtaggttttgtttttccccattttgttttctagtgttttttattttttcctttctttattttgggatttcgcgctgtcgcgacactcccacgcgaacgaagaaggcaagcacacataattctatatataataggtagtagacatggaattagaaaaaatagaataagtatgaatatgataataataaatatggtgaaaaaattggttttaataagagtgtaaacaaaatttattatatcagttacttggtccaaggaagttccaataatgggtttttcattagtattgttagcggggataattttagtatcttgttgtgatatgtattccaaattagcttttaaagtaatttcagacttgccatcgggacatataactccacaattttctgtaataatttgcttattatatgcaagttggatttgttgttcttttccttctttatcacaattcacttggaccttttgacttggacattccacattggctaatgcggtaccaaaatttgttttgcatgatagagtccaattagcaccactagtacaggaataacatccttccaatgatattgtaacaatattacaaatatttttatcataaatagctttaaccttatgtcctttaagtgtgacttgcatttgaagagaagttgtttgctgtattttagctttaatttgggaatcgaagtatacgtaacttccctgtgttttaatgggtaaaaggttctcttgcctagcaaatatttcggtaagtggacttttttcgcattcacaatgtacaacggaatcacctccgtggcattgacatgcttctggtggaaaagtgcaactaaaactttgcgcttcttctttgtttttacaccgtaatatatttttgagtaaattttcgttcgcaactattgctgcttttaattcttcgcgaactataataaatgtcgaaccaaataacggcgtcggtggaattgaagtcgaagtcagtgtgacagatatagaactattagactcgtcaccaatgtgtgttaaaattccgggtttcaagtcaacagaataggttaattctggattgatagacaatttaattgtcgcctgaatggtccaagatggacagttaacaacttcgaaaatttcgtcaccaactgattcggcataagttctgtaaaatagacatccatcagttgcgaggaaacattgacaatgccatcctccgcacgatggtacacagtatgaataacctggttgattattagcgtgatcattcacttcgggattccggtctgacatttttactgattgacaagtttggccggtacatttcccagcgcctgagcatcttttttgtgatgtcgaagataattcgtaacctctcgtaaaataatcagatttttcggtgcaaattattgttaaagtttctattgtaatttgtagtgtttccatagtggtgttagtttttgtattgtcgagttttaagcaggttaagtgttcaggtgtaatagagagttgggttgtttggtcataagaacattcaatttttccttcttgggttacagcacagtcatttgttccagcgactaaattcgtcacttcatcacaagcaaaaattattttaaataaaattaaactggaagtgattaaataaatcaatggtctttttaaccttggtcttgaaattctagttcgatttacttttggttttcttttaaaacaattaaaaataaattgtaaaatccaatggataaaacgtgtgagtattcgaataatttggaggcttaatgaaataacatataaaattatcattataattacaagcattaatgcccagtgaatctggtctacacattgtgggtttttaagatattccatacaaaatcgacgagttaattaattcacgatacgggagatgattgacatgtgatttgtttctcattggttttatctggattacttataaatttaatgataggtttatattcaaaggatgtaagttttgggggtaaataaattatttcctctttttgggggttcttttttataattgtataattttcaatggaaatttgtaattcttgtatatcatttattgctttaataataatgcctccttttaaacactcaatggttgcttcttcattgattgaagagttttcttctcttttattccgtctattttcaataaatgattgatttaaattatttggcaagtaaaatattttttcaatagttccccatgctttgatttgaattaattcttcatcagatttcacaagataaattttttcatagggttcataaaagcaaaactttgttccatatttttgtttgaatgaattatttttaaaacagtcatgttctcgacagtaaattggagtaccaatcgtcagattgccctccccaaaacaacgaaaattgtttattgagtcaatttgggaaaaaagtaaatttaatgttttcactatgtgaattgaattgtcataaagaacaattgaattaaataattttcttttcatgattgggcagttttcagttttatttggtgcgcagatatttggtttgaagaacgaaataatgctttggtaattaattttttcaactgattcatttttgattttattgtaagatgcaaaactacaaaatttgaatccctctggacatttacatttttcaccacaataaggtgggcgtcgtttaataatatgtttgtctttgcataccaattgtttatagcaaaattcttttgttattttattttgtctgattgtaaaaccgttttcgatacatagagttgtatatctcgttttccatattttaggttcctttggacattcgtatgaataagatgaacataatgaaattaatgttaataatgatataattgttaacgagttttgaaacagtctattcatttttatagggactaagggattatccatcttcctttttctgttgaaataattgggtttttgattaattattagattagagagagtttcttgctctttatcatcatttgaattaatttctaacgggtaaattaattttaagggtcgatttagtactg

SEQ ID NO: 2476 - DNA, 2283 bp, Heterodera glycines
agaaaagtttcgagttttttggtcccggtctcgagtctcgggaaattttcggtctcaaacagcactaattagaggacaccaaaccaaaaaaccctcattaaatatttattttagaattcctttttactttttttcaattaaaattaataagccccattttgggcttttcgcataattaaatttttccactatttaaacaaattaaaaaaccaaacattttttttttggccagaaatgtaattttttcactttggcataacgtgccaattaatgtcacctgaaatagaaattaccatcattaaatattctcacctgaagtaattaagcatgataaatgaaaccattgtattaaatatgaaaactataaatagtcagcaagaataaccacaaggaaaatattttaatttatgaaattttagtgataaacctatgattttcgcaattttttataatttcattttgattaaatggcattgcttttcttattagctaattagtcattacaccgaatagttttgattaatttgggccttggttctggcatcatttatattagaattaatgatttcacattacgtattgccaaaaaagcgtttccgttcaaacatcacgggcactgtaaacacaagaataatggcggttgcattccatgccagattttcctgcccacacaaaatccttatcctttttaggattttggttggcacttaggctctccaaaaattccccgatggcactctcgtactgctaatacttgtaagccattgttgacgtagccaattcttctaatgccaactgtcgctggcaatgcgcgcgagttcaaaaatggcacaccaatgctcaatccaaacaacaaaaatgccatcctcctcctcagtttctgtcccgtgcgcattttgcccattccaaatccggcatcctaatgaaaatgcccggggggagggggagggacgggcagtagcggttggtgggaacatcttccttcagcaatgccaatgccatttatgatgcctttggcataaagcagcttgttgctgtggcgaaggcgggcaatgcttgaaaaattccatggcgcatttgccgtcccatttcaaaatgcctattttcgaaaatgccaaaactgatttactgttttgtctataaaaatgattgaactgatggacccactactcattcacttttcttttcaattttgttccattttcatctgattcattttcatcaaaatttctttcatttcgttagtcattttgcgctttttccaatttccaatcctccgaaaccaaaaattattattattttttttttttataatttggcaaattaaattttatctttttttttaattgatagataaatcaattgaaatcattcaatactcaaatatgatcaaggactcctcctcttccgatgcctcgccttgctcatctccctacaattttcgcctcacttccgccttccgtcgcagttggaccattgaaaatttaaagtaatttttaaacatttttttcaaataatttacattttctatatttaaataatgcatttttggctcttaattaacaaaagcattcgcctcaattagtgagctctttatttattaagtgacaaatgaataggcgacaaattacctcttttataaaagcaccaccactttaattgagcatatttttttaaataatagcaaataattttttctggcctttttttttgcttaaaatgttttatatttcaaatgctataaaatttattttgtgagttataataaataaattaattaattaatataattaaaataatccaaaccagcaattaataaatcactttaaagaaatttgaaatttgctttttataaaactttttttaaaaaacaaattttacaggaaattgaccaatcggacttcaccaagcaacaaaaacagtgccaaggcaagcaatggtaaaatgaccgtaccagacaactcaccaacatctacagtaagccgtcgcagcattttgaagagagggagcagcaccgatgaagtggaacaaacagtcaaaacgttggcatcggagggcaagcagctgaggcggcgtcttctgatcaaaaaggtgaaaacttggagcataattgattttttccaattaaataaaatgacgcacaaatcgggccaaaatatttcgggagtgatccttttgaagctttcactgatcagcccgaagcaaaaattagaagcaaaataatccaatcatataaagtgacccaaaaatgcaaaaagacataattcactttttgctaatcaa

SEQ ID NO: 2477 - DNA, 5048 bp, Heterodera glycines
  misc_feature (16)..(16): n is a, c, g, or t
aaaaaagtaaatacanttcttttctaatcattgtgtagactttaaaaggtaactcgccctgtgcgactcgaacccacgcccctagcaatccacgccgtgctctaaccgactgagttacggacatttcgtttagaggttctcccataggattatcccactttctcccacactccgcatccttcttgtatcacaattgaatttttaattaaatatatttttaaaaatacaataaactaaagggttaattgcactcataacaatattttttttacatatatatagcctaggcttaggcctaagcctaaagcgtagaccttgcctaagcctatgcctatgtaagagctgtcatgtcaccaattaaagaaccccaaatttttttgttaaagaattagctcctaaaaagaaaaaataaatcgaacaaattttggtcacaaaatttgaaaacagtttcccttctctttgactttctctctattgaaatttgttgataattaatagagcactgctacaggtaattaattagtgatcatcatcattagggcctttccaactgtaaattgtttctaagcaaatgccaattttttgcgcaattttttcttcaatttgttttgtcgcttttatggcgaatttccttgaaaattcgtcctttattctgtcaaattgcttaatcacagctaattccctcttccatttgtaaattttcttgcgacattttcccaatgcattggcaatttttgtttcatttttgacacggttttcctttttatattccttttttaatttcgacaatttcaccaatttttcgaatattgcaattgttttgcattttgtttcattgttttcttcatcaaattgttgtttcctttttttcgtaattctttttcaactttcaaaataattagatttaaaaaagagaaaaaattcaattttcatatgaaatcgcagctaatttttccggcggtgttgataggtgttgccgggaaaaaatttgatttttttgtagcattttttacataaaaatggccatttttaagttttttttctcaaaaaatcagcaaaaatcagccaaataatcattaagaagaaaaaatttttttctgtatttaataaaaggattgtccttaaatttgtgtatttaaaatatttttgttagtatttaattaaattttagaattactcccgctcccgcccgggactcccgttaaaaatggacgggatttgaacgggagcgggatttttacgggattcccgttcgggactcccgtcccggtaaattttgaactctcgatcccgctcccgctcccggaaattttttttaccgggctctagaagaagcattatccttcctttttgaatttagagattgtttttagcgcataaaaataaatatcggagtattagcacataatttttatgcagagaataattaaacaattaaacgaattgctccgattgctcgctgaataatttcaacgaataaaaaataccttatttatttttaaaaataatttaatattgaattggcgaaagaacggttttcgaaccgttcaaaatgcagaaaaaacagcaaaatggtgcactcccaacaccggacaaatttaaagttttattcataaatttaacaaaaaaatcaaacagaataaatgtaataaagttttcatttatttataatttcaataatgtctggttataacgattttcattaattcgagatgatggtatattgaaacaaaatatttttttattttgattaattaaatttttagttttgatttatttcagatgaatttattataattttatttaaaaatatgttgatacaaataataacattattgctatcatcaatcatcatctgttgctggtcaccaaaattaaaatccatcttcaggaccgtacccatatcccacaatgccgtcgtgtccacataacatgcaccatcatcgtatcccggatatggatcgtatcctggatcatcgtatctcaagcctttaatagtagattaattttaaaaaagtaaatagctgttgtttgtgctaaattatttataacttaattgggtaattattttcaaaatcctttataatttttttttcaaatattgccgtacataccctcttaaattaatccaattaaatatattatcgttcattaccgtccgttcctccataatattgggttaaaaaataattaatttaataattaaatattgtatgggagcgaaataacagatattacaatatatgatgtcaccaaaaataagaaatgtttattatgctgaaaaggtccttaaaagcgatcacttaagaggaattttttaaataaaatatttaaatgaagaaaacaaaaatgaatgaaacgaaaatggaaataaattatgctggtgatgggggaggaatagatgacgggagcggatttattactatttaaggactcgggaatggctgggaaatgtattccgattttaatagaaagccgtctttccgagtttaactatgttctagattaatccaaaaaattttatcttcgacctgatatcccatctctgaaacatttataaaaataaagtccccatcccccacctctaacaaagaacctttttagttttgtttaaaaatgtcggttcctatgtataaattacttattaaagcaaaactaaattgcaaaattttagccccagctgacattgatcaccaccgaacacaaagtaaaaaatcgtctctgcccctctgaacatgaagtgttcactcctctcttacccgttcattggaatttccctcattttggtcgtcggagttgcgtcaagcattggcgcgcctgcggcggcgagtgggcgaaagataaagccgccaataatggagcgcggtgccgtcaacggaggcactaagccaactgaaatgggcaaggaggaggcggaacagtggaaaaaggagcgagaagaagtgaaaaagttgctggcggagcacaacgagaaagtgcagaagaagctgcttaagcaagccaaggcgttggagaaggacgaaaagtatcagcagcggatgaaggagcaaaaagccgcccgggcgcggcttccgaaggagaagcgagtgccggcaatggacattcctgagatcaatgaaaacagcccagaggctgcgtatctgtaccaaggggacattcaactatcgctggaagaagccaaaattttgtttgcccgggacgacgatgttgaagagggacgaccatcgacgagaactcccaatgcttcttctgatgctgttgcctccagcggtcgaaggcggcgcggggcgccaatgaacgctgtcacctttccggacagcaatggcctaatctccagtacccgttcagctttgacgacagcatctgtatgtttttcagtgtggtaataattgtagaaaaaatacaataaatgggtggtactctattcctaatggaacttctaattcagaggaggaattttcgatatattgtatccttacgatctttagccgaccagctaaaggggcacatatacaaagccctcaacctttggtacaacaacacgtgtcttcacctgtacgaagacccgaaggcctctccccgagtacactttaccagccatgccggaaaaggttgctattccgcactgggacgccaaaaatcacaaacctaccaagaagtgtcgattgggcctgaatgtgacctggtaagcagcagatcagcttgagacggctaccggtccgagtgtcgaccgttccgagtgtcgactgcagtataacttgcctcaaacttaactgatttggccgaccagaatatcaaattaagctttcaatgagacgaagctagccgtgagcaaaaacattttattcaataaagcgtaacaaagttatggccaataaacgaaaaatccaaaaaattgccaatttttgactctttttggacatagcttttttgaaatgctctcaatcactaagcttgtgcttaataatatcttggcctaaatacgctgcttcttttggtaccaattcagtcgatattggtcgagacaacaaaaaattacaagccggtcgacactcgcggagcgatcgacacttgggtaagactttgacttaccccacaaaattcatgaaacacttcgccaaacttagatgaacatagaaagtctgaaaaagattttaagctttttccgaaattttaaaacctgttttaagaggttctctgggttcgctgttcacgaatatgacatccactgcacctaatttcgaacaccagacccaaattcgaaccaaaagtcgaaaattgatttttcatgaaatcactcagaattagcactaaagcatagactcagcctaggctaagcctaggtaaagcaaaacgagttgaaacaggtgtagatcgaattttctgttcaagatatgtttattgatactaaatttgctatgaattgaatgttttgggcttgtgggtcaaaatttgattttttctaaaaattcatttttggtaaaagcacttttttatgacttggtagatggtttttcatgctttttcatactgtactatgcaatatctaagttttacaatagaatttcataaaaacttttgtggggctaagtcaaagtcatgccgacacttggaccggaagcgcttgagacgcatatttaaattgcataattctgctccaaaatgttttcaaaagagatcgccataaaataatatgtgttaaaccagaggtcgcattgaaaatttcccgaaataagtacatcgctggacaaaaataagttttaggggccaaaaataagtacattttttaaaaacattattttgaggctttatctcttattttattcaacaatatcggcataagcaacatatttttcgccgcctactatttttctgagcaattccggcttcgaaattagaaatttatacatttccgaaaatcgattttaacaagtttgtggaaaacatacctaagcaatttgtaaatttcagtgcatttagagtcaaaaaatcagatttttaacaatttttttggcgctttttcctagaaattttttgggtatgggtga

SEQ ID NO: 2478 - DNA, 1627 bp, Heterodera glycines
tgttttgggcttgtgggtcaacttcctatgtttctaaaaattcattttttggtaaaagcacttttttatgacttggtagatggtttttcatgctttttcatactttctatgcactatctaacagttttacaatagaatttcataaaaacttttgtggggctaagtcaaagtcatgccgacacttggaccggaagcgcttgagacgcatatttaaattgcataattctgctccaatatgtttccaaaagagatcgccataaaataatatgtgttaaaccgctatttgtttgttattttgtaagctcggcatcattgcgcatgaaattggtcattcgctgggctttttccacgaacaatcgcgctacgaccgggacgactttgtggaggtgaacactgacaacatcaaaccgaaaaaactgcacaatttcgacaagcagtcgaacatcaataacaacaactattacgttgggtacgatttgggctctgtgatgcattacgcttcaagtaagtgttgaatgaaatcataaacaatatttgaccaataaaccgaaacatattgataaataaggttgacattatgccgaccaatctcgatttttttaatattatttgatgtaggaaaaaagaaaaatgcttgttcagaagatttctccataaatggcgagccaacattggtgccaaaagcgggccccttgtatctgcacacgatcggacagcggtatgggcccagccacagcgattacaagatgatgaacgagcattactgcgggctgagctttagttcggcaaactcaagccggaacaaaggtgaatgaaacaaatcaaaattgaataaacgaaaagcattttttggactaacctcaagggctcataagtttattaaagtgtttgtgtccaaaggaatcgatcggttccggaggtgtaactgatttcggggttttttgtcttaaatccctggttaaagacgaatttcttcactccaatagtgatcaaataaaagactgaacaaatatttttacactgccaccctaccaaaaagcagtgttaaacattcaattcggcccggtgctccgaagctcaaattctttttgcaaactaaaccaattgtcatgctaggtaataggtatggttaggtaataatatttttttcaaacaaatgccttagtctatctgtacatattggcgaacgtttgtcaacgaaataatgtttgttgggttgcagttacttgcgagatggaaaccacgtgcttcaatggcggcttccagaacccgaacaactgttcggcttgcatttgcccgccaggctattggcatgaaaagtgtgagcaccccttggagtggcactcgccaatcggcgtaccgaagtgctccccctatacagaagccacgtcgtacactcactggacagaagttggtgcctaagatacaaactccgtatgtccaaagtcgaaaattgatattactataaatgatgcacacgaaatttcggttttcgggtttttggctttcggtttcgggttgcgagtttcgggtttcccgaaagtaaaaacacacccctaatgttgagttttggccattatcaattaatataaaaattccccgacggtgcatgaacaccgccggatca

SEQ ID NO: 2479 - DNA, 3439 bp, Heterodera glycines
  misc_feature (26)..(26): n is a, c, g, or t
ataattttttttcttttcaagccccnaattgctcaaaaattgttcgtggtgaaaaaaatgtcgcaaatgatgatattgttgaataaaatgcgagattagcctcaaaacaactttttttaaaatgttcttatttttgaccccaaaatcttatttttaacctttgatgttcttatttcagaaaattttcgatggcaaccctgatttatattctttttcccaaaaagtcatttgtaaggctgacaattttatgtgaatacatatttttcaaatcgaaaaattacctctaagaatttccaatcggcaccgctggatccatatatagaaaagatgctttgaaaaatgataagcaaaaacccaaattttttgagtagcaatgaactggaaaaatttctagctttcggttccggtttttttcgggttttatggctttcggttttcgggtctgactttcggtttggtttcggatttcgggttttttcgctttcggtgcatcactaattactatagccatgataaatttcgacttttggctaatcggagcggagcataggtgtcagaattccagcatgtcctaacgctttggataatccttagatgtccaaacaaactggtgccaccacgttggatgaaaatgctgactttgcttactgtgtttgggaaattgtgtcacgagagacaatctacatcgaagtgctggaggtcggtgatatgtgtagcgatggctgcacatatggtaacacggaaatccggacgagtgcaaacaggggcgacacgggagtgcggtaggtatcttagttggttagggtagaagtaatcccgtggactggttcttattggggtaggtcgatacctggtactgaaccggtttggccctatcatttatcctggtaccaaaccaacggcaccggttttcaaaaacggttggtaccagatatcatttaggaaatataaatgttttttcctattttttcaaaaattgtgcaaaattgaaagatttatggtcaagtttcagtcaaaaccagaaaagataagaggaatttttggccggagcggactccaaaaaaacgggaagcggaaggtttccagtagcctcgtttttttattcgaaaattttttattcacgtggtaaaaatgggggaggaccgctcaatccaagatgatccacttttactccacaattaaataacagcacacaatttgttgaagggtcaccaacggcagtccgaaaaggaaaggccgcccagaatccggaattggaattccggaccccaaaaaggtccggaactccggaatccggttccatcccctggtatacatacgtttagatcaaaacacacacttttttaatttgttgtttttgtaaaagtaaaacccagtactgataaggagagtttgcaaaaatgcaaatgcatttttttttcctgaaccggtaatggcttaaaaagcacgaaaacttgtttttagtttgatttgaaacgatgtacttcatatgcatattttgcatatttcattggtgcatatttgcatattaggtacagcgttatatgcatatttaagcgtatatttttgcttttttgaaaaacccataagaaaaactcaataaaacaaaatcaatttaaattttaataataactcctgaaaatcgttacaaacaaaaattctcctttaaatggttgtttggccaattttaattcaaaataattgaatattatataaaatgctctgttttgtttgtttttggtaggaaaattaagaataaatgttattgggattttttcaaatttgaatccctaattttggaaattttttttctgcattttgctgcatattttgatattttggatgcaaattttatgcgcatatttgccgatttaagtgcatatttttgttagccctagtgatcgttggtcttttaccacccgtagtttgtgttgccaagacgacctcgggggccccaacaaaacgctgagcatcaccgcatccaacggttacgcaaggatcagcttgtacgcgtacaaaggcatccaacgctttcgccttcgctggcgccatgactgatcagagagagagagcggatttatagttgctaaaaattccaaaactggtactaaaatagttgttgccaaaaaaaagtgcaaaatatttgctaataaacgcgaaaatgccgaaagagttttgtttaaaaactataaatccgggtatctactgatcagagatggtgtagacgagaagaatgaaagcagcacagagtgaagatgaagaacattttgtgatgaaaccccaaatcagcagcaatgtgaaagttaaaaaaataaaataaaaaagtgaatgcgcaagtctttaatttaaatcgaaatcggcgaatatttaaattcacaacccccttcacctcttcctccctccttttcgttttaccctcttcttctacatacccagggttcccagatctgaggctttagcctcattttgtggttttttgataggtcaatgaggctaaattttcataatgaggctttgaggctttttgtggtttttttgagaaattttgaggcttttggggaaaatcctcagaatcttttaaattttgataaattggcataatgtttggcaatttaaagaatttttttaatgaaaacatgctaaaaatatggtcaaaattcttaatttttcccccagcggcgcctatcggcaccgccggaccgtaaaaatccttaatttacaagcaaaaatttgctcaaaatcgcaaaatttggtcatttttcggacaaaatctgttaacaaatcgcattggaaattacaaaatttttcccggcggcgcctgtcggcaccgccggccccctttgttccccaaaagctctttggaaaagcgccgcaaaaaaatcaacttcgtttttcatgttcagaatcccaaaaaatgcttatttctaacaaaaaaaatgctcaaatcgatcatggacaatcaaaaatataacatttgatcattttaagcgtgttttgaataaatttgtaaaaatgaggctttttgacacaaaatgaggcttttttgcctgccaaatgaggcttttgaaaattttgatctgagagccctgtatatgccatatatttagaaaacaaaatctcgtttttaagtgcatgaaaaatttgaagagttcctggttaatggacataaaacaaaaatgttttccaggtcctttcgtccttttcctttttgctgaagacaattttacaccatagaaccgaacggacttcgatgggtttggtagtccatccggctgtacacccccgatttttgaaaattttggagaatttaaaaaatcctagtgggttacaaattgaggaaaaataaagcttgacctgagcttgaatttttctagaggctttttgtggttttttgagaaattttgaggttttgggggaaaattcgtcagattttttaaat

SEQ ID NO: 2480 - DNA, 2656 bp, Heterodera glycines
  misc_feature (2495)..(2495): n is a, c, g, or t
  misc_feature (2527)..(2527): n is a, c, g, or t
  misc_feature (2626)..(2626): n is a, c, g, or t
  misc_feature (2640)..(2640): n is a, c, g, or t
ttttaagcgtgttttgaaataaactttataaaaatgaggctttttgacacaaaatgaggcttttaaaaatttttgatttggggaaccctgtacatacccccttcctcctctcactttattaccccttctcccctcctcctctctttctcccttcctcttctttcattcttttccgccctcttccctctctccctccgcccctcttcctcctctagggctacggcttgtacataaaaagttatacttgggttgaaaattggacaactcaaaattgatcaaatttttgatcattttcccttgaaatacggtagaaaatactgatttttatcgtcatcaaattcaatccaagtataactttctatctacaagtcgtagacccaccattcaaaaggcaattcggtagagaattttgtgttctttctggtagcccaatcaaaaaatttcagaaaaattttcccagccccctaggaatttttttctaaaattttcccaatttcaagccatttttgactttcctgatcaccatgaaggagtgatctgatcaagttggtgtaaaaggctttttaaatcagtatcaaaagataagctagcatgaattatttcaggtttttaaatgaactctaaggtggtttttcaagtttgagtcaagacttttttccgccctttttttgagtcaagtctgatcaagtgaatcaatctcgggaatgaataagccaaataaattttcttgttgtgtgtggacgagtcatatattgaggtaataattatccaaaaagaaaaataataagtcgactttaaaaagtccatgagaaatttgtaaaactcattattcggcgagtaatgtaaaaaattttgagcctattaaatattttgcccgatttcttctgatacagtggggaaaaaagtcttgacgcaagatgattaaaaattttaacttttttactgaaaattagctgattattttttcttacagtatatttatttatcccaatacatgggattttcatacacccacaaattatttcaatccaaaaatgataattcatgcttgcttttcttttggtcctgatcaaaaaaacaaaaacaaacttacaccaacttaaaaaaaaagcagaaaccggaccgatacaccacaaaatatgttcagaatcgcggaaatcttcgcaaaaaattcattgagtgttggaatttctatcaacgtcaggtgagcggaggagggcaacagcaaatgcaagaagtgacatacgcccgacagtggttacatttatggttgcagatggtgatggaaaagtgaggaaattattggaatcatagatgatgggcccgggatttatatttgaaaccttattttaaatttcgaaaaaaattcttacaattagcaaaattccaaaattttgcacccaaagttctcctaaaaatgtaaggcgcaaatgtcgggaacttataattcaaaaaaaatggatgctaatcaacgaatttttttgcttcaaatcacctttcggcacgctttttccaaaaaaacgagcaagagggtcgggaaaaattttgaaactttggatctgatttgcgttaacagatgttcattcataatcttttttttcgatttagtgcaaattttttttttaatgaaaattaggatttttgtaggccggcgttgctgccattcattgcaaacgacgcaccaaattttcctccgtcgcttttacgtcggtggacccatcgcttctcaccgaaaataaaggtacgggaaaaagattttaaatttatagtaaaaattgaaaaatgtgcctttcaaaataaaatttttttttaggaaaagcgtggcaacttttttaagcttttgttcaaaaaattttttcgtttctttttaacaggtcttttacatttcccgctaaacgaaccgcgaaagtctgcgcaaaattcctggccttacacttcgagtgagttggccacgacgtacagacaaatcaatttaaaaaaatacgacaaaaaaatttttttttagggagtgaaaggcgacagttcgaaaaggcgccgttcaaatccagcataaattttcaagtaagcgaaaaggaccgtaaatttaataatttaaatataaaatggccccctactctatccaaaaggacaggttcggcaggcccgtatttgtgatccaaaagttttatgcgactgggacgggacaaaatctcgccgaaatttgaaaaaaaaattcgacggcgagattttgtcacgtcgtaggtattttgaatttattttcttggtttacatgctttaattatgtctatgaaattggcatcaaaaatgggagggtacacagaatacgcattactcccaaaagagtcaggaaaacgagggagggccgttggggctcgggtttgggtttttgcagggttcggttcacttagtcaattggcgatggacttggagaataattatttatttggggacaagtaggaaataatatatatttatttggaggagggacggattgngaaaggagagaacatgaagagaaaataataanacaattacgaatgaatatgggaaacgggcggggggatatgttgactgggtcaaagggtaaatcgataaatgggatatgaatggacaatgaacatcagancgaacgcccaattnaatcaaatgaccttct

SEQ ID NO: 2481 - DNA, 9980 bp, Heterodera glycines
  misc_feature (24)..(24): n is a, c, g, or t
agtattttaaaatatacctattantctttttgtaaaaaacgctttttaaccgcttcaatcagccttgtacgcatttcctcaacttcgttaattattttgatgtcgccatcaattgtcactgaaagatcaactcgttccaaagtggagaccaaagtgcgagcgagcggaattcgggcggagagtgtttctttacaataatgtaaagagacttcttcggtgggctttagaagttcctgaaaatattaaaacataagaatatattgaacactaaattgccttaattagtttgagaatggaccattcttcttgacttagaagcagatcgaatttcctgtttctaaccaaaaattcatcaacagcagccgactgttccagcatacgttcgatcatacgtaatgtcgaattccacctcgtacttacgtcctttgaaatgaaaattaaatgagtatttggtaattagcaacttgaagcaatttagctttcggtagcccaagttcgccttgaacatcttttaaatcatccatcaattttgccgaatgttttaaagttccaacaatttttcgacatttttcgaaaatttgtgccatttcgtctttttcttttgaaaagcactcctttacacataaattgaggtcatgggcggcacagctgattcgttcaatgtacattaaatcaaatgcctccaaaaaatgtatttgaaatgaaatgtttcataaactaaccttaactaaatttgctgccgaatcggtcacaaaacaatggcattcttttacattccaattttcgagaagagcttttagaatttcagcgatgcgttccgaagtgtgggccccatgaaatttttgaatagcgagtgtaaattttttgcgtgaaaattttgagctaacaccaacagcagtcaagctaaatttttgaatattttcattttactaaacaaataaaaaccttatgaaggaatcctttgttgtatccgaagtccaaatgtcagaggtacaacaaatgttctcaaactcagcaatttctcccttgattttgtttttaacaactttgtaaacttcaggcagaacatttcttcggtaatggctttcgtcgcgtaaattttccgaaggatttcggagcaattttttgaaagttttgtggttgattatttggaacggcaaattgcaacaagcaataaaattgataatgtccttgtccatcacacttaatttgcctaaaatggtaattaattaaaatcacaattttattcttggacccgaactccgtgttgtataatctgtgatttttggaccatccttctttgacttgccttcatccagttttaaatatatttctgcatacggcgtgtctttgtgcttggcaaacagatgggtcttgagccctttgatactccgattcgacaatttaagagcaaaatacaacgtttttttgtttacactccaagcactcgaccgaatcttcggtaattcggttaaaaagaccgatttgccaaattgggtggctcataataatagcttaaatcaaagtaaaataacatttatttaaattcctttgcaaaagtctcctcatacctaatccatgtatattataaaaacaaagtttctgtatatttggcattctgtcttagaaaattttttaaaaaatcaataaaatcccgcataatcctgcacaaaaattcaaatttgcggatcctgttgcaggattggaattcaaaaatgtttgcaggaccggatccggccggattaatcctgcaatcctgcaaatcctgttttttccaaaaaatgcaggattgcggactgggatcctgcaaaatcctgcgcaggatccggtcctgcgccgggctctagacataatcgcgaaatatggaaaaatatggatatagaaatccatcctagaagcttcaaaccaagctaaaaacatgtttttcttgcgtgtccaggaaaaaaaatatggatttccatataattggaagccctagtgatcagtgatcccggaaatccctgcctgaaaagtcaatttttgttgattattttgtgcaaatctcaaaatttttgtgtttcgtacatatattttttgccatttttatatgtccgatttatttaccgaaattgagaggttttcatcataaattgcatttgatcactgatgaattatgatcggttggccattcttaaataattcatttcttcttccactaatcaccattgtttcgttcttttgtccgtcactcattcatcgtcagcagaagacgccacttttgtgatgctttgtaccgtttcttctgccggtggcggagacaatggccttaattaagcgcaatttgaattaattaaacaaaattaaatgccttttttatttgctcacccaatgcaattagtgccaccatcaagcaaaatgatcacattgtcccaattattgtcccaatttccgtcttcccaatgaaccgccgccgtctccccaataattttgcatcgtttcattatccaaccgatgcccccccattcattttcttttgctttggccaatgtcagcttttcatttgtcgattcgttcaccaattcaaatggcaccatttgtattgacggcacatgaacagaaaaatgaatttcgtaactgacggaagaaatggcattggcacggagaaaatgctaaacaatttgaaaacaaaaaacagtgatttgtcgagattatggccacacctccttgaaattgttgatccaatcagtgttcgtttgttcgttgtgatcttcgcaatgcaatcgcttgggttggccatcttttctcggagagtgcaaccatttggacaatgcttggccagcagaaattgttgcatcaaaatcagcatcaatcgcagcgggcgacagaccaaatgaatagattgaattcaattggttaagatcgatgagaattgtcggcgaaatttgacgaagcaaattgtccaaatgatcaccatcgttaaagcgcaagtggcgaatgtttgccgaaaaaaagggccaaatttcgcgaacaaaaacatcccaaattggctggccatccgtgttgtgtggtgatggaagcgacaacaataatttgatgtttcttttgttgaaaatttggtgatttgaacgaagaaaagcgatgacggagtgatcgatgtacctaaaaatgggatgaatgcttttattgccataaatctctgattccgaattactcaatctgaagattcttaaaacggattttgctgggcagcggacggtcgggcaatggaaatggcacaaatttgtcatccatttgtacagacagcttcggttcaggtcctttgtccttgcgatgaattttgatctttctccaaattgtcaattcgcttttgccatcgaaatgtttgtccaccaacgcattgaaacgtggcgaaagaagtgccaatttgaggccgagttgggcatggtcaaaactgggcaaaatgtccatccaaacgtcgttgcaaatccaactgaaattatggaaaacagtttagctaaataaatgacgaatttgtgtgacttttaaaatccttttaccgtcggttcatttttgaggcaattagcacaatttggccgagctccgaatgatgtcacacaaatagcagaagaattaattgcgttggtaaagctttatttttatggttttcctatttcttgacggatattatcagggaacggatttatatgtttttatatatttttttatctatcgcatgaaaatctcaaaaatagcatttttacctgttttcctttcaatcagagcgagttttagcacatatttattttgggctttttgggaataaaaacatattttggggtttcggcagtttttgtcacatattttggcgattttttggaaaaattagtttttttttacaaaaatgtcttttggcactcaaattcgtggtcaaataaatgcccaataatttttcaaaattttctttttttgtatttttttgaccattttcatgactttttcacttttaaggcaaaatttgatttttagcgaagaaattccgaaaaatgagtaaatctttgagagcgaaaaaaaatttacgccaaaaagcattacattaagctagcgaaattgataaaaaatgagacttttttgagaaattaacttattttttgagcagtttttttcaatttttggcacatattttgggaatcggtcgttttggcgccgccgttttggcgacgccgttttggcgccgccgttttggcgacagggtcgttttggcgccgccgttttggcgacagggtcgttttggcgccaaaaaatcagagacgcagaaataagcggcagacaagcgcctcttcaatttggtgtagaattacattccgtgaacccgaacaatgataacgatcacaattaccacattaacccaaatcaaaatcatcatatcattttggaatttcttcgtggcgtttcgcgcaattatcatatgaacccatgaattttcttatttgtcttctttttgtttgttattgttagggccccgacttttagtgacgaaaaagtgccaaaaaagtgaattttcactattttaagtgacaaaacgccaaaatagtgatttttagtgacgaaaaatgacgtccaaatgaaaaattttttacgcggaaatgcgttttttgagctcctttcttcaaaacaattgagcaaaaaaaaagttttttcactaaaagtcggggccctagttattgttatttacatttttatgaaaagttgtaatttttaaaaattgaaatcgatcttggattcacaattttttaattttggcttggcgccaaaacggcagcgccaaaacgaccctgtcgccaaaacggcgtcgccaaaacagcggcgccaaaacggcggcgccaaaacggcggcgccaaaacgatacagactcatagaaaacatctagaactatcgaatgatataaggaattaaaaatttgattgattttaagtaaagatatgaaaaaattgctacaattgatggtaccatttgccgggcgttttaccttatccccccacccacaaatcaatcaatcaaataatcaattggatggataatttttacccaactttcatttgtaaaaggttagaaattttctttgtcaaccaaatccaacatttgttggtagcaaaaatggagaaacgagggaagaggaggaaaaggatgaaaatagcattggggaaggaggagagacggaagagagagagtgaaaaaggaaaaattcgaagcaagaaggacggggagaaagaggaggaagagagaatgaagcagaaaagagggaggaacagcagcaatttgacactttttaattttgccggtgctaatattgctaatggatgtcgtaaatccccgtcaaaatcctgaaaactacacaattttcgaaagaaaaatgcattcattcgattacacataggcaaaaaatttatgttgtggcgtgggtttgcaggagcacagcttgttccccaaatcccattaacgatttaaaaaaatcattaaatttctcagggaatttccggcaaatttcaaacaatttattacaaatagagattcttagaccccctaagaatcggtcggggccgttttcgcgtgagtagctgtttaggactgaaattggtcggatttgtgcaaaacatccatgtttcgaatccgaacccgcattcggacaaatttcttaacttttaatttttttatttcttgcggctaatatcttctacagtaatttgtcagtttggtcggatgtgcgtcaaacggaaaaattaaaattttataaaaatataacaaaaaataacaaatttcagaacaaactaaggtcgcatttcatagtttcgggaaaaaccagtgagaaaattgataatgttttcgggattcacattggcattggcataattgtgatcattttgggggaggtgaatgttattgatgtcgttatagaatgcgccgtttttgcaaattttttctcctccaccggcagaagaaacgggacaaagcatcacaaatgggccgtcttcttctgacaattagtgacggacaaaacaacaaaaacagtgatcagcagcagaagaagaaataaattgattaaaaataactttagccaatctggcatcatttgaaagctctatgtgtgctctatattcacatgtcaaaatagaataaatgattcaaaaataaaaaagttatggcacacggcgccgaaaaagccaagaaaaagtcaatttttgaggttttttggccacaacgtttttgtaaactgactaaattttttgaaattttgcaatctaatagagaatctcaagagctatcgaatcaaaaatatttaatttggttgataatgaaaaaagttgttagcaacggcgccgaaaaggccggcgccgaagtgggcggtttacgaggattttttttttccaaaaaataaccatttgaaaaatttttatttacatattggggcttttgtacatattttgggatattttaattaaaaaatgacaattctagataaaatctgataaaaacttgtgctgctccattttttctaggtcaatgacttcttttaaagaatttttttaatagcctcaaacaacaacaaaaaattgactctaatttttaaaattaaaaaaaaataaacggtagttttaatatttgccaaaaattgcgcaaaattttccaactgttgcagcctctattgtccgtcccatgtaaagcacttttaaagtgggatagattttaccggtgctaggtcgttccacaaaaaagctcagtgtgggcgttccacaaaaactcagtgatcgataaaattaaataaataaatttaattattcaattcacaaaacacggtgccgtccggttaacactaatgtacggcgggacgcgtcatttcaaattttttaatttttcaatttttgacatcacttctcgccaattttctccatttgtagtagacatagcctgacgccattgtactttttttttatttattatataataaagtttttatttttatctcatttttgccgttttcccaactttcgcctgcagcagtttgtgcctgtctttttgggtcaccgttttgccctgaacaatcaaaggcaattcgaataatgcataaatgactcaaatcaaataaaggatttttttgttttcaaaaaacatgaaagcatgtttcctagggtttggggccgctgatcacgatccggcatctattttgaccaatttcgaaccccggacatgaattcgaacaaaagttcgaaaattcaaatttttcgaactttgcatttttagtttgaaaccggctaaatacgcgtaatcaaacaggaacttatttacactttttaaggcaaaatttgactttttgtgatgaaaattccgaaaaataagccaatcttagagacggaactgaaatttcttagtcattaggactcaaatgacgaaactgaaaaataaaaaataaaataaaaatctggcggtgtaacaattttgggtacttgtgtgttatctgtgggcagattttcaaaaatttttatgtttttcgctataacttttttctttagcatccaaatccaagattgttggtatcattcgaaagcttaacatgtttcgaatctaattctatgtatcacttcgcgattagacaattaccaaaaaagttatacatgaaaattgcgaaaaggtcgaaattatgaagttttttcttaataaaattttgtaattacaactcgccttttgtctccttctccccttgctgcttttggtgtttttgttgtccctccaattcaccgattcaatcaaaattgccttttcagtaataacttaaattggaacaaaggcagtgtcctcgggcctcttctttttttgatttttataaatgaccttactaattatattccgcctgaagtcggaattaaattgtatgccgatgatgttaaaatttacatttcgcatgataatgacgcgaaaagggatttactctctttagcgttggctaacttagcaaatggtctaaagacaatggcatagccattgcgcatgagaaatgcgcagcattatatttaggaaaaaataattctagactgagtataaaattggcgagaaagtaattttaagcgtagattgtgtccgtgatctgggggttttggttgatcaaaagctctcatttaacaatcatatttcaaaaattttaaaagcggcctattacaaggcatatcaaattttaaaaatattaaaaacaaggaatatcagtaccttaatcctagcatataaaagctatataagacctcacctcgaatacgcatccgaaatttggaatatctcctcaaaagaacagagtaaaagaatagaaaaggttcaaaaatatttcacaagaatcgtatacaaaaaatgtggcctcaaggcaataccatatgaaaaaagacttgagatttgcaaattggagaaattaagtactcgaaggtcgctcactgatatgaatatgactttcaaaataattaggggcttaactcatttagacccaaaaaaatatttcgaattttcttcaaggtcgcaacgaaaaacatttaggattcaaaacaaaagattcagtaataaatctcgaaataacttttttattcgtacaattaatccctggaattgtctacccaaaacggctatggaaatcggaagtttagctaaatttaaaaattttctgagagaattttatttagaaaataagtcctgagtggtaattcatcccttttttattttattttatgtattttactgtattgaccatatcatatttttttttaaattgtattcattactttgttttccgctataagtgcaattacatgttgccttgcggtttgctcaaataaataattacaactcgccttttgtctccttctccccttgctcttttggtgtttttgttgtccctccaattcaccgattcaatcaaaattgccttttcagtaataacttaaattggaacaaatcctattaatatttgacagtaattataataataatgttacggtaggtacagtaattaaccattgctcatttcccttaactatttgacagtaaaccttcgtctgcactttcacatcaatttgtgccatgacatttttctcaagcttttcttgaaatgccatctgctgaaattaacagatttttctttttgcaaaaagcaatctattttctaaaacattaaaatattagtgccaaaaattttttatttttgtgtttttgtaagtgatttataatttgaccccaccgcgtttaattttttctccattttgtccatttttcttctccatttcattgtgatcatttttcatgttgtcatcattctccttttcggcatcagcgttcgtctgtagcatcttttacggcattttagcaaaaaagaaaatcaaattcaaaatgtgctgatcaatttgcttcattttccttttttcacattttcccaccttttccatctgatcaatgcttttctgttgttctttctgctgatgatccatttcgaccaactttttctgtaattcctccaaattcttctccaattgctcctctttcttatcaaatttttcctgcattttttcaatgccatttttgagctttcgattctcagctttggccataaaaaatgaaatctttttaacaaaaattttaaacaaaaataaagaattaaaattttccctgtactactgttgatagttccccctcatttttggaaaaaatagtcgttaaaacatgtttcttggagtttttgggaccatcgaatcgctacggatcaactatttaatccgggttccgaattcgaataaaaggtggagtgttacaatttttcataatgaaattttttttcaagtttaagtgtcgtaaaaacagttcatgttttagctgtctagtttttaactcgagatcggctcttctatttttacaagggaaaatcccctaaaaaattttaagttttgcaaagttttggcgttctgattactaaataa

SEQ ID NO: 2482 - DNA, 3577 bp, Heterodera glycines
acataatatatggagacacttttattcgcggcttttgtgccttttgtcaaaatatggtgggtgaaaacattttattttttgggtcattggatacccatttcgccatgatgaagtttgcccgtgcatgcataaaatttttttttattactctcaccgactgtaccggagttataattttttttgtgagacggtttagtcatcacaaattattgaatatttatttttcagaattttggctctagggcaatctgtcaagttatggaagagaaataaaatttgaattataattattattcttttggtcagtttaccctaatctcaaattttgaatgatacaaatccttaatgatatgacaaacaaaaaacagaaatcaagccttaattcactaatcacaaagggctctttgcaaattcaaaaagcggaaggattttgcgaattcctcattaagctcacatgaaaggagaattttgaaatttttgataggctcctaacatggatttgttttttttctttttggctttcttaaacctgatcaattttataccaagtctattctcagactgagaagcttgagatctcttagcttccaaagatggaccatttccgaatttttaaggggtactgtaactgtattggcaaaccaaaaaagacaagtgagaataatctaaaggttcagaaaacactgggtttaccatgcgaatttggctccttaggtacccgataaatccctgattttttaatggaagaaatcatcatggatagagataggtttattagcaaaaaacgaaatgaaactttcagtacaaatgactcacaacagcttattaacaaggatacctcacaggggaagctgaaggatttaatatttgaattattgaccgctcatccgagccatttccgatctgagtttttatgatcaaagccctcgggcaactctgtcaagaatgaagggacaggagctattaaaaaattatttaattgcagtcgaaagtgttaaaaaaagtaaatgtataatcttgtcagtaatggtccaatacctcaaaaaattgatttaacaacccgccagatttctatcagttcgattatcctcaagtgaacagtgagaacctttaatctttaaaacaaaccttgtcgtcaagcaaagctaaggttgagagccaagaggtgccaactatcactatttaacctatcattggtcatgtggattggataaaaatttatataatttataaataaactagataccaaaattatgtttgatagtacatggatttcaatttttggcacaattccataaactattattttaggtgccctttctgattatttcatattagctcgagatttaaattctccccttctacataccagaattttggtccgaaatttttttgtcattacttaaactattttttattctattctcttaggggaaagctgtcaagacattagtttttttaagaaagtgcctacaagtataagttttttacatcaaaaagaagtcagtatccagacgcatcattttttttgagaatgattaaaaagcattattcgaaagctcttcacaggctctattagcctactaaaaattacagaaaatttcgaactataaaaaaaagatagaaataaaaaacttcgaaaattctgccttttttgcggttttcaactgacaacttttttgagagctgattaatcactgagaaatagcttataaatatcttctaaacatctagggctttcgagtgataccatgattgtgaagtttggccaacaaagaaaaaagttatagctttttgaacattgctgagatggagttggccagacggagttgacccctaccggtgcagttgaccaattataattaagtgaatgccgtaaagttgtaccttgcctaatcactgcgcagaagtgatcaacaaaacctttttttgtaacaacggcctaatttcatcactttctcccctttggggaaacagtcaagttttctttggtctatcaacaagttttgccaaacaatgacataaggctgaattatcatttatcccaacatcatcattgtgatcgaatgcctgaatgccagaaaaatttcgaaaatataggtactttagttttacgcttttgggtttgagttctatatgaatactttgcatatgtcataacattttttctctcttttatctccacatttcgagttgacaataacctaatttaagttgtttgttaaaacttatccctctgcattaattcgcgccatttgcccacgttaaagacgggaaatccagccaattttcgaattcaatgaccatgataaaattaacagaatgccattcttaaattattagtcaatttcttcgttattgtaaatattaccggtcttgagtttctagtaattaaacaagaaaaattttctgatgaattattttattcatacattttgttgtattaaaatatcaaaaggtttcaattactatttcaataattaatcagggttggatgtgtatggtagctcatttattaaataataatttttctgtttggggaaaaactgagcttccatgaaatttttcttgaatagtattgtatcatgaagaatttttttttattttaaagcggaattttatcaaaataaaatttatcacacaataatgatagcctttcggggcatttgtcaagcagcagagactttgtgttaagtagagttgctcggtaccggtaccggtaccggtactggccggtaattaccggtttttttggtaccggtaccggtaccggtaccggtaccggttttttcaaaaatgaaagtaccgttaccggtttgtctagtaccggtaccgccggtaaaaatttgcactggtaagaatgggggtctggtcgagaaaaaaataggaaattggtgaagaaggagaaatttttgagaaaaaaataaattttatttcgtttagcaaccatgcatatgtggtgtaatggttaaaccttttgcctttcattatttttcgcttgggttcaattccccactgggatagaatattcttcatattttctttaccattattttaattgaaattttaattaaaaaaaatattccaactttttttctttcattttaagcatcctaaaaacccaaaaattaatcaattggtcttttttttacaaattctgttaacaaatcgcattaaaaatacaaaatttttcccggcggcgcctatcggcaccgccggccctccttgttccccaaaagtcttgagaaaaacgtgccgcgaaaaaagcggtgttgaaagcaaaaaaggtcattgatttacattaatttacatggccggagacccttcgcaaaattggaaaattggccgctgatcccttgttttgcaataatctgaattttgaggtctacatctgaattttagtgttctttatcctgaatttgaaaaaaaaacttggtcaccctcaatatacatatacttctgaacaattctaatgataaaaaacaggcactcgcgcgaaaactgaataaaaattttgtatttggaaaattttgtccaaaaatttttacgttggaaaattatggttaccggtaccggt

SEQ ID NO: 2483 - DNA, 5618 bp, Heterodera glycines
  misc_feature (29)..(29): n is a, c, g, or t
tttttcactagaaatttctaaaaatttcnaaaaattctcaaaatatgtataaaaaaataaaaattgccaaaaattttggatttttttttgaggatttccaaaaatttccgtaaaaaacccgcaaaattatgtaaaaaaaatcaaaatatgtaagaaaaagtccaaaatatgtaccaaatatgtataaaatcccgaaatatgtaaaaatatgtaaataaaagtcccaacttttgtttgcaaacataaaaaagaaagtgtttttcctactatttagagcatggagaagccaggaaaaaaatatgtatttacataaaattgacatccctaataatgaacaaaaacaaatacaaaattttcgattccattgaacacaatcgtttcaaaaaaaattctcaatttccttatccacctaattttcacccagacccctttcttaccagtgcttatttcgacccgaaacccgacccaaaatcatcgggtcgggtttcgggtcgagaaaaaggccgggtttgggcatcgggtttcgggtaacccggaacaaccctgctaaaaacccaaaaattaatcaattggtctttttttacaaattctgttaacaaatcgcattaaaaaatacaaaatttttcccggcggcgcctatcggcaccgccggccctccttgttccccaaaagtcttgagaaaaacgtgccgcgaaaaaagcggtgttgaaagcaaaaaaggtcattgatttacattaatttacatggccggagacccttcgcaaaattggaaaattggccgctgatcccttgttttgcaataatctgaattttgaggtctacatctgaattttagtgttctttatcctgaatttgaaaaaaaaacttggtcaccctcaatatacatatacttctgaacaattctaatgataaaaaacaggcacacgcgcgaaaactgaataaaaattttgtatttgaaaaattttgtccaaaaatttttacgttggaaaattaccggtttttaccggtaccggtaccggtaccggtggaaaaagttggtaccggtaccggtaccggtttttgcattaccggtcagtaccggtaccggttttttagcaattaccgattaccgagcaactctagtgttaagcataaaatgtattttttttagtgcattagtgcattaactaacagatatgagcatagtataattttagatttaatacagcttggtaaaattgccagaaaattcaaaggttttgtgtcttttgaatatgccctttgtgcttaatttagaaatatgaggagaatgacgttaaattaaattcagaaattatttaagactgtcaaatccttgcaaaaaaaatcaacaaaattttttcttgctttgatttctttcaatgaaataaattctttattcttatcaattcttcgatcagcaattatttgaattcatattcgagttgtattaatcctgcttgttcgcaagtctagtcatgaaattttttttaatcaagtatttttttttagaaagaaaaatagaagataaaattttttttgcatgaaaaaaggaaaattatatttcagctcgtattcgaccataattttttttaatcatttttgcattcttttttcaattaagccagtttggttcatcagtttagttctctttttatttgatgaggtttaaataatagaataattaattcattttaattttttgaattaatactactgataattaattttgcctgttagcaggcattgtcatggatgttccggttaatgattaatataccgttaaaaaactaatagaaaataatgcatctttattattttttattttcttcattaagcctaatttatgaggtacaaaatgttgtttttttttacttccttgcatttttccctctagaaaattgagtaatactcacaaaaacctatctattcgattggtttagaacagtttcgaataaaattaggttcattcgaaagcttatactttgggctacccaaccacttgccaaatatttttatcttaaccttaacacattttaaatcacaacaatcgaacccaagattttaaggatttttatattttttgaaattattattattagagctcggataaaaagtcactaaaatcggaaaaaaacgtcaaaaaggcaccaaaacggcaaaatgccaaaaaaggcatttaaggcacgaaaatcacgaaaaaggcaaaaaaaggcataataaaagtcaacgtagaagcctcaaaccaagtggaaaatgcgttttttatgcttaatatatcgaaactagtgcgcagaaaaaaaaggcatatgcctcaaaatccgagctctaattattatttataaattaacatgataaaataactttgtattttattctacttttgtatattatacagctttttccattaaaccgtcttataccaacagcaaatactcagaaaacggatgagcaccaaatgccggagattgctttcccaccaatgaactcagattcaaattttgcatactttcaattatgcattaatacttaagcattattgtgtcttaattatgtgagtcttatctacctattctcatgggtaacatgacaacataaccttcggtttcatttcaagataagaaaaggtcatttaaacttaaatgtacaagcaatctgcttcggcagcactgtcaagaaaatcggaatattggtcaatagaaacacgttaaattaatatactatctttttctctagctaattgagaaatgccttatatttgttttcaacttttacataatgaggaatttcctgcggcgaattatttaatttttttttattacaacttttcgctattcaaaaataaaagtttcaaggcccacaatttttttatagtgcattgtcgcttatctttttcgcttagaaaagctttcgtcaaggtcatccaattcggctgcaaaaaaatcaattaataaagcttcaaaaatattttcaaaaataatcattttatttttaaagaaaaataaataaaaacattaatattgtggagtggactcgaccctcctccttctttccgtttacttcttacaaaaaacttttttgccacacacggcacctttttgataaaggagttcattttcgggactctgtgtaaatggcattcgtcattgtttagaataaataattttttttaatgagttaaactttgacggaagcaaacggacttagaattagaaaattataaactcagtgttttgaaatgtgttgttagaattccaatgtgaaaagagcggtgaagcattgagaaaaaggcaaactcatagcagaaaggactttggtacatcagtcatgcaagttccttttaaaatgaatgccttaaaacctaagaggtttttgtaatttaagtttttattgaacatttgacaagacaattataacgaagccgtaactgattgttgagcgtaatttatccaaaatggatcaaaacttaaatttgaaattatagaccccattttcaaagtctcacgaaatcattttgcaattattttttcttgtttacaaaaaaataatttgaattatttaaaaaactattgacaaaaaataattaatttttgatttatttactctaatatatacatttttagccagcacttattcagcaagtaaacgccttaaaatccgtgcctataaaaccaatttttttttctcaacatttcataatcatgacattattcacctatcggatataaaataaaagttttgttctggtcattccatgtgattaaaaaaattaacccaatcactgtctgtttgacaccgattctaatattttcagtcaaaatctaatcatttatgatcattattcccatgactttggtcaatcagtcacgttttgatgcttattttttaaaaattaattcaactcaaaagtagctcaatcaaagtttgtggacaaacttaaaggaagggtggacgtgtaaggcgcaatttatcacatccgttcaatctctttctcacaccatttatccccgcttttccccatctttattccgttccataagtccaactatttaatcgggagcattctctcgataaggagtcagttgagcgggcagttaatcggcgagcgagagccgagagcagaacgcggcggaattattattaatgtaattggccaatatttatattattattttactccttctcgcccatccccgcacgcgtattagatctaataggcgcccatgggattacaaatttggggaggtcatttatccagggcccggattttggcttattcctttttcccccaaatccaatccccaatttccctcgtcccttcctcatattcagggctggacatcagcaccttcactcgattaaattaatagttctgttgaaaagtttattttcaataaatgtttaatatttaattctttaaattatattgcaatttgtgcagccaaaggccaaaaaaaatacaaaccttttcttattttgatttatttatcatttatgagagatttatgaaagttggtaaatttacaaattaattgggtttttttgtccctaattcattaaagaaatccgatccgtttcttaaacatacatttttatttcattttttaatcgtttttttaattgtccagacaattaatttgttttatcaaattaatgcggtttctttttttgtttgttctttttttattataatgccattaattaaatttgttaaagattattaattaaatgcgtgaccggaaaatcggtcagtggaaaatgcgtcagtggaaattgtcaattttttaaagagtaaataagatgaaggctggcctaaggcatcgtccggaatttttttcacaatatggatgaattttgagaagaaaaataatttaaattaattaaatttttttactgtggcgcaaataccacagaattaacgtatgtccacattcgtgaatggcgaatttttgctgcattttcttaatgcctcgatttataaaattccctgtacggttgccaataagtcttactcgttaaaaatgccatgaatttgaattacttatccacaatccattaaagcgaattttgttgggcaatggatgatccgacagcagaaatccctggggttttcgttgaaaaagttttgcttcttctccatctttacgaattgttatccatctccaaattgtcagttcatttctgttttgccaacatcaaaatgtttgtccaccaaagcatcaaaactgaagaaatcagcgccaattgaagccaagttgttctcgtaaccggaaatcggtcagtggaaaatgcgtcagtagaaaatgcgtcagtgatataaatattttaaaataaacttctatggcattaatattgtaatacagaagtaaacttctatatgaaaatcgtactcaatttcgaaccccggacccgaactcgaacaaaaagtcgaaaagccaaaattttcaaattaggttttttcttaaaaatcagattaaatacatgaaaacaaattaaaagccaatcaatcctgcaataagagatcatctatgccgtttttgaaccaaaaatgccaaattcgaaaatttggactttcgacttttagttcggttcgggtccggggttcggaaatggccgaaatg

SEQ ID NO: 2484 - DNA, 7662 bp, Heterodera glycines
gttaggggttcgaaattggtcgaaatggaggcctgatttgtgctcagcgcctcaaaacacccctagaaacgtgttatatggattttcagaaaaaaaattaaagaaaaaactttcgggaccaatgatcgacatgattgccaaatactcgactccaacaaaaatggagaatctctattaggattgaaaatcccaaatacttcgacaaaaatcgtaaattttacccataatttcattgatacaattgcaaattttcggtgaaatattagctcataatcattagagatgagatttttaggcaaagcctatttctgcactcctttttcatcgatataagcatgtaaaattaactacatggtttggtaaaatttcgaaaataagggttttttcaaattaatcctataaaatatggtttttaaacaggaaaatggctgtttggctatttttgctacctaaactcatctctaataatcacaatttcctgctattacgggtggcgatatcattcgccgccgccttcgcccgtcaaatttcgtcgcttcctctgtttttgcttcgttttgccttcgcctgtatctgtcgccccctttccgttttgataggcttttgtccgtttgctctttttcccattttgcgcgcgctggaggaaaatccgatgatggaccttcctcttcgagcagttcatcattccgttcatgcagttgaccatctttgagcagttcatccccttcagccaattcgctccattcaaacgaatcgtcctttccaaagcgttcctcctcaacaagttcgatccattgttcatcactccgttcagtttgttgttcgtcttccctctcttccaattcgtcgtcctttccaatttcttcgtcctctttctctgctcttttctcacccaattcccatgttttctctgattgtttcgtcccattcttcctcctcctcctccgacatttctttcctccattccatcaaaatgttcggttgttccgtccgaagggtcttttcgtcgtcgtcgtcttcgttcttctcaatttcatccatcagcagctgatttgatggggacacttcgccaaagctaacaataatttggattaaattcgtttcctaatatttaaaatttctttttctctttggacaaacttttcgagtgaatttgctgaaaagtaagtggtcgaagaattgaaggaatcgtcggacgtgaaggaattgcgtcgcgcttctctgtccgaagaggaagagaaggagcagaaggaggcacttgccatgtccgattgagtggcacaaatcccaaagcgaacaaaaggcatcgaaatggaaggggcgcaatctcttcgaccgaaagtgtcatttggaaagtcaagagtagaattctgatggtcgagaggtgaacattgattctcccgagggaaattttggtgttgaggagtctcggaattgttgcaaatatccaatgccatggaattgcttgagctgaagctggagtatttccattcgtcatattccggtgccgtctcgaaaccgatgtccgaaattgccaaggaggaggaggagggagaagagcgggtgtcagctgcagccaattctggcgttgagttctgttgataaggggagaaatgttaacaaaaattaatggattggatagaaaaggggaaaagtgccgtaggatgccaacactgactgggaaccgattgcccatcttgccagcttatttgaccgtagttggccctaaccatggataatcccccttccaattgtaatttggaaatgccgcactttccctgtttgtgttcgacctgttcatttcgttcaacagccgcattttcctccacctcttctgagtaactgctgttttgctccataaacaatgaatttgttgtggtggtcgaccgatgggcgctggaaatgcctccgaaaagtggcggaatggtcagcggaccgggcaccgcgccggcctccgttctgtaggaacagtcctcgtcatcgtccccggcgccatcatcggacaaagcgtagacaccgtttgagttcagcgagccgtacttaaggattggatccatataaattccttatcggcttaacttcattttatcggattccccatcgcgagtctcaaaatgagtcctttgtctgtttgctccccaattccaacggataacactttatttacccgttttctcttcctccattgcgcttcaaaagttgcaaaaaatgagtccgtcgtctcattgttcagtatccattcgctctgttggagctcctcaaggcttacacggccttcgggggacgggcaaaggcaacggcggataatggcacggcactctgtggggagaaagaaaagtaaacgaatgccaatgccaaagtgtttctttgatcatttttgaaaatatatgaggactctgatcaacataattgattaaaatattatgagttttctccgttaattatggccaattttccccccatttttttctcatttttaaaagggacctgacgacacattgcgcgggaatcgcaatttccctgtacaaatttggagctcattccgaaagggcggcttcccgaccaccaaaaggtacagaagaatgcctgaaaggtcggcaaaatggcgaaaaaaaaaattcgaaaaaaacggaaaaaaagacaaatggactaacgacgagggacaattggaaaagaggagacaattgacacgacaattttaatttcgaacagaaaaatgaaaagatttattaaaggtaaggtattatttcaatttgactgtcttggattgaaaattgcaaaaactacatggatttgaaatttgatgtaattcaatcggaaaataaataaataaattaattataattaaataaaattaattaaaataaattaataaattaaaacaaataaagaattgtttgtacccaatgaccacactgtgccctccaatgggtaaaaacagtcccttttgaacacctgcgaacaatcaatcaaacaataagtgatttgttcaaattatgtgtttgccattcaaatgacctcaggcggcgagtaggacaaagtgcctgacgaatttggggaaatggccaaaaacgaacggacggaacgaaccttgaaagcattgtttcctaaaggattttgaacattggtatgcttctcttttacattaatgctaaggctgcctaattgatgaacaaaggataattgatcaattggagtcaaaatagaatctcgtgttcagttggctttacattcggaattttgatcggatttgccgggattgtgatgggcttcccaatcctggaccattcatgcacctttgtctcgatttcgttctctaaacttacttagcacgctcgagcagttcggctgctccgaagtcgaccagccaaacagtcccagaatccaaatcgaccaccacattttcgtcttttatgtcccgatggatcaccgagtgtttcttgtacagctcaacaacggtgtccacaatttgcacaaacagtccgcgtgccattctctcctccaaccagccgaaggtgttgatcaaatcgaacagatccataaagttggcgggccgttccattacaatcaaaaagccacggcgactttaacggcacaaaaaaccaatgaaaatcagtgatcagaaagtaagtaaagaaaatatgtgtaacaccttgtgaaccatccaataagacgaacgacgccctgaaaattcgaatggaagggacagtcgaataagaacatgggaaaagccaaaaggtccgcttccaatcggcacgccgacctgcacatcctggcattcctcgatgaagcaaatctccgtggggattattcgccgttcggccatcgtccatccattgactcttttgtgccgaatgcttttcactgccaccggaagtccgtccgcaaggcgataggcccgaaattatgccatttaaatagggtttacaaccgcagaccgataaagttaattacaattaacctaagtaattacccaggttttctcagtgaacgatggaatgagaaaagaaagactcactttgtaaactctgccaaagccaccggagccaatttcaccgcatatccttcaaaataaacaacaaatgcttattccagatttgttatgcttatcccctcggggacctgtattgacggtggaactccctgagggtgtgttctgaatttggggtttttgcagaaaacaaatggacaaaagggaaggggggcactgacctttgtcatggcggagacagccgaaatggttgaacagacaaatggacacgtccaacacctttttgagcacaaagcccatttcagggaatggcacttccaaaaattaagaaaaagctcatagactccgaattttgaagattttttgcaaaatgaaaaatgctttctgaatgaatgcatcagacaaaaagaaatgacaaacaaaaggcaaagggcggcccggggggaggagggatcagcagagagatcagtagagggagagaaagcactgatggcgcaaattggggagggggagatcgatcagaagaaaccgaccgaccatttgaaaggtgacaccgacggaggggcgagagacaaacatttgcgtggggtcggcaaagagcgacggaaaaagcttattttacgatcagtttaggctcaggacaaggaaaggcggacgagttcttttttccgtggattgggacagggaaaaagacccggggggggggggaaagtaaatcctttttttttctcttagcattcggcccattagcagtaaaagccatcggtggggccactcattgcataatcttcaaaaatcagaagaaagcgatgggaggggaggtgagctgatcggacgctgcgcttcttatacttttgagttcgcgcacattgggaaaagcaaacggaggacgaaaattggggagggagaagcaatgcttaacgaagggaacgtaatgaatcactcaattgggctcaaattagcaacaaatccgtggaaatgattcttaaaaatgcactgctgagcttcaaatactttagcattttaaaattggcaagaaaataaacggcgaagggttaaaagcataaaaaagggatggcattaaattgtcaaaagggaaaagcaaaggattaaagagggaacaaagcaaatgattgatgaataaaggacaagcacagaatcagatcaatcaaactcagctgaattggctattttgaggggaaaatgccgaattaagcgcttcttctttttgttggtggcttttctgtttttattttcaatatttcgtcctccgttggctcatttcatcgggaaaaggtgttccaaatcatcgcacattcccccccccccgccctctgatcaatgaatgagccatcgttcgccctttcatcgatcacttttttcaccccggggccaattgaatggcttatgagtttttttttgcaagtaatttttttgcatcatcactttattgttgtcaattctctgatgcgttacctgccgatttccggcttttgattatcttctttcttttgccaatactttttcgtattgctcccgctctgatttcaatttgtaaataaaaaaatgcctgtgccgaaattgggaaaattccccgtcaaattttgacgaattttttcactttgcgttgcttttcccattgtcccatccccgtttttctgtcttcttccccatttttttcatttctctttcatttcaattttcctttgagggaaaatgagaaaaatccttccaaattttcattccaatttgttttttgtaatttatcaaatttgaggagcattgcctgcgctggacatctgctgttgtgctgaaaggggccgggcttatttatgattggatgtgttttataatatttttcgtggaaggaatctttggagaattaattgaattacagctttcaaatcctcgaccaatccattttaatctgaactccttaattgaagtgcttttcgtcagtttcgggcaaaaattacggagttgttggccaatcacactttgtacggcttcaactcttctccttgtgctgcttgaacttctcgtccctcccaaatcttcccatttctttgtccatgtccttcttcaacttctcccacagcttccaccgttgtctgtctgagcacagtcttcgcctttccgaccatcccattgagaccattttcatcggctttctcctcccccctctgatcgctttcggattgatcggcaattgtttgaatctgtgcgttttgctcggtcctcgcgttcacccgaccatacgacggttttgcaccaattagctaattagctgcagcggtggcgtaatcaaattctgactgtgaatatgcctctcacctctctcttaaaggggttccacaggaattaatcctctccgagtcattagtacaaaactttgctctaaaatgaccaaattttaatacttgatatcattgatagaactaaatgttctttatgatcctctaaaatttcaaaaaaatttattaactttaaaaaaagttatggcaaaaaatgttcgaaaaccaaggttttttgagttcctcgagctataacttttttgaaaattaacgaaattttttgaaattttgcagactgatagagaacacttagggctatcgaatgatatcaagaattaaaaatttagttgctttagagcaaaattataaataattattcgacaaaaattttcataatgatggtttttaaaataacgccctttatgatgttttttaaataacgacccgtcccagggataatccctcgttaaaatttgatccctaattgcgcccaccactgcccgtgccattggtttcgcttttcgttagcctttggcactttgttcagttcgaattcccttttggcggtgttggcactgctcgacgtgcttttccttctactgatgttgccaagttcattggcccattttacattttttgctcgtcagttcacttttcgacgggtttattttgccacaaaggcattaaacattgaaaagttggccaattcgtttactaattgcctaattaagatccctcttttggcactgataaatcaatgttctgccgctgcgatttggtgatttttcaattaattaccattttaattacgttaaaccagggctgggttaaattgcatacgtatacttaaattttgattaaaaaatatatgtaaattaaaaaccctcaaagcatgctgaccccgacaaacccccgaccccgacatttcacaaccccaacgttgggggtttcagccctactgcaaaaagattgaattaatcagcagtggtttgagaaaagcttaacccaaatttaactgaaattcttttattttgcattataatctctaaataaaaatttatgatttgaaaatgaatttaatttgctgaataaaaatttaatttaatattttcacctttcgctatttacaacctttttgggcgatttaatttcacttttttgtcactttttatttttcggtttggcccagccctggttaaaaccaattaattaaatccaaatttgccttccccaggattatgctcggcatttgcctcgagcgtttggtgggcattcggcgtcccttttcttcgcgtgtgcgaagttcgcgcggcggcacccaattcttcgtaatggccgtcttttgtggcactttcctgctgacaatgaacatttatt

SEQ ID NO: 2485 - DNA, 1917 bp, Heterodera glycines
tgcataaaattcatttttatttttatttttaattattgaaacccaaagctttcgaatttgtagttgcggcagtgcacacaaatatattaaaaatatgcttgtcttccttcatcaattcactctcaaattcggactaattatggcaaggaaagaaaatcctaatgcaagcaaaagccaaattattagcatttttagcatttgtattggagaatgaatgaagcggccgcttggaagagaagcgaaatcgatggaaatgcttcgccgcctgccgattgattaacgccaaaaaaatccctccccccccccccccaccttttcaattccttcatcttattcaatggaattaacttgtaaacgcaacacaaacaatacgattgttataaaattacaaattgcaaaattatgtgcaaggaactaatgggaaatgagcaaaagtcaaaaacaaaactatcaaagtaaaacggtaaacaaaaacaaacccaatattttacgcactctgttaattttgagaatgaaattagtttttttaggaagactaatttattcactgtttacagttgaaaaaatgaaaatttcataatacatatttcacgattcactttttaattttgattttttcatagtattgtaaataaggaatcatttgcttatttaaaattcaactctttttttttctttaacgtttcgtttatttgtgaatttgcttttttcaaatttagcgtgacttaagataaaagaaaatgtcacatggttcgcaattaatcgcatcatccatcatttttatattactaatttcgctaatgaaatgatgcaaaggaaccatttacatttgtagcaataaataatgaatctaatcagctaatcgcttctgattttcactgcttttttcaataaaaaattccgcgttttatacagaatattttgcatttgttaataattttgttaattgtcatcaattattattattattcattatgcatccgcaaggccaacaacaaaaacagcagcagcaaaagcagcaacaacaacagaagcagccgaagcactctccgcactccattccgatagtcagcagaatgggcggcgctgcgttgagtcacccccaccactcgcagccgtaccaccaccagcagcagcagtggtcaccgggggcagcggtggcgccggtggcggactttggaccttcgtccgccccttcggtcagcggatccatcattttcatgccctcagttgtcagcggcgacaacgctggtggtggtgggatgggcttctcctccaccagtgaattcagcagccgaatggcgttgctcatccgtgacgtgagttgggtatgtgttttggtgttgcacccattgcattttggggggcaaagcgatgtgtcggtcccacaaaatcaaaaagaaaaaaaattatttcacattttgacgaacgaaaaaaacaaaatgtgatagtcccaccgcatgtgccgctgtcgtgggttccccccccccacaccgccgttgttctttctccctcccctccggcgctggctgttattttcattatctttgttattttcagggtgcctccgtttatttatcagcttcctcttcaaacaatgatgatgatgaaaatgaatcagacagcgaaatttctccaaattgttggaaagaaggtaattgtcatcattttgaaaaaaataattcaaaaatttgagaaatttctcatttttttcagaattgcttaaataatgccaaatttaaaataaaattaatgtaaaaaaagttaagtcaattaatttagtgtccgttaacggcaacatttactcgaaaagagaagtgcgctctcctggtaaatgggagattgcttcctgaaaaacaaccaaattgaagtaactcatcattcatatttaaatattgaaaaaattatttctaaaaa

SEQ ID NO: 2486 - DNA, 4384 bp, Heterodera glycines
  misc_feature (15)..(15): n is a, c, g, or t
  misc_feature (21)..(21): n is a, c, g, or t
  misc_feature (42)..(42): n is a, c, g, or t
  misc_feature (47)..(47): n is a, c, g, or t
  misc_feature (55)..(55): n is a, c, g, or t
  misc_feature (144)..(144): n is a, c, g, or t
  misc_feature (178)..(178): n is a, c, g, or t
  misc_feature (4284)..(4284): n is a, c, g, or t
aaaaaaagtagcggncaatgncaataggcgcaatttggaccnaatgnccagtttntaattaaagtattaattacactggtttaccaattattataattatcacacttttgttaacttatctattattatttttgcactttttcnccttaattgggcttttttattttaatttttaatntaagggttctcggcaccactttgccccaaattgcgtggaataaggccggcattgcgaaaccgggcgccgtcatgcttagcgtggaacaaccgcgcgatgcgatgcgcgtcattgaggaacggtgcgcggagcggacggtcaattttatataattataaaaaacatttactgatcggcggtgggtcgttgattctatctattgggattgattaaattcggacatttcattttctttgattactttacttactgtatttcttgaaatagaatccatggctgatcggtctgtgtttcaattcccttcaaaagggaggctttgtttcagtgggggggggggctgtattataggaaatacggtatttaatttgatcgctttcaaacagccgttgattattcaatcattttaccaaataaaattaatgagtttgaacccctgcaattatttcattccttattgattcactgattaattttatgatcattttaattcttctgatcatcctctgctaattctcacttttgggtttgttaattattttcaaatatttaatcagtaattcttcgtcgttttattctcagatcatttattaaattaattatttaatttgatcacttttccccgcttttcagtgcccccttttcattgtccctccactcaccgattatcgttggccttcttccaccggcggtcaacggccgtttgaacttggcattgccggcccgcatcagcacatcaatgcttcgttggcactccaactggcacgcatttggctgctcaaacgacacggacggcacattggtcggcaattttccaaaaaatggaaattcctttttaggaaactgattaaattttttaaattcattttagaattttaaaattatgttttttattccattattttgtttcacaatttcccagaacatatcttaatttttcttgccttttctgaaattattgcgaaaaaaagggatgggaatttatttagactaaaattcgaataattatgatttcctaacagactaattatatttaaattaaaaactaattctggtttaagaagctgatcaaaatggcacagaaatagccaacaaaagcagcgacactaattcaaatgatctccagcaactgctccaacttgatgggaacaacaccgtcgacaaaaaagagccgaatttcccgacaaatcgtttgaacgcatttgcattgactcatggttagtcagccagttaaaaatggtaaagtggatagtctattcttcccgttgaaaaatggctttttatgaattaaaatttaaaaataaattgccccaggcgttgcgcaagcgttagccaagtgccggtgggacgggcggagtcagctgttgcgacaagggccaaacacagtgttccacttggacggcgcgcacaccccccaaagcataaaggcatacattttcagtttattttacaaattctattaatttaattttcctaaatgcttttcaatgctatttcttgcattcctctttcgtttcccttatctctcgcttcctttcttcccacagtttgtatttttaaaaaattttaaataataaaaaaaaatctttttaaaaaatcaaaaaaactcttcagttctgtgcccaatggttcctccaaagtgtcggtgccaccgtcacagcgccgtccgtttcagtcattcgcattttgttgttccattgcaccggcgaccgaagttcggcccaactgttgccaaatttaaaagtaaaaaaacacatttaaaaaccaaggccaatatttagggatgcgaaaatttttttgttatttcctaatttattttttaaaggattgccgttttgacatggcactgttctgtccggcgctgatctgtccgcccgatcgtcggcccaccgggcgctcacttggccaagactcgaccaacgtcaatttggacctgagcgcagagcttcgacgatgcgagaatgatcaacaaatttggcaacaaattgtaaattaaaaaaatgttctttttaatttctgatgaatttttccccattgtcttattattttgaaaaattacactgaaaaaaaaacatttttatgattccccatcaaatttctgtacggacctgcggaaggtttaaaaaaattatattttttatctatttgtaaatatattcctctctgtgtattattcgaacgtttctctattaaagcgattaaatatattttattttccaaaaatggtcgaatatttaagggatgatcagtttttttttctaaaaattattttaaaaaattcctcattcattttcccataggctcctggccatccctccgctgtgttcagttgtgtttcggatgcgttggacaaagtgcgtgccgtggcggtggagaacagcaaaggaagtgccggcactgagctgcacgtgttggtgactggcagtcttctgttggtcagtgattggttgggcggtggattttttcggggtgggcggggggtcagatgggtatggaaaataggacattctatataaaatgtttccttgagtaatttaagatttttttatcagattgaaaaatgttttttttttggttttctcaatttttgtcagtttcatttctgtataatgttataatatattcttacaattatttttaaactatttatatctatttatattcctttccattttaatttcaaattaattaaggaaaagttaaattacttaaattttaactattatgcgagacaaaagaaataattgtgcacagaatattaattaaaaatttgttattttttatctctcttgatgaatttttacttaaaccctcattaaaatgcccaaaattatttttatttatttattcaaaaataaaaataaccaaaagaagggctgtgtcacttacacttttggtggaaataaggtgaaatgggaagtactgataaaagacaattgaaattttgactggagaagcagaaagtagaaatgtcagacctccaacaaagggaaatttggttttttataggggttggagaaaaaagaaatttttttgaggaaaatttttaaagaaagtttgaagtaggatgttttgttttttaattttatttgaagaaattgttggaggtctgggtgaactatttattgaaaagatgagggtattgttttcgagcgattgatttggtgaacaattttgtcgttgttggcaatgactttaatgcttcataacatacgaggattgtttcgtcaaaaactttcgggatgtttggaaatgtcttcactgtcctcgttctggtttggaccctttgcacaacgggagtttggtcatttttcgtttgtgagagctgtgttggaggtgccaatcagggctgcatttttctattttttatttaaagggctacccgtatttcgatttatttaagaattaaaatagatttataattttttatttgttgttgttaaggctatttgggtagttcgcctagaaaatagaggcatcacttttttgtcacacctatttctcacgcattttatgaaaattcataaaaccttagccaggtgaggggaggaattccctcccaccccctcccccgcccgaaatgaaaaattaaaaatttttacaggaaaaattgtgactttaaaattttttttgtcgatttttcttaataaaatcattaaaattaaaaaaaaaattgcccgtcggcacctatcggcaccgccggaccacgatttactcgattttaccttatttttttaaattttgactacaaaatggcaaaaagtagtcttttttggctaaaaatggttacaattcctgtttttgctgtccggcgctgaacttttttaaaaaacactaaataaattttaccaaaaaaaattcttcggattcccccttaatttttttctggctattaaaatgttgaaattatatacatatacataaatccgattataatgatcagactttcaaaaaattttcaaaaatcaacccataaattcaaaaagaatgatttgatcagacacaaaattataaattttttgtaaaatttaaataaaaaatgaagaaactccatcaagaaaatcagttttttgatttttattaatcactatttaaaaatttttttctanaattctgacaaaaattgatttttaaaaattacggattattacgggaaattacggggtttttggaccccgtaattacggatttccgtaactgagaaaatcg

SEQ ID NO: 2487 - DNA, 861 bp, Heterodera glycines
cgcgttccgataggcgagcggcattgctttccgggaggccaatgaacaccaaagtacgttgacgttcttgatctgcgagtgcaacagtgtttgggtccaggtccagtgtagctgccattaaacgtttggcgcgaggcggagtgatgtttgttgcgttggttcgcttcatgacgattaattgggaaagaatatttgttttttgcgatcttaaggactacagaagagccattttgtgttttcatcatcccttatactctatactaagtgagaggaagctccgcccctttttgcgtttttgaatttgcttggcgttatgtttttagaggaagagaaaaagaataaaaatattatttattttgaagagattcttccaaatgatgaatagagaaagcatgcatatggagagagagtgcagcatgtttctcagtatgcgcgtaaattttggttttattagttcttaagtttttctatttgaatctgacgcttgtacaagaactcgtacgaaaatgtcccccgtacgaaaacggcggtacgaaaacgacccccctgcggtacgaaaacgtccccgtacgaaaacggcggtacgaaaatggtggtacgaaaacgaccctgaccgtgaaatgggtgtgcgggagtgggtgggaataaagaagtgaagataattagagagagataacgagagagggagacatgatggatagagagagaaaggaatgacgggtagagtgtcagatgagagaaagtgagatagaatgaaatgaaggaaaagaaaggcagagagagcgagaaagaagatgtgagagagattgacggagagaatggaagagagagagaaggaatagatagagagaataaggtgag

SEQ ID NO: 2488 - DNA, 6185 bp, Heterodera glycines
ctttttttggctcgaactttttttatacggaacgaaattttttggaattttgcaggctaatagtgcatctgaagggctttcgaatgataccaagaatgttgaatttggttggcaaagaaaaaagttatagtccaaaaactccgcccccacgcgaaaacggcccacgcgaaaacggcctggcccgaccaaaaaagccttccaaagtggcggaatttacgaaaagaacaaagtccaaaaaccaaaaaatgtcattttatcactaaaaaatggaaactttggcaaatagtatgtatcattgcgtccaaactctacacaaattctggttattgctgcttgagaccaaggaattctcgagaccgacactcggaaagtcttgacataatgcaaaaagctaattttagcgggtaaactttttaaattttaaaaaatcgcttcattcaattagtggtttaggccttagaaacaaacttccatcgaaatataaaatgtatttaatgtactaaaatagcaacaaaaattgtgcaaaaactgtcgaaactataaatcttttcgactgtaaaatttgcaaaaacggtccaaaaattgcattaattcgatcattcgattgacttccaaaattaaacagaatttctaatatacaaatcacaatagttaaccgtgacaaatttggaaacaccaaaaaggcacaaaacataaaaattaattgcattttttgtttctgttttgtgcctctccaaatgcgcaccttatagagtcgggggcgtttgggccccagtttttgggcccccgcgtttgggcccccgtttttgggccctcgtttttgggccccagggtcgtttgggcctcagggtcgtttgggccccagggtcgtttgggccccagggtcgtttaggccccaagtacagaaaaatgaaaaatcacagtaaaaacaactttttaaatttcagcataaaaatgtaaaataaacagtttaaaaataaattcaacaataattttaacaataaaaaatgtaaaaattaacagaaattcacgggttcattcgatagttgcgagaaattccccggagaaactccaaaataatgtgaaattgattgcgattgtggtaattgtgatcatggttgatgttgcctgcattcatcgggacgtaaaggggcctgggctgtccaacgtaattgattaatagcctgtaaattcagtggggtttaaatttaaaaaaagttcacacaccagtcaatcagcggttggaaaaccgccaaatttccgaactccgtatcaagtgccgctaccgccattctaatgtcacacaagggcacgaacgcaacagacgtgatcattcgagcgttctcggcaaacacagaatcggtgcagtagcgctgaaacgggtcggggtcacttcggcgccgcaataattaaaaaaaaaattattaaaacctgccacaaattttgttccttcaatttcttttgcaaatttcgcacaaaatggaagaaacaaaaattgatttgacaccctccaaatacagttgtgaccgcattgctcacggccaattcgaaatcaattgtgaatgatgtaggtgcaaatgttggccatgcctgatgtaggagctcaaacatacgaatgtatgacgcctgcgacttcgatgtgagcagaaaatggcacactggtatgatccatttgcctcgtctaaacattgcaaaataaaaaaatttctaaaaactaactaacctagccaaaattgtataaatttgataaaaaagtggaggcgccaatgaaaaggtcccgtcaccgaagcaagcttccattcgatctgcccaccggccaaatgactcgcgtccgaacaacaaaattctataacaaaagaaaaataagaaaataattgtcattttacctctgtgggttctcatttcctcgttcataatatacgccgctgtctcataacaggaactgttcatcgatgccgtccgtcggtgtgtacgtctgatacgccgggctgattataagctgctcaagatttgcaggaacgacggggggcgcattcacttctcggcgagctcttttgattaactaaattggaattgtttttattatatgaaaaatattttgttttcacatcttttgctgcttgttttgacaccaaaattgccgacggagacgggacattttgaagcgcttctgctctgatgacagaaggcggttcgaaggtggcaattgcgcgccttttgattgcggtcgtgaccatttgagcatcaacacgtgacgcatctgctggacatgtgtgcggagttgcgaggcgaatgaattggtcgtggaggtccgtccagattcggccgttgcatttgtcggtgctgtttttgaactcgcatctccaaaattttgtcatcccatcagaactcattttagcgaaggtgtaaaggtggccttcgtaagacaattttactttttgttttttggttgcaattgggttagccatttctgaaaaatgtccaaatcagaatgtacatcaaattggttaactattaaaaaataataggatttggaataagtaaaattgtaaaaaatgagcgaatgttaattaaacctaacttatgccaagtggcgagggatccctcaggcttagtttttagaatcttaatttttaaaaaagcacatttttcgatttttgggttggggcccaaacgaccccggggcccaaaaacgggggcccaaacgaccccggggcccaaaaacgggggcccaaacgcgggggcccaaaaacgggggcccaaacgctctggtcccccttataaaaaggaaagggccaaatgaataaattcaaattcaaattatcatcaaaaatcatttttaaaacaattttttaattctctaattaattaattaattatttcaaaatgatttcttctcaattttcccccatcgttttgctgctgcttctgctcacttttctgctgcacttttcttcattggtcaatgctcgtccccaatcgtattacgctgacgcaatttcgatggcatacaatcgcggcacaattttcgacaatttgtggggacggaagtgaagcagaaaatatcaattgccattggtgcatattattgtaactttactgttccatttgtttaataaatttacttttaataaaaatgttttaacaagctaagccacggatattagcagccaaaatttttatgaaatgctaatggttagtgatgctcgggaccaaaaattttccgagacataagatcaagacttgaccccaagactcggcctcgagaccgaaaaactcgagactttttacaaaaaattttcttattcgcttaaaatcgtttaattttttttgactcttttcttaacaaatttttcgttttaattttaattttgattcaattaggtatgtactgtatttaatatttatcaatccaaaaaccacaaaacaaagtagtttttttcacagtttttagttttttttttgatttgacctcgctaaaacaaggacaaatccgagctgtgagaagaacgtcaaatcatttaaaagtaacacaaaatcgaaattgatctttggcttctgtttttctatgatccaccgccgttttctccttatttctttcctttgccgcaatattggcacaccgcttggcagtaagggattttacagtcacatccattgccagggcatcggggagaaatagcttaaaaatgtgaaaataattaccggtacggcgcatttcggcattgccggactccaaaaaataatgtataggcattaataattccatttttaacaggaaaattgtaattaattatccaattcggatattgccatgttccgtcgtttttgactaatctttcgtcacacatttgatcaaaaacaatcaaaaataaatatttttggctgatagcccaaacaaataaatgcattcactccattaaaatgtaaattcaaaaaaggcttgagaattttcaaaaaaaatgttgccgaaaagcttctttgacttggttacttctttgaaattatggaggattttttttacgaaaaaaaaattccaaaatggcggatttatgaaattaatgaattatcttctcaacacgtgaatctcattaatttaattaccacgcttaaaacggaaaatgcgtttgtctccagcagctgctgccatttgtccatcttggtcatccacggtggtcgcattgtccgattggatcgtcaaagttaccaggagaagagtgatcaaaaatgggacagcgaaagaggacattttgccaattaaagttaattagtgaagaatgaggaaattaacggcaaaattaattaatgataaataccaataaataaactgatcacgcaatgatttttcagcttctttttatatattgcacatttgttgataagtaaatgtgtcgtaaacatgattgattattgtttttcttaattgccatctcaaagaaaaaattttcaaaatcgtaaagtaattaatgacgctcgtactcccgaccggcgaacaaatattttaatttcattgataatttatttgcaaaatgaaaaatttatttaaaaatttaaactgcgaggtcattcaatggttttgtgtgtaattttttgtgaattttgcatttatccgtactgatttgtgagtgagataaatcgcttttttggcgttttcccaatttctataaaaatgtaaattttggaactaccaattcagcgacttttctgttttgggatccggttttttattatcaaattgaaaattatttctttggttgttcgttaattatctgagaattctaaaatgtcctaaattacaaaaatgttccgaatattacaaaaattttctgctttttaaaaagccaaccagaaaaatgacaatttattttttcttcatcatcagggatgatatgtatagttatttcactatttttttcctgagctccctatagcctgaaacgcacgaaaaacatgtttttttcggctgttgttaagctactttttgagttattagaaactattttctagttttttatttttagcaactaaaaaactataaaaatgtgatgtcgaacgatcttttcaatttacaaatctattttaactgataatcgctcacgtctatctcccgaacaactcgacatgttacttatttgcaacgtgaatctcaataatgatttggattaatattgtttatttttgaataaaattttgttattttacacccctaaattcggaagtttttagcaactataaatatcatccctaatcatcatacattaatctatttttttaaattttccaatattaaataaattctgccaaattgtgcattttatttgaaaaattagtaatattttaaaagaatgcatttgaaattgtgcctattattctgttcaatattatttttgattatcctaactgatccgatcgaagcagaaaataaaaaattggaacaaaaatcatttgaggaaatatttggagaaaaattggaagaaaaaagatatggagaaatttgtaagaaaattggggtttgtcttaaattaattaaaaaatggaagaaacaatttggaattagccaaaaatttgcactaattatttctttgaaaatcgtgactttttgaacttggttatataaaaaatttttattatatctgcgaaacaaatcaaattaattaattgataaattaaaaattatatcaaaatcaaaaaatatttatcaataatataaaatgcgataataataagtattattcaaaactaccttataaattagctaaaattaaatatggcctaatctgttttatgcaaatcctaattgagttttccatcggaaaattgtgctattactaacacccaattttcgcgcaattattttttcaattgttcttgtggccttctggttgaatttgttcgtgaatttttcttttattttttcaaattttgcaattaccgtattttctctttttatagacacggggggataaatggagaaggggggattatttttcgacagatttattttgtataaaatttttgatattttttagaacatgtcgccaaaaaatgtcatcgagtcaaagaaaaatcatttttaattgcattttttaaaataaattctgctttttctattttttaactatctataatgcacaaaaaatacattctttttcaaaaaattttgttttagcgccactttcatcact

SEQ ID NO: 2489 - DNA, 1706 bp, Heterodera glycines
  misc_feature (1516)..(1516): n is a, c, g, or t
  misc_feature (1579)..(1579): n is a, c, g, or t
  misc_feature (1601)..(1601): n is a, c, g, or t
  misc_feature (1637)..(1637): n is a, c, g, or t
attcatttttagcagttttggaaaaattaaaattatgtaattcaatcaatttacaaattccattatttggtaatttagtgaacattttgcatttttgcccgagttttccataaaattagagtaatttttaaatcgaaaaaaatttcgataattgaaaaaagttagttcatcttaaagcacaataaattttaaaaaatactgatttttaacaaaaaaaactttaagtgttcaattaactaaatgtcatttaatctttactcggccattgaaaatttaacaaatcagacagtctcggaagataattcttatttaaacaacaacaacaaatgtcgagaatttagagcggcatcggcgcttttgaaaaaatgggctctatttagaaatccgccgggaaacgttcgtccaagtactgtttaatgtccaacagaaaatgtctgaggttggtacacaacgccccaaactccgacagaaatggctgatgctcgcgacggaagctaacactgaccatggtgtaatcctgaaatcaatgaaggcaattaagaacgaagtgtgcgcataattacagacaaaaacgcttaaaaatgcataggtaaacgaccgcctatttacataaattggctcaaaattccaaaaatttgtcagcaccgcaaaaaaaaacaaaaacaatttttaatgattttttatttggaataattcaaaattctaattaccgcaacttataattttttatcggccaaatgctgattttataagcgggatagatacgtactacgtaccccgctcccaagaaagttttaatgacaaatttgattaaaaatatgcagtgcatttttgtcattttctggacaagttagcaaataaattggggctaaattaaaaaaatttatccggcgccgcctaaccatactcgtgatttttttgaacaaaacacagcacgaacatagatttgcgaaaagtaataaaaaaaatgtcgaatttcgagggttaatcccattaataaatgtgatggctgaccacccctcgctgactttgggttcgaatatggaacacctgcgcctaaccctgtttttcaaaactgaaaataaaaaattctttttttcaatataacacactttgctgccatcgaaaatcgcatgcagaagcagtgcaccataaatgtcagccatcgtggccgctgcggcattcaatttcgcacagagcagagaattctacaaaatggaacaaaatttgaatactttaattaaaatggctttcccagtttaacggtcatattaagaaagaattgccgtccaaattctaaagtgccaaaaataataaaattaaaccattttccaagaggctaaaaataaaaaaaaaattatcaatttaagaagaaaaaatatatgaccatattttaagaaatgtaaaataaattaaattccggacccgggatcctctcctggtcccgatcaaattgataaaaccaaaaaatttttctcgacgtcgcctacgggcaccgccgtccaccaaaatccantggtggtttttagcgaacaacggtcagaaatttctgctttttccaggcattgaaaatattaanaaaaaactgggagaaaaattanaaaaattcaaaaaaatcgtaacaatccaacgtacanatcgcgattgtcatataggggggggggggtttgtttttgtcaatcacaatcaaaatttgaaatttgagg

SEQ ID NO: 2490 - DNA, 5975 bp, Heterodera glycines
atataacacactttgctgccatcgaaaatcgcgtgcagaagcagtgcaccataaatgtcagccatcgtggccgctgcggcattcaatttcgcacagagcagagaattctacaaaatgaaacaaaatttgaatactttaattaaaatggctttcccagtttaacggtcatattaacaaagaattgccgtccaaattctaaagtgccaaaaataataaaattaaaccattttccaagaggctaaaaataaaaaaaattatcaatttaagaagaaaaaatatataatgaccatattttaagaaatgtaaaataaattaaattccggacccgggatcctctcctggtcccgatcaaattgctaaaaccaaaaaattttctcgacgtcgcctaacggcaccgccgtccatccaaaaatcaatgtggtttttagcgaacaacggtcagaaatttctgcttttttccaggcattgaaaatattaaaaaaaaaactggagaaaaattaaaaaaattcaaaaaaatcgtaacaatccaacgtaccaaatcgcgcatttgctcaaatgggtggttgtttttgtcaatcacaatcaaaatttgaaatttgaggagataatcagccggcgagtccgtttcggcgaccacaaaatacttggccgcaatgtccagcgtgtggatcgaaagaaacgggagacagttggagtgaaggcgcaacagaattggccatttttggagcgggtaaagaagctcacatttgtaagcattttcgcgctcctaaattaaagattagtttaattcagggcttcaatctgtccccatttatcagagaaatgtcctgatttgaaaattttgaatttttgaccccgattttgaaaaattttcgatcgaaaccctggtttaatataataattattatttcctaataatggaaatccaaacaaaatatatatagaaaataatgttattatcatttaaatgaaaaaaaagccattcaaaagattaaatttaaaaataaaaaaggttgcagtcaaaaaaagtttcttaaaaaaacaataaaaaagtcgcacttgaataaaaataattaaacaaattggggctgaataatattaccacacgattctatatcaaattaattctaacaaaatactattttctaaaaagagcattaaaaaagccaacttaaagacaaaaaagtgagttttcccactgaaatatttaaaagtcgtagtgaataaaaagaaatcaaaaaactgaatttggctgaataataatgccacatgtttttatataatataaaatttatttttcttattgcttttaagggaaataaaagcagcataatttcgacgttaaagataacgattttcacttacaataattgagaatggctttcgccaatttttaatattttttctgcagacaattaaacggtaaaaaattgcgcttattctcaacaaacgctttacgcccaaaaattttagtggctccataaaaaggagaagctcattaatgagttcggctggaatacaaaagcgcaatttctgttgtttttgtttcgttttgtcgtagcaaaattgcattgttgttgttgtagcagttggaatttttggcttaaaattgttggaattcgtcaccatggttacttggtattttagcaatttctttaatatgtgtcctcccccatatcagtgccaatgtaagtgttcattaattaatcaataataactgataaagaataaacacagacagtcttcaaagacgaagaacataacagtagcaaattgaacattacaaaaaacattaatttccattatattgacactcactaacgacatatttagcaacataacagatacagccgaattacaaattaatgtttaaaatcaaagcaataatgttagagacacaattggccattgtgagtaaatataattaaggggggggggggtcggagacgaaagattatgaagtcaactttattcttagttcataaaattttcccatatattttaatgtgatttcttaaaaattttcgttaaaatgatctaattttgcgatgttgatccattttttttaatgaaaatgaaggtttttggcaccctctgaggaaattttttaaccttagatttccaaaattttatctagtaaattttttatgaatttttgttcataaattcacgaaataaaaggaatgggcgaaaatttaacattaatctttaatttgaaaaaatcttagaaattgtttaattattttgccttacgaagacgcctctctctctattgccccttcgtctccgatcttttcccaaataagaagaatataaacataataattcggatgtgtatttttgttaatttcttatatgtattgtaaggtttattgaatcgaaaaaagcataatcgtcaaagtaaaattgtactttatagtcaaattttaaaaatgtattaatttaggccacagaatcttatattaatcagtgattaattgggaatttttgtggaacaagtataattagagaaagtgataaaatatggagatatcataggattgcaccacttaattgagccttccaaagagcattaattgaaaactcatattcacacttattaaggataaaaaataaagaaatataaagataatttcgctctcaatttataatagaagaaaatgaacggagacaaaacacgaagatgacgaaaatatcaaactataaaaaattaagaagagttatttgaaataatatttgttagattttgcttgtaaattagagtaaaacagtacttgcaactttgaaaatcgatcttgacctttatttttatgatattaacaataaaaagaatcagatgaaaaatagaattatgaattgtcaaatttaatgacagagataatgcggcagaaataaagattcaattctggacaaactcgaaatgtaaacaaattattctatcagaatggcttgttttaaataagcaaagggcaattaactaacaaattaattaaatgattgggtatttccttaagaaaaaaaaacaaaaattataagagcagaccagaatactaataaagataaagacaatttcatactttctaaaaggtgggatttaaagattattaaagaataaacaggagggaaaggaaatgacaatgtgtagatggataaaagttgttgtggtcgtgttcaaaaataaaacaaaaaatgagcactattaaaataaacaccaaaaaacaaacaacaaaaagcgtgctaatacaaaatgcttgtaaacttttgagccttgccttaattttataaatcattcataaaataaatttaaattatatatgctatgtgaattacatgggaaaaattaaaacaataacaaagtcaaaaatctataaggtttacggagtattcttgcatattacattataaaaaaattttatattttggtatgaaaattaagtaacaaatttattaacaaaaaaacaatttattaacactagttagtgtttgaaatttaaacccaaaaagcggaccttaaagttgatacatgtaaaaaaataacatttagtccaatattaaacaaataatttgaggaaaaattgcatattcacaaatattgttcaatgttagcgattaaaaaacaatatagtcatttttggcgatatgttttgtcactctttgcttggtgagggagatgatacattttcaaaaatcaaaggagagtttttagggctataattttcaaaaatatccatgatatcagcggaccggaataagggaaaaattgacttaaaatgaattatatgcgtcatggacgcggacaggtagccaattatacaaaatcggacgattccgaattctggtcaattgggctgtaaattaaaaaaatttacataattttcatgatttttggaataaaaattcttagaaaacacaataccgtaaaaacggcctatttaggcttaggaaaacttttaggtatttaaaaattggttttaataaaataatgttttttcgaacgatacttttcaaggacatataattttgtcatcgaagaacgaataggaaccatgtatttacattttcatccagcaaaaacatcattttagaataattggcgaataatccgatttagatttagttggcaaaatgccatttgtgaaagctaagtctgggtggccggcgacaatttgatacaaagttacaggcacaagacaggaatcgtttgatacatattttagacaacacacatttttatgcattattgcaaaccaaaaggtgcaaggtaggatatttcaagccgagagcagagagtgcaccccaattccatgttcagccccccccccccccccacccctttcccccaccaacttcaacggttggagtgttcggttgcgccattttgtaacagtttgaggacaaagtctgtaataaagttaaagtgtataggcacactctttttgggaaatgaattcttaccaataaaatttggtagctctttaaagcaaggcaaaaggcagcaaataacaggcttaaacaattataaaataagcaaaaaaaatcattaaaatgaaaaataaaagcgcataaaataacgctctaaacaattaaaattaaaaagattgtgcaatttaagggagacgcaattaaacaaagcatttgtttattagcattgaacgcataaaatcatttctgagtgtcgaccaacaacatattgtagtacaatcaaattcgccgttttgcattgtctgactcaatgttgtgctaaaaaatgcaaaaactggaagagaccgtttacgaagttaataaattattacacttagcttcaaaataacaaaaaaacgcattattgatcaaaaaataaattttgatttacaaacaaaaaatgacgaaaaaaacaaaattaagagaaaagttattaccaacggcgccgacccggtcggtgacaaatgttcccgtttccgctgctcgcggcggcatcgtccgacctttttttaaattggttgttgccgttgccaccgccttttcatcgatgtacatctccaactcctacaaatgtggaaaaaatacaatagttttaaaaaaaaattttataggtaaacatttgaaaataaaattgttttattagtgactaacacggcgaagaaatttgcgggctcatctccaacatccgctcgttgaccagcatatagcccatgggatcggaggacataatgacatcgaccttggaatataaagaaaaaaaataaatttgatcgaataattttcaaaattttagactgaaaatttttttattttctcgactgttgaaaatgcttattttactggcgaaatttgtttaacaaaactctcgaatatatctattttccaagtgaattttttaaataacacaatagattttcaaaatgccaccgaatttttttccccgcaaaatttaatccctaattatctgctctgggaatttcacctcctcaattttggcactcatcaccacatcatagagctgaatccatttgcgccagccaattcctcaaaaaacaaaaaaaaatgaaaaaaaaatttttttttttttactcttgtgcagccattagaggtctattttcccaaaatgccaccgaatttcgatgcgaatttttttccccgcaaaatttaatccccaattatctgctctgggaatttcacgcctcaattttggtactcagcaccaccatcacagagctgaacacatggcctcaaccaattttcgtaaaaaataaaaaaatttttactctactgtgtccatacattgaggcctcgactttgaaaaataaaaaaaaatgaaattttgaaaaaaaattattccaccaattgtgcagcaaaaaagaataaataaagagaatcaaaataaaaatagtctttttgtagaatcaaacttttaaatttctatttttacaaaaaatattaaaaaattttcaatttttttctggagttcgaataaagaatttttttatataaaaaaa

SEQ ID NO: 2491 - DNA, 4162 bp, Heterodera glycines
ctctttttgggaaatgaattcttaccaataaaatttggtagctctttaaagcaaggcaaaaggcagcaaataacaggcttaaacaattataaaataagcaaaaaaaatcattaaaatgaaaaataaaagcgcataaaataacgctctaaacaattaaaattaaaaagattgtgcaatttaagggagacgcaattaaacaaagcatttgtttattagcattgaacgcataaaatcatttctgagtgtcgaccaacaacatattgtagtacaatcaaattcgccgtttttgcattgtctgactcaatgttgtgctaaaaaatgcaaaaactggaagagaccgtttacgaagttaataaattattacacttagcttcaaaataacaaaaaaacgcattattgatcaaaaaataaattttgagtaacaaacaaaaaatgacgaaaaagacaaaattaagagaaaagttattaccaacggcgccgacccggtcagtgacaaatgttcccgtttccgctgctcgcggcattggttgatgccgttgccaccgccttttcatcgatgtacatctccaactccatcacattggcttggcttacaaatgtggaaaaaatacaatagttttaaaaaaaatttttataggtaaacattggaaaataaaattgttttattagtgactaacacggcgaagaaatttgcgggctcatctccaacatccgctcgttgaccagcatatagcccatgggatcggaggacataatgacatcgaccttggaatataaagaaaaaaaataaatttgatcgaataattttcaaaattttagactgaaaatttttttattttctcgactgttgaaaatgcttattttactggcgaaatttgtttaacaaaactcttgaatatatctattttccaagtgaattttttaaataacacaatagattttcaaaatgccaccgaatttttttcccagcaaaatttaatccctaattatctgctctgggaatttcacctcctcaattttggcactcgtcaccaccatcagagagctgaatccatttgcgccagccaattcctcaaaaaacaaaaaaaatgaaaaatatttttttttttttttactctacattgtgcagccattagaggtctattttcttttcccaaaatgccaccgaatttcgatgcgaatttttttccccgcaaaattcaatccctaattatctgctctgggaatttcacgcctcaattttggtactcagcaccaccatcacagagctgaacacatggcctcaaccaattttcttaaaaaataaaaaaattttttactctactgtgtccatacattaagaggcctcgactttgaaaaataaaaaaaaatgaaattttgaaaaaaaattattccaccaattgtgcagcaaaaaagaataaataaagagaatcaaaataaaaataaaaatagtctttttgtagaatcaaacttttaaatttctatttttacaaaaaatataaaaaaatttcaatttttttctggagttcgaataaagaattttttatataaaaaaattaagaagtatagtttatagaatcaaaaaattgaatttgatcaaaaatgccatacaaatgcctttgcgtgggcaatgacaaatttgcgaatttttcccgagcgatgcttaattttttcatattttttcggggtgaaaaattttttttttttaatattacctatatattttttgcaacaacgaaccttcccagaaaccgtgccaatttttgaaaattggccgctgatagggaagcggcggttcgggtgattctctgtagcatgttctgctgctggaacagcaagccacagaattgaaaattggtcggtggaatctgttaagaaattggggtggtaaacattaattttaaataagcgtttttttgcaatttaggttatttgtacttttcggttttgtcaccatgttccataaaaatttacattaacgacgatcaaaatatccaattcataaattttttaccaaaaacctaagaaaacaaaaaatttaaaaacaaaattttttttggggggggggggagggggtgtttcagccggtaaccgcgcccctcccaaaaaaaggtactttgtaagtagatttttggacattatatggctcaatttgtaagattttgcgggttccaacaaccaaagtgatacattacgatcttgtcggaacagcgagcaatttggaaaaaattgtcggcggaacctgaatgaaaaaaaaattttttcatgaattaagtggtgggggtgaaaaagcgaaaatttttttacaataaaactccaatcattactagggctgggaatcattttgtaagattttgcgggtcctagcaacaaaaatgatacattaaacgataaatgaaaagcttgctcggttctcgagccaaactccgagtgcgttatatttgcagatttcaccatcaccactacggccgtcaatgtcatcgtttttcgtcccattttccgctatttctgcagtggttgtgccgaatcgccgtcggcactgtaaacgttgatgccgtcacatattcgttttttgcagccgccgtagcccgtcgttttgccagcagcggtcccgtcgccagcgccccgggacagcggcgatggactgacgccgcaaaacgcgtccaaattggtgcgaaatgtggcgctcttgggaaaaccaaaagagccaccacagaacggagttaggagtcaccagcgaatggggagataaaaattactaactttcaaacaaatcttaacaaaagttcattaaacattacacagcaaaatttgtagtattttcataattaaccaccgatacaccacaagtaccaaaaaagatttgttttctggaaaaatcctgatccgggtcagtcagtgttcatgtctaatttgttaccggatcaggtctcctgaaaaggatttttaatcctgaattccgttccgggtcaaattccctaatgctggttcagatttttataaagtcggggttttagtaatgagtagagtaaaacaatttaaaaaaatgatgcgaatgtatggaaagaatggtctttggtaagtgttttgttacacaaaaatcagcaaataaatcaattacttctctttatccctcacctacacatttgaattcattcacatgtacatatatcatcattttgacaaaaattgcctaacattataaaaaaaatgagtattgaaacgagggcgccaaattcaaaaatctttttattcccaactgatcaaatctaagcaaacataattcttagtcgataattggtgtttgaaaggtttatctgatcaaaaatattaacgtgaacaatattttaacaaaaccggataataaaactaacgattcctaacaattgttggtcaaaggaaaccgatttgtctgtcgaaaatagaattgagcaatgtctgatgttctccgatcttcagcagcagttcgtcgcccttgtaccgcatgaagcgctcagactaaaacaaaaaataggtttttgaactgtgaaattgagtctgtccaacctgcttgttcaaaacgtggtgaaggtgttcgattccctgttcactgatccatgcgaaccacccccaacgcttggcaaagtctggaccatgggcgagaagccagtgtaattttggggtgaatccagcggcattgtttgtgtcgaatttagccggatgagtttcccaaagtttcttgaaaaggggaaaatgagaaaaacagaaaaaaagtatctttgccttgaaatagccattgagcatttatttgagaaattgtcgatttgttcttgggtcatcaggtcagcacgtccaaaaatgtggagctcccgaatttcgtcaaggaggtcagcaatgtccatcgaaaacggtgttccgatcgagctgatttcggttgaggcgagaaggaggcgcttcatgtgatcacctaaaattaatttgaaaaaaggaaagaggtgaatgtcaggaccagtatactcttgcgtcttggcatgccgaattgctcccgattttgccataatttcttctaattgacgtttttctacgggtgacccatttttttcaaaaaagtcaatgcatttccgtccggcggagtgaaatgtgtgaaatggtgaaggaatcacatttgtcggtggcacgaatt

SEQ ID NO: 2492 - DNA, 4520 bp, Heterodera glycines
ttaagcgttgggagtatttgtttttaggcgaaaaaatccctcttgaggaaaaggaagatataattaacaaaaaatatgaactttgtggtaaatttgggtgtatgtgctgtgtgtatgtgttcaccagtacgtgtgtgctgatgatgatgatggttggctgcactcaccacgcccagtgttggtaatttcgtcaatgctttcataccatttgcagcctttaccgttaaattgtaaataggaagagttggaagaatgtgaagcttcacttttggtgtcctcctcctcctgcgcctcaatttcagtgaacaatcgaccaaataatcgccctccctttttgtcgtcgacaatttcaagcagttccatcggataataacggtcctcaccacgcgtaaagccttcaatgatgcatggcacataggggtagtgcaatttgacacggtgacgagcgtaaaaatgcgctgccacgttaatgttgaacggcttacgcagacgtccatatgctggttcaaatgccgcgcctcgttcagtcattccaccaacgaggaaagatttgcgcattccattccgatccttgtatgttgtctggacctttttcccaatcaattgctgcaaaactcggactcggtcctctgggtggttcagtcgatcgcgaagtgactttgtcgggcaggagagaaattgagcacaaaattcgctgacgagaaccatttcagattttttatgcctgaatgaagaaattcgagcggcttttataccggtgttccaactcaaatggataagctccgcccctttttattttattgcatgcataattaatgaatgggaaataaagtacgaaaataattaaacgttggaagatgtaacttttaggtagaataatgcataattagtaggtggaagacacaattttgaaaaaattaagaaattgaaaatataatttaactgttcaacattttatttagcattaataatgaatacatgtcagggtttgaacaagttttgagaatatgtataaatttatcgaatgattttccatgggacatgtggtaaacaaagacaatacaatggggggcacatgttgatgtcaatggggactggtaggcttcaatgtttttgtgtaaacctttgggaaaattatttaaaaaggatgatgaaatacttggtggtatgggaagggcaaggctatcaaagtaaatcacaggcacgtccaagtcccgggcataaatggcacaccaatgggagccccctttgtgatgggggtcacggttcacaatgagtgccgcaggatactgtagggtggccggcgaaggcaattggtcactggcgaaacatcctcgaaaaatttgtgacgtccgttggttttctctcaatattttggtgatttgtgtgctgtccattacgtttcaaccaaaaaacagagcacaattggtgtaggaccaaactgacgataagcatcaaatacagagccaacagtgcccagcaaatgatttgttggaagaaattattttcctttgaggagtctttgcacaattgaatcagtggaggcaaaattgaggacacttgttcatctatcagcttctcttgcttagggggttgaggatgggttgttgtggtggttgctggacttgccagccgggtcgaagttgtactgggaagtcgtgtcaataatttgcgtcttagatactctgggacacgcgttgtactgggttgagggctgcttttgggccagcccatttttagtctttttatatattcggaatatgatgctgatacctcggttgtttgactggacacaacatcgaaattaattcgaagtatgaagaaaataattccaacatttttgtaattcatctttattcaaatgatagtggcatacaaaaaaaaatgacagccttaaatagtaatgtctgtgctaattgatcgatttttgtctaacatcacaagagagtcgcattcgcccatcaccaccagcattatccccccggtgggcactgcctggttgaatttgatgctcaccgctgttgtcccgttctttatcaggtcaaacagcgcagcttgatcatctccactgctggtcaaattgaacacataaatgcagtgggtttttccgaactgttcatagctaattccattgctttccaatgagttggcgaatcccactgcttcgttcatgtcattgaaagggcgaacatatttccaatttgggtagtccaagtcgtatggcgcttggggaaaggagcggccattagcaataattgagatttcgcgcacattaaacggttgaaagttgaacggactgcgcgaaattgttccaatatagtcagaattagccactaaccccattgtgatacggcggggaatttgatccatgaacaaattggctgtaaactcgaaacgtccatgactaatgaacattgatttcatcagcgttttcctcacagcatatcgtgccggtttcacttcaagttttcgcgcaatgtccaacgccagtccatccatcaatgagacttttttcacatacattttcaaactgacaacctcgaagcggtaacgaggagcagctgcagcaccctgggcaacagcgggcgtagtgattaggacaaactcgttgtcgttgggtaaaatttcaatgtccaactcacagaagttgatcaagtagagaggttggttgaacaaatcggcgtcaattttggcaatgaattgcgctgttctgcttctcgcaaacaggttgcgtcgcgcaatgcatccgtcccctgtctcaagcgagccgccgatgtcacggtaatagcccgccgcattcaaatgcgagtcctttgccgtattggaataggacagctcatgtgagaagtatgttttgtaggccattagtgaattggagttgaaaacttcacgtccatttatgctcattttgatgtttcgaatgaaagtctggccgatcatctggatcggagcaacttcgtcagctgcgaggtcaatcagatgaccatgctcattttctttgcgaattcggaattcactttgtaagtagcatttggacaaatcaataaagttttggctggagtgaagcttgaagtggtagggagtgtccgtcagtgggttactgggaagcagctcaaacacttttgatgaagagacgctcacattggtgggtggaatacgaaaaaagtctaaggcattggtgattgagtttgcactgtcattatcaattttatggaaagccatttatttagtaaagtccaaatgcgtctgaacgaatacgtttgtttcctggtttgctgattgtccgtccaattatggtctgatggcttggtgcatgagatttctttctttttatactctttcttcgaccaccgccaaactgttttggcaggccgcccttctcaagtaccgtatcaattcctttctttccctcgctgacaaatgcctccttaaatggcactccttcgtttcccactctctccagcactcgctgccccgtgctcagtgcctccgatcctactgtagtgccaacacgacgaagaatgggaaggaaaaagcgccaaagtccgcgaaacacatcccccacccctgcgcctcgttgtccataccctcgttggaaggggctggaccctcggaagtaatcctcgctttctatgccacttccgtattgcatgtactcatcatatccgataatgcttgggtcgaacacaatatgaaccattttatttgcgtaaaatgagtgaatgaatacaaaaatgagtgggttttaaaaatttatcactttcttaaatattaataccaccatggtcgtgccataggcgaatggcaccagtcgtcccttgtccatcgtgcgcagctcaatttcaatttcgctgatctcccgtggcagcactcgagcgtatattggcgaatcataaatcttctcattgtagtcaccgggtgtggcaccgctcaccgacaccacgcgaagcagcgaactcagcgaattaccaacaatcatgttctcggtcagtccttttgagtagactgcgaaacttgagaagccaccccgtaagtcacagccgtattttgagatttcttgaggcccaacgtgttgggggttttcaaatccaagcacatagcctagctgaggtgagaatgacaagtgactgatcactggatttttgaacaccaccttgaatcgctcaaagtcatcaagatattgtatttctacatcatcgacaatgtttttgaaaggatcatatggccattcggactctttgtcatcgtcgtcgggaaactcgtctccggcagctaaaccgccaaaaaacctatcatccacatccaatctctttgattccttattgctttcgtttggggcttcgactgatcgtttagcgtcctttgctatactctgtggtggtggtggtggtggtggtggtgatggtgccggaattgaagtaggaataggcttaataggaggcgacggtggtttcggtgttgttggtgtaggcccaatctgagggggggaactagaaatagatgttgtagatacggtagtt

SEQ ID NO: 2493 - DNA, 2131 bp, Heterodera glycines
tcccccccccctgcccctcgtgtcccatcccctcgttggaggggctggaccctcggaagtatcctcgctttttatgccacttccgtatggcatgtactcatcatatccgataatgcttgggtcgaacacaatatgaaccattttatttgcgtaaaatgagtgaatgaatacaaaaatgagtgggttttaaaaatttatcactttcttaaatattaataccaccatggtcgtgccataggcgaatggcaccagtcgtcccttgtccatcgtgcgcagctcaatttcaatttcgctgatctcccgtggcagcactcgagcgtatattggcgaatcataaatcttctcattgtagtcaccgggtgtggcaccgctcaccgacaccacgcgaagcagcgaactcaacgaattaccaacaatcatgttctcggtcagtccttttgagtagactgcgaaacttgagaagccaccccgtaagtcacagccgtattttgagatttcttgaggcccaacgtgttgggggttttcaaatccaagcacatagcctagctgaggtgagaatgacaagtggctgatcactggatttttgaacaccaccttgaatcgctcaaagtcatcaagatattgtatttctacatcatcgacaatgtttttgaaaggatcatatggccattcggactctttgtcatcgtcgtcgggaaactcgtctccggcagctaaaccgccaaaaaacctatcatccacatccaatctctttgattcctttttgctttcgtttggagcttcgactgagcgttttatgtcctttgctatactctttgggggcggtgatggtgccggaattgaggtaggaataggtttaataggaggcggcggtggtttcggtgttgttggtgatgattcgatctgagaagttaatttagaaatagatgttgtagatacggtagttggtacagtggacttctttgcgacatttggctcctttggtttagctgccagagttggtggtattttagggatattctgcgccttggtcgatgaagcaggagtcggaatagttgatttagatgctggagtgggtgttggagttggcttcggcacagccgctgttttggacggagaaggcttcggggccgatggagcttgcttaatgggtggaatgggagcgggagccggggaagttttggttgtagcaggtgtcacacttggcttttggggaggtactgtagcagattttggagctgcctgttttggtgcctttggcgcttcagttggaggatgtgaaggaggagcaagtgttggagccggcggtatcggttgcttagtgacaggaggaggtgttgcttctttgacttttttatcctctttctctgtctcatcgaatctggggggagactgaggctgctgctgctgccgtgattgttgctcatctgtctcatcatatctcgggggagagggcagtgaagagagatcatcaattgttgatctcttgaggcgcttggcgtgtggaggcgagccgagcactaccggtttatcgaagtacccttcttcatgcgcaagcggcttaagtctgactttttcttgactcttcaatgttgcttgtaaaaaatccctgagttgctcaacttttttgtgcgacgcctgtgggacaggtactctgatgacacgctgtcggtcctcatcaacggaatggagattggtgaaatgaatgtcaatccattggtcatccaatgtaccaattgtagagtgccatgagtagggatagctgatgctatgcaacccacaaacccacgacccactaaaatgtagaggttttggaagacgtaccctatatttgttcggttgattgtcggggtaatccgatacattacttggcaaaaacacaaagaagctatttgatgtcattagaaaaagatttatccaaatgtaaaaaataatgaacaaactgaatgcttttatacaagctgagattcatcgatccattccctctcgggatagcctatgaattttacacgtatctcaactgacccatcgggttttcttctcttcctgaagaccttctctattcggtagcttgtctcatcatccttacgtacgcgtgccaactcctgctcataaaaagtgcccctgaact

SEQ ID NO: 2494 - DNA, 2820 bp, Heterodera glycines
agcacttgggtcaacctcaagaatttcatcgccgtaattgggcaggtaacccttctcgaactgccccttctctctgctcattcgcacaaaatcgtctttacggaagcggggtgtttttttaacaaacgattgttgtccatacattcgttcccacaccttctgagcattccgaaaattgacatcaattggtcgcatcccgtgaacacgggacggtgcactgttaattccatcaacaatttgctgtacagtatccacccagttgagagtctgcttttccgcaaaatatctgtatagtcgctgcttaacatttctgatggctcgctcagcaactgaggctttcactgacgaatgaacgggctcgtgcttcgcaatctcgtgctcctcaaagaattctttgaccagtttgtttttgaattcagtgcctttgtcggagaatattcgatggggggccatgggcatttgctcaataagctccttgaatgcctccagcatctcctcggctctcttatttttcagtgggacgacaaacaaacgttttgacaggacatcaaccgccacgagcaggtaccggtggcctccattatgacgagaaagggcttgaaaatcagccaaatccacctggacatcggtcatgaatccagcagctatagtttttgctcttggaaaccgcaccctgcgggggcgcatcaatgtataggtgcgatgtccctccaaatatctctgcacttcttcttttcgtaaatgtttaatctttttccgtgcctctttccacagtgctgtaacacctgcaaacgccgctggggaggatgggtcattgtacattttgtcaagagtggtgttaatcagctccattttttcgggcgaaactccttcttgattgcccgtgccgtccgggtggttttgctctgtgatggtctctttggtggagccgtccatgaatacaaaattggatcccgcctaagccgctcctccaataggtctgctcccggtggtttaatggtgggacggcccgctcttcggtctattatatacttgatggccattcgcaaattgctatgcgccaacggcttgccgttggcggtgttaattgtattcacccgaacacccatacgatcggcataatggttacatttgagatataatcgttctattctctgtgtcatggtcagttgatttgacggaatagcaaacagctcacgttgttgttgtcgttcttcttcactttgtgcagatgttgatggccctggctcgggcgagtactgtactcttacccttctcggttgcctcactcgttttcttatgtgcacctcatcatcatcattctgggggtaggtgcgtttggtccccctcctaggcggaggaatatagggcatttcttcgacgacaacagctggaggaggaggaggttgttgttgctgctgctgtaatggcttttcttcaatttttggctcttttttcgggatacggtatggcactggcctctttgtaggttgcaactcatgttttggctcggttttgattttcgggggcgggaagtacccggcttgcttcgatgtggatggtcgtgggtcaacttcaaattttggttcctttttggtgaagtgacgcggaggaggaggaggaggagctagttcaactttcggttcccttttggagacattgcgaggaggtggaggaggggcgagctctatttttggttctctctttgcgcgatgtggaggcaatggtggaggcggtggcgaggcggattttttcaactttgttggttgtggatcccttttcagttcaactttgggtatagaacgaggcggaggagggggatggtctggtcgtttgtacacgggtggtagtgtgggagatggtggaggagaatagtaaattttgtattttttgtttttatctattccctcctctcctttaagctttcttctgcttgcaagtctttgttgggcggtgtccatttcctcaatttcatctgcataatcaggcaatattggcatgtctccataattttgtgatggtgttggcagcagatacccaccttccagcatttgttcatcgtcatcgtcactttcaggtaaaggagcagctgctgcctcagcgagtagatcacgtactaccggttgttgttgcaagtcacgacgcctttgcttccattggttcaaccgaccatgttttatagaagattgatggtttttctttgttctctgaggacgtggtggacgaggggggcgaggcggatgactatcgtcagacgaggaagattgctgatcgggagggctgggatggtgatggtggtattgatgaggtggaggagatggtggtgatggtagtaaaatcctctttgtcaacgaggggcacacgaatttcgaaaagtgccttgccaagcgcagcgcgccgcttcttggcggagcattccgtgccatttcgacggcactgcgcatcggcccaacggagtgcctaatgatgtttaattgaaaaattaatggtttttaaaataatttacagcctgccaaatttccaattctccgttcgtctgcaattggtcacgcgcaaaaatttcagttagaaattcgttgtcaatttgtaaaaagtgttttgagaggaataaatcgtgcgcattttcgtcaatgtattgcagacaacattgagcaaaattctaaaataattttaaaatagtaaaataaaatttcatcatttttatatttgtgttaacaaatccctgattttttttgcaccatttgctaaagtaaattattttacaaatgacaatttaaaatttttgacattaaaaactgcaaaataatccctggtaatttg

SEQ ID NO: 2495 - DNA, 2878 bp, Heterodera glycines
ccgataatcagaaaaaaaaactttagttttgtaattttaataaaaattagtgcaattttaattatttaaaaaaaactattttcccctatttttcaaattacggcaataaatcatttagaaattaactctgtgattttcctatccaagggctaattttatcaagttttggtcaatgaaagaaagtcatcatatctaaactatggcaaaattagtttggcattatggctgagcattttgattttgatttttatgcgcggatggcaaatattagcctgggctatgaatttttttttttccaatggaaatgaaattgcgctatgcatctgaatgttaaatgatgtgtaagatgcgaaaatgatgtggcttttttacatttacattctgcttcattttacgtttttttattgatttgtgtataatctataatattttttatgtataatttgaaaaaaaaatagtaaagtaagcactcgtatacgtcattaaattacaagaatttcaatgcttccttgcttgaatatgtaaaaacttttggtccttaaaaaacgagttcggtaaaagtgaaaaatccggtggaaaaataaattttcaattaaaataataaatttatttcttaaattcattttgggacttaattgaccatcctcggcatttctccatacccattaaaatgccaaaaataggtgcgaaaataggtgtcaaaaattggaaaacattgtcttttgcacaaaaattccaaagtgattaattttttatgaattttttcgggttttgaattttacattttaacgaattttccagaaaaaaacgcagattgctttccagctattattgttttgaccatgtaacattcaaaattaatgtaataaaaataaaaatattaatttttgacatagactctttaaacaaatcccagttaatgctaaagttcaaatttacgtatttcccctaatatgccctctgagggaggggatggggggttgaaaaaagcacggggcttcaatcggaggtaacacagatttcatttttaaagattcgtccatactgtcattatcactgaaaaaacatacgacactgtcgactggttctatgaggttccttcgtgtgatttgcaagtaggccgctgtgctttgatcaaaaattaccgtggcatcaatgtgatcatttttcgctacccaatgggatctgaagagcgtgtcagaaatgcgcacaagtggttgaatcaaaaagagatgcatatcagatggagcattgggtaaaatagaattttaaaaaatttataagattaacccagggttcagatcggacaaactccccttttccaaagacgggtatactggtttccatggacataaggggaaaataccattaatttaaagacatctaaaaattttatcatatgctaagaaaaatgttatattttatccaaacggtttaattttttgccggaatgaattctattgtcattttcctcatgagattcggcgatgccgataggcgccgtcagggggaaaatttggaatttttgtgcaacttagtaaaagagtttgcaccaaatgccataaatttaagttcaaaaaatattaacttttgaatttttctttcgaatgcacattttcatgaacatcttgaattcatgatattttcaagtgagagggacaaattacaaggagaactttgccattcaaggacgaatccgaaccatggattaatcaaataaacaataaaaaaaatctcgtttttcaaggggaaaacggtcctacctcttttctggggtttttattattttttgttattttttacgggttgaaaaacgaaaatgttcaactattagtaccgctttagccaattttgaaaatagcgcccaaaagctctcctcaaattgattgtattgtaagtttttaggtatttgaaaatacccttctaagtgcaatttttccatacttcacaatttaggacttggttcgcgtatggagccgaaaaattgccatctattttcgaaaaaatacaagccggcctgccagaaggactcattagcccgcggcttttttacaacgccttgtttttgcacacgcgcaacttttgggcgcatgagtgcgtgattcccgttggcatttcgtccattccaattggttcaatggaacctgtgcaattcgttgagttttactttactgatccgcagccctggtttgtcaacttcagttaccgaatctatttggttctatggttgttattaattttaaaattattgataataattttcttgcagaagttcatttatgctgtccgattggcttaattcgtcgacattgtgaaatgaaatatggaaatatgtcatttttaattttacgttacaaactttcgagttttacttgatttaaatcgataaatttaattatttttttttgggttttgttttatttataatgaatcggtaactatatgcgggacaaaataatttgtttgactaattattcatcccacaaattcaaaagtgaggattgaaatggttttagtgaccttttttgtgtgcccaccgtctaaaccaagcttgcagccgtaaattgaaaaaaaagcatcgaccatctttttggtgtcggcataatctatggaaaattttaggaaaacagcttaatgataagcggtataatttcgttataaagctggattgataataaatacattgaaaataagaaaatctaaaatatggcgcaaaatggacagaaaaagtcaattctttgaagttttttgccatgttttttactctattaatctttttttaaatggtttcacgccaaaaaagctggcattccctaataaagcgaatgtgcctcgcatagcttagtggtagagctgcccatcgtagtgagtatgggtt

SEQ ID NO: 2496 - DNA, 1688 bp, Heterodera glycines
  misc_feature (33)..(33): n is a, c, g, or t
tagggctgctaattttaggtaaatacctaaaantttttgcacacttaatacacggagataggcgcgaaaaacgagtttttaacttgtttggagcttatatacccacctttataattagggctgggatttttatgtgctaaaaatcctgaaatatgtaataaaatatgtgctaaaaaacccaaaatatgtgctaaaaaccaaaaaaaggcctaaatatgtgttaaaaaatgcaaaaatatgtgctaaaaattggaaaaaccaatggtatttttgcataaaaattccaaaaaactcattctttatcatttttgcccgcacaattgcaaataaaaaacatttggaggtgtttgggggtaaaattagtccttttttgataaattttttttaaagataatttttccatcagttgagtaagtccagcaagaaacttcgatatccagttgtcgccaaaagaaagcgacaaaaatcgatccgaagatcaattttgtgatgactaagccccgccccctctggtcgatataaaaggggctcatttttcccattcgttagcattctattaattttctctgtattaaatttagtttgttcactctcttcccttttttaataaagtctctttgaaagagctttgtgcaattaaaaaggtattttttaaggagaagaattctccgtaaaatcaaaaggtttatttgtgaagagaagaaattcttctctgtcacaaatagaagcaaaaccaggactcatcctttctaagggtgagccaaggaaaggagaagaagcatctcctcttacctttccatttgctaaaagactccccccttttgccgggtgagtcagcttccccttctgccgggaagtacagattttttgcggcctttcgccgacaaaaattggagccccgtaggggtcggcttccagtcgtaagcctaccctccaaccatcgccaatccaaagcgcagccgtagcgcttggatcaaacgcacaacccaaaggggtttattgcgttttcatcaagcgtaagagcaatgagtgagctcttgcgcatttccattgcaccaatggtggtgcgtctcaagatgtacattgagacagcccaagaaaacttgggcaaagagctgacggaccaaagtgtccgtgcagatcttcttgcagggagacaaaatctctgcaaagcaatttctcttttggagaaatacaatggaaaatgggaagccattttcctgagagtgaagggacaagctcttcaagatgaagagcaaaactacagagactttaagcctgaagggaaggctttcatgcattgggtcgaccaagcccgagggcttgtcgacaccattgaaggggccttgggcctctcagagctgggggatgcaattccccagccaaaccagccagcacaagtcgtgcaacagccacaacttgtgcatcagcgtcatgatgtgacgcttccgccgataacattgcccaaattctcgggggaaccccgagagtggcctttattttggaaactcttcgagacttccgttgaaagtcttcagattgaagacttcaaaaagcacatttatttgctgggatgcctcccagagaagtcagttactaggagagcaattgacttgtatccgccatcagatgaaaactacccaagggtagttgagattctgaaaaagcggtttggggagaaaaaacga

SEQ ID NO: 2497 - DNA, 4366 bp, Heterodera glycines
actctggggggcgcgaaggaagcgccttacggatcaagacaggtgtattaattgcctcattatggggcataattcccagaactgcacctcaccccgcaggtgtagtcaatgtggtgaaagacaccattttatggtgtgttacggagaaaagtcccgagagggaacctctcggggccaaccaaataatcagatgaaaagagaggcaagaaaatcctctcaaagtcatctgactatgtgcgagcacgctcataaaagcgtgtccggatcagaagttttcccagatgttgaaagcttatccatcactacaaatgtgatgacaagcgtgatggtgaaaaagcctcacgcatttctaatgaccagaaaaatactggtcagatccaaaaataatcgaagagtttggatggaagttccatttctcttcgacccaggaagtcaaacttcctacgcctcagaccctctcattgagaggctcaagccaccgaaagtgacttctgaagaaatggaagtctatggcttcggaggagagagaaatggaccaatgaggttccattctcccgtgtactccatccaaatcagaagaacggatggaaaatgtgaagaaatcctactcaataggacggaaagaatttccacgccattcaaaatggcagaatggaattccgaggaattcccactcgaagaaatggacatggccgacgctatgcgtttttctcgggaagaacccgaaatactcataggtgccagacatttctggcaattcttccaagcgaagaaagaagtttctccagggttgtttgtaattaaaacaactttgggaccgttggtaaacggagagtccgactttgggccggaacttccgaacccaggattatcaatgatggccattgatgagtccaatcaagggcaaatgcccaccgctaaagaaattgaatatttctttaatttggagtctttgggaatcaaagacgatccaaatgaaaatgatgaccaaacagcaatgagtctgtttaacaagtccatccgccgagataaggacggacggtactctgttaaatggccatggaaggaggaggttcccgacctcccttccaattaccgcatggctttttccaggctaatgtcgacttttggaaagcttcgtaattctccagatttaatggagcaatacgatgcgaccattagagaccaattggaaaaagggataattgaagaggccaggaaagcccctggcactcttgagcattatatccctcatcagggagttcttgccaaaggcaagaaattgcgcgtcgtttacgatgccagtgctcacaccagaggaacaaacagtctcaatgcctgtttgtatagaggcccggtaatactgccggacctggtcggaatgcttatgcgtttccgatgcccaaaattccctctcctctccgacatccaagctgcatttttgcaaattgctttggaaccggaggatagggaagtcaccaaattcctctgggtgaaggatgtcagtaaatcactggcaccaacaaatctgatcacttaccgattttgccgtgtggcattcggagtgatcagttctcccttcattttggctgcgactttgcagcaccatttgaagggatacgattctccagtggccaatgaattggcccaatcattatatgtggataacactcttcttgagtgtgaatccgcagaagaggctttgcataaatatgcagagtctaaagcttccttgcctcattatttgaccctcttggtctaatggggccgtgcattcagcctctaaagcttttcttccaaactctttgggaagaaaagaaaggctggtacgatgttctttctgagaaagaacaaattcaatgggcctccttccaagaaaattggaaggatcagaccctcaaaatcccacgaagagcaatgctgcaagggaatccttcccttcaattgcatgcttttgtggatgcttccatccacacatttgcagctgctatttatctaagagcagtagaagatagccaaatatcagtttggcttatcttctccaaaaataggctcaagcctaaaaatgcttcaaaagcattaacaatccctagaatggaactcatggccattctaatagggattcgcggtcttaaatttgtcgccgatcaaattcggcgacccatttctgaactccatctttggggcgattcacaaatcgctctgagttgggtcgtttccaaggaagcacagccaaaattcattgagagacgagttagggaaattcgtactctcaatgaatgtgcttttcactttgtccgaacagccgaaaatccggcggacatagcaacccgaggcgcaaaaccaggagaacttaaggataagtctctctggtggaatggcccttcctggcttaaggaagaccatgaccaatggcctaaagaaatggaatttaaaataaaagatccttcagaaaatctggaggaagggtctctggataacgaagagaaagtgttcttcgttaataccagaactgaggaactgattgagagtcctctgattgaccccaaaaaattcagctcttggacaaagattgtccaagtgactctctttgtgttaagatttctccgtctgaaattgattcagaaggaaaatccttccaagcttttcgagatccgtcgaaaagaaatcgcaaaagtgtccgaaaagggactattttcagcagaagatgttctcctagcagagaaccttctgatccgcatggatcagattaaaagtgctgaagacttcctaagctatccttctcttaaggatagcgaggggattttaaggcttaaaaccaggttgggaaggtgtgaccaaccttttggttttagccacccaatcattctcggaggacaatcctccatccgagacttaattattttaaaatgccaccagagaaggcttcattttggggtggaaggcaccctcactgagtttttactcgagtattggacacctcgagcaagaactaaggtcaaaaaagcactgaagggatgccttcggtgcaaaaggatgcaggcataccagtttgcattgccaaaaatgcctcctttacctgacgagcgagtatgccgtcaggctcctttcaaagcaatcggcattgactttctcggtccaaccgaaacacggttggccggagagaaagtcaaggcatggatactccttatgacttgcctcgtaacacgagcggttcatttggaggccatgcttgacacaacggccgagtcattcctcaatgttctccgacgtttcataagtcggagaggaaagcccgatttaatttggagcgacaatgctacttcatttaaattggctcaaaaaaccattgagcatttgaccactccagaaagggtggatcaaaatacgcaggaatttttcgcacttaataaaattaagtggcgattcattccacaaatcagcccttgggcaggtggcgtttatgaacgccttgtccaattgtgcaaaaattgtttcaaaaggactttggggagaaaagtcctcagttatgatcaactcataactattgtagctgaagtcgaagccacactaaaccatcgccctattacttctgtgtccgaagggatggatgagttcctgccccttcgtccagtggacttcctccaaccggaagttcaaattcactgggacacaaatggtgaagaattcgatccattggatcgaaatctttcatcacaccaaaaattagttgccctttttcaggcaactaaagaatcccatgaatttttctgggaaatgtggcaaaaagaatacctcctccttctgcgggagagaggtaaatgggaccacaagagtccccgtcttcaggacaaaacagaaccaaaggagggaatgatcgtcctcattcatgaggagttcactccccgaaaccaatggtctttgggaaagatcattgagcttaatggccgaccaggggccattagaagcgttcagttggaactcccaattcatgggataaaatcaaagaggtatggaaccatgcctcggaaaatcattatcacccgtccggtgaataagattttcccattggaagtaggatttgacaatcctacagaaaatgaagaaaaatttgaagagagttcaaatggaactccccaaataccaaatgaggaagaaaattcttatttggaggcaccaattgaaaaggaaactgaaattgttcaattggttgatcaaccaattgatcaaaaccggcatggcatgactacccgcagcaaagcaaagatggggacagttctgaactgtctttccatcctttttgctatgtttgcgttggttggagcttatccaaccaatcattgcaatgaatgcaaacttctttgct

SEQ ID NO: 2498 - DNA, 1890 bp, Heterodera glycines
atcgctcgttggtacaaccatgttcaaacttacgaagatgttgaacgttccacgtaaattttcgtatccgtctttgggcaggaaacacaattttcttcatttaaaaagcattatttaaaaactccagaccaaatgtgtcctcctttttgtttcccctggctaacttaaaaaataccattgtttaaatgaatctatttctcttcaagctggccagataaatcgtctaacattgtcaaggaagagacagcaccaaagaaagacagagttggggaagattcgacgaaagtgacaacccaaaaacgatttgccgagatgtttggtcatttgcacttccacgaggtgggcaaaaacgacacaaccgaaggttatgtgcggacagagaacacagaacgacttctaagagagcacgtcaaagcggtgggaggaaaggttggccatgggatgaaggggaaagggattcccaatgaaaggccaagcccatttggatactgaaactccaacgatatttatacataattgctttttggtaatttcaggttgtcacgcgttttcctcctgaacccaatgggattttgcatatcggacacgcaaaggccatcaacattgatttcggattggcaaaggcaatactaacaaatgacatgaattattaatgacgaataatctttaggcacgtggtggtatttgctatcttcgcttggatgacacaaatcccgaaaaggaggaggagagatttgtgcaggaaattgtggacatggtcaattggctaggtttggtgaattgtttatactctttccacgctgatttaggctattcgccctacaaaatcacacattcttcggattattttgaccaactttacagctgggcattgacccttattcgtaaggtgcaatttgaattcgtttccttttctgtgaatgtttgtttattttcttttttcagaatttggcctacgtttgccaccaaagtacggatgaaatgcgtggctttaaccctcctccttcgccatggcgcaaccgccccatggaagaatcactacgtttatttcaggcacacttcagccgccttgctattatactttttaacgaaattacgaataatttaggcgatgaaaaacggcgcatttgacgaggggcaggcgacgctacggttgaaactcactttggaggacagcaagcaggacccggtcagtcggtcttctattcagaaattctcaggtactttcccagtttaactgacacttttaacacatatttttataactgaaaatatatttatattacatcaaaatttagcattgttttttttttgtcattcatcgaatgaaaattatttatgattgatattaaaggtacaaaaatatgtgttaaaagtagcaattaaactaagaaagtaccgattctcacccaatcaaaaattatccaaaattcaggtggcatatcgcgtcaaatatttgccgcaccatcggactggcgacaaatggtctttaaagaatgccaaacattattaatacctaattgaataatcaggcaaaaaaatatttaggtgcgtttaccccacttatgattacacccattgcttatgcgattcgttagaaaatgtgactcattctctgtgcaccaaggaatttcaagcaaggtgttgttactcacaaaaaataagagcgagttcattaatttatcatcgtggatttacaggcgttcctcgtactattggctgtgcaatgcgctcgacctttactgccctgtccaatgggaattcgcccgtctgaatgttaattacaccgtcgtttcaaagcgcaagttgctcaagcttatccaggcgggcattgtcgagtccgtctgttttaaacggagtaataagcacaaaatctcacgttttagtttc

SEQ ID NO: 2499 - DNA, 3491 bp, Heterodera glycines
tagacttcgcattaccaattatcgagagttggttttataccagcgaaaagcaccttacgggtcaaacaattcccatcctcaattaatgaaagtacggaagaatgggaaattgcatttgacgagtttgtctacattgagcaggctgattttagagaggtaattgcgtgcagctttactagacattattacgtacactttttaggttgccgaaaaaagttatcgtcgactgacattggaacagccggtgggactgcgtcatgtcaatttggcagtcaaaattgacaaactggagcgggatgagcacggtgtctatttcttatactaagtttattttaattcatttattttgaaggaaatcccatcgaattggtggtaactgcgaatccggtgagtagtgagtgtaagccgaaagcattcattcattgggtggcgagaccggtgctttgtgaggtgcgtctctacgacaaactgtgagtatttactatccctccaaatgttgggtaaacattttttagatttgtacacaaaaatcctgaggaccctgccgaagtccctgggggttttttgactgacataaacccgaactcgctccatgttctttcaaatgcaatggttgacggaagtattattcgcactattcgtccgttggatcgctttcaatttgaacggaacggctttttctgtttggatccgaatgattcgtggtcgagtgagaaaaaagtgaattttttttttaaatttatgtttactttttagttgtgaattttttaaataaaaaattacttctttttagttcgtcttcaatcgcatcgtttctctgcgtgaggatgcaggaaaaaacatttaaacttttccctgcttttttctgtttatttttatttattagtgcattttcattgttttgttgttgatagataaattgttgactctctattttactaacatattcttttttctttgttttttttcaaacgtacatatatttaactgtgcttaaattccgtctcatttgattttcccagcctttgttaacatattaaatggcgtggctcagtcgtgcgactttttgtcctcaccaattacaccaaaaagctgtcaaaacgccgttacagaaagcggtcacttcggcggcagagcgtgcgcttgacattgtcggcaatgcgtcgcgagtgcggcttcaggacttgagggacaacccgggcgcgaggacggtgggcaggcaagtgcgcgcgaagggccacaaccaagcgggtcacaccattggcgagttgcaacacgcgtcgaagccgccgctcggctgggtttggggcgactattacaaaccttggcagcggtcctttgacggcgacagacgcttcaacggggacataaagtaattcgttgatgatgatgttgttgttttacattaatgcatcatttgttcagtctccgccgtgaatacattcccatttctttggtcgagcttcagcgcctcatcgacttgggctggttggacacgagtcgactcgtcgacatcgccgcaatttgtgccaccaaattgttggaacagaaattcaagccggaattgcgtcagtttggcattcatctgactgatgaagtcagtgatttcgcaggtttaattcgatgctcacccgctatttagggcgaagaaatattctcaactccgatcaatttggaggtccaatgggcctcgtgcactgcaattgctgccatcgaacgcgctggtggtcgaattcggacggcttattacgacacggaaagcctcaaagccatgtccgacgccgagaaatggtttcgcacagggaagccgattccgagaaggaaacacccgccgtattcgctgatggaatattacatggaccctgaccacagagggtaatagaaatgtgaacacatgaacattttggtgctgaaaaaagcaattttagatatttggccaaccctgaggacattgagacgtcccgagtccgattggcagacattgtcggctacacattggtcaccggtccaccgcctttcgaaaatgaacaaaaaagaccggaccaagtgtttcttggactcgagcctggccaattggtcagtttggaggacgaaaaggtgttcgagccaacgcatccgacacttgtggaatattacaggggagaagaacaacaagtagccgacacaattcgatgaaaaatgttttccttttgttcgctgcatttcaacattctatttttgttttaaagtttaattttaatgtttgacatgaagcgtttcaaatagtctgagtacaattacatacttttcaacaaattcgaattttttatagctaattcttattgctgtacaaatggcatcgcatcaccaccagcatcgtcgcaaaacaaaggtgggcttttgcagcgatgttttaattgctactatatttaattgcgttttctgcatttgttttgacggtttctcacaatcaatctattacttcaaccgactgtttcagcatcgtcacggttccgtgcacaatggccaaagcaatgactcacaaaacgatgaatttttggtgttcggttactccgcgaaactgcacaatccgcgtgacgaacatcggccagcagaagagcaacagcaaccatttgacgagagtctctacttgataccatggaacggagacgatcggcttaaaattgatcggtgagtttttatgcgctggtcgaatgcctttgggagtattctgtccgaaaaaaacgtctgtaaaagcgtcacttcgcctgcgtaatgtccccggatgcgaggtttgttcgcgtttaaccattgttcaaaggctgacgccatttggcacgcgaaaatcatttcaaataaccaagagaactgtacatttttaataataaggaattccggaatttttgccaggcgccggccttcgctgtaaataagcgattgttttttcaaaagccataaattaattctttgcctatttttacaaaatgctcttcgacattcggatgctcttacgttttttattctttactaattttagtgtttttattagatacatttttagcttcttccctccccgttccttctcccgtctcggctcctcttcatttctccatgtattttcgggcatttattttcgtccgatcgtaagttcgtctctttggcagcgttttattgtgccaatgttcagccaattatattttccttttgaccattcctccaatatctgtccgccacttatccattttcctttcagatacgatgtgcgtctttatctgagttcgttggacgaatttgatgaggaaaaacagcgtaaacggtccattgctgacattggggcagccgaagaggaggaggacacggcggagaagttggaggaggaactttgcgaggaggaacgttttttggacttgtacgaggacatccgaaaacgggaacttggtcattgaatctgggattgcttaattttctcacaaataaaaattgcagaagaagccaaccaaaaacgcagaaaa

SEQ ID NO: 2500 - DNA, 6015 bp, Heterodera glycines
tccgctcccacaaaaaattgaacggaaaccggcgtcgcctgttcctgacctcgatgtgctcgtccaacagttccatcgttcttcgagcgtcagtttacactgggatgtttttacatttcattggcattctcgcggtgttttcagggaaattctctctattcttcgttgctcaaagggcttcactccgttttgccgggaacttcgcctaaagttgaaaataccgtgaaactcgaagctgaacctccacagccacacattgacgaacccatttccaaggccgaatcggtgggcattccttcgcttttcgaatccgaccaacaacaacgcactgacggtaaacaatttctcggaaatgaacgctattttggtttatcctttcgccctttcctattcagattacaacaaatggcacatggaattctacggtcggcccagtcccttccttcccgggcatccgcccgtttgccaacgtcctgtgccggactcggcagtagaatcggctatttctgtggccgctaaatacgttgcattgcacggcgcttatgccgaacagagactgattggttgagttgtcttattatttttaatttgtccagaagattttttcatatttaccaatccctttgaacagaacacaaccaggacaaagtgcactttcttcaagcgagaagcccttactacaccttttaccagtcccaagtacgacaaatccaatggaaaatcttccagcaaagtcagcaaaatcgtcagcaagcgtttcatgctccgcaactgttcaccacaccatttggcaacatcgccgccgttccatcgcctcctccgccaagcgttgctgaattggtgaaagttccgagtggtcggcaaatggcggacacaatggaaaaaggggaagaaggcatggaactgaaagaagcaggtacaaaaaaggacaatttgatagttatggctaactttaaaaaatggctaaactgctattgaattcagagccggactccaaacaattggaacgccgtgaaaaggctcgactgttcatggaaagaattctgaacgaacggatggcggaaaagcgtcggacaaaaactaacaataagccaaacgaggaggaggataattggtgaattttggaataaaaaatcattttcccttttgattggatgtttactttcagtgtcactgtttcggaaacagcttcaacttctgctgctgcttctgttggtggcgtcgctattcagccgttgccaagcagtgcattgtctccgctcgcattgtcaaaagccatctcctgtctgatcgacgagcaaataaaacggacattgggcacttctccgccacaagcgccagcagaggcgaggaagaaaaagaaggaaaagcgaagggaaggcgaagagaggagacgaagaagaaagaagagacggacacgttcatactcatccgaatcatcatcatcttctccatcatcatcaaccgattcaaatgaggaggaacggagcagaaagaggaggaggagaaagagcagcaaaaggcggaagaggggacgcgagcatggaagtgaaagcgaccacagtgaaggggatgaggaggagaagagaaggcaaagacggaagcaaaaggggcaggaggagggggacagcaggtggaccaaccgagcaaggcgaagcagcgcaatcggagaatgcgagcggacctttgccattaatgcactttttaaagtactatttgtccccgtttcagtctttcccaccgtcgtcatcaacatcggagtcggtcacgttcgccacgtcgatgaaggaaaggaaaagataatttctgactgatcgattctcgattttaatgatgaaaaggacatttgaattgttggaaattgcactttcctttattactctattcatgtgttttatttgacaatgtgaaaaacggttcaattcggagaatatatatttccgtttgagtgggtattaatcattaattatttcacgtgttgcgtcagtttttgattgagtagatgaaccccaaccaacaaaggcgtcgtttgtgctgatgcttctccgtccgcgtgtcctttgctctttcggctttctttttctgctgctgttcgttggaccgtctgctttatttgttttgtttttgattgtgttcactttcatctttgggttggtctccttgttcgtttaactttgtttatgccaggtatttagctttgtcattttccttctccgcgatggcattccgttgaggcgtcgtctccgccattcctacgccaaatgggccggcgagtttcgctttccgattcatgggtatttcattgtttgggttgggcacgtacaattaacatacgccgccccctttggtcattggagtgcatctgccaaagcttgtaacgctttctccgatgagtccatttatgccgaaaagcattcgatgaccaattccgaactgctcgacccaattttggaagaggtgaccttttgcttcatttgttttccattcgttcccatttaacttttagattctggacaatattatgcgtgattgtgttgacccttggtacaatgggcagctgagtgacgacaaattgttccgtttcagtctcatgcgaaccgcgagacggtccctcgtcgcactacggacttggtccgtttatcggccaatccaaacggtttccaagaatccattttagcctttcgaaagtggattggatgactttgctgactcgacacattgtggacgatttcgcatcgcatctgaagtagtcgcttaaccataagaattttggaccaattcatttccttttttccacattaggctttatcgaaaggccaaagagcggctgcattcacagaaagaaatggcgaatcggacggacgacttggaatcggtgttcttcgatttggagttggaaatggagcgcagttattgtcgagatttggtctcaacatcgcaagcctatgaaagcggtttgttttgtaaagaaattcctcaaaaacgggactttggtgtatgaataaaatatacgatcagcagggggtgggattagaaataacagacctggtcaatctcctcccccatgttcaatctgggtcaatggcagttcgtacaataaattttttacaaaatatagcttaagcctgtttaagcctaggcccaagcaagcctaattgtaagcttattgttagttgctgtaaaaacgatcaatgggttttatcttattgcagcttatctccacgacatttgcgatattttgctctatttgctgatgccttccgaagattttcggtcgcgccccctccgttttttgattcgcgagattttcgtgtccaatgttttcctccctctgcttgaccgattgtccaacccaaatgtgatcaaccgaataatcgtttggctgctcagcgagttgcccatcaatacggatgacttcgtggccagcatcgaggcttgcaagtccgtccaggagttggaggcggtcatggaatcggtgcacgaggaaatgaacgctttgcgctcgaaaggcgcttcgaatcagcgtgataacaatggtgctcagtaatttatatttaattttcattacaatttattattctggccgatatttagccattttcccctttttcagggagcattttttcgcaacaattgttcagtttggagttcactgaaaatatcatcaaacgaaggatgtctgtgttggccaatcggtccgcggaattttggcctcagccaacactcacaacggttaacaattccacccattccgtttctcaatacgccaaatttatacaaatcttttagattaattcggtcgatcggcctgtcggaagtgaatttgcggatgattttgaccagtcaaatccgtccttcgtccatttgtcgatcactgtcgtgctgacccatcccgtcgctttgactttttttgtggactttttgaacgaagttggcggtcaaaattacatcgatttctacttggccattgaggtgtggttgttttttaagcagtgcgtctcatttggttgtatcaacagggtttcaacgtgtccatggagcatcagttgagggggttggcctcgggcgacactttggacagcgacgcgcgggagacaattcgagaagcggctctcttcatgtaccatcagtatctgtcacaggaagtgaacctctaaacaattttggtcttcaaaagacgaagatgactcaggcaatcactcgagttccgttgagcgaagcaattgtcaacaagtttttggcccggctgcgcaacgacgaaccatcggatggatggtttgagcaaattcaggaacaggcaaataaaccaagcccaaagcgcaatccgatgcccattttgataacgaaacaccccctgaagattgtcgaaattctgaagagtgaagagcgctttttccccgccttcaaaagacacgcgctgtacggtcggatgctcgaccaactcggaattaccactggagggagcgaagtcgctgccgagtcggccgaatcaggtgctgcccaatgagtcagaccaattaaagtacgccgaagcatttagcaattgacgcggacgaattggcggaagggacgtccgtcggctcattgtccggtggaagtgtggaagaggaagaacaaatcgcggctgcactcgacgattttgaggtgttcgacggtcgcaatgaatatcgaatgcaaaacagtggaggtaatgggtgttgaagaataattcattcattggtcagcatacctgtgcaagggggtggtcagggaaaatttttgacaattaaggtttttaccaaaaaattattaggttttttgcgattataagccaacctttttaggaaaaatatttgaatttttaatgaaatctttaaaaaaagaaagcaaaattttaggaatttttcagcctttcctcttacattcgacgaatattcttcagcagaattcgtcgaacgtaaggaaagtgtcgaatgaatttgaatattttaatgatatttcttaatggaaattagttaattttcaagtctccattttttacgttcgacaaatcccactcctcaggattagtgaatgtaattcacggcactttccttgatttcgacgctgccttttctcccttttttccttcctctttttcttttctctctccttttttcctcttttgaccccccccccccgatttcttacgttcgacacccgttgaccccttatgttcgacgtcatgaccccccccccttgactacctccttgcacaggtatgttggtcagtactgagaagtccatgatttacgccttcgattgctttataaatttcgttgtttttcaagtgtctgcaattgccaatgcaaccaatggcacttcagtacgcatcgaaatgctcggcgttggccaacagggacgacagcttttcgctctttacaatgtgcgggtccatcggacagccaccgatttacgtaccggttcttcgtcaaatgtgaccagacgctattccgacttccattcgttgcataatttgatcgttgtaaaggtggagaaaatatttctttttttaacttttttattttacagttcccaaacctacgaacgttgagctttcctggcaagaaaacattcaacaatttgaacaaaaccttcttggaaaagcgctgcagggcactcaaccagtacatgcgtgtaagcattgaaatgggacagggcggaatagtcccttttacaagtgaatgtttagtgcatcctgcagccgtctctttgggccgctaaccccggccttgaacaattggttttcgattttctcacccaaaaactgtacggtggcgacaaagaggggttgtcgggtgcgatgaacacgatgctcaacccactgatgagcggagtgaaagcatttggcaccgctgcggcagcgatgccgtccgacttaatcgacgggatcggcaaaatgggctccgagttgaacaaggctgcttccaatgtattcaaagtgagtgcttcttttattcattggcaataccttttcttctgttcagggctcttcca

SEQ ID NO: 2501 - DNA, 1439 bp, Heterodera glycines
taccttttcttctgttcagggctcttccaccagacaccttcattctttctcggggtcgttccgtctcgtcctccaccggcaatttgcccgactccgggcgtgtcgccgcccatcttgacgagaatgttgagtccgcatcggatttcgttcacctttcttttcttttccaggattccgtcgaaagcattccgcttcgtgtgctgcttctgctggtcgacgaagtgtttggactgcgtgccaaaaaccaatggttccgtcgtcggctcgtctcattgcttcgccaattcattcacgcggcggtgggtcagtcgatcaatcggcggatcattgacgcagtcaattggctgacttcggaggagcaagtggctcaatatttggttgctttcaggtattgagaaggcttcggcggcacaattgcttctaaaggctcgctgccccccccccttagagattccttttggtccgattccgccgctggctcttcgtcccgtgcagataactcgccccaattagactcgcagaaaacacgcttcctcgcccgtttcctggtgctttccgcagtgcctgaacagctgcgcctttttgtcggttcctcaaccgttcagtccggcgttgagaccgtttgcgaggcgttgcagaacagacacctcaaccgacgcctttgctatgtcatgttggagaggtgagcacgaagtgataaaaacaatcccaaaaccatttccgcattaactaccgtatatgctctaattatagcccatgggggattatttttcaacctcctcagaataggggggataattagatactgggggataattagagactgggggattatttttcgggtgatttatttcgaaaatttttttgaattttttaaacatgtcgccaaaaatgtcatcgagattattttttattgcatttttgttaatgaattttacatgaaaatttaaaaatgtcaaatatttacaaaactttgacaaacccctcaaaacattgaaatacgaatatgaacgatctacgtcagttgagccccacacgtttctccccagaataaccttttcaaaagccaaaaaatctttttgtttttctaagctaataaagcttgttaagagcttttgaatgatcccaagactgttggatttggatgacaaagaaaaaagttataggcatagtggcaaagtttttttttcaaaaaaaaaacaaatgaggctttttaaatacctaagctgagtttttttcgcatcgacctagcactccaaaataaaggacaatcttagaaaaattacattttagctttctaagatcgggcctctccaaaaaaggataaatcttagaaaaaaggacacttggccactctggctataggcaaaaacatgctggggccatacgcgagggcccaactgacgagttccaaatttgaaccttatttttctttcata

SEQ ID NO: 2502 - DNA, 931 bp, Heterodera glycines
aggcctcgaacgtatgaaaatatgttttggttcgttttgaagcttcaaggacgtatttccatatgcatattttgcatctttgtgcattttagcgcctttttatgtttttcttaaaaatgattttcatatttagtattttcgatattttagcttaaatttaatgaatttaatttggaaaaattcgtgtgcatatttttcactataatatgcatattttgcgatttgtttgcatttaattagattagataattaccacgttcactttcttcaagaaggtttaaaaaagccaaagattactatggtaaagaatgaatgaatgattggttgttgttttttttcaaattcgattgggcagtcacagtttggcgcactgttttctctcttcgatggtttcaattgcctttatattccattttaattatttatttttctttgatttttcagtaaatattgaaaaatgcagagctttaaaatttttaggaagttaaatgaatttttcaaattcatttacaaaatttcccttttttgtttgatatttttcatatcttttgcttcataaattctattggaaattgataagagaaagggaaataatattgtaaataaagttcacaacacacattcagcctccattctgctgaatgtttttttctgcgcattttgtcgatttttgcttaattaattaattatttgttaattaattattaataatataattagtttaattatttattaattgctcatttgccaattcccttttagcgatgttctcctcgctttttctccttcccttttccctttttgccctttttctgctgcttatccccgctttttctgaccccctttttccaattgtcccaactaaattcggccgagtcaaaggctttgtccattcccttctccgcctccctccgcttttcgttttcgttcc

SEQ ID NO: 2503 - DNA, 2107 bp, Heterodera glycines
gcttcatgcttttccctgggatttttcagaagccaattcccccaaagcgttggcacggcgtccgaaatgccatccgtcccgtggccccgtgcgtgccgcacgcgcgcaaactgtgcaacaaatgcagcgaggactgcctttatctgaatattttcacgccccaccaacactcccttagaaaaaggtgaaccgaagaataaatccacataaatccgaaagggacggaattaagtggatgaaaaatattgcatttgaattccttccctaatattccttaattgatccctaatattccttaattgctttcataaatcgtcgtctatccgcttcttccgttcatcgccgtcgtcgtcattcgccgcttttccccgtcctttttctgatccatggcggtgctttcgaagtcggatcagcggccgacttcgacaattacactgatttgggcatgcgatatgtgtccgctggtattgtggtggtttccattcagtacagactcggcataatcggtgggttactgtatttgttgtctgggattactgtaaaatttgaataatttattattaaaatactttaattaaaatttgaaaatttaatgccattttttgcaggattttcatcgacgggcgataagcaaatggcaggtgaaaaacaatttgctaattgggaattaatcaaatgagatttatcgcaggaaacttcggcctttgggaccaattcgccgcgttggaattcgtttcggaaaacattgcgcaatttggaggaaaccctgcggacattaccctttttggcgaaagtgccggcgccgcgagcgtttctttcctcggactttccccgcacagccaaggcaaaacgatggagaagatatttgcaaaatttaaacaaattctgcatatcaaatgcacaaattggccaccattttgaaggtcttttccaaaagtgcgtccaattaagcggctcgcctttgtccgcgtgggcactaaatggacgcgtaattaacgaaactgcccaattagcagcagcgattaattgcgctgagaatggacgggaaggaatcaaagaatgccttaaggggaaaacggtggacgaattgttcgaaggggtcgaaaaagtggtaggaaaggaacaaaagccaagtcaatcaatcagctaatgagcaagctgattgcttaattgaatgaggtgaatgtgaatccccttcccaaagggcaaaacgcgccaggaatacgacttcaccaaatggggcccccttttggacggcgactttctgccggcggacattccgcaactgatcgaaagagcaccgccgaagcccacagtgatgggaattgccgatttagagacacttttatggagtgattatggataattaaacactaattgcttaaatttgaataattccaaaagcattggccatcggtcacaacgacagcatttcactttatgcaattccatgggacgaaatggccaattttgacagacgacgctttgaaatgtttgtccaaaactttgtgactaaacgcgaattatttggccagcaaatggcgacggaattgcaacgagaaattgtgcaattttacacaagagacaaagcggtggagagaattgaaaatgagggcgaatattatgtgaggaaaatcactttggtaagagaaaaaggaaaagcgaaaataaaatgggaaataaataaattggaaatggtaattagcaatttaaaatgttttttagcttttgtctgacctccaattcgccgtgccggtcatttgggaggcggcgcaaaaggcgcagaaggggtggccgatttacttcttcaaaaacagttacttcaacgaagtggtcttcccaaaagtggtcaaagtcagacgtaagaaaaacaaaaaacggacaaaataaatgcgtaaaattacggtacttttgcaatttaaatggtacttttaacacacattttttatgcctaaaaatgtacaaatttatattacatgaaatttttagaatgcaattttaaaaaagactacgatttatttattctttgcaaaaaacggaagctgaatttgaaaatttgaaattgaatgaaacggacttagtgagaaatttattagattaatgaatt

SEQ ID NO: 2504 - DNA, 3748 bp, Heterodera glycines
tccatcagaaagttttatgcatttgttgatcgaaatgccaatgccgaaaatgaacccgaaaatggaggaggaaattggcagggcccaattttggacgcaaatgcgaacaaaacacccgaagattgacttaatcaggggccaattttgaccaagccaacgcattttcactattcaatttttactctctttccctatttagaaacataaagggaatattttattttaattaattaacgactaccagttttgaaggatttgctattaattaattgaaatgtacggtcatttttactgtatctttagttcgtttcgtattgacacagtgaaaataatttaataatgaaaatgatttttaaacaaataaaattaagcggcggaaagagaagggaacggcgtttgctttgagatcaccaaagtctgtctctgatgcgatatgtaccctttgattttcttttgcgcaattaaattggccaaaatgcacgacaattcgtccgcgtcaatgtccgtgcccaaaaagcgaaggacggcgaggaaagcgtccaatttgatcagatgggtgttcagaatggaagcactgaaattaaaaagggaagaaaatccaatcaaaaagtgatcggaaaggaaaaagagaagaaaggagcacatttgaagaataacttacactcgcttgaagaggtttctgtaggtgatcactttgagcttttccaacatcaaaaagatgccgcatttgatgaaaaagtgttggtgtttttgcagtgccaagttcaggtcgcgcaaattgccatcccttacggcaattaaatacattttagaagggcaaaatagggggaaaggacatttccgtccccttccattctccgactgacttaacgctggcggcaacgtcggcaaattggccaaggttgtagcggacgagcaattgttgggtgggcatatggccaaggaacattttgacgggcaccaaatacatcagaatgagccgtttgttgtgcatgaaatgagccggacagtgctcaaaagcgaaggtcagtgcttcctcggcacgggaaaggtcctcaaaatgggagaagcaaaaaattaggggaaaggaaagaacgaacgaatagcggagggaaatattggatgaaaattgaaaccatgccgagaaaaatgaatgatttattggcaaatctaccgtattttttaaatatgtctaaaattgacaattggggacaagcggcaaacagaaacgacaacgcattgccatgccatgccagacaatttacaatggaattgcccatccatcctccgaaattgtaatcaaaatgccaaaaagaagaaagaaacaccatgtcaaacatcgcttttcggcccaaaaagtatttgtaagtgattttgtcggccagcgaaaaacggtcgtacagttcgcccacgtggtcaatgctgcggataagcggtttcagcagatgcaaacggttgatctgagcaactcgaaaatgcaattggatttgttaattttttttattagaattgtcaagactctcggcaattgacccgagaaaagtgtccgaaggcattagaaaaagcacaaaagtcaccccaaaataaatgcgaaacaattggttggtcagactgaggatggccactttctttgtggtcgcgtccgaccgctccgccacacaaatgcggtaactctccataattgaggcggccgactcttcgtaaaaggtcgccgtttgcgcgtcggccgacttccgctggtggtggccgccccacagcacacagccgcgcttgtcagcctggaaaaggggcaggagtgtacggtaggcatactgtaattgtctaattgtaagacggcaggtgtgcacagcaggggaataagccgaacacccaaaggcactttgaagaagttggaaacggtaccattttaatttcacactccgtgaaccgttctcctacgcctcctccagagaactcgtttaggtaaatttaccactcatttcgcccccggggattaaattaaacaccaaaataagtgcccacaattcgcgcaatgagtcgcaagtcgctgcacagcacgtaaaggatgggcatgaaccaattggcgtccttttcgcgctgcaaaatttccctattgaacagctgcagggcattcgtttgatggccaaacgccgccggccaatcggacgcactgagcgcgtgcagcacattcaaatgggacaacacaatgtcgtcgaacacggcccatcggaccacggcacggtcgtcgtagcgatcctcgggcgatggcacataaaatggggagggtagattaattaaggtgataatcaacgagggtgggggtgacggttaggatgataattactcggcgtgtcgagagtctcgacccgcgagtagagaaaccctcagcatttctctcgatatcgttggagacttcaataagatttaaggcttttgccaccctcactccacctatttcacacataactgaagaaatttaaggtccgcatgtttgtcacgacaacaaagcaacacggacgcctgttcagctgcttcccacgtttgttggtcgattagcgcagccaaattgtcataataggcgtagaaattggaaaattccatcccaattaaagcactcatatgaattaatgtgcaaaattcattaaataattagtaatttaaagttttctaatacaaattcaaaaaattcaattgaaaattaattcaactaattaaactttatacaaaaattagttgagtaaatttcttacaatagttaaaatataggatggattaaaaaaataaagttgaaatattatgatgtttttgaaagaaccgatgaaaaaggaaaaacaacccaagtgaataacaacaaatgatatggaaaacactttggacagaagtgaataaaagcacaaagcaacggaaaatcgaatgggagaaagtgagtcggacttaccaaaacaatgccaataaaatcacaagcattttggagaaacaaagaaaggaataaatatggaacaccggcggaagtgaacgaacgaacaaaaattgggaaaagcgattcttttccaaaaatgaaagaattacacattttcattcctttttaaaatcaaattcccaactaaaattttggtaaggaaatttggaaaagcgtaaatcaaaaggaaagtgaatgtgtttgttgtgctgaaaagcgacgttgagttggcctttgcttttggaattgcaatttgtcgtcgcttttgctgccatttccctccccctttagactgtctgtggcattttccgcgagtccaacacttcgtcctcctcgtcttggtccgtctcttcccccgaggtgtaaccctgcaaaaagatgcaaattgactaggtgaagtgaccagcaagggcatttaagatcgagagcaaaacccgataaaaacagggaatgggtgcccttcgaaccccaatttaattttggaaagagatatttgcataaaattagccaaattaattcagtgattttgttcgttttgtttttgtctgttgtacagaatataaataaatgtttgttggaaatgcgttttccacctccaccttcaacggcactctctcaaatccgtccggccttcgtttttccttcttcgaccgttcgccctttttgttgccattgtttcttcgcctccatttccatcccccgttaagcgatttgcacagacaatactgaaaaaagcaaaaagtaatcaaatgccaaaatgaaaaaaaaaatacaaatgaaatgaaagca

SEQ ID NO: 2505 - DNA, 5026 bp, Heterodera glycines
  misc_feature (2315)..(2315): n is a, c, g, or t
  misc_feature (2447)..(2447): n is a, c, g, or t
agtctccgcagtcaaagggtcgccctccacgttggtcaccttcgcggtgaagccttggagacgctaaagcaaataccaaattttaaattgtttaaaactgctcactctttccaaaacggagagcaaagggcgacgattctccccaaaatgatgaccctaaaactgtgctttgttttgaagagaagccgcctcaaaagtgagaccaaagcaaccccttaccacgcccaatccctcgtaacagcagccaatctgtgccaaaagtacgtccggcgatgcgttccatttgtccctggcgaattgccaatggaattcgcccaaaacggcggtcgacggtcgattcgtcgcgcacatgtccaagttgctctgacaatgagttggtttgtttgtcaaattagatcatttcatcactgacctgtcgcatctgttcatggtgtttgatgtacatttggccaaatgccattggcgttgcggtccaattgccctcgggcagcttctcctccgccattccttgctccgtgcccatcagttcctgctcctcctcaaatggggcggccgtgccgttcttcagcattccgttgtcctccccggggcggagcacatcgataaaacgaacctgagagttgtctttaatgtcccattttactcaattagtcttaattgccttgagaccgccagtggcaattacaatgacaaagtcaatttccggcacagtccccaaaatgttggacaccaaaggaatgaacggagaaattgtggcgtagtcgtggcagttcaactgagtgctaaatgagtctcacgatcagatgggattatatttcgcaaataatactgtgggatttcgggtgccaaaacgatggtggagccggccaaaatgcgtgccaattgtttgtcctcctcctctaaataggcgggcgctgttactgcttcggccatttcggcatccatttgatcgcaaagacgggcccccaattggtagaccaaagcagacgttttctgaaatgcaaatggaaagcgttgccaaacaatgccaatttaggaaatgaccttttcgaccgcaatcaccaaagtgtgtgggccgcgatgagagccgacggcgtgcaacttcatgccatcggccgactcaatcagtcgggcggaacaaacggtggactgagacaaccgatcgaagccaaccgaagtgaccgccgcaatttgcgagggagtgaagtgatcggtcggggcgacagaaggcacaaccaccgaaaactcgtgaacctcgtcccttttcagcacgttgaccatcatctgaagggaaagggacaacattttcgggaagttatttcactatcctaccataaaatccaaatagaaacaataaaattaaaagaaattttatcagaaattgttggagaattaataatacaattgcgatttaagaagggacaaaaaagataattaagaatataaacagcaaaaaaggaggaacaaataatttaagcctcgtttttaagttagttatcacaaaaaaggaacccgccataacataaaatgaatggactaacccgaaaagagtaagtagcgaaaccaagaattgtatgaataaatacaacaaatttgaaagttggctttttaattgtcggcattggaattgtgcgcggaaatcacctcaatgatggcggtcagtgctacgtccaacttggccgagtcaatgtcccgttcggtggagtttccgcaaccgatgccaacgcccaactgaaaaaggcggtcgaggcccatctgatcgaccattgctgcgacacctgcgcaagattaattggaaaagagtgagggggaaaaggagataatgggtaacaaatttggacaaaaactgacgagttgaccaagtcggtcctcacagttttcagtggtcgccaacaccaattgctgctcgtcctcattgtcgacagaatgaggtgcaaagactctaaaatgcataaaataacaaaaaataaattctggtagcagttgaaaagccaaacctaaaaaaaatttcgcccgattttggacagtttctgcccgacccctaaattgcacgtactttttcaaactttctccaaacgttcgttcattgaacagccgaggagtgtattcgcccgcactgaatacaatcgattggggaggacccgaggcgaacacaatcaaagcatcggcgaacacactgcgcaagtagggggccaactcagtttgagtgtactccgccacaatgtgcagttggacactttcgtgtaaaagatgggccttagtgcacaaatttaacgatgaaatttgtcgaatgaataagagtcgtacaagttcanggttcttgttcggaatccaccgggcacgtgtgggcggccagccgagtgagcaattccctggacgacgagtcaattccgaccagcaacaagtttgaggttgccttgacctcggacgaatgtctgtttgcttgnggttgtctgaatttgagaatttgtcacatttttaaagaaaagttcggttggaaaaccttggccatcacattccatgtgtttcaaagtgacattgacctctttaggctggcccacaaccaattggacgtcgaattggtacggtttgtagttttggtgcaaaacttggatctgacaaatgcaattactaatttatttatatgaattcaaaagtataaacaattgttacggtgtaattgcccgggggcaacagtcgccaatattcgccaagtgttgaagtggtcacatttttgccagttccaccgctaacgaggctaacctgaagaagggcagcgcaagtcaaaggcataaattttccgaaaaattaaaaaactgcttattgttagatttttttgttgaaaataaagttcgctattttcctaataaaattttcatcgagttagactagctaccatggcatttgcgatgggtttgtccttctcattgcgcaccaatcccttcactccgccgtgcaccgcctccataaaggcgagcagagagaagcgattttgagcccaaagcgtgggcaccatgtcgtcataggggaacttgaagcagcccatttcgatggtgatttccaacgaatttgagtgcaaatattgccaatcctttttttgggaatgtgaaattggattatttttcattatttttgtaaaatgatttgttttgctcacttgcatcccaccagcgaggtgatacctacgaaaaacaagtgtattaagacaattcccccattattcacaccatccggccccgttggtaattccgtgcagaaaaacgtcgccgttgtcgctgaggccacaacgtctgcccgacttccacatgttcgtgtgcgcccgtgcgtagtcgtaggccaatttgacaaacagcttgtcgtcttcggaaggcgtgtacactccgtcctgtcccgtgtccgagtcgtcgtacggataattggcaaccaatgagcctataaagggtaggcccagtcggggaaaattttgagaattttaacggaatgtgttaaaaaaaatttacatttaaaaattttacctgcatggagattggcggacaacacaaaagggtattggagaagccatttcatcaacgccgcagtttcaggctcaggcaaagtgccgccggtcgcctctttgtggaaagggtaacgggccgggaagtttcggttcaggtcgatgttgtgcgcattggcacgaccctggaagattttgattgagactcattgagtaaaatgaggcaacaaaaacggaccaaatacccaacacggtcgccggctctgtccatttcataaccatccggattcattgagggctgaattaagcaccgataatgagagagagagagagagtaaattcaaattggccgaaccatcaaatgaatgcgcgtgctgttgaccattttggacaaatattcgttgtggccgtaattttcgcagagaatccatgccaaataaagcaaagcttctcgaccaacacctaaaatcgggccatatttgtcatttattatatttctaagtgtgtcaaaaaggcggaaatacaaaagaaaaataaataagttaaaatttgcctcatttccgtgcatattggccacatatttgaactcgggcctgagcaattcgtgttcccgagggttccgtgccactacaagaacccaaaggtcacggccctgcacacttttaccaacgctgtacagccaagtgatgtgtttgaagcggtcagccaaatcactcagccatttggtcatcgaatcgaagttgtgattcctctgactggcaatgggaaaataaaaattttttttttgttgaatatttgatggtcatgtctctttttttatgggtgtgaactgcaaaagagccaaggaatcaatgggagttattttacttgaaattggggatgacaaaaaatttgatttttaaaagaaattaattattcgttttgtgtcggttttcatatttaagactgaattttttcgtttttttttcaaaattcccttaactcactccgcaattggcacatctttaaagtggccgatcagcgctttcatggactcatagcttcggaatagccgttcatcctccacttgggtgccgaaatatttgctgagcgcgtcctgccgctcatttctcagttcgtcaacatttggcacaatgtcactgttccaatcgatggccgaggttatgcgaaaacgaattccttaaatgatttgttaaaaaggaaatgaaatttgattgttttttaaattaattattctcacaattctccaaaacgaaagattaacctaataatgtgcaaataatgaccaaagctttcagtgacgaagcggtcatggtaattctgtgccggcgcattaaacccattagcaaacataaacacaaccgccgctaaacctcaattttaattgaaacaaaaaattatgtacattttatgttttaatgaaataaaaaaacaaatggatcggatataatagatgaacacggcaattagtgatctctatgctgagttggagataatgatgagacattcgctgtaacgatttacgtagaaaaa

SEQ ID NO: 2506 - DNA, 4095 bp, Heterodera glycines
  misc_feature (58)..(60): n is a, c, g, or t
aatttttgagcttattaggggagtggtaagtttttatgaagccggagggacttcattnnntagaaaatagaataatctttttacaaatttgctcttttttatttttatagtgcttattaattcaattccccaatagaaacgtatgattgtgatttttttgtacaaaaagctcagtcattaaagctccataattacaccattttagcagtcatttacaatcgaattcaatattttttttcgttaataagcattctgtgaaaatttcagcatgagagaacaaaattactttatttgacttggacggtcccaggatttcggcgtgaagggcgtaccgcctccgggcgaaaatttatttttcttcatttccatcccttttatgcaatgcacatttctcaaaaaccttttgggaaaggaggagtcagacggaaaatttaaaaaaaaaaaatggaattttgagtgctatttgttaatggaatttattcaaaaagaccaaattttgggattttgagacaattgtgtaagaaaacagaggagttttagggatccgatggtggcgccaccggggaaacattttggcgattttgttaataaatttgcaccaaagattaatactaatttttgaaaaaaacggaaaaattcaaaattcgctatggtcaatttatatggtagggtgaactttattatagaatgcgttaacataaaaataaatgaataattcatgatcagcgcctaaatcacctttcaaaaaaacaattaaaatttcatgggagtcaaaaaacccataaatgaccatttatttttaaaaatttcattctaagaatgaaaaatttaaaccattatattcgaaaagggatgagatttatctttttccatctaaaagtcctatccatgcatatgtacaaatcaacaaattcaaatgaatttgctttgttctcctcatcgtttttcgggtcataattttgccgcaattattttgttattttgtgccctcccgcataaaaaaagtgaagctcatcagcagcagaaaatcctttacattacaaatctttttttacaattatacaatgagtaatgttcatttttaaataatacataaataacttaagctaataataaaatgtaaattatcgtttaaaaattaaaatgttaaacatattttttttctttaaattgacttacgctctgaaaataaaattttctttttaccgattttggcatttgaattgataaaattactagtttggcaattgctttatcattacaatgtctttgtctgtggttgatcggatgaagcggatgttgagcactggagaggacgcggatgtgcactttttggtgggggaaggagaggaaaaggaggcaagtttgaaaataaaagtattaattaattaatttttatttaatttaaaaaaaaagcctttttaagagagttgcagcccataaagtaattttgaagcatgcttccgaagtattcgaggcaatgttccgttttgactcacagaatcaaaacgtagaaaatggtaaaaatttgatgaataaattaattggtcaattaatttgttagcctgcactaattgtgtcgtggaagtgcccgatgttgaggcagcagcgttcaaagtgatgctcagcttcatttatgccgacgatttgagccaattggacggagacaacgcaatggcagtgctttacgctggtcaaattgtttttgtgaaattaatctaacaatttaattattcattaattagccaaaaagtacaacatcgttggcctggttgtcccatctttgcaaattccaatttcaaaactgcacaatgttttctttgcctatgcccaggctcagctctttgaattagaggtgggatgacagagcactcaaaagcatcactctttcaatagattaaattgtttataaaatttttatattgaacaaattcagaaaaggcaaaaattatgcatcaattattttgaaatataaaaatttaaaaattcagtattgggtattgcgagtttcggaattttaaggaggtcggattatggcgattttttcatgcgaaaatatcgaaatattaattatttagttttttgagttaagaactttgcctatcattgtttgttttatattgatgagaatgcggacactttgctcaattcggtggcatttttgcaaattgaccaaaaaacgttgtgtgaaattttgagtcgtgacgaattgcaaatcagtggagaaatttcaatttggaacgcagtatgatattaatttatctaagaaaattacgttgatattttttggctatccgttgggctgacggaaagtgccgtgaaaatggcattggatgttcagcagagaatcgccgtaaaatgcttggcccggcattgttcaaaattcgcttttccgctcgtgtcaaaagaagaattttcaagaaatattggtaagaaactaaattctacaaggaatttaagactttaaatgttcgaaaatatattcccattaaatttaattaaaataatttaattaattccgtttccaatttatttatttttcagttccctccggtgtgttaactgtggaagaagtgatcggcatttatcagttccattgtcatccgaatttgcacatggtttccgagctgtacccattgaaatttccgaggcagggaagaatttcggaccgaacagaagggacacttcagctggaaattgaaaaaatgtcggaatttgcgggcgaaactgtggggagctgccgatacagcaaaactgtgcacatccgagggcttccatttgaaatatttgcaaaaataaatgcgacgacggaaaacgatgaaaattttgttgggaaatggctgggcattttcctttggtgcacagcgccaacagaaggtgattataggcgcaacttttagtgaaaaaactttttttttgctcaattgttttgaagaaaggagctcaaaaaacgcatttctgcgttaaatttttttcatttggacgtcatttttcatcactgaaatcactattttggcgtttcgtcacttaaaatagtgaaaattctctttttcggctttttgtcactgttttttcactttttcgacattttttcgtcactattttagttaactatcgggatttttcgtcactaaaagttgcgaccctagtgattaataaaggaacaaaacacaatgaattaataatgaaagtaaacaatgttcactaatcattggctaaaaaaaggggggggggtcgcttcttttttgctttttcaaaccaaaaaatgttgtaatccgatttgttaacaaagattttgagcaaatttttaaggaaaatttggattttgtggtccggcggtgccgataggcgccgccggaaattttcaagcacttttttccacttcgaaatcggcaccggtactgcctttattctactattggcattaagattcgaattggagttgcaattggtcggcaacctttagaattgtcgcgcaaaacaatgggacggagaattgcacagggaaacgcattgacaatgtgtttaacagcaaatcaaacagcatgggattccccactttcattgctttttgggtgagggcttattataccgtacttacggtattagaacccccctctgtattagaaccccctttcgaggggggttgaaaatagaacccccgggagtactaactaattcagtaattacggtattctaatgagaatattttaatcttctgaatgatacgaagaatataaaacgtctccgactttcagcaattttgccattatttttcatttcccctggcaaatttaagaaaggccaataatggcagaaatggagaaacggcccaataaattcaaaaaagctaccaatcgattcctctcgaagagttaatttgtaagcacgaaaatataggtctccagttgcggaaatgcaaaaaaaaactgttttgaccggtttaaaactcgattgagcaaatttggcacttctaacttttttaaataaatgatcgaattatgacaaaattgggtatcatcgaaactcttgacgaattaattttaaagatcaggggatgggagaccgtattgaatgtgagctgatttttaacgc

SEQ ID NO: 2507 - DNA, 938 bp, Heterodera glycines
tcagccatttcttttttttgctaccgggtcaaaaattctctcattgccagacggcacaacgtcatcccctgattttaagatttagctcatcaaggttttttaatgataaaaatttgtctgggttcgatctttaaaaaaaagttgtaaataccaaatttgctcaactttagggtttcaggttcctttttggcatttccagaaccggatggattacctttgttttcgtgctttgctcctcgagaggaatcgtttggtattaaaatttgcgccattttttcaagggcttcactatgatatatccaaaattaagcaattgatggatccgagaaacggcttttacgacagagacgaggacaaagtgactttggccattgatgtcattgtggggcaagcagaaatggacagagcaatttccgctgatcagagcaaatcgaaagggacactttttatggacattgaaaaagtgtcgcaatttgcgcgagaaagcatttggagtgagcgcaaaagcgaaactgtgacgtgcttagggggacttccatggaaaatatccgttcaaatatttacgattatgggaagtgccgtcaaatgtttgagcctttttctttgttgtaccgctccaaaagaaggtgaaattaaaataatcaaattttgtttttgtctctcatttttttcattgaattgattaaagtaatttaaaaagttgctttttggttgtgatgctcgagagtctcggtctcgactcgggttttcaatctcggtcttcgagaccgagtcttttttacacccctaatgattggttttttgctaacttaaattaatatatttttgtttactcatttttcttctaattttcaagttattcctttttcgatggggaatcaatcataataaaaaaaaaatcaaaaaattggttaagaaatgagtcagaaaattttttt

SEQ ID NO: 2508 - DNA, 3385 bp, Heterodera glycines
gtagtagttagtgtcttcccatccgccggattacggtagcctcccatacctatgggaggggtgcacggccaactgagcgccagccaggtgagcgccgccgggtgagcgcgggccatctgagcgccaaaattttcagtactaaaaccaaaacctattgcgcgactttttttctgaaacccaaacctattgcgcgactttttttgaaaacccaaacctattgcaggggtgcgcgactttttttctgaaaccaaaacctattgcaggggtgcgcgactttttttgtaaaatttttctctgaaaattatttattttttaaaattttttattcgaaaaattctgccgcagactagcgggctcgaacttttggtctgccaccaatccaacacactaccactctgccacgcaaacacttgcatgcaaaaggaaattatccactatatgctggaaagatgatgacgtcaccactgcgagggatactgtagtccggtgaacattcgcaataaaatacgcaaaacagggcaaaacgccacaatatatacttgaagccaaaagtttattgaaacgaaaagtcttcgcgttatattcaaattcaaaaattggcgggaaattcaaattcaaaaaattggcgggaaatttaaaaatggcttgtaattctaaaaatagtaacacttgacctagattccggcagggtggcatataaaaggatgcgtcatgcactttctttcattttttctactgctatatacttttttcttgctgttaaccagggcggtaattctaattaatgaactaccgtttatcctggcaccaattaatccatgttttaggtcttgaggttgtttatgatacattacaaataccacgaggattttcaggtgccctgtcgtcttgtgcttcatgggtggcggtgtgctgctcatcaggccaagattggttacattttgcctattatgccaagtttgctgttaaccagggcggtagcgctaattaatgagctccgtttatcctggcagcaatttcaatttgtattttagaccatgaggtcactcaaactatcttgctaagttacgagacttttcaggtgccctgtcgtcttgtgcttcatgggtggcagtgtactgctcatcaggccaagattggttgatattaataaatcaatttcctttcctgcgcaatcccaatcaggataataaatgataaaacaacctgatgcgcaatgcctatataaggcagcccctttttctatataccgcataattttatttcgcaatgtatcctttgtatcctactgtattgaaacatgtcgtccgatgacgaaattcctccgttcctcgacgggccttacacgcccgtgcgagatggcgatgagccctttgaggatgctccgccccttgtggaagtgattaaccaattgcctattcaactggtgaaaattatttgaaataaaataatattattaatcaatatttagattttggatgatgttaaaggaaaaaatgaacatgtgacaaggagcgattaaacttggaagaatttaacggcgagcatttcaaatgcctggatgccgcacaagcggagagtggaagattcaaaggttgattaatttcttcgagcaattaaacaagttacatttttgttttcatttaagcctaccgttttcttggacgctttatgctggactacatttggaatgccgactaccccgaagctgttttgaagagcctctttttgatgtgcctgtcatactctttgaagggtgcttcggccatgaacatcacggcaaaccatctgattttcctcttaacatcacggcatcttgactacgaaatagcagtgcacttcaaaaacttcaagaaaattgatgacaaaatggctgaaacaattttaacacactttgaaattgtcgaccaaagcaacaaagccaaagagcggccatcacttcttgaggaatcgtttgttattgacatcacggccatcgacagtggaggaaagagacagaagatggcggggaaaggtgggcgtcgccgtgacttcaatgttccgtacgaccttctggagggtgcaacatacggattggagaacaacgatgcgtattgcttgttccgcgccttcgaattccttcgcatgaagcatgtgatgccacatcagagattttctgaatataaacgtgatgaaggacaacaacttaacaacgtgacttctttattccgagagtgcgacatccaaatgtggttgcagttttattccattgaggaatatggaaacaaaattcaggtaatttaaaataaataaatttaagattaaaattacatttaaaaaatactacaacgaaatgcaccctgggatgttccgtctcttctgctttgacacctttggcaagatgaaacccatttggaagtccgccatgagtgattaccggtatgagctctgtgttctttacacgagggagatgatggagctgttggacactatgacgcaatcaaatcaattggaaaaaatttcggctcaaagaattactgattgtaaacttgattataatccctagtgtaagtaaccgatattcatacaaataaaaacatctctttgccttaagcaaaataaaaataattaagttattaattaccgagtctgcaataatataaaatatttgggtactgtgctttgtacaacctctgaggttcctattaggaaaagccttcagattaagcctatatcctatacgagtatgggttttgaatgacaagataaatatatgttaaattaaaatgctgacacaaaagacctatgttttgtagaaaatccctaatagtttcagctttggctagattttcagcgaatatttttgaacgaaacttttctgtatgttgaatttatccagaaattacagacacatttccatgaaatattgtgaacttgattataatccctagtgtaagtaaccgatattcatacaaataaaaacatctctttgacttaagcaaaataaataataattaagttattaattaccgagtctgcaataatataaaatatttgcgtactgtgctttgtacaacctctgaggttcctattaggaaaagccttcagattaagcctatatcctatacgagtatggcttttaaatgacaaaataaatatatgttaaattaaaatgctgacacaaaagacctatgttttgtagaaaatccctaatagtttcagctttggctagattttcagcgaatatttttgaacgaaacttttctgtatgttgaatttatccagaaattacagacacatttccatgaaatattgtgaacttgattataatccctagtgtaagtaaccgatattcatacaaataaaaacgtctctttgacttaagcaaaataaataataattaagt

SEQ ID NO: 2509 - DNA, 1160 bp, Heterodera glycines
tatgtttgtagaaatccctaatagtttcagctttggctagattttcagcgaatatttttgaacgaaacttttctgtttattgaatttatccagaaattacagacacatttccatgaaatattgtgaacttgattataatccctagtgtaagtaaccgatattcatacaaataaaaacatctctttgccttaagcaaaataaataataattaagttattaattaccgagtctgcaataatataaaatatttggttaatgtgctttctacaacctctgcggttcatattaggaaaagccttcagattaagccgatatcctatacgagtatgggttttaaatgacaagataaatatatcttaaattaaaatgctgacacaaaagacctatgttttgtagaaaatccctaatagtttcagctttggctagattttcagcgaatatttttgaacgaaacttttctgtttgttgaatttatccagaaattacagacacatttccatgaaatattgtgaacttgattataatccctagtgtaagtaaccgatattcatacaaataaaaacatctctttgccttaagcaaaataaataataaacaagttattaattaccgagtctgcaataatttaaaatatttgggtactgtgctttgtacaaccactgcggttcatattaggaaaagccttcagattaagcctatatcctatacgagtatgggttttaaatgacaagataaattatgttaaattaaaatgctgacacaaaagacctatgttttgtagaaaatccctaatagtttcagctttggctagattttcagcgaatatttttgaacgaaacttttctgtttgttgaatttatccagaaattacagacacatttccatgaaatattgtgaacttgattataatccctagtgtaagtaaccgatattcatacaaataaaaacatctctttgccttaagcaaaataaataataattaagttattaattaccgagtctgcaataatataaaatatttgggtactgtgctttgtacaacctctgcggttcatattaggaaaagccttcagattaagcctatatcctatacgagtatgggttttaaatgacaagataaatatatgttaaattaaaatgctgacacaaaagacctatgt

SEQ ID NO: 2510 - DNA, 3142 bp, Heterodera glycines
  misc_feature (3065)..(3065): n is a, c, g, or t
  misc_feature (3083)..(3083): n is a, c, g, or t
  misc_feature (3129)..(3129): n is a, c, g, or t
gttcaaaatctcaaaaattttcaatatttttccgccttcgtagatgaatttttttaaaacgctcggagtccacaatcccccgaattagtgtcgggggtcggggggcaaaaagtcgggggtcggggacctcggggggcgacatgtcgggggtcgggtcggggaatatgtcccaaaaaggtctcgggtcgggtcggggaggaaccctagtttaaactttctttttttataaatttcgtggtgccgatatgcttcgtcgacaattttttaaaaatcttttggtgcgatttgttaatggatttacaacctgaaaatggaaaggcataaaataaagagatagatagtttttaataaaaacctccaagagaaaaacttttcaaaaatattaaaaaataataattttaattacaaataaaaagaaaataaccaaatccacctccaatagaagaattgttttttgaatgattgcgtcattttgacccttttcttcatcatccctgtaaattaataatgattttttatagtggcttccgccataataattttttttggcatatttccatttgaatatttaattttttgccattacattgggcccacgtattttttttccggcggaagtgccaaggaaataagcaaacagatgaaaatattagaaaattaaccagcatgaatatgaggaagtattatgaaaactatgtcaaatgaaagtgtataaaatgaagggaaaaatggaaaatataataaaataaaatttaaaataagtacgaaaaacaacaacatttgataatcatttcacaatgaaagtgtttgtgctcttaatttgtttgctgttcataacaaaggcagaatccgttgaagaaaagcagccaaattatgatggccaaggttttgttttaagcaatttttaattaatttttaaataaattttaatttattttttcagcaaaatcttgtgacaatttgttctttttttgagttttagattttgacaaagacgatattcaaacaatttttgaagatgcggttgactatgcccaagctttggcattggtcactttgccgcacacacatgaaggaaggtgggaaaaatgcctaaaaatgtctaaaaattatatttaattttaaaattttaattttaaagaggtgacgaagcattgattcacccgtttacgctctttccgactccatttccacgacaactttacgagcaggcgatagaactacaatgggtggggaaaaagaccaattattatgggtcaaaaaaatatttaaaattttaattcaattaaattaaattaataataattcgtctcattaggcgtacaatttgttgtatttccgaatttcaaatgacttcgattttctcattgaacattatgaaatagcagcaaaaacaaatgcgcacgtcagacactatttgaacattatgaaagaagtcaaaaaggagggcattaaacagaaaaaaacgctgcttttaggacgatcggtaaattttaaaaattattcggttaattaaacaactttttcatcataattaaacattaggctaaatttgtttagagagtgtagcgcccaacgggcatttgcccgtttgacccagtaaattttgagaaataccgggcctgctgggtccggtcattttgactggtcttttacgggcttaaatttggcttacgaatctgtcccatatttaaaattaccttgacaaaatatctttaattcgaacttttaaagatagaacttaggatttttttaataagttgggacaaattcaacacagattttagttgtcggcaccgccggtccaagatttcattattatttaaaaaaataaaattggggctccttaagcaaatttacttattcatttaatataaaaaatccggtctcctcctttccagaatttgaagaaaaagcgcgtcgcaaaaaaacatttcgaaaagcaaaaaaatcagcaaatttttgaatcttatgaaaaagaatttaagttggattcttgaaaattttcggtctcatccctgttatattatgattttcttacaaaaatggaagccttaaagtcacaaaaatgttcctaattaagctgacaaatgagcttaaaaattaaaccttttaaaatatgtgaattaaaatttttcattcttttacattaattaatcttgtactaaaacagaaggttaaacgatttttttttgttaaattctaacacagacccggcagtttcaaaatcccgtgctcaaaaacttataaaaataatattaataattttaaatccaaaaatgttttaggattatatgtgccatgttgtgaaagacgagaactcagaaaaaggagaacgttatgagctaaaacaggcaaagcatcaaaataagccatttatttcccgcaaatcgaaatttcactttttaattatttcagattgaatttaatactggccaacttggcggtgtccatctcgcgcgtcttctcacccaactgcaccgtcggacaatgcaaaaagcgggccttgaagcatccaaagatcagcttctgaacaatgggtcggactttgtcatcgccgaagcgttattcatggcctggtaattttgggaataattatttttttttgggataaataacatcccaaaaacaaaaggtaattttgggaattgtatttttattttttgaaataatacccataaaatttaatttctattttaaatatttaatacctattttcgacctaataaaacaggctgacagataatttaaactttatgaaaaataaataaatttattacacgaaaaaacggaaataaaaaactttttttatgaatcgttttcgaaatttataccatgcaaaaatattgaaaaaaaatttatttattaaaatcagtttaatcaaataattttttaatttgattagtaaatttggtttaaaattttattacggaatatttttgttcgccaggactgcgtttggcgacccgaaagcggtctttctgttcgtggccagcaaaacgagtcgcaatcggtttggccaacggcaaattgagtaccttctcgagaaaatatcaaattacaanatgaaaatcatccgtatntcgctgccagcttgtgcagaaaaatgaggtgggaacagtgagtttnaaactgatggaat

SEQ ID NO: 2511 - DNA, 5662 bp, Heterodera glycines
  misc_feature (62)..(62): n is a, c, g, or t
  misc_feature (77)..(77): n is a, c, g, or t
  misc_feature (99)..(100): n is a, c, g, or t
  misc_feature (111)..(111): n is a, c, g, or t
  misc_feature (4826)..(4826): n is a, c, g, or t
tttaaaaattattcggttattaaccaacttttcatcatattaaacattagctaaatttgttnagagagtatagcgcncacggggcattgcccgttgacnncagttaatttngagaaataccgggcctgctgggtccggtcattttgactggtcttttacgggcttaaatttagcttacgaatctgtcccatatttaaaattaccttgacaaaatatctttaattcgaacttttaaagatagaacttaggatttttttaataagttgggacaaattcaacacagattttagttgtcggcaccgccggtccaagatttcattattatttaaaaaaataaaattggggctccttaagcaaatttacttattcatttaatataaaaaaatccggtctcctcctttccagaatttgaagaaaaagcgcgtcgcaaaaaaacatttcgaaaagcaaaaaaatcagcagatttttgaaattaaaccttttaaaatatgtgaattaaaatttttcattcttttacattaattaatcttgtactaaaacagaaggttaaacgatttttttttgttaaattctaacacagacccggcagtttcaaaatcccgtgctcaaaaacttataaaaatgatattaataattttaaatccaaaaatgttttaggattatatgtgccatgttgtgaaagacgagaacacagaaaaaggagaacgttatgagctaaaacaggcaaagcatcaaaataagccatttatttcccgcaaattaattcataatcgaaatttcactttttaattatttcagattgaatttaatactggccaacttggcggtgtccatctcgcgcgtcttctcacccaactgcaccgtcggacaatgcaaaaagcgggccttgaagcatccaaagatcagcttctgaacaatgggtcggactttgtcatcgccgaagcgttattcatggcgtggtaattttgggaataattatttttttttgggataaataacatcccaaaaacaaaaggtaattttgggaattgtatttttatttgaaaaataatacccataaaatttaatttctattttaaatatttaatacctattttcgacctaataaaacaggctgacagataatttaaactttatgaaaaataaataaatttattacacgaaaaaacgtaaataaaaaactttttttatgaatcgttttcgaaatttataccatgcaaaaatattgaaaaaaaatttatttattaaaatcagtttaatcaaataattttttaatttgattagtaaatttggtttaaaattttattacggaatatttttgttcgccaggactgcgtttggcgacccgaaagcggtctttctgttcgtggccagcaaaacgagtcgcaatcggtttggccaacggcaaattgagtaccttctcgagaaaatatcaaattacaaaatgaaaatcatccgtatttcgctgccagcttgtgccagacaaatgaagttgggacagtgagttttaaaactgatggaattatcatgctcaaatagtgggaaattggcgaacaaaagcggaaatttatttaaatattctgaggtcctgatttttctgagaaattttatataaaaatcccaggagaaattttatttaaaatatttttggaattatatttttatgtttctcctttttaacttattttagcaaaaaatcttgacaacttggtttgaaagtttaaatttttgaaattccaaaaccccgcgcgagattccgcaacttttaattgcgggataatccatcggagtccaatcacaaaaaaattgattcccaatcccgctgcgggatccgcaaatttgaaaactccggtctttaatcattaacttttttatgtttcattcaaaaaatttgaattcaataataaaaaagaaaatgatgtactaaaatgactaattgtaagatataaattttttaaattgacttttacaaaacctaaatcctcacatattgttgattctttttaaaacataaatatttcgttaaaaaaataaaaatattagataaatattttttaagattaacattggatccccaggacaacacattgcgtttgtatgggcaaaaagttgccgtcacttatatcgcaacggaggcgccaaatccgagcgacgatgaatggaaagtccgacttttgttcgaacgttcgacggccattgtaaaaaaattaaacaaataaatttttaaaaaataaacaattttagaaaagtccaacaattgggcaggatttggcaaatcagaaaaaagtgcagcaggtgaaaaaacgttattttgtgtagaaaataattgggcaaaaaacggacgactttttaatgccaacaaccatttttcagcttctgactaagccgggtatgttggaacgctttttgccggaacctgaacatgccgcaaaggtggaagcgcttcggcgatcctttgccggactgtgggctttgcacgacgaagacgagcaaaccgaacgggcaattcaggcaaatttgaaatggcaattaaacaaaataattacctattttttgccaggatgccattagaaatccgcagaattatgtgataaagccgaaccgggagggcggtggccacaacatttggggcgaagacctgaagcaaaagttgttgaccttcacgaaagacgaacgaaacgcgcacattttgatggaaaagctgaacccggtggttatccatgtgagttaattaaaagccattaaatattttacaattaaaaatgaggaaatattccaatggtttttcggtaaaaaaattgtcggatgtaaaacattctcttttaatgtgaagttttattcattttttttttaaattaataaggtttattatgaaaaatctttaaaaaatcgatttaaaatggaacttttgctgattgtcataaaatccaatgtttacattgattttattactttttaatctttttttctatttaatatttatttctcttttatttgagaatttattggtaaatttcagactgctgcttaatacaattgccttccatagatttatttgaatacataatttatgtaaaaaccatttatttaatttatttattttgtattttatacgatttgaccgtttgtcctttgtcattttggcttctggtcccggcattttccacaaaagcctggtccggtagtgccggtaaaagtcaggattcgaatcttggcatttatcgctttcgattatcattgctgtgccggatgggcgaccttttaattggcaaattcttttccatttccccgttcttttttttcagaattacattgtgcgacctatgccaaacaattacaaatacggcgaaatgaccactgagctgagtatcattggctacgcttttggcaatgtggacgaaatggaagtgaaaaagaatgtgcaaaaggggcattttctgcgcacaaaattagcccacgtcaacgagggcggcgtgtcctttggcaacggcgcttgggacattccctttttgatttgatggcacaaaaagtggcacgcagagaaacacaaaagattcaaaaaatgtcataaaaaattgctaggcaatcaccatgaacgagagaaataataaatattttgcattttattaaatttttgataaaatttggaatgaattaattttgcaattattaaccaattaattttaatgtttaaaaggccaccaaaaagaaaaattcacataataagagggcgaattattctgctttatcagacatgttctgaattcaaaaaaaattcacaacacaaatcgaacctgctttatccaatggtctataacatctatactttttccggattaatgtcacgcccttccctaattagaaattcaaaaaagactaccgttaaaaatttaaaaaataacattttaagacgcaaattgatgctcgaggcacttaatctattaaaatctcctcttctatattttttcaaaatgattcagagtgctgagaaagtttgaatcgctgagccctgtactatttggcataatttctgactgttcccaaattactgctgaattgtaatgtattaatttcgttgtatttaactaaaagtgctttaattttgctccatttcggataacatattttccattgattgttttctttaacggcgtcgtgtgccatcctcaaagaaaacgccgccgtcgatggcacaatatttgggacagatgcccttctcgccctgtccgccgggttgtccaggctgaccagaagcaccgggttggccatcgttgccgggcgatccgggcgggccgggaggtcccttcggaccaggttggcccggcagtccgtcttgtcccgcgttgccaggcggtccggggggcccaggtggtccggcatcaccttaacaatttttttagtgatggatggacaatttttacaactttcataccaggttctccgggtggaccgggaacaattggctgcgactgtgctggctgtccgggctccccgggtgctccgggctgtccaggctggcccgacggcccaggcggtccctttggcccgggctcaccgggcggtgcgtcttgcccgggttgcccagactgaccaggcccaccagcgtctcctggcggtcctggaggcccaggcggtcccggtgggcctgcagggcaaggcttacacggcggctaaatgttgcccaattttaattaaaatttcaatggaaggcgccaaagcgcaattctttctataatcgacacggtttaacaccaaagctgtgcactggctttaaccttataatattttctttgcaattcatgaaaatttggttttacattgttatntagaaaatataaataatcattttttgtaatattttataaattatttcttatttttcattagtttttttataagaagtttgacatttttaattttgataaaacacaaaattccagcctcaccggtgtgactggctcgcacggttgggtgggcggtttgcccgggttgcctggaagtcccggtgcgcccggtttcccgggacggcccggtttgccaggcgtgccggctggtcccggcgggccaggcaggcaacacgcgtcgcagccgcccccgctggccgcttgctgctggccgcctgccaccccgctggatggcgctgcggcttcgccatagcctgccgcttgacgagccgtacgattgtgcgccgctcccccggttggcaccacgtgccgcaactgattcacctccgaccaaatgtcatgagcggaaccctgcaaaaatatattgtgatcaaacccttaaaaactatattttttaattttactcataacccataatagcagaattgtaaccataaaggcattttgtgaaggttcctctgataatcgactattattgtactttacagtatgcattttgtaacaatttcaccgtttaccttacagtagttgacttcgttgttcatgctacggcgcacgtggtgcacatagttgtacaccgaggggaagctgtaacacacaacgctgagcatccgaaacgacggaaaagcaaacggcggaataagccacgaatcggtaggctttgatccgattctcaagctcaacaatcatttccatgatttccttaaaatgacacaaaatgattttttctttttcactgaaagagactaataatttat

SEQ ID NO: 2512 - DNA, 4130 bp, Heterodera glycines
tggtcagatttattgacaaaaaatggaaatttttgaattttcgagatctctgtgatttctaatggaaatgttaagaaaagaaaacgatgggttgaaaccagggctgggcgcaactggattttcaattacggaaatccgcaatccgcaattgcggccattttttcagttgcggaaatccgcaatccgcaattgcgggggtcaaaaaaccccgcaatttcccgtaatccgcaatccgtaattttcaaaaaaatttttttttattttcaaattttatttaaaaaatccaatctaaaaattggttaagagtatgatcagaataaaagctttgcatttttttgaggcgaaaaatcccaaaatatgggccgcgggagaaaaatagtaaaaatggcagattcagagttatggtcgaaaatttttaaaattttaaaattaaatttcaataatctcatccttgtagaaacccttttaaaaccaaattaaaaagattttcctggtttggcggttctggaaggcaaatatttccgtaatccgcaatccgtaattgcgcccagccctggttgaaacaaatattaaaaaaataaagcattcgcattttttggttttacaatattaattactgtaatttgaatgtttattgtttcttcaaaattattttttcagcacatttgcaatttgaaattgcgaagaattcaaactctagtctaatttgaagtgtcaaactacagtataccaaaaattgtctacggtttgggcagttaaatttctcaatgttatttattatgacccaaaatcaactttaattaaagcttcatagttttttttttctagaagaatacaaattaatccttcatgctattattcgagagctctaagaattctcagtctacggaagtttagaaaaaacgacccaaaattctaaaagaatatagcaaaataagtgaaaaagcgaattttaaaatattttggccataattttctgaacaaataaaactttttaaatatttacaggctaatggagaacccttagtgctatcgcatgatagcaagaatgtttaattttggtgcttctagaaaaaactatgaagcgttaaagatccatgttattatataatttttatggtcctgtaaactttagtaaagccgagccatcaaaaccataaagactttatctcatcatatgccgatatatgcacaagccattcccgttcttttgtcacgaacacgagaatggtaatgctaatgaatcagaaatggacagtgatacaatttcttacccttcactttcgtttgtcctaaaattgtctttttttgtcgcaatatttgcttatggtcccaatttgcttttttattaatttttttaaaccggtttccattagaaaataataaataatttggcgttcgttggccgcaaatatttccatcatccgccggccgtaaatgtcattttaccccgaaattcgttcttctttcttcagaaagttatgtgcttaactcaaagcattgaccagcagcagcagataaaaccgctttcagtttgtcaagctcattttttattaaaattattttgtttgttttaaagctgaattcttaaaagagttagcgtcgaatgattcatagccgccactcggcaaaataatttggaaaacatagagcatattgacttccaagtgaatattaagcaataaatgaagctataattggggacgcctagctaagtgaaatcaaaaaaacaaacaaagacaaactcgagattagttgatctaattatccgaaacagcgaaaactaatgaatgtaaataatttaattggtccaatgacaaataattcatcattttaatgctaatgccttttttagcttttcccaaattaacttttaaacaatcattttcagctgttcaaactttttcacatgaatgaatcacatttctcctctataaatatttaaggccaaaatttgttcatccaaaaaaagtcatttccaatttttctattctctctttcgtcactaaattttcattatttcaatttaaaatctataaggcttaaaaatgaaattcataattcttattttattgatgcttatatatcagttatataattccctgcaacaggtataataagttaaggaaaaaattattattttttaatggtttgtattcaaatattctatttttgtataaaatctccaactcaaagatcctttatttttattttatgttttgttttaaaattgaaaacaatttagacataatttgttaacaaatcacacctaaatagttcaaaacataaatggttcttgaaactagaaaatatgatacaatatgaatgaaattcgaatatgtaagagagaagaagctgattgattgctcatttacagacggacaatcagcaaatggaagagcttcggaagcaggaggagcaattgtgggaccaaatgagcgatgtgaaagacgaaaagcaaagggagaaactgaacacggaactgcaagaagtacagggcaaactgaacacaatttatggacagatgaagcaaaaaaacacggaatagagaaggagaacaatttggaagtgattgatgatcgatcgatgagacacaaaatattcgagaccgaaaaaaaagaattttctcgagtagaaaaaggaaaatcacttccctaaaggatgatgaagaatggcgaactttgctgggctcaaaacaagtttcgcttcttagaaatgtattttttccggcaaaattaatcgaccatttgtcaaacaaaaattttgcgaattgagtttcgggggtgttctaaatctctcacaaatttttgaaattaaatggaaaatttatttaggaaaaacgccataatttcggtaattcgtaaactaggaatacgatttttaggttctaaaaaccccccaaaaataattgttaaaaatgggaaaatagttgctaaaaactagagtgcagcgggaccgggaattttgggcttaaccgggaccgggaccttttctggttgaaaaccgggactagtcccggtcaaaaccgggaccttaattttaaaaatcaaaattcttgtcaagaaaataaataaattattctggagatgaattttaagaaatttttcatttattaggagtgtattttcagaaatttttggtcgatttttaggggtgtatttttcgtttttattgcattttgttaataattttcggcaaaataccaaaatagggtaaaataggttgtttcaataggttttttaagttctaagaaataaaaacctatgtatatagattttaaaaactcgaagtatcttaacaacagcaaaaaaaacatgtttttcgtgcttttgaggtcacagggagctcaggaaaaaataggtaaacgcctaaaaatcgtatccctattcgtaacacataattcgtaatttaataaaaattatttattaaaagacaaaaatcattcaattgaatagcctgttaaaagctttttgcatttttagggtgtattttagccgcaaaatcttgttttaattgggaaaaatatgccaatttatggggaattttttgattttgggtttagcaattataaccgatatttatcaagtattaccactaacttttcttagaaagaacttagaaatcttgaaaaatgcatacaagcataactttttatgctgatcaattaattgcttgggaacatctaaaaaactaatttacaatatgtttttaaatctatttaatcattttttgaaaacttgaaaaaacatcggtcatttgaaataataaatgctaaaattttgtccaggaaaaggtttttccgtgttttgcctggacctgattttttcacatttgactggatctggatttactggacatgttggtctcttaactgattaaaatgaggtccggacaatccgtcagtaattgacaatcctgacaatccttcagtggattatccgtcagtggacaattcgtcagcaaatttatttttgagcaatgatcaaaaatcttgtgaaaatgattgttaaatttaacaaatataattttcattgattcttaacgtttctagtttcttgtacttcttttaattgacgatctcgaaaaaatcatcatttaagtttttaaaaatgattatttcataattttta

SEQ ID NO: 2513 - DNA, 3505 bp, Heterodera glycines
  misc_feature (3477)..(3477): n is a, c, g, or t
  misc_feature (3494)..(3494): n is a, c, g, or t
agcccaaaaatagcattttctccgaacaatttttggcttagagcgacttataaaaacataaaaacacatattttggcgttttggcacataaaatatgttagcacatattttggggtttggcacatattttgcacatattttggcatttttgagaaaaattgcaataaaaatacaagaaaattgaaaaatacacccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatccgagccctaattatatggcaccaaattttgtcatgtaccgatttaaatcccccgcataagtcatgggtgccgaaccgtcaatttaaccattttactgattcctaaccaatttttaacacaccaatcaataaaaattagtgggtgtcgcttgttagtatccacttgcaatgaaggggttcaatactcgaacagaacacgaacaaatttatgcacggaaataatcatacggatgaagcacgattttgggacaataattaaatagttaaagcctaagagattcagaacaactagcaaatctccacattacgcaatataaagtcatcatcatagatcggtcctcccattatgctttcttctccaattcgatcaggtgtttcactccgtcgtacatctgcttcaccgcttcgaactccgtgagaccaagacgggccttgttgctgatgtcgtaaacgccgccagcgctaaatagaggaaaattgtttcaaaaacagaacaataaacaattacctctcggaatgttcgccgtgaatcccgcggatttgcaatttcaggccgtcgcagatggacttgaagtcgggttttgcgctgatcttcggaagtcggatatgcacactcgcgcgaacagtcgttcccaagttggtaggacagaaagtcagccagccaagacggtcgtcacgcgaaaacggaactttcgattcgatggccttgactccctttatgagacgctccagcacttgtccaacattgccgccattttgcatcgaaatgatacggaggtgcttaattgaaaatcgatatcaagatggaatgaaacaaacaaacatacatcttcctcgttgacccacaccaaaaaggttttcttggcgttatggaaaattccgcgtccggtgggccaataacggcaagcattggcctcctgcagaaaacggtcgccctctttaaacaagaagtggtcggcaatcagctaaacattcaaaaattaatggcttattatttgttggatcgaacctgattttggacgtccttggtcatgccctggagcggatagtaggtgcctcccaactcggcatctaaaacataatgttacaaagaaaataattagcggttgcataccgcccttcagctgctcgaagaccgctttgacctttgattccatctcgacgtaattctccttggtcaagcatgggttgaatggatacccctgaatacgactgttttttggtatgttaaattcaaacaaacacctgaagagagcggccgcaacgaacgcgagtcgaattgatgaatttcccctccgggtccaagtccgtcagcagttgagtcttcccctcaccaaggtccgttgccggttgcttgctgctcggtccaaagccaccatgatagtcgttgatgatcgggtcgaacaatggtttgaagagtgtgtaagcctcggctgaatgaatgtttaatggttgtgattatgcgtagccatttaactgaccatctggcgcatacacgccgacaccactgtccaagttggcaacccccgactggatgacgtccaaaaaagtcgctccgagcttggtacgcttgtccttgcatgcatcgacgacgtccttggtgaggtacttcttcaacaacgatttgcaatcagccgccgcctgaaagttagttcaaaattagaatagttaacacacacattgtgtgcacctgaagctttttgtagccagcctcaattttgtcaattacttcctgagggacagccattttggtttatttcaaataatatgtgtgtctgaaaataaaaatatgcatttaaagagaggacaaagttagtgtaagaaacagagatgattaaattggagttcaaaaaaatgagtgaatgacggacatacgagaacgcatgaatttatatactaaaatttctctggagactcactttggctatgggtcaacttcactgtgcagagaaaagcatagtatttcatcgtttctctttttctttgtaatttttctcactttggcgtactatctattcattttaattacctatataaaaaacaacatttacttcgtgacgtttacctttttatctacatgttaaatccgctttaaactttgcatatcaatagagaaaaaaattctgcatagatttctatgttgaatttttgaatttatctgttagttcaagttataggacaaacaaaaaataatatttcttttcctctcatcttggcgttcttttttcaagtctctaacacatgaaaaaacatcaattcgcaaattctaataattttgcttataaagatacaaatcactttggacatttagaaaaaataaaaataaataaattttagcattttggttaaaaagagctgcctagaccttgagttataacgtaatgaaaatttgaaactctcacaactttttttatgagttaaattgcttaacgtttttaaagttgagatttgtgtaactctcggggataaaagaataatgagaggaataaagttagcaagcaaagtaaactgagatgattttgataacaaaggcaaaatttttaaagatgcgaaagctgaggtgaagaaagaagtaacctcgacgaggagaaaagtttgtattttatattgatcatctcagtcagcaaaagtccgactcaacttgtctacctgggatgaaaatacaagaaatggagagcagtgaggagaaatgacagcagttatgtctgtcagctctcactaaatgagagaaaagggaaatgagaatttgtgaaaggagcagaaggcgctgcttaaaagtgcagcagcagcagatgaatgaagcgataatgaaaaagaatgaatgaatgaaatgagggagtgacagaaaagaaggaaagatttaatgaatttcgagaaaggatatgaaaangtgtcaaaagttaaacnaaactagagga

SEQ ID NO: 2514 - DNA, 1907 bp, Heterodera glycines
taaatccgcttaaaccttgcatatcatagagaaaaaattctgcatagattctatgtgaattttgaatttatctgtagtcaaattataggacaaacaaaaaataatattcttttcctctcatcttggcgttcttttttcaagtctctaacacatgaaaaaacatcaatttgcaaattctaataattttgcttataaagatacaaatcactttggacatttagaatcaaagaaaatgattagttttagcattttggttgaaatcatcaaaatgattaattatacatttttaagatgctttcaaatcgcataagcattttgttgccgcattgtaaagtccaatttggcatccgaaattggcatgatcgttctcaggtgcctcgcatttttgatgatcggagaaaggcaacaaacaaaatcaaagacgtgggatattactttcgttatcatcgacctggaatcgacgcattgccgcggatccccgactgcaaagagcagctctaccggccgaaatacaaagtggggccagaaaaaggagagtttagactggttgtgtcttccgggaatgaaactgtgtctggaagattgggttacctccattttaaagcacattagcacaacattcggtgaattaccccgttcagcgtttacacggtcacacgaacacctaacaatcgtttgttatccattgggtggttttaaattattgtagaaatacaatatttgatgtctgtttatccctccttaagattcgtgagccttggcgcgaaagtcaggcgagatttggcgagaacgactacatcgacctgctcggagacggctctctccatccggcccaacttcagtaccacgtcccccgttggctgcgcgggtttcccgggcaaaacagagcgattgagccggtcaagctgatccactacagaaacctgtacaagtcaaagttggagcagaattcgcctcacaaatggcaccagctgaacaagcgcatcaaatatttgctgcaatatcacaactacgacaaatcggacgaattgagggccgaacggtcgctgggactgtgggaggaggagccggactatttctacaaggacaaatcacgccgatcataccaagaccttgtgtagtttattgtttcgtcattcagttagtgaaaaatgcattggcaaaattgggacaattacaacacaaattttattggcgtgggaaaaggaaaatgttccctcgtggcacccaattgaacgtttctcgacgtgaagtggccaatttcccggtgtataggtcgatgttgatcggcacgaactcggacccacgaaggggctgaaacagtcgggagaacacttacaattagtcccatgcccggaacattgggtttgagttccacagtgttttgaccaccttggactgtccaaatacgctttggtaacgggtcgacaccaacttccttctgctcagtctctcattggtcatctgtcaaaattggtatttcctcccctttttgtgatctcaaaattcaccggatttttgttgtccttcgtttgcttttgctcttccctttctctcccttttctcgtcgtttgtctgttcgccaatgatttggccattgccttcggctgccaatgtcccttttccccgtagccatcgctcagtgctatccacgggtagcgaaccctcacggacttttggcccttgcgaagaaaaccccaaaataacgaataatttacggtgccttttttacgttatttctctgcgacagcaccaaactcagcaaaagaagcgaaggaacaaatttcaaaagcattggaggagaagaaagggacgcaatcaaaagcgaagcaaatgccgtcgccactggccggaactcatttaaataaattgtgcaaaaatgtaaatgacgactaacggattggccc

SEQ ID NO: 2515 - DNA, 2199 bp, Heterodera glycines
tagtaaatggtacgctcgtccagcagatgggccgggatgacctctttgatcactttctctttcaaatccgatcggaccacctccaaatctccatcgaactgtttgtgctgggcggaaatgacgacggtatgcacgcggaccggcacacaggcgcctttgttgaatttgtactcgacggtgacctagaaaagcaatgagaatggcacggccaaagactcggcacacctgcgacttcgagtcagggaaggaccagccgagggagccatccctcctcagctggtgcaacttggccaagagtttgtgcgcgatgagcagagacaatggcatcgcttcctccgtttcgtccgtggcgtagccgaacatgagacccttaaagaaggcaaaacaataaaaacagcaaagtgagtgccctgcctggtcacccgcgccgatgtccttctcgtccgctttgttcatccaaacgcccgccgcaatttcgggcgcctgctgctcaagttcgacgaggattttgcatgttttgtaatcaaatccttgggaatttgaagtacggtgaaataatgacaagtcccgcgcttcatcatttcgtcccctttcgtttttagatcccccccccccaattttcctccctttcgtcatacctttgttcggctcgtcgtcgaatccgatcttctgcacgacatccctgaccaactggcgatagtccaaattggctttgctcgttatttcgccacacaacaaaatcattcccgactttgtcactgtctctgaatcgcttaagtcgtcaacccaatttgcctctccacaattttcccaccgcaggcgacttttgcgtttgggtcttggccgaggtgggcatccaaaacggaatcggaaataatgtcgcacattttgtcggggtgtccctcgctaaccgattcgctggtgaacagaaaagtttgacctaccgcttctgaatcgaaaaattgtgtattaaacgaatgaatggccaaggaaatgccgaactgaccaggaacgacgtcaacatccatcggaatcggaggcattttatgggaatttggaacaattaaataattcttgacgagctaaaaagctgaggtcgtgaaaagaaaataagaagaaatgagaatcaactgaaaatgcaaagcaaaataaagtaacaaagagcaaagatttgaaattagaaatatgtaaaaaagggggaaggatgggaaaagaattagaagaaaatgaaccgacggacgaacgacggaatgaataaatgaatgagcccttctttgtgtcacccaatatgatcattatttattcaattcgcatacaaaaaaaaattaacaaaggagatcacaaagatgagtccagggaccgctaaaatttaaaaggcaaatgctaataccctaaaagatgttgaatcctgtgctcataattagggctgcctattttatgtaaatacatatttttttcctggcttctccttgctctaaatagcaggaaaacactttcttttttgtgtttgcaaacaaaaaccgggacttttatttacatatttttacatatttcgggattttcttacatatttgtacatattttggtactggattttttcatatatattttcatttttttacatatttttacatattttgaaaatttataaagaaaaaacctaaaaataccaaaaaagtaatttttatgtcattttgtggctatttcatactttacggggattttctttcccaaaaaataccattaaaaaaaatttttatttacatatttggggttttttgtacatatttttggcagccctactcataataaaatgaaatcagaattcgccatttttgttcaaaatacattaattaattattctttaattttttgaagcattattttttcgcgatataataaattattcaggggcgtacatttttcgggggggggggggggggacctgacctgaagacctttttttttttttttgctatttaaccaataactttttttccctgctgggtaacaactgcactttttcactaaaaattaccaaattttggccgttttaaggcaaaaaacttgtaaaaatagtggaaaatgtaggtccggcggtgccgataggcgccgccggaaaaaatttttggaaatttgagtgctacttgttacgaaatttgcctattaaactttttaattttcgtttggggggggggg

SEQ ID NO: 2516 - DNA, 1446 bp, Heterodera glycines
tcttcggccccttgggcacgttcattgcgatcagatcaaatcccccaaccggcatcggaggcacttcccattgctcaatctctgcgcgcattttcgcatctgtccccacatatttcatcagttccacacactcgcgtttgatctgttctctcatttctcctaaaaaaacaaattctgatttggtcccgcctttctgccgacctcccctctcgaaggtttggttcaatatgaaatgtcggaagtacgacggattcgcccgttcttcgctcgcctcttccctccgctcgacaatcgtctcgcaaagccatttctccaaatttgaacatttgcacagcgattggaatttgttaacgtcgtccgaatttgcaaaaagtgcgctgagtgcggtgctcggctcaatactcaatttcccgtcgtcgccgttgggggcattcagacgcgaaaccctctcgaattcatccactcgatcggggcgaagtgcgaggaggggaccgaggccacaatcgaccaacatacagcgcagcacgggggcagccaaccgccccacaaggatttgatgcaattccatccaaattcgctcaccactgacaccctttgggaaggaaattcaaaggcaaatattattaaaaatgagtgttaatgggcacctactttgagcccatctcggcaacggacgatcgcttccaaatttttctgttcatggggcgcgtccaatttggagaaacggccgaagaagcgaaagtatcgcaaaatacgcaaataatcctggaaatgggctgtttatgtaactgcaatggactgacattgagcaaagttaaacctcctgaagcctttggatggggtcaccgacaaaaatgatgcgccgctgtttgacgtcttcgataccaccggtgtaatcgtagatgagcccgtcgagaccaaggaagagcgagttgatggtcaagtccctgcggaaggcgtccaactcccagtcggtggtgaagttgaccttcgccctccgtccgtcgcacaccacgtccacgcggagggttgtcacctcgaagttctcgcggtcgtttatccgacatgtcaccgtgccgtgctcctcgccacgcttgttgaacattctgatctgttctcgctcaaacatctccttcatttgagttggcgtggcgtccgtcgcaaaatccacgtcggacggtcgcgtgcccatcaaaaggtctctgacagcgccgccggcgatcctttttggagaaacattaagagtaaaaaaagcattaagcaccgaatctcgaatccatgcccctcaaacagttgggagagtcgggtaagttcgggagtaaacaacgtacgaaaggcctcagactcatccagcttcattttcacgagttttgacaatttcggtttcgcaaatagcgtttgaattaaacgacgaacgatcacattcatttactaagaattagacaa

SEQ ID NO: 2517 - DNA, 1054 bp, Heterodera glycines
tgtgctgagggtttcgctgatgatgtcgaagcatttgcattgtcggtggagtggccggggacggagagtcctattaacaaaggagacgatggaaaccctaattaagcaatgatgccatttgccagttattacttccatttgccgttgattttcttcaacaactcttccaatgtagtggagggaagaaaatgttgggtcggaaacgtaggaagaagtggacggatggtcgctgcaaatgctgcaccctgtcaaaagctcggccagaaagggcacaaatgcctgaagttcaccagtgtaaacacaaaacgatggaagggaaagacctgcgatcggctctgtgcttcgctggaactgacagcgtttgactggtcggaaggcttggacaattggagcatcacttcgccaatgtgcagattcgtgtcgcgttggatgtcttgctctttggtaatgcttgccaaacagttgcgaagttcattgtgttcagcaattcccgcgttattcggtgactctttgaacgccgtcgatgcattgttcagaatcttccaaattgcttctgagtagcccccgaaaccggccacttggctcagcaaacggccaaccgcagtgtgtggggggagaaccaacgagaatcgaaggtagttcagccagtcctctttgcaagcctaacatttttagagttggcattgatttaataaagaaagaaaataaagcatggcaccttattctgcaagagaacaacataagacttgagcacattggccaacaaaatgtctcctcccaaaacgccaattgtaattgtcggaggcgacaccgaattattgttacaactaaaagcccaaatagtgaaccttcaaaattagttaaaactcacaaattctgaattctccaaatgattgcttgcatcaatgcccgaacacttatcgatgatggacagtcgagcagacaaatcgggtccaacaacttgttgtttactgaaacaattagtgggccaattaacaaattccgaagtttaacaacaaaaaaaaagtatggaccctttgaaatccaaggcaaa

SEQ ID NO: 2518 - DNA, 1932 bp, Heterodera glycines
cgctcattaaggtgccaaactttgctgtccccgtgcactcactgatctggacggaaatgaatacaaaaattggattgcggcggaaaatccggacatggacattgtcatttctgcgcacctttcaccaaattggaccgtaccatccaccgtattcgagctgacgtatgaatcaggcaaggaaaatagaaaaataaattttatattttttaaatttaattttatttttaaattcttttgttttaaatgtttttccaaatcagaaccattattacacaattaaaactgttcaaaaatgttaggcaacgccaaactcatcaattcgagcaaatgccctcatgccgaaaatgtttatgccgagaaaaggaaccccggcaccggcactttgcgttgttataacccgacaaagaatcaatattatgactgctcctgtcacggtgataagaaatgcctcgctgaagaaaaatgggcacacgaccgctttctttgtccaataatgcaggtaattaatgaattaattaattattaatgtattaatgccaattaattgattaattattaatgtattaatgccaattaattaattaattattaatgtattaatgaattattaatgtattaatgccaattaattgattaattattaatgtattaatgccaattaattaattaattattaatgtattaatgaattattaatgtattaatgccaattaattgattaatttaatgtattaatggcaaaggacactgtgccgccgaaacatttcatataatactggcaatttaatttttttggccataaaaattaccattttttgtatcaaaaaagcggaatataagaaaaaaataaggacaacaagcggaaataaggacaaatatggcaaatgataaaccctcatttattaattaatctgtaaattcaaggtcaatggaattcaaatccaaaaagatcctcgatacaattggactcgtcttgatattgattgctatgtgagccgagttttactgtaccttttcaaaaatttgtttgattgactaattttacagaaggccgaagcgggtaccgtaagcttttggggctacagtaagccggacacaaaggaaatcattcgggtggacgaaatccactgtttgactgatggagtgctaaaacggttcaagagtttgcaagtcgatgaacagtcgccgatgaaaaaactgagtccaacgagtccattcttggccaataatgcttcatccctaatccacgtgttcgtgccatttgtttaagtccctctcatacatttatgtatttttaaacacataatccaccagcatgggcaaatataatttgttggctaatatctctcccctaaatacacaaaaaaaaaacaatgactaaattttgatttaaatgcatataaacaattaaacatttaattaatgcctgtggcggtgtctgtttttgtttaatttgttaatttcatttttatgacatagcaatgtattttattcatttatctaattattttgttgttgtttttatttcttattaaaatggataaataaaaaatatctcttgaaataaaaaccgcaaatttttatttgatttttaatttttgaatatttaaatacagtaactatacgcattttttaacgaatcatccaccagcagcagcacagcacgtgctataatttttgacagaaattacacaaataattctctcataaatagaaaaaaaagacaaaatttgaaattacaattaaacgcatcgaaaaaaaaaattaataaaacattattcatttattattttgtctttgtaaaatccgtgccaaaacccttccagacaaaaaagtgcaatgaaaaatttacgtacaaaaaataaatttcaaattaaataaaattttaaaaaacaatagaaaatatataatattttttcatttctgggagtg

SEQ ID NO: 2519 - DNA, 1146 bp, Heterodera glycines
caaattgtagtaattatttgacccgggagccgcgcaagatttttgtcttgggctctcgtacttacaattcaatgacattgaaatggttttacggcaaaatcaaattgttactgagattctgacctcatatgctttggtgccataaaagccccccccccccccttgaaacccaaaaaataaaattttccagtacggatgattttctgatgattttgccaataatttgtaaaaataatgaatgaataaattacttttgtcatttatcggtgtccacaatctctgctacaaaatgtgtggtcgtttgtccgctttttcttctgctggtggcttttcccccacttttttacacgtcgacacagaaaattcagtgatttgtccaacgacggaatttactgcaccaaccaattccatcccaccattttcatccattcatttcatttgatcatttgggaataaatattttattcgtaaaataaaataaaaatattttttaatagtaaataaattaaatataattaatattaattaactagcaaatgaactctttttctctattgaccgtctttctttgcttggtcattaattgctcagctcctccgatacggtaatttcataagtaatcaaaaaccaataaatattttaaattttaaaagcatttcaaaataatcgagtccaagccttgattcaggcctaatcaaagcctggatatttggcctgaatttttctaatttttcaaaattttcaatttttcagccctttgtcgtccgacgttagcatttggaaattgtgcaatggcaaaaatgggaaaattttggtggaaaatggctgcacaaagtaaaatatttcaaaaatttattttaaattaactatttttaaaccatttttaggcttcttctctgctaccaaagcgaaatggccaaaaacagaaaaatcggaaaacgttttggggtgggcaaaggaataattggcaaattgaaatttgtggaatgtgccgaagagattgccgaagaccaatggcacggtctgatcattacgaagcaccaagacggagtgatcagctacgaatcgaggcaaattgggagagataaaatattttaaattaaggtgggagttaattaagccatggattcgacgacattttcggca

SEQ ID NO: 2520 - DNA, 3291 bp, Heterodera glycines
caaaagtaaagccaaattaataataatattttaataataattattattttacagatgctgaaccactcggaaacgaacttcgagaagcgctttcttctgccgcatttttggatgattttatgccatttgttttggcattcgaatttggcacaaaattttgcgcagaaaaggccggcaccaacaaattgtgcaaagagaaagtccaatttttttatatttaaaattctcaatttaattaattttgatttttagtgccttacaaaggcaccgtttgttggcacaaccaaattccatcgcccaacaacagcaacaacaacaacttcaatcccgacaaccacggaacaacaaacattttcgtttcaaccattttccgaatttgtgtcccattttggcactaattgttcgaaaatcgttttccccgtggaggtggccaaattcattgtgaacatcaccgctaggccctaccgaattgcgtgcaatgactatgaaaaagagtacgaaattggacaattgccaaaggattatgtggcaaatgcatacaaaggtttcttcaatgcttgcatgtcagtgccgacaacaaaatgcgcaaagtgattgaaattctggcacaaaaatttggtgccaaattctcacaaattgtgttttaggcatgcggaactgaacgcatgctataaaagcatgaagccagtggtgccaagcaataatgccatcgccaaattatgccaaaaccatcttaatgaatcgaatgctgccggatttgctgtacaaatttgcatccatcgcgatgaaaaggaacagaagcttgtctttgaaacatttttgaacctttccaccacagacgaattgtatttaataatctcattaattaattattaattgggttaattaagcatcaaaatgacgcgcagctaccaaatttccattgaagaaattatagagacaaagaaaactattcccattttctttctcgaatttggcaccgatcaccaacaaagcgcaatccgtgaaaaagccaatgggaaagtgatcagcgaatcactgaatgaaaatgtgaaaacaaaatcgatttttatttatttttaaataattaattaattgaaatttaggccattggcattggcaccgttctcaatgacatcaaatcagaaaaattcaatgaaaatttggccaaaatgattcatttggtgccgcctgttgctgatcggatgctggcatttttccagattccaacgccggagttctccaaactgatcagtgcccagacgaatttgaagccatacgaaaataacccaaaagaagtggtaagaaaaattgaacaaaatccggcaaaaggattgggccaaaccatcactttttaatttaagccgagacttggaatggagccgaactttttaaaagtttttcagaaaattatcaatcatatttaaatgaaattaatttttaaaaatttacaaataattaattttatttgttccaatcatatttgtatcatcggtgggcattgtttcgcggagtgtcaaccaaaattacaaaaatgaaaattacaaaaattttagggcagatcatcaagatgcgacacatatggaaaagactgtgcagtgatcacgaaactgttgaacaaaattgaacaattgagaaactgtaaaaatgaaaccattgatacggtaattaatcaaagattttctaaaaaaatagaaaataattatttgattcttttaaattcgagaaaaatttagtttttttgaaaaaaaatgtgtatttttatttttattatttttatttaaatataatttaaattgttttctatggttgggttgttgtattcacctgactaatcctcttctcggaattctaattatttctgctccgtgtgcttaaattacgcttttaagtctggttttcgccttcccccatcggtcgatgttccgtcacctgcgataccgtacctaagtccgaccaaaacattgacgtgcttcggtgatatgtattgtaacaaagaaatactgcagcaacaatatgaccgagaacgcgaaagtaagttgaggaaggaagcattttaacttactgtagtcgattgttactgtataaaaacgggtttgcttcttttgcttgggaagggagcataaagttactgtaggtactttacagtaaaaaatgtttagttcttttgcttaggaggaaggattatttactgtagttgactttcacagtatgaaatgggtccgttttttattggggttgtagagataatttactgtcgtcaatttgtaagtaaaacaccaataagagcttgtcttgggatgggaaatgcgcacgggattttgctggtctctgtccgtgatcccgcattttttcgagcaggaattaggggttagttccgcgagatctctccggtccaacaaaaccttagaaaaacggagtattggaaaatggctaggcctaaataggtatgtgatcaatcaatcaatcatcaatcaatcaaaaggatgtgggctcaagccagaaaatctgatcagccgtcggaaaaggcaatttcgtccgttgaatggaacacaattgggcaaatggaattcgtttccgatcatgatcagttccgcagaaaaaacgtaagtgattttaattaaaaatgaaagccaaaatttttataaattttaaaatccgctcttggccaatgcttcatccatcacttatccatgtgtttgtgccatttgttgaccgtccatgaaaaagagagatcagtgatcagtgaaatctgtcatcatttgaaagctttatgtgtgctccatatttacatgtcaaaatataaatgaagaatgcaaggcgtacaaaagttatattgctggcatgtggcgccgggaaagccaagaaaaaagtcggcgctacttgcaaagagcacaattttgaaaattttttcaacttttttttggacaaaattttttttgtttaaaaagtcctgaaaccaagtacccggtgattttaaaggtagctgatctaaaatatgacaattatttgattctatcgcgaatatacctataatactgcgtaatcgtgctgctaatgctgattatgctatcagagattgaacaaattgaaattgaatccgattttggacatatgcgcaaatgtttgggcacgctttttctaccttaaaagacacggcttaagaaatttctatctttatgtatttttcagtgcgaccacaattcttaacaattacatcattgccattgttagggcaaccgattatcagaacatcacaagtaattagaactatggaatctcgaaaacaca

SEQ ID NO: 2521 - DNA, 1552 bp, Heterodera glycines
tcaagaatatgacaattatttgggcctatcgtgaatatacattttattcatcataattgtgctgttaatctttaatattcatcattatgtgtaaaaaaaacaaaaaaaaattttgaccaaaaaaaagttgaaaaaattttcaaaattgtactctttgcaagtagcgccaaaaagtctatttttgtggtttttgtaaactgacaaaaaaaaaaatttttttttgaagtttcgcaaactaatcaagaaccttaaaagtttcgaatgataccaaaattatttaatttggtgataatgacaaaaaattattaacagtcaaacaaaattcttctccgagaaaaattttggtaagtcttgaaaagtgtcgaagagaccgaaaacccgagacgaaactcaaaaccgaggccaaaaagagcccgagacttttctcgagtcgagactcaagactgtgaatcacgaacaacaatgtatgcgaattgcttttgtacgaattgctgcaattgacccaaatcaccgggaaccaaaaaggcaatgctcgcagtgaattttttgaattagcgctgcaaaaaatagtcctttttggcgttttgagcgctttttatctgatactgtgggtggaccacaatagatagtggtagtacattacaacagcctggtaagtttcaaatttgcggatccctctcgctgtcccgctgcagaattggaactcaaccattttttttttctcgggatgagatcccggccggattaatcccaacaaaattttgtctaaatttttccaagttttaactaccaaatgatagtttagggaacacaaaattttatttgcaatggctgaacccgttgaaaaaaagaaaaaacttttccccgccgccgaacattgctcaagttcttcagcagccgaaattggtgaaaatcagcagcagagctcgtcgttgggttcatttgtggcagaaattggaagacggcaaggattttattttgaaaatcgaacggaattcactaatagagcccgggattttgaaagtaccgggacccagggttaggcatttgaccggcccgaggcctattttggtcaaaatgacaattttgggtaatagtaccgatggtatcacaccttttttgaaatttttttagaaaatgtctttctccctaccaatattgatgatacggttttcaggggcgctgaactccactatggcatccatgtcactcgcattcctacccctgtgtgcttttcttgcgatcctcgtcctcttcatcctctcgaaacgcaccagttgagttgggatacccgcacatcagctgcattcgattgtgtcactgcccctcgaacaaaagaccagagcgccaccgacaaactaaccctcctccagggcaaggctgttggcataagctgctttattggacaacatcatccactttatcaccacaaagcacatcgacagttgtcgctatccaagaaacaaaatggacctccaaaaggcgtctcgccaagcgccctggactttcactatccttcgcaaggtacagacccctctgccgagggtggcgg

SEQ ID NO: 2522 - DNA, 1528 bp, Heterodera glycines
  misc_feature (15)..(15): n is a, c, g, or t
gcttaaggcttggcnctaagcctaagcttgcgcttaagcctagcttaaggctttggcctacgcctaagctaaagcttgcgcttaagcctagtctgggctcttggcttaagcctaagccactgtacgagttgcgccttttgtacaagttttgtcatgacaccctctccattccgcaacaatttcagctgggtgagcaacgacgtgtggatggacatttttccccatttcaaccgtccccaactcggcctcaaattggcgctgctttcgccccgttttgatgcgttggtggacacacatttcaatgcccaacacgaactgacactttggcgacccatcgaaattaaaaaacacactgtcgctggaagtgaaagggccgaactttctgtatgcgtcggtggtgaagatcggaaatttacgttgcccgaccgcccgctgcccaacaacatccgctttgagagcctaaatattgggtatcaaattcttcaaaaatttagggggggaggcggggtgggggcaacgccccgccgggcattcggcgcggtgcggagccccggcattcaaggcccggcttttgcgcctatgccccaaaattagtttcaaagttcaagcccttaaattacgaaaacccagttttttcactatcggggattaacaaatgtaagtttgaacccgatttgagacataggcgcaaatacccaagacgcaaatatctgtacacgctcgagacttccgttggtcttgaaagattcgggggtggaaaagtcggcaattttcgggatacgaaacgggccaattccgggtgagccaaagttttttctttgtttttgacccaatccaacaatcttgtgatacatatgtatcattcgaaagctcttcataggctctattagcctacaaataattatagagaatgtcgaactgtaaaaaagagaaaaaacttcaaaaattctgcctttttttgcggttttcaagtgacaactttttttgtgagttaattagtcacttagaaagcatagaaatatcttctaaacatcaaaagctttcgaataataccaagattgttggatttgggatgacaaagaaaaaagttatagccaaaaacatgttggcgcccaaccgtgagtgcgccaactgctgacggattccgtttttttaaactttgcttagatggagatggcctctacccggtaggggtcagttccgtctgagccaagcttaaagcattataatttttttttcagtgggccaaattttataaatttagtatcgttcgaaagatatgcatgtttagaagcttttgataagctatttctaagcgattgaacaacttataaaaaagttgcaacatgaatattaccaaaaagtcagaatttttgtatatttaatttatatcttttttacatgtcggtatttctttgtgatttttgggaagccaatagagcttgttaagagctttcgaatgataccaactttgttggatttggtcaacaaagaaaaaagttatgatgatctaaacttggctcagacg

SEQ ID NO: 2523 - DNA, 2721 bp, Heterodera glycines
tcctacaattagttggttgagtggtagtttccctgtcctctcaagctcgggttcgaaccctcttccgggaattaattttctttttttattgaataaaattccgccgatctctctactaaataccaatttccatccatcttcatttatttgatggtctaaatgccaagaaatatcaaatggctttttatgcaacattttgatggcattccgttccaaaaattgttggtgtacaatacaaacgcacatccaacacccaaatttgaatgtcttccgtcagttcgatggtgtgcctcccgttcagtttgtagttgagagtgcgcaacccgctcaaagtgttccgtttacgcctcctctgtaaaaaaatgttggattatcccaaaaaaaattttgtttcaaaaattggaaacgcacctaaaaatgaaccatttttggggatttggcacctaaacccaaggttattggatgcttttaggtccctatatttcaacaatttttgaaaatgaaaagaaatagaaaaagttttaaatttgaaaaaaatgtgtgcctcattacgaccatatttattgttaggtaaatatccaatttctgtcatttttgacaaaattacgattttcaattcgtacaccgtccaaggcctccccctcatccaaatttctcaaaaatccacaaattagcaattcttgttgcaagtttgttgaaaaatatggccagaatctcaatttttcggcacttctgagtccctccctccccgaaagtttttttgtggaaaaaaagtcgctaaaaaatgcctgaaaatatatgttgagctaaagcaaaaaaaaaaaaacgcccagagcggcagcccaactcgtactattatgtagtaaatatagaaacagaaaaaaacgagacagcgttaagtcatcagagaacagagaaaaaaagatactctaaattctcagcggggggggggggtaaacaacataagtgcactaaaatttcatttacccatgcaattttgacggaaacactgcaatctgtacaaaagtgatgagcaacagcaaaaacacagcgacgaaaacaaccaaaaaacttctccgccggactttacgatggaaaaggaccattttatgcttaaaattcggcgtacaaaaagcaaaaattggacgaaaaatgttaaaatatacacagaatttttaaattattccaaaaatgaaattctttgcaagaagcatggaaaaattgtttatcaaaagcactaacaaaaaacatttgctcatttttttattgaaaatgtattttgtcggtgtcaaacatcacacgccaaaagttcaggtcgttgtcagtttatttcccattcgttcgcttcgctcattttccgaactgttgattcgctgccctcagccggtctgatgcccacttggccctggtttcccgtgtaccgcagtcatatatgcgtcctcagcagcgcgcaacaacccgtccagcagattttcgaaattttgggggtttccgtccagcgcatcgccaacagctcgcatgtactcggcatgcggaacggtttcaaacgacacttggtgctgttggcatttctccaaaacaatatttcttaccgccctagcggttcgtccattaccatcgccccaaacatgggctttgacctgtggaaaacggttttgattttttctgttatttatgtggtacaaatttctattttcacgagactgttataatttattttactaaccaatttattatggacttccgccgcaaatcgcaagattccgccttccctttcattgttttgcacttttactatttcgctgttcagccatgtcaaatagtcagagtacagcgctggcacctccttgaagtggggaggctgatgctgactagtagagccatgtacaaccacatcgtaggtacgcgggggcagcgaacgcagttccttgatcgccttttttcgaatgtgaagcattttctggttaaaaaatgaataaattcaccaaaattgttaaaacaaataccccaaaacgaccaaagtttcacatatttcaaatcccggacccgaattgaaacaaaaggcgaaattaatttttcaccaaattcacatttaaaaacgattcaaatagacgggaatataaaaaatagagattcacggccattcagtgcacttgaatcgtttttggacaatacatgtgaaaaataattttcggcttttgttcgaattctggtccggggttttaatagatggacatgaatgtcatattcgtgatcagcgtacccgaaaaccccagaaaacaaaattttaaaaaattataaaagtacccaattaaatggcaaaaattgtcaaattatggccttaaaatgcttaaaaaatcacagcccgaaacttaaaaaggctaatttctgattacttcctctgtgaatggcaaattaatgttgatgtccaatggttcggcggcattcaagttggttgttgatagtatatgacgcatttggctattttgaccacgctcctccaaatgaacttcgcgcatcatttgtgccaccaattctgcaagttcttcctcggtgaagtcctccggcacatttgaccgactgtatgcgttaagcagccttggtcttcgattgacggattcgtttcttaattaaaagaaaattaaaaaacggaaaacaaaattttaaaatattttggaaaattcagaaatcggaattggacctcgtagaaggtatcccccc

SEQ ID NO: 2524 - DNA, 1056 bp, Heterodera glycines
aaaaagcggaacacaaaatgttaaatattttggaaaattcaaaatcggattgttttctttaatttttggttgttagctgcctgccactcccgatcactgatcaaacaagtgccatttaatgctatttagtaaaaacctgcgcttttttacgagaagagaatgagtcgagcgaaggcacgaatgaagggaagagacaaggctgaaactaacgaataaaaaaacaaatgtaaaaagcaaattgggaggaagaaaaagcgtagattattcgaaaccaaaaagggtaaattaaaaaacaaataattaattaaatttttaataattaagccaattaggaattatgggtcggtcggggttgtttcggcgccagcctaagtttttttggatataatttttttcattgtcaaccaattacggaagttttttctttataactttttttacaggctaaactttttttgttttttgtaagacaaatagagcatgtgaagggctttcaatgataccaagattgttagatttggttgataaagaaaaaagaaatatccaaaaaacttgggctggcgccgaaatgacctgttcactatggttcatttaagcgcaaatcataaattgagggggtgatttaaaaatatgttgtattatatcttaatcataccttaaatgttcgatggattgggacggaaaatgccaccaacggagtgatgattttgttgttggaaatgtctaaagcaacgaacggacggataaattgaccgaaagtataaaacaaaccaaaaaaacgaattggcggaagaagggaaaattggcaaatgaaaaaaagtaaaaaatggccaagctaaaaatgaaaaattgaaaacgtacattatgtaaatactttaaattatacaataagaaaaacattcccaaaataataaacaagcaacaaaagtaataggcaaaaagtgcacaaaattttctgttttattatgcccaaattgggcggatagcgttggccttcatggacggtaaaaaaacgaaaaaaaattgccaaaaaaaattggcgaaaaatgacattct

SEQ ID NO: 2525 - DNA, 1418 bp, Heterodera glycines
agaagcatcccgtgagtgcagtttatgaacatttaacaggctccgatcagttaatccgtcagtgatcactgatcagtctctcctccggtcagtccgtgtcttcgctgtccctccctccgtcctcctcatcctccgaactgctctcactcagctgcaaatcttccgccaaaatgctttccgcatgaatgacgccgtcttcttcaccggcatcgggtgtttctgttgtggcgattgtttctcctccctttccgtcgttccttttgcactttcctctctttgattttggtgttcctccgttttttgttgtgcttggtgaaaaacgtcctcctccgcctccgaccgttcgactttcgttggtgccttaacaaaattccttttttttgttgaattactgaacgacgacttaatcgaacgcacacaccccaaaggtttaaaaattttctgcaggaacaaaggattttctaaaaaacctataattttttcgtttcggtaccatttccaaaccaaaatcccggtacttgtccttactgaaactccctcgccccgcaccgaccgccgccgtacctccgagaagatcagcatcagaatcccacaatgccggccatgaccactgaatttttggatttttgtttaaggggggaagggagagaatggaaaaaaagatttttcaagaatatgacaaaaaaaaattttttttttgtttttttacagccgataaggtctccttgtttgttcaaaacaattttcaatataagacattttgtaaatctcgcaaatttttttcgaattttcttgaaaaatgtcaaatgaaattttcatccttccctacaggcatctatcaaaaaaaccagaaattttaaaaaaattaaagaaatgccattttgaaaaaactcataactaaaaaaaaaattttttttttaattttctgtcttaccaggaatgatcgccttcatcacgaggtcaggccttgctacagccatacaagcaatgccagtccctgaaacaaaggagggggcgaaggaacaaaagaattttaaaaaaacctttattttttcttttcggtaccatttccaaaccgaaatcccgggacttgtccctactgtaccctctcgccgccgtacctccgaaagatcagcatcagaatcatgccgacaaacaggcgcggctgctgcgacaggccgcgcacgcccgcgtcgcccaccacgccgatggcatagccggtgcccagcccacacagaccgcacacgaggccggcagcgaactggctgaacccgcggtcgatggtgtatccgggcccggccgcctcgagtcggccggaaatgatcaccgccaccaatggccacaatgccggccatgaccactaaattttcggatttttttaggggggggggagaatgtaaaaaatgataaaaattgat

SEQ ID NO: 2526 - DNA, 1773 bp, Heterodera glycines
aaacccgcaaaaggaaccccttttcactgataagagggtccaataggcaagaaagggcaaacaattaattttttcttgaaagacgaacactcaagatacaaaacggcagaggcaaccctcaaaaaaaattcttttctctgataagagtgaccaatagagagtgaagaggcaaataaagtttcgtattttaatgtatgaatatattttcattatttatggcatacaaatgtattatagttcatatgaaattataattagttcatatcacttgcgtttttgaatttattttaatttttgataggtaaattttttttaaaaattatttctcactgacgaaatcaattactgacgaaatcacttctgacgaaatcaaccactgacgaaatcacttctgacgaaatcacatggcaccctacaggcatctcatcaaaaaaaccagaaaattttaaaaaaaattaaagaaatgccacatatttatcaagctttgtaggtgaacagaaattttaaagttatatgtatgtatatgctcgacaaaaaatgatattttataaaaagtaattaatttgtgtgtgaaaacagctaaccagactaaaacgaccccctgactaaaacggccagactaaaccgaccctctgactaaaacggccagactaaaccggccagactaaactgacccggtccgtcgaagacaatctaaatttcgcaaaagggagcatgcgaagacttcctgtcatttgcttactttttatttcgcttctctgccggatacaggaacctgtcaaattgacaggttttttccactacgaagacggagcaagtagttaggctttgaattagcgcgaagaaatattcgttttggcgaaatatttgttttttaattttgtttttgtgttgatcgacataaagtgtttttaaaagaccattttctccaagatcttcataaattttgctcaatattttcgataatgtgtgttcttggtttattgggttaacaatgcataattgtgatcattttagtttgaaaatctggcgcacgatttttcgtcggaacccccctggcaaaatttcaaaaaccctatagaaaacctgacaaaaaccatttaaacaattatctattgtttgattgatcattgaggggtaaacccaactcatccatacccaactcaccatacccaattcatccatatatccaactcatccataaccaacgcatcaatccccaactcatccatacccaattcatccatatatccaactcatccataaccaactcatcaatccccaactcatccgtacccaattcatccatatatccaactcatccatacccaactcatccatccccaacttatccgtacccaattcatccatatatccaactcatccatatatccagtacccaactcatctatatatccaactcttccatacccaactcatccatatatccagtacccaactcatccatccatatatccagtacccaactcatccatatccaactcttccatacccaactcatccgtacccaactcatctatatatccaactcttccatacccaactcatccgtacccaactcatccatatatccaactcatccatacccaactcgtccatatatccagtacccaactcatccatatatccaactcttccatacccaactcatccgtacccaactcatctatatatccaactcttccatacccaactcatccgtacccaactcatccatatatgcaactcatccatacccaactcatccatata

SEQ ID NO: 2527 - DNA, 4850 bp, Heterodera glycines
  misc_feature (4815)..(4815): n is a, c, g, or t
atttgccggatcctgcgcaggattgcggatttttggaaattttgaaaaaatggaccggatccggccggattaatcctgcaaatcctgttttttccaaaaaatgcaggattgcggactgggatcctgcaaaatcctgcgcaggatccggtcctgcgccgggctctacaactcatccatacccaactcatccatatatccaatatccaacgcatccatatatccaactcatccatccccaactcatccatccccaactcatccacacacaaaaaaagccacaagtagaccgtataatgtaaaaaaaaatgccacgactaagaccgcacaatcaaaaaaaatacacacgactaaaccgcacaatcaaaaaatgccacgacgacgattcgcaatgtgtaatggatgagtgggtatggatgagttgggcgtgactcatcattgatcacagatagatcagttgactgattaagagcaatttgaagtgattaaccttttgcttttaactataattgataagcgctttccaaactgatcacagatttttgatcacaaatttgatcggctggaaaaatttttcttcatgccgacctgcacattctaattagtaccaaactaattaattggtactgcattaaatactacaactattatattcgcaatccgtaaaatttctaaaaaaattttttttttctgacgggacgacggggagccaattacatcagcggcggcaacggtggcatgtcaccgtttggtgcccaagtccgtgactcgcgggaccgggagaagaaggaactcagtgatctgaacgatcgattagccaattacattgaaaaggtggggtttgggtcggctgagcacggccaagcgaggcccaagcccaaacagagcacaataagcaccaggacaaatttaggtccgtttcctcgaagcacagaaccgcaagttgaaggcggacctggacatgccgcaaggacgccgcggcaaggacaccatcaccatcaagacgatgtacgagagcgagattcagacggccaaaaagttgatcgaagacacgggccgatcaaagcacgagttggagcaggacgtggccaaactgcaacgtgacttggacgagcagcgccgcaaatacgaggtacgccatcatgaatagcaaaaaaaacatcacccgggttgattgggaattaatattttctaaaatacttattggattttctgtttttttccagaaaatctcagggttggactaaaaattatggattacggaaattgtaccgtttttggatccctatgatgacggattacggatttccgtagccagttacgcccagccctgatttgaacccaggtaaactcggcactttacatttgccaactctttgggggccagctttttccggaacttccaaaaaaaatttgggtgcgttaactcattgaaaaactcaattaactaaattaattcggtgcccaattttccaagattgcaaaagtgagactctcgagcactataaatagggactaaatttatgtgtccaatttttgccccaaattttcagcattttcaattccacacaatcaacaacgggcatcgccattacaaatcttcgtctgtttgccggttacggaggggaagcgattgcgttttttcccaccttttcaccttttttgttctcatcttctcacctttttcaaataaattgtttttcatcaccttttctttgtcatcaatagggtgagtatttttaggggcgaaaaagtccaaaatagggaactaaatatgggcaaaaaaataacgcaaaataagggcgaaacgccaaaatttggatttctagggtcggataagggcgttaaaacgaaaatgattttcgtgcatttctcgtcgagttaaagccgcagaaaaaatacataagtaaaaagctaacaataagaatccaattttgaaaattttccattttttgttcgaattctgctccgggactcgtaattggtcaaaatgaatgtcagattcatgttcagcgaacccgaaaacccttggaaacatattttcagtgacttttaaaagttaattattttctttttgcaccgcctcattttacccaaacaaattgtagacaataggagtaattaaatttagtttagattttttttatttccattttttcgaaatttaaaactcccgaaatcccgggggtaatcccgcaaaggtaatagtttagatggtacccccccttttttaaaaatttttttcaactttcaaaaaatcataaaaacatgtttctaggggttttttgggtcgttgatcacgaatctgacatccatttcgaccgattccgaacccctgacccggattcgaacaaaataaaaaaattgattttttaacaaaatttacatttattgctaaaaatcgattcaaatgcacgaaaaagaaaataatcaatgttcgcatggataaaactcagagacatgcaaccaaaaattgtaaaacgcattttcacggtctccaaaacgctgacgccaaataaattctgggaaataggtgtcgtatgtttcagtcttgttcccaaactgctttttttattttgttcgaatccgggtcaggggttcggaatcggtcgaaatggatgtcggattcgtgatcagcgaccccgaaaacccctagaaacatgtttttatgattttttgaaagttgaaaaaaatttttaaaaaagggggggtaccatctaaactattaccggacaaagacactggtagtctcgcgcttcagaattgtgattatgaaaaaatatttattcaaataaaataaaatccaacgaaggggtgaccacttacacgttgaattataaaatagtagtagtattatggaagaatgggtacttttagagttaaattttgttagcctccagccacgtctgtattcgctttttgaagcagtcaacagacggggcatctgttaacactttgttaagtttggaccaaattagagcagttctattaataaaagaatgggatgttttagtgcattgtgattttaacacaactttacgtcttaaattgtatggaaagtgatcggaaattaaaggaaaaatattttttttgagatgggttagaccattaatgattttaaatgcttggactaggtctataacttttcttctttcctctaaagattgtatcttgaaaaaactgagacgttgttggtagggaatataaggtaatctacatttgaagagagcaatttttgtaaaatatttttgacatctttcaattttaatgatatccttttttaacttaggattccaaatttcaggtgcgtattcaaggagggggcgaatgtacgtcttgtaaacagtagtccatacccgaattgagcgggattttagaaacttggctatatatctgatccttaaataagcagccttagtaattttaagatagtgatcagaaaactttaacttattatcaattaaaacacccaaatcattaatcgattcaacctcattgataattttgttgcataatttgtattgttgtttagagttgtttttgccaaaaaatataataaatgttttatcgggtgagatttttaaaccgtttaaactggcccaattttcaatgttttgtaaagctgtgtttagcttaatgcgctcatttctttttttgtatgaaacatatagtttcacatcatctgcaaaaagcttaacttttatttccgaaggaataaccttcggaagatcatttatatagatcaaaaacaacagtgggcctaaaactgatccctgtggaacaccagacttaatcggataagattttgaatatttgttattaatttttaccgtataagttctttcctttaaaaactcagataaccaattaagcagttttcccttaattccgatattatccaacttttgaaccataatgtgatgaggaagggagtcaaaggcttttttaaaatccacataaacacagtcaatatttctgttaccatatatgctgtcataccaatcctcaagtacagagataagttgagtattggtagagcgttttttaacgaacccgaactggtgttcagatattaatttatttttatgaagaaaatcgtatatatgccttgctaaaattttttcaaaaaccctacagagacagcaggtaagagaaataggtctgtaattatgtggatcatttcggtcaccttttttaaagagtggtataacaatggattttttccaaatataagggatcttgcctgtatccattgatagtctaaaaagttccgaaataaccggtgtaagaggaaggtaacaattacgtaaaaatttaaaggaaatttcatcaggggaagtagattctctattcggtaaagtcctcagcatacaggatatttcacctgcatcaaattcaatatcagaaatggttggataattagaattagaggaagaattgataattggtaaaatacctgagtttgaaaaggaatcttgaaaaattttagcaaatatttctgctttttcagaatcctcaaatacaattttattatcatggaataaagaattaatctgaatacaatttttattaaattttctcatatatttatagatagcatttcttcctttgtttaatattttattttcgttattaacagagaaattatttacttgtatttttatatggagggaaatgctatcgtataaagacttatatttaattggatcaattttttgtaatttaaaaagtctggctttttccttaatagatagtctaagactgaccgggtagttaggctttcttggttttagatcggaatatttattttaggcaaantaataatcaaaatttcccctagtgatttcataaaa

SEQ ID NO: 2528 - DNA, 1706 bp, Heterodera glycines
tgtccccgctttttctccactaccgtatgtccccgccttttctcccactaccgtatgtctccccaccggttctctaatttaccgtatgtaagttgatcagagcgcgagccccgagtacagcttcggcgacatttcttaccacagatgctataattttgttaataacgatggacatcttttcaacactgctaaacccctcgcgctgttcgtacgatttgacgatctgaaaatgaaccgataataccgaaaataaaaaattcccaaaaaatcgagaccgagactccaaaagaagcagagaaaatttcaagattcaagtaatcgagaaccgagacttacataaaattcttaggaagtatgagaaaattggatgttcaagctttttaagaacatttgattttctttaaagaactctaaagtttttagggagactttgagacataaaatttaagaagtttttttttaattaaaataattccttaaaattactttttgaagtttcaaatcaacattttgaagaatttgttgttgtcttttggcgagaaagtaattaaaaactgaggaagaaattcgaagaacggaccaacggaaattgaaacgaaaggcattggccaattcggaaagaaactcatcagggagtttaatttttgaggcacaatccatggcttaaaaattttaaataatttatggatattagtgaaataattaaaaaatttggcatggaatatgaataattagtgagtgagttggtggtggtcatttggaggagggaaatggaacacaaaaacggcaaaaatcaattggatattaatacaaaatagcacttattgtgtgtaaaaaaggcgttggttctcaggtcaatggcaaaatgtaccataaaaagcaaaaaactctttaaaaaggtcccaataaaaactaaaaaaatatataagaaatctatacatattttcttaaaatttatttgaatttttcaaaaacttccggcactgattagcggcactgccggactttaaaaaatgcgctgaaaacattttgttgaaaaaatggccgttttaagccttaaaattaacttaaaatgtgcttatttttgtccccaaattcttcgtttacaaatgatttgcttattttaattaaacaagttttgacaagccgtttttcctgcaaacatagatttttatctaggaaatccagttcagacgaaatatggaaaaaaatccatgtccaggtctaggctttttttcaaaatgtcgtactctattattttttttaataaatggcaaggcagtccttttctggcatttgagacggattttccttccaacaaaaaatctgtttttgccaacggggtgaaaaacccggcattttcgaaaaagaactttgctaaagccattgtttaataattggattttttttagtccaatgatttggatttccgaatgaaacttggtgtgtggatagggtaccttcttaagaaaagtgtttttattttctgcgaaatgagcccatgtgccgagttatgacggccaagctctttcccccaaaatcgaattgccctctatttctccgagtttttttgtctcagtcttcctgaaatttttagggttctttaaaaaaaatcaaatgttcttaaaaagcttgaacacccaattttctcatacttcctaagaattttatgtaagtctcggttctcgattacttgaatcttgaaa

SEQ ID NO: 2529 - DNA, 2178 bp, Heterodera glycines
  misc_feature (69)..(69): n is a, c, g, or t
  misc_feature (2102)..(2102): n is a, c, g, or t
  misc_feature (2138)..(2138): n is a, c, g, or t
atcaaggtgttattgaccatttccggttacctcgagaggcatttttcgactctgtgcgatggtttctcngaaattgcacccgctttacgacaatcgatctacagacatagtgcctttacatcaacttcaaattgctcttttatattatgccacaggtgtcatatgttgagctgattgctagattcaattgctagtttcccaaggtgatcatcaaaatactatggctgcagcaagcggggtgcataaagcaactatctcgagagcgatcactgctgtcactgatgcattgctagaattttgcccttattatgtatctttgccttctactggaacagaacaaacacaaagaattaagaccggattctattttgtttgtaacattttttggcgttttaaatatgagcttaagaaggcgcgtatgccgcaagtgattgggtgtgtggatggaacttttctgccgattcaacggccttcaaatcaattagattatgcatttatttgcagaaaaggctttacggctctcaatgcgatgggtgtttgtgatcactaaaaaagatttattgcatttttttgcaattaccctgggtcttgtcatgacagttacgtattacggtatttcattacagttgacaaaaaacattgtcttaaatttcaaagctcctcacaattcttctcaagaatggaagaagggggtcttgatgggataatattgggggattctgcttaccctcagaaaaattggttgtttacgccagtaagatttccccgaaatcaaaaagaagaagcatataatgccgcacatgccgtaacacgtgttactatcgaacagtgctttggtatttgcaaaaatcgatggagatgtttaatgaataagtgtaggctccaacccggtataaatttattttttgcttttttcacttttaaattaagaaaaattggcaaaagtagcaacagtttgcagtatgcttcacaacattgccattgattgtcaggcaccacagcctgcttttgatgatgatgaaatcgaaaatgagcaacaagaaaatttaaatgatgaaaatatcgcattaagtgctgaagctgttcggaccgattatattaatcgtaatttttaattatttttaaattaaaaataaattatttgactccacaataaacccgggtttgcttaacccgggtttacttaacccgggttaaagacgagcaacgctattttcaaaaatttttaacccgggtttacgaaacccgggtttaatcgttaacccgggtttactaaacccggagacgagcaacaggcccctggctggggagttcctgcgatcaccaaggcagggctcctgtggcgaggctccaccattgcactttcggtcggggctgacctggcagggcggtcccgaactgggataggcccacagctaaatttttgagtgcagggaacggcgttcgcgcctcccctttaaaagctttgcttcatctatttgcttgccgtttatccttttcaacactccgagtgccgtgccgcgttgatgaattctaattgtttttctcataattttaaatgttggatgatttaaagtcgttaagaaaactttaagaacgagaacgaaaatgtccccctgccgtacaaaaacgtctcccttacggaaacaaccataacgaccctgaccgtgcacttccggtttacctcagttgggccccagcatatttttggactatatatattttttccattagaaacttaacgatattggcatcattagaaagctgttctagtagccttacaaaaaatcaaaaagatattttggcttttgaaaaagatattaagaaaaaatttaactttacgcaattttatttcttggcgttctgtcaaaaaccaaaaaaaaatacaatgaaaaaagaatttgcttaattttgttgactcattgaagtggatatgaacaagtttttgccttactcgtctgacaaaaccataaaaaccacttttccaagaaatggcttcttctgctgctggatttgccattgtcaccggtgccaacaccggcctcggctttgcattttgttaatctctatatgcttccggcactattccgccattgtgtggncctgtcgaagtgacagcgcgcgagagcgcattgacnaatttgctgtggcaatcatcgccggcggaaatggcaacgc

SEQ ID NO: 2530 - DNA, 1054 bp, Heterodera glycines
cttctcattcttgcgccaaacccggaattgctaacaaattaaatgtttattttacattaatgtggcttagaaacaaatcaaaagcatttattgttgctttgtttttggtaaattttgcgcggttcagactttgaagaaataaacatgaaattcagaatcggttttcttatttccctagaaaaatttctaatttaaactgatgccctttgacatgggagattaaattcattttccattttttttttttgtaatgacaagtttattgggactgtaatacatattttttagttggatttgacctgcaatgattcggtccgcactttcgtctcccaactcgacgagcgtccctatcaaaagggcagtttgcgattgctcgtcaacaatgccggcattatgggccatccctttcaattggtcgacggcgttgaggtaggcagacaaaaaaattaaaaaattaaaaacattttccctgggatttcgaggtcgctgctcacaaatatccatttgtaccttaaatacacggaaacaaacataaaatcatgatcagcaacccctgaaattttaggaaacttttttatgacatttaaacttttctccccaaaaagggggttgacgcgatcttaattaattgtattcccaaatgtttatgcattgcgaaaaaggaaaattccctctaacaataaaaaaacaggattttttttttgaaaattgcaattttcaaattttttaggtgcatttcgcctccaaccatttgggtcattttctgctcacaaatttgctgatcaaacacaattggttggcttccgacgcgcgcattttgctggtcacttccggcctctacgaaaaggttttgtcccaggattttccacagacgcaggcttcgaaatcaaccaatttcggcacttatatggattaggggtcgacaaaactaaagagtggaccctaaagacaatgagaattacacacctttttaatgttgctgatcaagaatatgctaatttatttattttttctaaaaagaaaaaaattttcttttgccattagtgtagggtcc

SEQ ID NO: 2531 - DNA, 4610 bp, Heterodera glycines
acgaccctgggacccaaaaacgagggcccaaaaacgggggcccaaacgcccccgactctccctgggattttcatccccatcttccagttccaagtcaaatatgagaaaaaaaaaataccaggtcccatttaggcacgaaaaacctggattttctggataatattttagaatttgtgattactagggctgggatttttatgtggtaaaaatcctgaaatatgtaataaaatatgtgctaaaaaaactcaaaatatgtgctaaaaaccaaaaaaaggcctaaatatgtgttaaaaaatgcaaaaatatgtgctaaaaattggaaaaaccaagtgtatttacgcaaaaaaaaatcatatttaatatcagtctttatcaatttcgtgagaacaaatgcaaatcagatgccgctgttccgttgtcaaaactaatacttggtgaaggcaccgttgacaaaagataatttttccatcagttgaataagttccttccgggcactttgaaatccagtgacgatttaacacagcgtttgatttgggctgctttaggcatttaaatatataaagaaattttccaaatgcttaagaaacgtaaagtagtcaatttttagggtgcattttcagattttcttgtatttttcttacgatttttctcaaaaatgccaaaatatgtgcaaaatatgtgccaaaaccccgaaatatgtgcgatatgtttttaggtgccaaaacgccaaaatatgtgtttttatgtttttataagtcgctctaaatcaaaaattgttcggagaaaatgctatttttgggcttctctcgccataactaagccgcaaaaaaaatatgttaaaacataaaaatcccagccctagtgattacgaatgctgtgaggaaatgacaacgcatttatgttcccatttaaaaaccccgaaatatgtaaaaatatgtattttcccactatttagagcatggagaatccagaaaaaaacatgtattaagatatttttagaattcctaagcaatgaattgatttcttttctaacatttgtttgctctttaaaacaaatttcaaaaaattcaggtccagctggatcaaaacctcgaggatcctggatttttccgacatgtttcaaaattcctctagttttcttctgctcaaattgaatgcatttatgccaacaaaattttgccaaaaattaccttttctcagtgccaagcaaccgctttttgtccattttaaatttgaagatgcctttacttactttattatggaaagaattttgggcgttttaaacaatattttttgccaaattcatttttggccttaactttttcttttggccacattttcatctgttcagcattttcccgtaatgactttagtttgttgctattattcaaaattggccaattaaggggtaattaaaatattattatagccatcataaaatgcatttgcaattttaaatttggcgcaaaaaagtaatccaaaaatttgcgcacatttttccaatgaattttccggcattcaacggatttgtggtgaattgtgtccaaattgtcctctaaatgagcggattccatgacggacaattaattttaaatacttcccaaaaatccatttgtctatttacattctattaaaaatattattaaaatttaaatttgctagtgcgacgacggtgccaaagaaaaattccattcttgttaaaatctggcaaacatttttaaaatttcgtggcaccaacaaagtagtggcaaatgaaaaaaaacaaattgattcaaaagctttgatttcaaaatcctggcatccaaaaattactccccgaaattttgattcattatgcaaaaggaaatgaaaaataaataaatcctttaaaaaataaattgattattaatccacgctatttccaatcagtttatttttttatttaattcttatttcaaaatatatttataaaaataggtaaaattgggctgtccaatctttcggtgtacaaaatttacggttggtccaattttctgacacctgaaaaatatacggtaaaaattaatttgctgccctatttcttgtattttcctatttttctttcaagaatgacttcaaaaatgcaaaataaaccttttaactgcagttttgttgccactgttgtataggttttttggtggtgccattgtttggcctatttttggaaaatgaaaatttgaatttcgtctgagccaaaaagtgccgtcggcatacccccactattcttttattctgtccactccgtcgtctcagccgccgcgccatttggcatttcatcgccatgtgccaccctctggcaaagtgccggctggtttggtgtgccatcattcacaaccctcgccacaaatttgccgaaatttaattttaccaaattgccggttgtcacagtgtttcgagatgaagcggcgaattgggaacaatgaagcggaacgggggaggcgcaaaatgccgcgagaccaaagaccggacggaactttcgggcggtgacattttggagattaaaggtcatcatataaaaatttgttccaaatttgtgccctatttcgattggcatttttgagaaattcttcggctatggccaaaatgctttaaatgattccgaactgctgctcggaaatcctttcttccaaagttgcgataagtttttttagaggtccattactgcaattaggcaaataaattacatttgagtaacaaaaataaatttatgcattttggaattgcctcaaattttcaaaattcttacctaatttttcttaaatattttatttttttttgtttttggactaaggagttttatcactgactactgacctctgaaacataatacagctccaaagttgatcatattttaaataataataacttttcgagaatgtcagacatattacataacaatggattaggtatatccgctaaggtttaggattgcttgggattaacaacggatttaaaaatttgatcgagacaaagccgggccccgagcaattcattttcgtccaaatagtgtttgaatgtttttattcatcaaaatttcagcatccatccggaagacaaaaaaaaggaatccaacaacacttggtgtgctgtccggtgcacaatttcaattccccaccggacgttcattcattcctcgttcctccgatgggtaaaaacccacgcgcaaattggcaaaaaaaaaaagaaaacatcatgcgtacccagcaaattgccctacggcattttgtatgccgaatgcatgccaaaaacataaaaaatggggggcgggggaggaaaagccggggccaaaaccaaatccgatccgtctcattttcattgtgcgcgccaatgccttggggcataaaaaagtgcatcatccgcccaccgccccctttaattgcttatgaattcagctggaaaaagcagcaaaaaatggtgggcggagggggcggacaatggtagctaacaataagggaggtgcttcttcttcttctgcgcgggaagtgtgccgttcagcagcaggtggccgccccttcaattgcacaggagtgatgggtttggcacaaaatgtcatttttttgtggcaatatgtcatttatggcgaaatgtcatcggcaggcaatgccaaccccaacggcacaccgtttggccgtttataagcaggccatgttccaaacaaatggacaaatggcctcattttcactcatccatacatctgtcagttgcacttgcattttgctgagattttggcggtgttatgatcaaaataaaaaatatttttggttataactttgctaaaaagcaacaagattttttattcttgatatcatttaatagcactaaatattcttaattatccagccaaatttcagaaaattatgtaaagttttcaaaaagttatgaccaagatgttcaaaaaccttgtttttgagttcctatggctctaactttttgatagttaataaaaatttttaaattttgcatgctaatagagaacttttagggctatcgaatgatatcaataattaaaataatattacttttttagcaaagttatgggtaattttttgttgaaaattttcatttgatgtttttgagtaacgacccgacaccttttgagccttctgcttgagaatttagcccctgggtattaaaacgtcatttcttgggctaaaatagctcaattccgattgaactcttaatccatcagcagcctattttatttttctattcccctttttgtcacaatttgtgcctttttaagtgcgcaaagtgtcaaggactgctgcatgattttacaccctccgccggcggaaatgccaatttgcgcaccgctctgaaggggacgaagggggagcggtaggggtcagtcaactgcgtctggccaactgcgtctcaggcaactttaagaattcataacttttttctcacttgcctaatttttaaaaatttggaatcattcgagagctctttatgtttagaagtttttggtaagcatttctaagcgattgaagaaattattaaaaagctgcaacacgaaaaccgcaaaaaagtcagaatttttgcatatatttatttataacttttttatatgccggcaaatctttgtgatt

SEQ ID NO: 2532 - DNA, 2518 bp, Heterodera glycines
aaaaaatttggccaaaggttacaaagtttacatttccagactgaaaatgtggatttcataaatttgcgccccccaggccccgtaaccagaaggaaaaattgggggcggggcgcacccgaagaagcttttcccctaaattttggccattttgagacaaacttttggaaaaatattagaaagttgggacccgtcgcggaaaatatagggttaatttcttaagaaaattaggtaaattacccattttttcaataacaaaaaaaaagtttggctctccctatgccatatccctcctatatttttcaaataaaatggtcgatttttcaagcccaacggactaccggcccatggcgctggagacgggcgttctgctgggctccaacgggtccgcccggcttcaactcggcgccaccgatgtgctcgtcgcggtcaaggccgacctgcagctggtggagccgtccaccgaagccggggacatccaacgcgtccatttctttgtcgatatttccgcaaatgcgtcgccacgctttgcgggacggggcggcaacgaccaggtcagtgagtcatcccagcggattgggggcttcgacggtcccaggatttccgcatggaggggccaccgccgccctgggcgaccacctcctttcacaccattttgttgcgacgttttccagggaatgagagggccccgtcggtgccaacaagtgtcgtcgggggaaatttttttttataattttggctacaatttgcactaaaatgataattttgtagatttttttttaaattagcatattttcatattttttgggacgtttgggtgaaggaggccttggagagggtaccaatgagcaaaagcgaaaattttgatcaaaaacaattcttaaatgcgcatttccaaattttaacactttttgccatttttaaattttaatttgaattgcattttttctctggccaggctgaggaatgggccaagtcgctcgcgggtgcgttcgccaacaccgccccgtcagcaatgcccgacatggccaagctgatgctggcacccacccagctgtggtgcttgtacgtcgacgttgtcgtcctccaatttgacggcaacgcaatggacgcaatttcgttggcggttcgtttctcactgaattattttaaaaattttcaaaaaatgtgtttttcggtagaaaaaggtttaaaaattctcaaaaaaacaagctttttgaccgttttataagttgtacggacgatagaaatgaatattttttggtacttttcggttttgtggcccggatttgaaatttaaaaaacaacaacaaatggagcatattgttagtgcaagaagtgcacaccaaaattattgcggagaaataaatgccataatttgagatattttcaaatgcctttttattaatttattcaatggaaacgtaaattgttgttttttgttgctgttttatgccgtgctgagacgatcctaaaatagtatcaatggggcgttcctaaaatagtatcaatgtgggcgttcctaaaatagtatcaatgtgggcgatcctaaaaaagtatcaatgtgggcgatcctaaaatagtatcaatggggcgttcctaaaatagtatcaatgtgggcgatcctaaaaaagtatcaatgtgggcgatcctaaaatagtatcaatggggcgttcctaaaatagtatcaatggggcgttcctaaaatagtatcaatgtgggcgatcctaaaaaagtatcaatgtgggcgatcctaaaatagtatcaatggggcgttcctaaaatagtatcaatggggcgttcctaaaaaagtatcaatgtgggcgatcctaaaatagtatcaatgataaaattaattaaaataattattattcaatgaaacaaatattttgcaagtaataaaaattgttttctacataaaatattattacgtcggaaacgataatcaatgtatgtcaatatttttttgccatataataacaaatttttaatttaaaaatatatttcccttcagtgttaaattcattctttagattgactaaaaaatgaaaatattttttattagttttatttttcccttaattttacttgattatttggaaggccataaatccggatttgaaggattcgtaaaaaatcctcaagcaatatcacttgtcaaaagctatgaaaaaaaggaaataaagacacttgatgaactacatggacaacttatgcataaaggcatacggatttctatatgcactttgaaacgctacctgcataagataaaaattgtttttgcgcccaaaaaagaaaatgttgattcatcacctaagcttgaagtggaaaaatgcttctccaaaaagctgactaacactatttatataattggaaatggatcaaattggagaaaatacattcagactaatgaaaagaataatgatctctacatttcgtgctccaactgtttgtatttacgtgaaaaggaaaacaatactagatctattatctcaacagcagtgcttcgacaaggagttaa

SEQ ID NO: 2533 - DNA, 2548 bp, Heterodera glycines
tatataaaagcaaattatgaggtaccgagtcaaatgctttttgaaagtcaatataaatacagtcaactttttttccattaataattgcttcataccaatcttcgacaactgttattaattgatttgttgttgacctatttctaataaaaccaaattgggattctgaaattttattgttttttaataaaaaattgtaaatatttttgctgagaattctttccataactctgcacagagagcaggttaaagaaataggtctataattttcaggattgaatttatccccctttttaaaaagaggaaagacaattgattccttccaaatgtttggaagagaaccactgtctaatgatagtctaaacaactcagtaataacagttgccaatgaaaaatggcaattttttaggactttataagaaatgttatccggagagttccatttttatttggcaattttcttaacagtgtttgagtctcaatgatgttaaaatttatgtccgatataaagcattgaatattaccataggagttgtccaaacttaaatcgtttaggacaacttcggagttattaaatgaatttgcaaataaaatggcaaataattccgatttctcttcactttcatgatagcatttattttcaaaaactaaatttggtatttcaaagggattgacattgtgtttttgaatgtatttaaaaattgaattttttccctttgaaatagccttatgttcaattaaattatgtatttttttggtttggatttttatatgtaaagtaatgctatcataaagtgctttttttgttggataaattttacactgtctatataattttgccttttctttaatggatgccaataaatgttgtggatattttggagctaaatcttttttttagtaatttttttattggaatacactcattcaaggcattcaacaaggcgctattgaaggcacagcatttttcatttatactaaaatgtgaaagagaaagagaacttaatctagcagaaattacagcatttaaatgtgatacattagacggagtaaaccgtcttaggcaaatttctttaggctttggtcttatttctggaacactcagcacaaaaagctgtgctaaatgatctgatgaaaatatgccaccttcaacagaacaatgttttacaattttatcatttgctgataagatcaaatccaaccatgatttacccctagtgggctcattcgtggcatttataaatgtaaatttattaaaaaagtcgcaaaatatttcaccaatatgatttatagcgtgtggttggccttgcctccataccaattctcgatttgacaaatttagatctcctaagattatataattttcacaccaaaatgtttgtataaatttaaaaagttcttttgtttgttttaaagtggttttgggaggccggtaaatcaatgcaaatcttattgatttcagattttgtaattgattaattaaaatttcacaattaaattttgtaccagaaaattttacaaaaaaggctatctcatttttgattaaaataccacaaccacctccacgtgaactgttttcggattttcttgatgcaaaaatataattataattctccttaatccatgggctaagaggaattccctcattgtcttttgtccatgtctctgtcagtaataatatgctaatttttttatttattaaagccagtgaaatttcatcagttttgttcattatagagcgaatattagttaagcaacagataaaaccttctaaagaattaatatcccctttgtttagtggtagtgaattagaattatttatattttggtaagaattttcttcttccgaccggaaagtgtaatctactctttttgtaaaagtgttttgttttttttgtgatttggtgtaaaatttaaaaatttgattcacgaattgactgactccggaagatgtgcacttcatctctcaaaataacgttcccagcatacacaatccaatcttgcccatctttctgtcgtttttcaacgcattgcaaatgcaggcgacggcgttcctccaattgtgcctttgtcagcgattcacggagacggacatggtgcagagacgaatcagcagcccgaatggtgttttgtttttttttgccatgcagcgagagcctgtttttggaagccacgggaaggcaagagaattttcaatgggcgaggacttttttgggctgggttaaaggaacgacccatgcgataggcaatggtaccgcattcgatccccagcgaatcgaataagcaattgatttttgaccggtccatctctgcccgctttgctggtgaactgtcgttgtgctctggcatgccaataatgacgacacttctctgtctttccaattcctccgctgaataacaagcaatataatttattttaataaaaattatttgtttttatgtttactgtcgaaaagtccactattttttgtgtttctgtcgaaaagtcctttactgtcgaaatgtcctttgctgtcgaaaagtccttctgtcgaaaagtcctctgtcgaaa

SEQ ID NO: 2534 - DNA, 5119 bp, Heterodera glycines
  misc_feature (5026)..(5026): n is a, c, g, or t
cggtgcgaatgggtgagcattggtgagtgcgtgcgcatgtggtgtgagtatgtattggtataagtacatgtgtgtgaatattggcatgtgtatgtgtagatagaggtagggtgcaagagcaaaggttttgtttgtgcattgcgatgcgtgtgagtgcatctgtgcaatgcgtgagtgtttgcaagtgcagatgcaggttacatgcaaatgcatgaggcgtggatggtgtgttttgcatattaagcctgtgtgtttcgggtgcagggcagagtgtagatgtatgtgtaagtgtgttttgtttgcaggtgtatgtgcaaatacaggtaatgtgcaaagtcatattggctgtgtgttttgcgtgcagggcagagtgcagatacaggttagatgcaaatgcatgaggcgtggacggtgtgttttgggtgcagacaggtgtatgtgtgtgtgggggtgtgggtcaggtggtataccaattgtatgttacatggtataacatgtatgctaatggttaggatgcaggcaggtgtatatgattgtattggtcacgaacaggtgtaattgtctgttggtttgcaggtgctggttcacatacagccattaatgtgcaattaaatctcgggaaaaggccccctatgccccaggggttcgagaatggttcgtaaaaatgtcagattgtatctgggaaatttacaccgttctggataaaattaatgcagagtctgaaagggttgagacgatgtggcttgagattgaacgttctaaagatttcgatcagaccacaaaacttgaggagaaagtatttaagagtttaaacgaaaccaagaagttgcatttcgagtcccgtcggattcatactaaaatattggagcaagaaagcagttcagtctatagtgttgggatttattgagcttcacgagtaaaatggaggcaattcagtataattgtcacgtaattaacaaatttgggatcaaaaaacatattacaaagtttattttttccggtgcatctgattgtgaatttaaacaatctctagaaaaaatattagaaaatgcatatataaaagaatcaggaatttttaaaacaattctaaaactacaatattctaattttctagtagtcttgccactacgattatcacaggaaaatacaattgacgttcttttagaacaacctatattttcacacttttttaccattggatgataccgtaatttttgaaataacaattgttaattttaataatgacaactatagaccaagaaattaattttataaagacacaagtcgaaaaggcttggaaaaggggtagaaaattagttagagaagcagataacttggtatcttatgcctatgagctttcgaaaatagctgagaattatattacataactaaatacaaaaaatttgatgatttgccaacgagcagagaaaattttgaaaaaagccaagaattttttgatagctatcaaaatcaactcacaaatgttagaattgacttagaaaaattaattcaaaaaatacttgagcctaaacaagtagagcgagaaatattctttacaccctaccgtaggggacagtccaaaattaataagtcttatgaaatatattatacaccctattatacatcgacaattaaatgaaatattttacattccatatagaagggattaaaatttaaaaaatcttaattccttaaaaaactctaaataaagtaaatttgaaatttagtagcacaaatggttgtaaattacgtgttaatacttattattttaaatatatcattattcaagttcaaattaaaaaattaaagtaaaataataactgcaaaaataatgtgttccgaacacaacaatctttcaaatattcaatctaattaaactatttaaacaattatttcgaattattgttattttctcttttcttataagattttataaattcaatttttttatatttattatattccttaatttttaattatttttcattacctttgattctatccttaaatttcaattttttaaaaattaaatatttccaatcaatttccatgtggatcgattaaagggaccatctccaaaaagacgatggcagcgcaccacctccccactatccgcgcggattttacattttttatcatattatatcttccattccccacaactttttttttaaaattatctgtagtcatcaaggttttaaaattaaataattttatttcccgctctaaaaactaaaaaatccgacatttttcatataaattttgtttagcattttttttcgcgcactctcaccatttttttatgttccacttttaaaatatatgaattatcttttctaatttaaataataatttttctgttaaattcccaataaagttttttttatctgtacagttcccaaatggtttattatttagagggagaggcaaaaatactagccttttaattgtttattcatcacatgaaaaaacggatatgagagaaaaaaattttattacagaactaaaaaaatcccaataaaattatttctaatatttctccgctaatatctattaactggggacacaaaagcaaaaaaacggctgaacactcgcgcagtggcgcaaaacatacccgagaatatcattaggctcgggttttttgtattacaactaatgaccggggatccctttacaatttaatcatttttccttcttttagaaattactctttttctctgtttctctcctctctcctatagtgaatgcgcatctctctgcccagggggggccaagatttctgtcctaatactactcctgtgtatgagttgtcatgataaccttaggtttaacaacgaaatttatagttaaaaactttattgaatacctaacaaaaaaaagtttttctcttagttattaggacaactataataccatgagaccagggatggcacggaatttcgatttccgaaaatttttggggcctcggaatgccatccctgccatggacacaaaatgccatgggacgcgtaaagtgttgttgggacgcgtaaaatgtcatgggacgcgtaaaatgtcatgggacgcgtaaaatgtcatgggacgcgtaaaatgtcatgggacgcgtaaaatgtcatgggacgcgtaaaatgtcatgggacgcgtaaaatgtcatgggacgcgtagtgttgttggggctcgtaaaatgtgatgggacgcgtaaaatgttatgggacgcgtaaaaccgactagaaccaattttaattattttttccgtttgacgcacatccgaccaaactgacaaattattgtagaagatactagccgcaagaaataaaaaagttaagaaatttgtccgaattcgggttcgggattcgaaacatggatgttttgcacaaatccgaccaatttcagtcctaaacaggtactcacgcgaaaacgtaccccacgcgaaaacggccacgcgaaaacgtaccccagccacgcgaaaacgtccccacgcgaaaacggccacgcaaaatggccacgcgaaaacgaccccgaccgacaattatttatgaagttcattttacaaaatttctttttttttatttttggcttaatgtcctttcggcgctttaattcaaattaatagttgctaggcgtgccaatgtgtggcctaaaccattttgttgtcttatcatctcaaacagccaaaatgaataagcttattcagaaatacaaatgaataaatacccaatttagcagcagcggcagcagcagtagcaacaaatcacctcccccccccccccttcctattttcaaaataatcccaaaaaggcagcgccataacaattactcaaattcagaaaatgttggatcacccagagaaagtggaaaaacatatgtatgtggtaccgttttctgtaataaagccctgggtctccgttttctgttcgatcgttaaaagtggacccctctaacggaacaaattgtagtaattatttgagcccgggagccgcgcaagatttttgtcttgggctctcgtacttacaattcaatgacattgaaatggttttaacgcaaaatcaaattgttactgagattctgacctcatatgcttttgtgccaaaattggcactgaatttgccattttccttatgggtagaattgttgatttattcacccgttttcccgttttaaacaaacacctgcaaaaggagaaggatggatttatcacaggggatgttgggctctaagggccttggaaacaggaaattttggaggctgttaaaaaatatccaaatttacaacaaaaaattcaaaggcttttagcttcatttgcggcgactgctggctttcgctgttccatttgctgccacctgacaaagttgggcttgaaattgcgctgctcagctgccgttttgacgctttggttgatgagcacttcaaaacgcggcattggacattgggcattattgaaattcgcaacaagtttcggcgttgctatcgggctaccggcaaagcggaaatggaaattttaaatgccgaaggcaatgcgatgccaattccggacagaccattgcccaacaaagtcgtcgggttcggcataatttgcacagagtaagtagtggtgatacacatatgtttacattcttattctcattgagaaaatttgtattaaatccaaaaaattagacaactcacaaaatttttagcattttgcgcgggaaatggttcagaaagttgttacaaagtatctttattgaccaaaatatcttaaagaatgactattttccgattattttttacgccgcgagtagagtgtcacgggaccgggacctggtactgaaaaacacggacaactgaataccgaagtcccggttttgaccagttttgactgggaccgggaaaagtcccggttttgccaaaaattcccggccccttgatactctaaccgcgagccctatgattatataatagataccaatgttaaatttagttgacgttgacaaaagttatgaatagggaacagatttttaaggacgaaaaagtacaaaataagggncttaaataagtgcgaaaaaaattggttaataaatggtgaaataagcacaaataagtttccaatttagggggtgaatttattaacagctgtttt

SEQ ID NO: 2535 - DNA, 2151 bp, Heterodera glycines
ttttttgcgtgttttctttttgcagttacattgatcacaatgcgatggcatttttgtgcagatttcggcaactgttcgcctctcatgcaaccaaagtgaaaatttgtgcaagaaatgattgtgcttcggagtacattgtgcgcaacttttgctcactgctcagtggtaacattttatgcatgatgatcatacaattttcggcaaatttgtgccgtcaatttgcacaaaaattgtctgacacacaaaaagttttttttttgcatttttctgataaattttcccgaatttcaaaacattcgtcccaccatggtgtggtgcttatacccgccggtatatgctgtttattctacaattgaaacaaaatgtgccaaaagcaacaaaatgcggctccttaaaaaagctccgaaagactcaacccgcaatttcggaccccctgggaaccgatcaattaaagcaatttcccagttgcgtgaagccatgctgcaagccctgtatttaaacaggtgaacaaagtgccaacgcgtcggatggccatacgccgctgatcaaatggttgctacgctcgtcgccttatgataacgatagttttgttgtgccaccacccaaagtactcatctgggcaattcaccaatcgagggaatggtcaccaaaaattcaagcaatcaaatcggtaattgtacttgataagcaatagataccaaacaggggtcggagggatccgaccgaataccggttccgtcgatgaagattttgggaaaacgatcagtaggatcgcgagtagcgatccaaatgaaatcccgtctcgtgatcccgagaatggttatttattttatatgtttttgacagacttatttttggattgttagtgagctgatttatctatctttaaagtagggttacatgggtccgggacccgaccgggtctcagacccgggtacccggttttttcaacaccggactcagttttttaaaaatgcaatacccgacccggtaagtccaggtacaaaagtacattggtaagaatgggggtctttgtcaaattgttgagtaaagttggaggaaagaaaatttttttaaattttaattaatatttactttaaaaaagttatcctttagtgattcagtggcttagtggttagtctctttgacccaaatcagagaaaattttcaaaaattttctggggatccctacacagtccccagttttaaaaaaaaacgtcgcaaaaaagttggtttgaatagtagcaaaaatttgtgcaaaaataaagcgtttatttgtaaaatataatatttttcctgttttttagcttttattttcatgaaaaaaataaatttggaaaaaaatttttttgttttttcagcgcccggttggacccggtacccggttgaaaattttggacccggacccggcttttcaggacccggcaatacccggaccaggtttttgtccaaatacccgggccagatagagcttaaatttcaaaatttgctcggcggcgcaaaaaattagccaattcctaaatttggtcattttttagacaaaatctgtgcatttatgccaaaaggaattcttgtttcacaatttttttttgcatgtttatgtgcatttttttaccatttttcttacttttaatttgcattcctagtcatttgtcaacgcttcatctcgcgccagcttcatcattgtcattgcatatgctttggcaaacccaattgaaccgttttgcttgaccaacgcattgaccggcgaacaattgacgctggaacggtgtgaaagaaatagtgttaagcctgcccagaccctcggggagagaaaagccgggatttgattggggtggagcctcgagaaaatttattgtttactcataatgtcttggagtacaggcgagattttcccgcgcagggtcgcggggcttaacctaatgttaaactttgtaaatccgccatcttgacagtctttgtttttgacactcataagtagagctcgacttttgaggcatatgccttttttttctgcgcactagtttcgaaatatattaagcataaataacaccttttccacttggtttgatgcttttacgttaacttttattatgcctttttttgcctttttcgggattttcgtgcctaaaatgccttttttggcatttt

SEQ ID NO: 2536 - DNA, 1529 bp, Heterodera glycines
tgatgaaaagaatgtgtgggtttatgggtgacctttctctgatcagttgtggaacttttgaactggtccaaccggttcagcgggggccatggcatgggaaagtgcgcaagtggggcgggggcagggagaggcaagaacaggtcccacccacccgacacggaggcaacccagcagggggatggggaggggctgaactgaacggtacagtccggcttccgagactggacatgacccagatcagggtcctgttagtcttgtttcctgttttatgatcattttgctaggctttgtggtgccaagactaacccgaaaatcctctaaatcccatcgggccccaattttcatatgcttaagcatcgtgatcacaggcttctaactttttttttgtaatcgttataccatgttcatcattggtcagtgcaatttaaccgggttcatctcccatttttcgggatgccaaatgccattttctattgccggcatcggaataatccctaaaaatttgctggcttggtcctgatcccggcaaaatccgattgttctagggagatcgatcccatccgcactactgatcgtagcatttttgcattggctttatgtttgggagagatccatgcgcagataacaacaataataataattattattatacgccaatttcatttaattgattttttggatgctaaaatatgatgaagcactcaatttttatgtgccgaaatatttggcgaaatttatgcagccgataataaagcggacgcgaagcatatgaaaacgcggaactgctcggaacaggattttgaaagaaaaagcaataaaatggatagagtctagcgtcgaatcgcaaggactgactgatcagagacctcggcggggctttgatcaagtgatcaggcaaacattttcataatggagtatgctaaataaatgagtgatcagatcaattattgattgcggggaattgttgatcacaaattgggcggtcataccatagggatcgatcgagtaattttatttgcgttaattgattgatcaaattgggagtagattgggtaatagccacgtgaaataaattatggaggaaaaaacaaataaacaaataaatgtgacacaaaaaatacagttgtattgatcagcataagtattaatataattccttgatcaaaatgaggggtatataaatcatcgaacaaaatgctttttgagtagtgccgaaaatggcgcaggcattccctcatataccaaaactaatcaggagactgatcacaaagctgatcagaggggaatgaggccaacagggccaacaaatctgtccggattagctcccctctccaagggacaatcgctttgcgacgatcagttgggggattgatcagagagagcgtctgatctgaatgcaatgatcagagccacaccaaaatgttgtgttgctgatccgcatcaacaaaattgtgggctggttggtgtgctgtgcgttgccctcgctgctcttctgtctccctcattgtctcagcccgtgctgctccaaa

SEQ ID NO: 2537 - DNA, 7943 bp, Heterodera glycines
ggtttaaaggaacaggcggtcaaccgagggcgggtgaatcccaaaacttttggttcgtttttggggaaaggaaaatttttatgggaaaatgaagtgattgaaaaaatatttttttggttttggttttattttattataatttgccggtcgggcttaagaccttccctgaggaattaaggggagttcgagtggcccgggatgccccgcaattcctttgacggcaagaaggtttttcgacgcaaagccggtagtacacggcaacgcatttaaaatgtgaaatgaaactgatcactggaattcgatctttgaaaattggatagcagaaggaagttttggggaaaagaatttggcctttgcaaaatgtcagtcgaccctccccccccccctcccccctcgaggggaagtgagtgagtgtaagtgaactcgttttcggagaggggaccccgcactgcattatcagcaagtttggcgcgcgccatgttccgcagctgtttccggcgcccccttcgactgggcaattttgtccatttttgatttgggtgggcaaaaaaggaaaactgttgaaaatttaaaaaaagaagttcttggcataatgtttaagttttaagagcattttaaaatgccaaattaaatgaaaaacaaaatttaactcatttttaaatattatttaaaattaatttttgttttaccgtgttttttaaactgacactaccgtatccctcccccccccctccgccgcttgttgtccaatcattttttgccccgcgggcatttgggcggagtttctctttttttcgcccagcagcagcagcaacacaacgccaatgggccggggggagccaataattgccacagggctcttcttcgcttgagttgttgcgccctctcgcgttttacgattctcgggcatcaaaatggaacacacaaattacacgcgccccgaggggggggggcattttgccaaaaatgggaaatttaaaatttaaaaattaaaaaccaaaattttgttcaataattaggccacccttttggtaaaaatgccgtaaaacgcgggagagggtaattttgccaaatgtacacattaatttttaaaattcattaaaaacacccccctgagaaaacggcactgtcgattaaattgtgccaagaaatggcgattttaaaatttaattttaaaaattttgctctattttatggatatttttttatgtctaaatattacttatttcaaatgaatagctccggataaatgtgctagtaaaaccccaaaaagcttatgaccaattaatatgtcccatttgtggtcattaaaaaatgtaaaacaattgcaacaaaataatgcgctaattaaattaaacagattgtgagtcatacggtagataatgaaatacggtggtggtggaacaccgacagcagcagcaaattttgaccaccaccagcagcaacagcaacaccaccaacgacaacaacaacagcagcaacaacgaggaggagtgatcgctggcaatacaaacaacgccaacagcagtaacaacggcggacaaatgttcgtcatggatgggcaaagctcggtaagtgatttgggacatgggtgatcactaatcacttgtcaaatagtgatctgatcaaaaggtgggggcgggggtaaagctgggattttgatcacttttggcaatatcaaattgaacacaattgatctgacccacttgatcactttaatgataaatctgatcaccttggctagtgatcaaaaagattaagtctcactcatttccaagctgatatgatcacatttattttggttgatcaatgtttgattaattaatcgattattattgttgattaaattcactaattgacaatgacaatcttcctctaatttattagtgattatccttcaccttttgctctggtcactctttgtaccaaatttcccccgtctgttcaggtgatcaaaacggcaccgccgtgccgtgccaatgccagcaatagctcgtccaccaacagtgccatgatgatggacttttcgcccaagcaggagcccatcgatttggccccgctggcacatccgtgccttcaggtcagtgcttgaattgccaatttcttgcaaaattatcaatgcattcctttgataattatcagcgtccaatctcggctgatctctcactcaaaatccgagtctaatctccactctctccaccaccgtcgttgatcagactcaaaatcgttgtcccggctgatctcggatcagtcccaaattatcccatacaaattttttctccgatcattcactgccaaccaacaaaaaaaaaacactgtctctccttatcacacacaaatgagtctttgatccaaatcaccttcacacctttgctttcacctttaaattcttctagcgccacttccgttatcaattatcacatttatcatctctatatcatttatttttttcactttcgcctccgcacattttaatatgcatctgtcagaaaatcagtcaattatcaacagtttgtttgctcacgttgatcaatgtgatcagccgaggcagaagaagttcctttacccttcggcgcgagcagaacatcaatcccctccgctgatcaatttgatcaatttcttccgctgatttgtatgatcagtcccatccgcacgccgatcagtcccaaccattggtcactcacttcctgctgccgattagcccgaccgatcagtctatgccgcttcattaccctttcaccgagctttcggatctgtccgatcagttccatcagccgctttctgtcctaccctttcatctgcttgaacgtttcgatcaaccccatcctgatcagtacaatctgtcgatcagtccgaaccattggtcactcacttcctacagccaattagcctgcttgataagtcccattgctggtctccccctctttcgctgatcattcggatctgtccgtccaatcagtcccatcagccgacttcggtcccactcttccttctgctccaaggttccgatcagtcacatcctggtccaatccgatcagttccatcagccgccggtctctgccccacccttccttatgctttaatgttccgatcagtcccatcctgatcagtccctcgcgccgatctgtccgatcattcccccctttccctttccctttttctctgtttgttgttttcacttttgtctctgtcgtccccacccccactttcccaaatgaaacgaaaattggtgaacatttgttggatgtgattgggcaaaattgtagcggcgggtggcggtaatcggaaaattgtcgtcgtcggcgggtcccaaaaatgcgcgaaaattggaaataaattgatcgatccatttgggacgaccatagggggggggaggaaatgcaaaattcggccaacacaatgagacattttggtagtacgtcaaaatgagataattcaatcaaagaatggtcaaatcgaaatatatggtgtaaaatttgagtcatcaaaaaatgagtgatcagagataattctttgcttctaactttttttatggtggttctgctgatcagcacctttctgatcggcagacattccgaatcatcttcggttaaaggtgaaaaaaacatagtgacgcacggcttgctgatcaaacagtgtttgtgatcattgtgctgaaatttcattcacgtgatcacacacaggatgatcttgaaaactcgtctgacaatcaccagcagagctgatcagttttttgcgcaccagtacttctatatatcaataatacaatcagtatttgaccctatcgattcattgcttttcggcactaaagccacagtcaatcaatattttcccaatcgattccttgattttctgtgtcaattctacaatcaatcaatattggctttcggcaccaaatccataatcaaggcattttttcccgatcgattgattggttttctgtgccaattccacaatcaatcaataactgcctttcggcactaaagccacaaatcaatcaatattttcccgatcaattacgaacgctatttaaccccctttttggcacacaggacctcagcaaaatgcccacccagctggagcactactatgtggcttcctccaagggtggcattggcatgccggccggctacggcgccaccgctgccggtcccgcctactacgagtacctcaacgtcggctcggccgcctatccgacgcccacgcaaccaggcccgtccggcgtcgccggcggcgcgtccgccgcgctgctgcaaccgaccgcggcggcggttgtcgcgctgcagggcaccgctgggggccaaccgcacgcggcggcaccgcaccaggtcatacagagactttaagggctcaattgatcagagacgaccaattggtcactgatcaggggctggtcaaaatgatcattgctttgggtgttcatgtgaatttgcatccgggatgtgagccgatttcgaattcctgttcccggcacttttgcaggtcttgcccattcttgattctcgaactttatgtgaaagtctagtctaccaattcgaatagagctccaaattatgaaaagcgtggattaagagtccaggaaaatccagggcttggttggacccaggttcagattgagccctaaattcctattcgaaatttctgaatttttagatatggactttcatccctggtcctgcagaacatgtgcaatatttcattaatatcaaattttgtaattgaatttaattagggaggttttaacaattcaattggggaaggggaattgagcttagaaagacgggaccgaaccgccggaataagccaagttgtccttgacagcaagggcatagccaaccccttggcttcggggtgggttgaatgtatttttatttttttaataaaaaatcttaataattttattttaacaatttcttacttaattattatattttccaggactggccctacatgtcctattcgtccgtagccgcccacgccggactccaccagcagcaccagcaacaactgcaagcagtacagcaacagcagctaaacggctacctggacgtcgtcatggagcaccagcaacaacagcaacaacaacagcagcagcaacggttgtattgcggtggcattggcaccggcggcggcaccgccaatggtgcggagattttcttgttttttatttttttatatatttccctcatttttttatttttgatcattacctaatcacttttggttcggctcttcaggtgtatttaatttaggtcaagcaaattcaaattttagcggattattttggaaaatttcaaagttcttgagaagagaacataagtcgaggccaaaaaaaatcaggaagccttttgaagagcctgatcacttttcagtgggatcgtcgaaaattttcaatgggatattttcttcacatatttcaagtgaattgttgctttttgatcgctttgggcactttaatttgtccatccctattccgatcactttttgtcttgatcatttttcaattcccgatcactttatgtctttgggaccgtttttcgttcattacccaaaaagacgaggccattataattcattgtttgccactgatcaaattaacacaaagcgttgcgcaggtaaagcgatggacgcggtcacagccgcaacgctggcggtgaacgcggcgacgggcggcattggcacggtgggcgccggcggcggcggactgctgtccccggtggactcgggcatcggcacggaactgtccctgctcgagcacgccaaacaggtgagagaattgctgattgatcagtcaaacttggtccagggattctgatcacattttgttcaattgatcaaaattttaaaaacataaaactagcgacctgtttgatccacggggcagatttttctgatcagtttatgattttcctattaaaattttcagcctctgttagtcagatctgaaaagtgagaaatgctaataaggctgatcaataattatttttaccaacttattatccctgcaattggatctgacggtcttctatattgatcagatattttctttgccagtatctgatcaaccagaagatctgctctgattatctgataaaaaattctaagttgatcgctgatttattccgatctgataatttctttgccaacatctgatcaatcggctctcttatctggtctgaatgatctgatcagaattctaagctgattgatttgagctctcagatttctaatatctgaaatttgacctgatcattttcccagttgcacgaatttttcgcgcccggctgttccctggcgtccgctgccgtcctgcaacttccgcagtccgtccaagcgcagcagccgtcatccgcctcctccgcgctgcaatccgtcatccatcaccagcagcagcaacagcagcaggaactcgttgccggagtagtacaacaacagacgcagcaacagaggcgggatcacaacaacggccgaagtggagccggcagcagtgaatcggtgaggcattttttggcatggcattttggcaagaggggggccgcacgagattctcggtctcaaatctagagaatttctctgtcttctatgtctcggtcttgaacccttggataagccccgatttggtagaaagtctcgaaaaaggtcggctctcgaagagccataattggcagtgtgatgtcgggaatggaaaattcatggcactcgcgagacgcaagattggcattagcacacctgtccaggcagggaaacaaggatgggatttgtcaatcccgagaatgggtgggggcccagattttcccatttcagtccaatcaaatctctctctattcccatttcagtgccacaaattcccccatcccatttcagtcccaccaccgtgagtcccaacaccgggaacagtccctgcccattgtgatccccaaattggaaaatcctttgggctttcaatacgctttggaggcgcccatttccacgtccattcggaaggaggacgatcggatgacatatgtgaacaaagcaagtgatctgtggaggcgtttttttaattttcattaatagtttttgttcgaaaaatcgaaaattcatttttttaaattttcatttaatttattttttcctccattttcagggccaattttacaccgtttcgcttgactacatccccgacctgcactgtcccctcaaaggcttaaccgtgagggttggtttattgtttttttgaaattttcaaatttttttcgaaatagtaaaaaccggtaattgccattaaggatggtttaatatattttcccgagactcttgagcattttttttaaaacacaaacacctccttccattagagcaaatctcgaagcttttgtgactgattttccaataccggcaaccattaaaaatagcggtttcaatttctggaccaaaatccaggaaaatccagatccaggaaaaatccagggtgccgaaaaatagcctggatcttgacctagatcaaggaaaaattcaggcctggatccaggtcgaggccgacctctaattaccaaggcattttgtaattaattaattttcccattttcagagtcaaattatggtcgttttccgcgaggacaaaacgtttgaggacgagctgaggacgtggatgttgtggcacaaacggcaacattcgcacaagcagcgaatcatcgaagtgagaacatttgggggaatttggaggggaaagtcagaaattacgaattaaaattgaagaaaaaaaaacaaaataaaatttaatttaataaaaaaacataaataaatcgagacaattaaactaatattaaaaatatttaaaatttattttcaattttttatggcaaaaatgctttttaaatgtaaaataaataaggaaaaattaaaaaaataataatgaaaaatagaaattgataattaaaatattgtggattatggactcgaat

SEQ ID NO: 2538 - DNA, 7739 bp, Heterodera glycines
tttttaacgatcactttagggtcttttgcatttctccgtatcaataattaattaggacttaccagacggagatgagccatagcagcaaatctcgccagttctccttctccttcatgcagcttttcctcttcctccttcagccactgacaaaattccgtcatggcgcccgggatttcccatactggcacgccaatcgggtcttcaccaacaaacacatccgtcattcgataaacgcctgctgcggcagcacggtccttttccccgaccattatcgtatggtgcagggccagaatcctcttaaaaataattaatggcttttactttaaaatgttaatgcttcatagattttgttttcattttgttaggcctcgcgttagggtccccgacttacaaaggaaggtccccaggtgtcagtgggatttccgaatgaaattttggatagagcacccatggcttcttaagaaaagtgcggaatgagcccgagtgccgagttgtgacgtgccaacattttttaacgaatacacaaattcaataattgttaggctctttttgcagtgttcaatggtgcagcggtagtgcgctagtccgctttttttaagccccaggttcgaatcccttacagtgctagcgaaagataaagaatgagactctttttttgagaattctcttatttttgagcacatttttggcgttttttagcacataacccgggccctgtttattattattggtgtaccattttatagtgagcagttgcggcgaaagtggcaacgtcatttgtttgggcgtcttcggcattgagccattccacaaattgcgtcattttctcaggcacttccgcagcagttgcttccaccttctgtccgcccacagtcacttcgtccactctgtattcccccggcatcgattccttctcccccgacatcacattggcatgcagcgctttgatggtctcaaaaatgatgtataatttttttattttgtttggatgaatcatatgggtaggaaaatcctaggaggtctggaaatttttctcatctagagggcgggaaatacaaaatttgccaaaaactacggctctatcaaaactacagtattaacactataatgccaacgatcaggaagacaccgattagaacaatggcgagaagcggatttaataattattttttacaaacaaattaattcatatacaccatcaaaggctcacgcacggaaaatgcattagagttctgtgcagtgagtatttttttaatcattttaatttttgaaatgttcaaaaaataataaacattttccaaaatccattaaaaacaaacataatatgaatggattactgtaggtttatgaccatttacaatcagcttaaatttactgtcagcatataaactgtttcgtttttcatgaaaattttgattcgctaacgcattttccattgatccattttccgtccgtttttactcaactcttcaccgcacacaaccataaaatttaattcttgtaaagttttctccccttttcttttgcagcaaaaatattctacctgttcagaaattgtttttgggtccattccttcggtgtccaagatgtacaagtatttcgcgtcatcatcaaacgacgcggacacatcgcgatcgtgccgcatgccgccggcggtgtttcgtcccgcgtctctgcctctttgcatgtccactgccccttcatcagcaccatcacagcggacaaagtgagcacgaacaggaagcaaatttggtaaagttgttcgcctgttcaggggggggctcatttaacgaaatgaatgataattttggtggggtaacaagcaaattttccgggttcgactcggaaaaccaggtcttaaatagcctgggtttttttcaaaataccgggccttttactggaaatcttgacgggtaaccttttgtttgtagccccttattcaacatttaaaacattttcccccaaattttgctcacctctcgatcgagcaggccaactttactgtcaggcaatgtcgtcatcaccgatctgaatttatttgtaaatgatagaggcggcatcaaccaaaaacgttggcaaaaaaattgtatagaaaaattggtgtcggttggctctcacctcgtctcccgcccggtgtacaccaccagtccaatggctgtaccgcttgccaacactgtgttggcccacaacacacagcacattctccacagatagagctccccccacccgtaacgtctcctaccctaattttttaaaaattttcccaaaaaaaatcgcttaaaattttttcaaaattttccctggaattttggatgacactgacccggtatgtgccgacaaatgcgtggttgtccttctgcagcttctccgcatacacctcacagttcaggtccaaaatttgcatgtcgtccaacaggttttgcgtgtacgggatggcaatgcgcagcttccaatccgtctctccatcaagctaaacccatcaacaaattcagcaagtttttttcggacgccaaaacctggtccgttcggatgaaacacgcgcccgacttttcggtggtgcgcatcagcacaacatcggccggcactcgacggtccttttcaatgatgatcaaatcgccaacatggatttcgcttaaagtgacattcattacgtgacaaaaggcaaatttttcatccctttccgtggcccggattcgaaaaatttgattttttaattattttttttccaaattcaaaaaaaaaacgatggaaaacgtacgcgcttttgatcagaacacggccctcaagcatacttttcactgttcacctccctgtcgcgcaacagtcggaccatgtcgtccacaaattcgcggatgagtgtgatgaacaggataaaaccctgaaacattttttgaacccataaaatggtgggggaaacattaactgaccaatggaccccaataagtgatcggagacccaatttggatggccgggaagaactgactgcaggccatgagcaggaagtacaggttgagaaagaatttgaactgttggaagagtacctgaaaaagaaaagggaaaattgaattttcgctaaaattttcggttttccctcacgtaaatttctcaaaaaaaaattcgcgaaatttttccaaaaatcaacaaaattatcatttttggtgataaattgttacccctggaaggtaaaaaatgtgtcatcgtccgggggcgaacccacccaacgccaaaatttcctgggaccgtccctggatgggtgccatttctgacctttgtgaatatggcaatgaaataaactaaatggacaaacgaccgaaaaaaacaatagatatacaattcaaggaaaaaacatgatgatgaaacatataaaatgatcattttttctgatgtttctgagaattaaaaaaaaaagagagaagtaaatttttgaaaaattgtacaaaaaagaagaataaacataaacctttgtaacagaaacggccacacatattttttcgtaaaataacacctgtcgaacaaatttggtaaattccgtggccccctgggcactgcacagttccacagtcgacgacgttcagccggctcatgagcatggtcggcaaagactcggagagcgagctgaaagcggggaaattgctggcataattgtcaccatttttccatccattttgctgttttaaaaaacttatatatctactaaaggtgtgtaatttcacgacgccttcgaggggggagggggggatttttcgtcaattcaactgaattttcagtttattggtcgaaatatccccaaaaatcgattgaattttttcaaaattagcgtttatgatgaaggaccaatgaatgtcgaaattttttaatgcctcatcagagctattttattaaatataacttattttatgttaattgaagttgggtttgaacccaggcctcactcaaaaaagcaaatttaaccaactgagccattcattccctcttttcctcgccatccctaggaaaggaccctcaaggaatatttcaaaatcggcataagagtaaatttaaccgagaaggcgcccttcgaatgtcgatgaactgggcgattagttggcgaggcgaacaacgggccggaaaatgggcaaatcttccattggtttccggcactttgtgcagctccaaaatgtgttcagtgtccgctgtttcggcacagaaacccaaccttaaaaacagcaaaaaaaacaaataattattaaacgttctcgttttgagcacaaagtccacctcctgttcagggttctcgaacagcccgttgaacgagtcgccggcgtcacagtttccgaacagtacacgctgttgttgttgctgatcagtcaaattaatattattttcgggacatgcctcacctaaaatttcatgtatttgctgaagattttgaaaaattgatagacaatttcttgatggttttatgcatctctttctaatcccattttttcagcgtacttctcttacttattaaaatattaatttttatggctcaattcggctctcagcagactggcaacgcttcgggattggtgggtatttatcgtttagttttttatatcctttttttgcatataggtgcggtgtctgtattcatcgcaagcccgttacccaattcctgtggggggccttttcccattggcactgatggaaaaaagcgaacggggcgaattgagagagagaaattgggatatgtgggtcgttaaaaacgacagttatcccagggcgtcaaataaagaggtcagaacaaaaaaaagagccgcaataattaagtgtttaggaagcgaaggaactgcgcattgcgcaccaaaaacgccgccggacggaggacgaataccatctgtttctctggcggatcatctccagccgaattcgtggcgaatgttcatgcggaccgctttgtctgcacttcagtttgcgagacctggaggacatttgcatcggccaatttgggataatcgatgtaaaatttattttattcagtaatttccataatcccattccccctcattgttatagcggttggagatgggtggccaaaaaaaaatccacttggtgtacgccgacaaacctgtcagtgcactggaggaggaatttaatgccgccgggaagctgtatggccagcctgtgcctgcactcggcgcgtacaaaaatggccgctcaactccaattgagccgcggctggactattcggcgcagtccaacgctgacgaccacccaggacttggctacaagtgtggccgttggcaggttaatggcttttaacaattaagctcttaaaaatgtgttttttttgcactccaggtcgagggcatggtgcccgaaattctcgaggaggacattggcgaacgtgtattttacacacaagcccaggtggagcaaatgctggacgactttaaggtagcttttaataaatgggcgagatttttttaaattttcattaatttaaaaaagcatttttctacgattttattactttttttaaagttatatgtgggtcaactccacagtgaatgaaaagttaacaaaatgccaaaaaagactatttttagcgctaattcaattaactgatcatgatcattgcctttttgtgattttattcactcataactgccttcttaatttgattactgattcagtcataactagggatgggatttctaagtttttacttatttttctgcggctttaactgaacgagaaatacacgaaaaacacattttttgtctgaaaattttgcgttttcacgcccttattcgaccttagaaatccttatttttgatgttcgcccttaaaataagtttttgcccttattttggcgttttgtccaaaatttattaacaaaaatgcaataaaaaacgaaaaatacacccctaagaatcgacccaaaaaaatttcgaaaaaatacacccctaagaatcgacccaaaaaaatttcgaaaaatatacccctaagaatcgacccaaaaaaatttcgaagaaatatacccctaagaatcgacccaaaaaaatttcgaagaaatatacccctatgaatcgacactaaatttttcaaaaatagaccctaagaaatgaaaaattttttctaaaatatagcttatttgtaactgcaatcagtgaataaaattgtttgccttagtctgaaattatttcatgtaaaaaacagcaattttaaaaattataccctaaatttgaaactttttcgaccttattttcgcccttatttcgcgaatttttcgcccttatttacggccttattttggactttttcacccttaaaaatcccatccctagtcataactatgacatctaaaaatatggatgaatatcgcgaaatttagccataaaataatgacaaaaaaaacgcaaaaacatgaacataaaatagcaaaaatatggtaattttgcaaataaggttacaatttaaatttcttcagatttgttaaatattaagagcgaaaaacaacctgagaaatgaaaaatacgcttttttgacataaatttataaatttgacgaaatttaaaatttttcaacatttccacgaaagtttcaaaaaatatttttgtggtaatttttttgaaatttaggggtcaaaaaaaccaattttcagacggggctgttctaatagattgtttgaaaaaagccaaaatatgcagaaatatggattttaatctcctaaaacatgttttgcatgcatttcaggtctcccacagtccagtaaaaatttgtattttctttttatggatgccttgtcataactcgcgaatttccaattagactgaacaaatttgacatcaagtgaaaaatgaaaaagtagtacaaaggaaaaaaggcaatgaaatagtgcagacctttctttacacactggagttgacgcatagtgtgggggtggggctgtcggcaaatcggaggaaggaaaaaattcttgaaatttagtcaatttttcttaattaatttattaaaaatcttttaaaaatcgggtaaaatttcgaaaatgtcctcattaacatcgatttttttttgacaaactgttaataagttgcacaaatttcaaaatttttcaaggagtgctgaatgtttttgaaaaaggcacataaaaaagtggtttgtaaagaaaaaagaaagagtcatcaacaatttctgtttatggcctctggtccgaactaaatattttctgcaaaattttaattggtttttggtcaggtgtccactgattgggccggtcataaaatgacaaagaaggtgttcgtcgagacggatgctgcggtcgatgggaggcgggacgcaattttggctggtgcccgccgtaaagcggcgttttatcagctgaaaaaaggtgtcgtcatgaggatggacagcatgtatcagcaacaacagcagacaggccaaattggacagaagggggagaatgaagcggagcaacagcaatggggcaaagcgcacacggaggaacaggccgcttttgaatttgtcgacgttgttgtgcatcccgaggaccttttcgtcaacgaaacgcacagcacttccacctttgtctaccaagccggcgacaaaattctccaaaacaattcactgcggcacagaatggcgagatttctgttgccaccaggagaattggtgtggggagcagctgctccaacgatcagcaaagcaagaaggacgcgcacacagctgattgacaagcaccgcaatcgattgaaagctgaagtgaaaaatgaaat

SEQ ID NO: 2539 - DNA, 2148 bp, Heterodera glycines
atttagctgatgccgacaaaggaccgtttggaagcgttggaggcgttcgcgcaaaagcggccccccaaattcaaaggggaatgaatgatggcgagagaattgcggcgcgaatgcatattattgtatctagtcatatcagcagactccagcaatgaaaataagaatgaagatgacaaacaacaaaaaacgcattgtttttttttatacaaattttgttttaattatttccctttgtttttgccccaaatgccaaaaaccctttcaaaaagcgaaatgcgcctttgttttttattattattgcttattggaacaaacaattataataaatgaatagcgaatttgaagcaacaattaaagggataaatgatggaatttgactaggaccaaacatcttcaattaggcgctccttttcacgcagttttttcaacaaatgaatcgcttcgacaggggaaaagcctggaaaaaaaataattttcggtctgatcaagtcgaccaaatctatcctgatttccctgtcgggttaggggccgaattggggtgcggccacagggattttgagtgggcccgaccttggggttttttaacgaatggatattcgggatttgtctcaaccaaaaccatgggctcaatgccgtccctgtttaagtcagccaaataacgctcgcctttctcgcgctgcaaaatatcgctgagacatgcccacaactctctgctcatgttcttcacgtcgccacacgcgtagaacagaccgccctcccccaactcctccgcctcattgtcagtgggcatcaaaaagtccgcaacttcggccgaccgttgccgcaacgcgtcatacactcgctgcggtcgatggcactgttgctggtggtgcggttgtggcgacgtctcattgtcgccggttgtgcctgctggtggcccagcgttctccgctgacgccgccgcgtcggcgactgttggacgcgactcgcacagcaccaactcgctcagcacaccgtcagcgaccatctgctgcagttcagacatgaaatgtgtgaattaaccatttggaaaacttggcacttggcatgaatatttgtgcgtggtacctgaacaggaattcgtcgtccaaattgctggacgcatagaacagaacgcgtttcactcgtccacaatcgccgcccattcgttgcatgaaatgcctgcaaaaattttaaaaaatccaccttttgaaagaatttttttataaaaaaagacaggcagatagtgtgaaaagtttctagaaagaattaagtcaatttcaagttgataaatttcaatttgctcctacagcgccacaaaaaattttatatttccaatttccggaaatttttgaggcctcagaaaaggtgaaaaaagggggacctgattttttgaagaaatgcaatgaacggagcaacaccagtgcctgggccgaccatcatcaacggcatgttcagcaacaacagcgcatggtcgggctggtcaaccatcgtggagtcgggggacggcattgaggcgggagaggggacgaaagaagggggcaaaaaacggaatttggacggctccttttggatgatctgcaatttttcaatatggaaatggatttctttatgaaccaaaaaactgtcaaaaaagtaaattggacgaaaaattttcatagcaaaaattaaaaaagggtaaaaaaaaactgaaaaaataaaattattttcgaaatttttcacaaatttttaggttgagcggaatgcaagagaaaaagcatttcgtttataattccgaattatcatttttggtaaattggaaccatttttggtcaagttcgtcagggttcttcaaaattagaaaataattgcaatcgcaccaaatattttatttatttttttaaattttacgggtgtccgtccccacctgaacagtttggccagtccgttgctgcaacagccattgagtgcatgcgccgtaccgtttttgttgtttttggccctcaaattccgcacattcgtcaattatcactgacgggggcatttggaggacggagtaaacgaagcggaaacgcaactgttgctgcttgtgaggttgtgccgacaaatagcagcaaagtgtgtaatggcggggcaaaaggcgcggaaggcactctgaaatttggggatttt

SEQ ID NO: 2540 - DNA, 1516 bp, Heterodera glycines
  misc_feature (1119)..(1119): n is a, c, g, or t
tttgtttctaccaattaaacattccaacggcggtgtaagtgaagagaatgtgcacagcaattccaccagggaaatgttaggctaaaaaatgaaattttgaaaagacaaaaaaaaagttttttaattaaacctgtcgaacaaatttggtaaattccgtggccccctgggcactgcacagttccaacagtcgacgacgttcagcaggctcatgcgcatggtcggcaaagacacggagagcgagctgaaagcggggacaaattgttgatatttttgtcaccgccactgccatccatgttttttttgtgtgtttaaatcccgaaaatcgaccatttttggggaaaaacagggttataaattagttgtaaatgaaataaatagggtctccgactcatctccaaaaacttattttatgagcctgattgttagtggcagtaaaattggaaatttaaatgaaaatttactcgagaaggcgccctgcgaatgtcgatgaactgggcgatcagttggcgaggcgaacaacgggccggaaaatgggcaaatcttccattggtttccggcactttgtgcagctccaaaatgtgttcagtgtccgctgtttcggcacagaaacccaacctaaaaacgaaaaaatatatatttatgggaaattttggattaatttactccattttagaatttgaaaaattaaaaaaaaaatttacaacctaaattccatgggaatgccggaaaatgtttaattttattgcttattttgccaccttttaagcacaaagtccacctcctgttcgggattctcgaacagcacgttgaacgagtcaccggcatcacagctttcgagcagttcacgctgttgttgttcttgctgatcatcagcaccatcctgatcagtggtgatcagtgccaattccaactcccattttgctttgccaattcggcccgtgtccgtccgagtgacgcattcgttacgcaccacgcgcgtgcgcaacagcgggccaaaagcagttggaatgggcgcaccgcattgccaaagtgtattggaagaggactaaatcaaaaattgttgtaaaatttaaaaattttcaattttgggacatcccttatccctataaaaatcgtttntaaacatgaattttggtttaaatttgtatttctattaccaagacttgaaaaatccactgaaaaaagttagctaatgaaattaagacgtcttaaaaatgaaaattatacaccccactccccatcctcaacaaattgacctttacatgctcattgtcagcaattcgaatgctcagcaaagattgtgtgatggccggaacactcaactcggttacctgtcccaaatgcttggcacctgaacccaaccattttaaatacataaaactgacggttaattggagacgaagattttttgaattaccaattttcaaggatggaacttggtccatgaaagcgctaagcgttgaatcgaaatgcaaatttttgttggcaaatactctagaaattgttgtcttataaa

SEQ ID NO: 2541 - DNA, 1864 bp, Heterodera glycines
  misc_feature (18)..(18): n is a, c, g, or t
ctgatcatttatcccctntttgttcatttatccaattttccgtgatttataccattcgcttcccatttattgcctaatttgtttttgtgtcgatcatttgtcccattttgtgccatgtttcttacatacactgagaacaggtgttccgtcaccgcagcagtcatttgttgcggtcgcttaattggtgtgttccaaaagccgcgcagcaccgggtcaatgccgccctcagacaacaatttttgcgatttgaaagtgcctttagggggataaaatttgttggcatttttttcaaatgccaaacttattgccttcatttaatggaaatggacccgccgctattgactggccattctcagtgagtcgggaaaattgttccttaaaaatgtcaatgatcagccaattaacaacattagaacaccagttctttttctacttgaaaatttattttaaaaagttttgccaaattctgaaaattaaagttctcttataaaatttcaacaaatttcgaatttcgaccgcgcgcttttggcgccaataacaatttatttcaattaactctccgacggatccaatcctctattgtctgacccgttaattagcttctaaaacccattagaatggcaagtttcgtggcactgcccttgaccaataaaattcatcttccttaatcacccgattatcctgtaaatccgtcaaaactgactacgatcgttccgtgcccaaaacggaaggcggcggcggtgaactcattggccacggtggggtccacattttggtcgtatccgttgtagggcccgatcagacgttcagcggatgggccaagcatcaacggaatgaactcgttgtagaggacggcttggatttcggcaccgacaattttgcgggtctcctacgattttttagtaggcccaaaacatagttcaagatccgtttgaaggaccaaaacatccattaggttaataccaaaagtaaattttggcaccatttttgccgtttttgattttttgccttttttctcacttgaaaaagtcggtcaccactccatgcccggttcaacgattgcaattctcgggcaattctgtcagatgtatttaaaaatggcatgcaattttggcataagaaatggcacctgttgtgctcccggacaaaaagtgtgtataacgaggaaaggccaatgaactgtgaaagtgaaggaaatgcatgacaattttgtcaaaaaattgatcatttgtcgtttagtcaaatcataattaacataattgtcatttgtcgtctatcaattatttaattggccttagatgtgaggttaatcttcatttaatagcttttggatgtaacaatcgcataaaaattccaaaaaattacgggaataccgccagatttcaaatttgttaaattcaaaaatagcaaaatttcgttaccatgttcacacggctgtcccccgtgacaaaagttgctgctgcgcaagtgccgcggttggtggcggcaccgcaacggctggcatcaaacggcagaaccatcattccgttgaagctggacatcttcaggaaaccggtacgaccgtctcggaccttcagtctaaagcagttgctgatcactcagctgatcagtggcagcgagtggaaagattcgtcttgcaaccaaaatccagctctgatcacgggtgatcgagccaaatatatcaaaagcatttttttagaattgtcatcatttcagtcattggaaaagggctcctctttttgtgatcagagcacacttgttcagcagatcagtttcgataaataattaaattttaaatttaaaacgtacaaatccttggcatttgacccgtaaattgttgatccatccacaaaggcagtgttct

SEQ ID NO: 2542 - DNA, 4203 bp, Heterodera glycines
ctctccaaactgacgagagtgatcaacaattggtgccaaagctttcaaaatctacctcatatatgcccggaaagaagcgccgagcgtcggtcgtgccaaattgttgcacactccgtcaatagaccggtacgccaaatggtagcacaacgcttgggaacaatgagcactgtccgcacttagctgaacggagttgcggggataatccggattagtggcttaatttaaagtcgaaatttcccggactcgagaacagagccgataattgatcaagaaactcgagttgagaattgactccaacaccgagaccaagaatgattggaagagtcaagaccgaggccaaaaattcaagaaatattctcggcacaaaaactgagaaacccaaaggtttttaattgttattacgatatattataactacctgaggaaaacatccgccggacttgttcgtcctggcaaagtccgctgcgtacagtgtataacgctgtgaattgtcctcgatcggattgatcagtctgcctttgatcagctgttcgatcgctgttgacgggctcttccgaatctgatcacaagaatttgatgctgcttgacgatgatttgcgcctcctccttggctcgtcaaaatgttaacttccgatcgaccattttgttctctgttttggccattttgccaatttctgcctctgaattggccatgttggccttcgaatcgtccagtttgccaatttccttctccaaatttgccatttacagcttaaatttggttttgtttcatttgggtttttacgggtcatcaataaccataactttcaccgtaaccgccaccatttgactcttgtccatagattactgtatttattagtaataaatactgtagaaggcaaagaaatagcatatttttattttgttttctaaaattacatttttattttattttctaaaaattttaacgaaaaatccaaattttatttaaatttaaatttgattttttgaaatgaattgaagatgaccttaatttgtttgtgtatttttaaacattttttggcaataaaaaaatatttttcagttaatttatgtgtcaacaaattttattaacaattagggagggctccgactcaatttgacaaattacccaaaacgaaatgaaaagaatgcgcatagacaaaagaaaatgaattaattaattggtgaaaatgggaccaaaaaaaaatcattagtggttttaaaattgtcaaaactttttcagaataaacacaattaattcaattgcctaagtgtattcttaattggcctaaaaaatgtcaaaacggtttcaaagtttaatcaaaaaaaaaagtaaatttttgaatcttttatccaaaccttttttagggtttgaaaaatttcttattgaaaaacaggaaatcgagaacatgaagtcggtcgaacattggaaagagtacaaaattctctacaaaatacaaaagtccacatctctacgacttacacccatgaggtatgggcacttcaatttcggtgttgatcatttctactgtaaactgcaatattttcttaagaaatacagtactttttgtagacaccgaaattgaagttgacatatctcagcgggtgtaatttgtagagacctgaggtcttttacatattgcagagctttttgtgctctttccaatgggtctactcaaaattttcaaaaaaaatttcccaaccccctaggaatttttttttctaaaatgttcccgattttcagtattttggggtgtctagatcactatgaaggagtgatcggatcaacttgttgttaaatacttttttgatcagcatcaaaacttatgttagcatgaattatttcagatttttctgtgctctcaaatttgagattcaaaaactggtgttaaacatatgcaccactgaaaatggggtatggtacacaaagtcaactgtaattcgggtttgaaccgatattttgcttaatgattggtatcatttgaaagccattaaaaattatacaaaaaatgtcaaaacatttggtcatcaccaaccatttaactttttatgaagccaaatttctcgaaaaggctagtggtgttagacttatgctcctaactgtatgcactgtgaaaaaatttttaatttttaactttgttcacaaaatttattcacactcatacataatatgcaatgaagttttgtatggaaatgtcaccgtttttgactgcctcaacttgacctcaaatttgcactgattccacgtttcgatacgcgctggtgtacaaacatttctatgacataacttaattgacaatttggagagcaatttgcaattcgcaagggcaatggaatgccgaaatcatttttcgagggcaaatcttatggattcatacttggaaaaaaaattttccttgtgcacaggttttcttaaaatttttgcataggctagactatttttgaatcttttctactaaattttattttttagaaatttgttttctaacgttgtctcctgcatttttacaagggcatttttttaattagaggtcgtttttggctggcatttcactctagtaattgttttctttgtcatcacgcgtgttttttgtttatttttaaagttctgtgctttatcaaaatgcaaacatatggatgggcggagcgagtgagtaattgaaggctaattaatattgctgttcgagattctcggggtcaagtctcgttctcggaaatttttctgtagcgttactaattaaccgtaggtttgggtaaaactgcagaattgcagctcgcgccaattaaaaaaaatgcgaataaggcaatacgagatgcactactctgaattatgcattttattttaattctgcgcataaataaatttttggcattatgattcatccattacattagcataaactagcggtaggggtcaactgcgtctgatcaaacaaaattggtatcattcgaaagttctatatatttagaagataatgcaagtcttttataagcaattaagaaacatgaaaaaaagttaataattgaaaactgcagaaaagccagaatttttgtataccgtaaatccgctatttgaaggcccgggccttctattgttcaacccctcccaaaaggggcctttaattggagggggccttctaccagagaggggccttctattgttcaacccctctataagtcaaatgtgaattgcctattttttgtacctctatttattcattataagcatttttacattcaaatttcatggtaaatttgtaattttgaatcaatttagttaaacaaatttgcttataccaatttctctataagatggacccatcaattgaatgtggcaattcaactaatttagtaaagcctcgtttcttattcatttgttcgaataatttttattaaggtctgctgcttttgcaacaaacccacgtctggtgctcacgctgtgtccctttgttttactgcctaagaagagacctgtgcctgagattgtcaaacgttttaagaacgatttagtgttgtgctggtgtggccgtacatggatggacaacgaactaacgacaaagtttttagaggaagtgcgaatgcttatttatgtctttaaagaaattatgtaattaaggtgcttggcggttttgcattcaggacccggcttctcgtttgggacagctttcgttgtcacatcagtgacgataccaagcagacactccgacgtttatccatcgaatctgctgttattcccggtggcactacgaaatacattcaagtactagacaattcaatttaaatcaaagaaaattattttagccaccaaacgtgtgttggaacgcaccgtttaagaacaaatcaggcaaatttacgatgaatggatggtgaatggagagaaagaaacaacgtcatccggaaatatgaaggctccgccaatggagacttgatttgggacaagacgaaagcgatgtctctgtcgacgttgctaatgaataatatattgatcaaatttaaaaactgtgttttagggggcctttaattggagggggccttctaccagagaggggccttgtattgttcaacccctcccaaaaggggcctttaattggagggggccggccttctaccagagagaggccttcaaatagcggatttacggtattttattttaaattgtttttaaaggggctattccagtttacgcgtcctatcagtgaccat

SEQ ID NO: 2543 - DNA, 3284 bp, Heterodera glycines
cactttcacagacgcgttacggtgacgcggccattcgtcgcgcggtgccgttggccctggcgctgctgaacacgtccaacccgcagttgacaatcatcgagacgctcagcaagtacagccacgacgcggacacggagacggcacggaatgcaatctttgcgctcggattggtcggcgccggcacaaacaatgcccggattttggcaattctgcgccagcttccactccaatgaccaggtaattattgaaaatgcagtaataaatgctaagtttagtgcagtaattagtaacaaggaggattttgtttctttgccactttttataaacgggaacttgggccctgacaaattccaccaaaagatatttcaatgatgatgatttttcatgtagagcatggttgatttactattgccaatttcggcttttttggctccgttgccgaaagtgatcagaaaaaatcgatcaaatgaaaattcaaccaaaaataccttaaaatttagtgccattttttcttacgttcaaatgaccatttttcatgggttcgggtccgttcggcagacgatgaattattttgatttttcttctaggtattattccacctagcaactttggtcgattttttctgatcacttttggcaccggaacaaaaaaagccgaaaattggcaacagtaaattggcaatactctacatcataaaagtgtcagcaattaatttttccatgaatttctcttgtttttaaaaaaaacattattttgcacaaatgcacatccaacacacagaacacgatgatgctgctacggatcacccagggactgatgcatttgggcaagggcactcaaacgttgaacccattccaatccgaccgtcagttgatgtgccccgcaattgtgccatttggattggtgaacgaattggaccaatgaaaagctgatattgaagatgatcggcggttcagcagaccggtccatttaattttgctaatagttcagatggtacgactttcattattgattttttgcataaatgcgaatttttgggaaaatgaattttagacttttgttcgacattcaaaaaaagagtcataccatctgaactattaatccatcttttattaatgttatgacataaattgcatacgaataatatataaacatttgttttgtttaattcattcaaattgccatgaacttttagcctttgttctctacccggggccggtcaaagcagctaaaataaactttttggaaagcaaaaatacacaaaaaaataataattcgatttttacaacattttattgaaacaaaatatttacatatacatacaattgatacagttcacatacaatggtggattacaaaaaatagttacatagttagacaatatagttacataacatatacaaaatatttacatacacaaatgactaggaggaggaggagggaggggagagatgggggcgggcgcacggtcttgagcacactgctgatggaagcagacgaaggtgatgaacggtgtcatgttcttcgcctctgacgatgccgccaccaagcactcgtagtactcatcgcgcttctcctcgggcaggatgatcggttggaagccgcggcgcatcagaacgaagttcatcagcagccgagcagtcctcccgttgccgttgtagaacggatggatgtacacctgtttttaaaaaatcttattttttagcaaagcttttttggggaaggattagcacattaacagtttatggaatttaatttagaaaattgtacaaaatatgaaaatttgttgtttttgggtaaaaaaacccgaaacttttgatttttacgatatattttggccttttttttgggttttaacacaaatttttgtgttttttttcacatatataccgtatttcctaaaatagagttcatgggtctttgtttttaatttgttgattttggcaaaaaaacggaatttgcttttttttcgtcattagcacattttttgatgtttttttttatcatatgtgtaccgtatttttcagcccgtcaaaaaatgggggggggtgtacttaaggaaatacggtatgctttgtttcagaatttaaactcaaaattcagattgccttgtaggagtgatctgattgatcacattggtgcaattggcttttttggtcacaaacagttataatagcgtgactttctgatgatttcgcaaaatttggggccattttttaaaataaacattaatgccgatagtatcgattctcaattttttaaaataatttattggttacaaattgattagcgatgaatttttgagcaaataaatcagctcaaaacacagtaaaaaatcaaattcgatactgtcggttcccttttatttatttatttttcaatttttctcacgagagtgtggtgcgcccgcgccgcaaattccccggcggtcatcgacttggcctcaagatgttgattgaaccatctgatgaagtcctgcattgctgccggcacttcctcatgtggcatcggctcgaagtctccgaccgtcatgttgaatgtgcgcaagcagcccgcccgggagtcgcgtcggcccatgacttccaagtggagttcaaagaaggtctgcaaaaagtgttgtatttccaacggaagggcatgtgtaggcagcttttcaccttgagcgtgaactgctcgacctggaaggcgggcttcagcagggctggcagcagcttggcatcatcggcgaacggcgaatagtggggggtgtcgtcgtcgtcctcctcctccgcttcagcttctgcagcggctgcttcagcttcatcattctcgccgtgcttcaggcccttttcgcgcggcttcttggcttggaagatgggcttctgcagggctcatcctgcccgagaaggcacgtgatgagtactacgagtgcttggtggcggcatcgtcagaggcgaagaacatgacaccgttcatcaccttcgtctgcttccatcagcagtgtgctcaagaaaccgtgcgcccgcccccatctctcccctccctcctcctcctcctagtcatttgtgtatgtaaatattttgtatatgttatgtaactatattgtctaactatgtaactattttatgtaatccaccattgtatgtgaactgtatcaattgtatgtatatgtaaatatttttgttcaataaaatgttgtaaaaatccgaattattatttttttgaatttttgctttccaaagtttattttaacctgctttgaccgggccccgggtaaaaaaacaaaggcttaaaggtcatggcaa

SEQ ID NO: 2544 - DNA, 4796 bp, Heterodera glycines
cggtgctggtctgtgcggaagtgatttgtgagcggtgctctgcgcacggggtggagctggagcgggagccgttgcgccgagcaccgcgctgtcagtgcggcgtgccgtggcggggcgccaaccgtcgacgccggtgctcacgcatcggtgaacagctcgttcgacgacagcggcgtcgacattggagcggatgagctcggtgtcgtcggacaacaacaactgccgttggacgggctgaacccgcgtcggctgcgcttcttctgcgacggggagccaggcaccgggcggggcgcgatggagcaatttgtcgactttctgctccacaccggcccaaaaggtgtgcgcaccgtgatgcttgcacataacggagtaagctttgatgcctttacaaatgcgttcataatttattgttatgctgcttttctctgtccgcttagggccgttacgacatccatctgttgctggaggagttgcagcgtcggggtgagcggccgcgaaaggcggttcagcatgggttgcgcgtgtacatgttggagttgcgcggcacgcaccagcgggagctgatctgcaaggactcgctgaactacttccactgtgcgctggccaccctgccgcgcacgtttgggctgcgcggggtgccggacaaaccgttcttcccctaccatcacatccacgcgcgcaacctggatgttgagctgccggccggcacgctgccaccacctgctgcctacgacccggatggtgcacacgccggagggcggattcctgcgcggacgccgagcatcggtggagtctcggcgcttcttcacgctgctggccgccgtacggcccgacctgggcccgcttcgcactgcccgctggtccatcggcgaagctgttgtgggggacagcgggcgctcctaccaccgccgccgccgcgacaacaacagcaccaacagctgtgccggcgccgacgatgacgtattccggctcgactgcgtgggctaccgtcatccaccactgcgaccgttgtgcatcgagttcaacggctgctacatgcacggtgggacacctacacacacacacacacttacaataatgttttaatttctgagctcaattaaggttgtcgggagtgctaccccgacacatgctgttggcggggggacgcagcgcggagttgctgtgggcgcgcacccagcaacgggcctgggagctcgccgagctgcacgggatggaggtgctgtcggtgtgggagtgccagttccggcgcactctgcgcaccaacatccgcctccgaaagctgtacaaggagaggtgcgtggatgtgccgggcccgctcgacttgcgcaagcatgctctgttcggcggccgtgttgagcccttttggctgttgcacaaatgcgctcccgacgaagagattgtgtacattgacattgtatgtttttttgaatgacattattttcatctgaattttatcaaaatgtttgtctctccaaggtgtctctgtacccgtactgcatgaaggcgcgccccttccccatcggcacaccgcacgtgtggaccggagagcagctgtggcaggcgggcgcccatgcgtttgaaggtatttgtagctgctgctgctgctttggtccatattggaaaacagcattttcagcttctgctccacctccagcagggctttgtcctcctcctgctctgccatggcgccgcccggaggacaacccgttccgcggcttcctcttctgccgcgtgctgccgccaacagcggaggagctgggcgatcgcgagccgctgctgccctaccgcacccaggcggatggacgtctcatcttcggcctgtgcgcgcgttgcgccgagctgcgccagcaacgaatctgtcatcacacggagcgtgagcgtgcgtggaccgctgcctacacgcacgtggagctaaatcgcgcgctgtccatcggctaccgtgtgctgagcgtccatgaggtgtggcactacgagcgctgggcgtcaccggacaacggcaacgggctgttcaccgaatacgtgaacaccttcctgcggctgaaggcggaggcgagcggctggccggccggctgtgacaccgaagcggcacgcgcggagcacatccgccaatttgcggagcaggagggcatccatctccggcccgacaacattgggcacaacccaggtctgcgtcagttggccaaggatttgctgaactccctgtggggcaaaatggcggagcgtccggagcgcgacgaggtggtgtacaccaacagcgcacgcgacttccacgagctgctcatgcgtccggagcaggaggtggtcagcttcacccacctcaacgaccagctggaccgctgtgtggtgcgcaagcgggagccgttcgcacgggcgccggagcacaacaacttggccgtcgcatgttttgtgacgtcccatgcccggctgtacctgtacgactggttggaggaggtccgacgggtgggcggtcgatctctgtactgcgacacggacagtgtgctgtacgtgaagcagcgtggcgctgaaggtgtgcgcgagggcaacgcgttgggtgacatgaagcgggagctgcccggccgtcgcatcatcgacttcttcgccgccggcccaaagaactatgggttccaacacgtggacgcgtgcacgggcggcgacctgaaggcggagcgcaaggtgcgctcttttgagctcaactatgcggcggaccagcagctgcagtatgagcgcatgcggcagctggtcatcaaccactttggcgtcgggtaaataatatgacaccactcccctgttgggtcgaggggggggggggggcactgaggcactctgaacacacacacacacacacattttttgatgattttcaggcagcaccatcaacaacaacaacaaaggggtcccgcggctgatgctgctgacggaagcgatggccaggaggagcgcaccatctctgtgccatgccagcggtttgtgcgcaaccgccaggcggacatcttcacgcgtcgctccacccgcgtgtaccggcccgtgtacacaaaggggcgcgtgcttcggcggggtgcagcagagtgtgttggtgagtcacaaaagaaaacagaataaccaaaagggagaatagcaactagattaccacacacacacacacacacacacacacacacacacacacacacacacacacacacacacacacacacacacacacacacacacacacacacacacacacagcaacaacaatttcaatttttcagatgaagtgccgccgcaatccatacgcactcgcccatttggatggagctgttgtgccggtgacgtggaatcacccgacagctcagtgatgaacgaggaggaagaggaggaagagcccatgcaaatggctcccgatgaagctgaccagggggaggaagaccgatggggggagcatgtttggccggaagaaattgctgatgataatgatgagccagggcctgaacggaagcgtgcaagggtggaacagtgcgtggcaccgccgccgccctccccaccaccgtcgccgcttcgcgagccgcatgcggagccggagccggtggccggctgctccacatgggatcagatcacacggcacacaaaacatatttgtagaaataatttttaattttccgccatttaaaatatgcacaataaaatttaaaaaatattattttctttgatggttttgacataatgctcgaactgacgcaactgcttgctccagttcttccggttgtcgcacaccagtcacaataacagtgccggtgatgaagaagagacatgttgccaatgtgttttcccctatttttttttgtttgttcttttgctcgtttttcttcgcccccccccaccatttgaacgcctgcgtatcaccagtgtacagcgaaggccggggaaagtgcacaagtcgaggcacacccgtttcacatctgaactgctaaagtgttgcgtttcgcaccctcccctccctcgacccgtctctcaccgttttggccaagagatggcaagtgttgtgccatctgttcaatgttcagtcggtagggcaagtgcagggtagtgaccagattgcgcaactccaccgcgttgacgctcagtgagagcgccagtgcgggaaatccgccccatttgagtgccgcaccaactcgtcggcaaacccttttggtttgcttgacacattgtgcgtggatttggttgggcgggacacccccaatgccggtcagcaccacacgaccactgcgaaagatgagtgcagtggtggtggtggtggtcgcggtggcggcgctactttgctgcctaggtccgctacgcatgcgcatcacaatggcgtggaagcggtggggtgcgtactcggtgcacaccccgttgcgtgccaaagccaaaaactgtgcaagggaaaagcactgctgttgctgctgcgacggtgagcgattgtttccgtttaagggccacacagcaaacgtagccgtgctgtttatgatcgctaattgctctggcatttcacaataatgcgtttatcttctcaataaaagaagtaaataacgggcttttaaaaaatgtgattgattgattgattgctttcattgtgcccgttcttagtttgtgaggcggacacacgcagtcgatgatgcggtggtggtagtggtagtggtggtggaggtggtgctggcagcgtcctccggtgcagtcaccgcgacgtgcacctggatgcactcaagcgggtagtaagaagcatgcattccacctccaaattccaccagagtgggaagactcggatggcgaagccg

SEQ ID NO: 2545 - DNA, 5382 bp, Heterodera glycines
cacagctacagcaatttcatttgttcagatgaagtgccgccgcaatccatacgcactcgcccatttggatggagctgttgtgccggtgacgtgggatcacccgacagctcagtgatgaacgaggaggaagaggaggaagagcccatgcaaatggctcccgatgaagctgaccagggggaggaagaccgatggggggagcatgtttggccggaagaaattgctgatgataatgatgagccagggcctgaacggaagcgtgcaagggtggaacagtgcgtggcaccgccgccgccctccccaccaccgtcgccgcttcgcgagccgcatgcggagccggagccggtggccggctgctccacatgggatcagaccacacggcacacaaaacatatttgtagaaataatttttaattttccgccatttaaaatattcacaataaaatttaaaaaaatattattttctttgatggtcttgacataatgctcgaactgacgcaactgcttgctccagttcttccggttgtcgcacaccagtcacaataacagtgccggtgatgaagaagagacatgttgccaatgtgttttcccctattttttttttgttcttttgctcgtttttcttcgcccccccccaccatttgaacgcctgcgtatcaccagtgtacagcgaaggccggggaaagtgcacaagtcgaggcacacccgtttcacatctgaactgctaaagtgttgcgtttcgcaccctcccctccctcgacccgtctctcaccgttttggccaagagatgacaagtgttgtgccatctgttcaatgttcagtcggtagggcaagtgcagggtagtgaccagattgcacaactccaccgcgttgacgctcagtgagagcgccagtgcaggaaatccgccccatttgagtgccgcaccaactcgtcggcaaacccttttggcttgcttggcacattgggcgtggatttggttgggcgggacacccccaatgccggtcagcaccacacgaccactgcgaaagatgagtgcagtggtggtggtggtggtggtcgcggtggcggcgctactttgctgcctaggcccgctacgcatgcgcatcacaatggcgtggaagcggtggggtgcgtactcggtgcacaccccgttgcgtgccaaagccaaaaactgtgcaagggaaaagcactgctgttgctgctgcgacggtgagcgattgtttccgtttaagggccacacagcaaacgtagccgtgctgtttatgatcgctaattgctctggcatttcacaataatgcgtttatcttctcaataaaagaagtaaataacgggcttttaaaaaatgtgattgattgattgattgctttcattgtgcccgttcttagtttgtgaggcggacacacgcagtcgatgatgcggtggtggtggtggtagtggtggtggaggtggtgctggcagcgtcctccggtgcagtcaccgcgacgtgcacctggatgcactcaagcgggtagtaagaagcatgcattccacctccaaattccaccagagtgggaagactcggatggcgaagccgaacgccatgtttggcgaaaaaatactgacgcacctgaagccgaagatggacggacatcattataatttaattatccattgtttcttggtcaaatgggtggctgactcaccgttaggttcagataaccaccgcaggcaaaggtcagactggcgctccgtgcactaaaattgtgcgcgtgcagtgtgatgttgcgctcggtggggcgcaaatggacagtgcgcagaaggcagcgcttctgcagatgggtgagcatgcgaccacgtgcgcccttggacaggaacaaggcctgcagctctcccacgctgcatccatggttcagcgcacacaggtagtcaatgagtggcattttgagcacctccaaagcatttcgtggtagctgatgcgggtggtgacagtgaccacatttgtccgattccgcacatccgctgactgattccatttcatcatcatcatcatcatcatcatcgtcattgtcattgtcatcatcatcgtcgtcgtcttcgtagtcaaatgatgagtccatgccttgccttcgatgcgttgttgaaatgtcctcatcttcctcactctcctcctcctcattctcctgttcatcaatgaacaaaaggggcccttttgcacaatttgaatgatgtgcatccatgccgttcctgtccgcctcctgtttgacctgttgtccagcctcatcatcatcatcatcatcatcatcaccattgtcctcggcggacagctccactttcggtgcgatgatttccgctgtacgcccctgaatcttcttgataaaaaattaaataaccgacaccaatttagagcaaacctgttgttgtttctgctgctgctgctgctgctgctgcgtcggttcaatctcactgaatagaggcggcggcgctgccgccactgtttgttcatcagtcataaaatcaattttcgtgtcagtgatggcgggagtgtcatttggcgctgccgacatcttttggtcaacagcactcgctgcctcggcagcagcctcagctgctgctgacacatgagcttgctcttcaaccaacaacggcattgtgcgaggagacgcaacctcgcgctgttggcgttgttgacattgatcgtgtgcagcagagtcggcggcggcgtcgtcggtgtctttgacagcgttatgaacgttgaaccggaacatgtccattgaatgattattcaaaaattcggaagctaaaaactttatatatgtcaatatgcgaaatgtgcgggaggggggagggggaaggataagttgctttttaatatatatatatatatatatatatatataatgagtaaaatgtctttttagtttatattttgggacaagagctaaacggcataatgaagcagcagcagcagcagacaaaagagcaacctctccgccatcaacaagtgccccctgttttcaagcatccgttcacaatgtgtgtgtccgggtgtacgggcagtggcaaaacgaaatgggtattgcgaatgttggccaacctggacaccctggtcggccccgcacacatttcgggtgtgctctactgttatggggaagtgaatgaagacgtgcttcgattacagcaattggaaactgagtcgggggatgaggaggagaacatggggggtcaaccgcggcgacgctgggtccgcccctgccacgcgcttcccgatgaggaggcggtgaagcgggcagccaaagcgtgcggtggcagactgctactggtgttggatgacctgatggtcggcatgcgtgccccgttccttgacctgctgttcacccgtggctcgcacaattggggcgtcagcgttgtgttgatcacacagcatctgttcacgcgagagctgcgcatcgcgcgcaacaacgcgcactatttggtgttgctgaggaacccggcaggggcgctacaggttcgcacactgggcatacagctgttcccgggcccgggtgcactgcaccattttctggaggcctatgatgacgcaacagcggacccgtttggctatctgttgatagacatgcaccccaccacacggcctctgatgcgtctcaaaacgcatatataccccgggcagctgaccgtggtgtacgcaccacgtgtatcagcagcaacggtagcaacgacaagcatgttcaatgcggaagaacactaggggcgttaggcgccgcaacaacagcagcagcagcagcaaaacgaatcgattacaaaaacaacaacaacaacaaccaccacaaaaacacaaagggccaaggccgagcaaatacatttcgcgcaatcttgccttcttcaaactgttgagcaagtgtcgatcggcacgcgggcgggcctatcgaaagctggtcagaagtgcgactggtgagcaactgctgtgtctggtggaaagtgcattgaacatcctacgctcccgggtgccgcttcgtggaaagcatttggacggactgcgtgcccaggcccagcacgtgcgtgcgctcgtccgaacccggagtggacacggggcgcgccgagtgctgttaagacaacaaacgggcaggggtgtgccagcgttggctggcctcctggccagcgtcgttctgcccctagtggttgataagctgatcaaaaaccagcagaagcagcagcagtagcaatacatcaacctcgacaagaaggacaacaacaacaacaacaacaacaacaacaacagcactcattgacagaatgaagcacacaacccgaatgttgttggtgccggaagagatgtaccgctccctgttgtcaaaggcgccaggtgctgctgctaccgatgctttggatattacacccaccaccaccacaacaccgattgaacacgttgccaaacgcatggcgcgcgtggcgcgcactgcacagcagacagcaacgcgtgcattgatgaacgacgatgaacgcctgatccactaccagcaggagtacaaacggttcaaaaagctgttggcagatgagcaggaacgaccggcacctgtccgcctcaatcagctgccgaatgatccggcctcaaaaggggtgttgcgtgatgcgctgacggaggccgccaaaacattgcaacaacaactaccgcagcaactgcaacattcacctccctccttgacaaagcgtcgcaggcgtacaacagcggtggtccctgcccgggctggtgttcattcgacgccgccagtatccccacagccccctgcagcagccgcagcacctcaacatccagagcggcggcaagacaaagacaaatccggcattactggacaaaaagggaaaaggaaacgaaccaccaccgcctcatcgtatacgtcagccgcttctggagcagaaaaagaagaagaacaacaacaacagccagcagctgcatctacatcatcatcaacaggcgccgtcgttgttgccggagctcagcgcctgggtgaggcggagcagcgacgaaaacagcaggcccttgactacacgtcacgtcacgcgggcacgctgggcatcggtgatggtcagcaggtgtacaagttcatgcatggtgcataccgcccgatcaaaaacagcagtttgcaagccgtactcgcctatcattttacatctgcccaacaaccacaacaacaacaccatcggctcaagcccccgcccggctaccaaacgttcatcgctaacgctaaacagcatccacagctgtcacacctgctattccccacctccagcactagcagcatcagcggtgaaggacatggtggtggtggtggtggtggtggacgtgggggcatattgaccaaacgcgaaagcagtaatgccgctgatgttgctattaccgttacaag

SEQ ID NO: 2546 - DNA, 4013 bp, Heterodera glycines
  misc_feature (2035)..(2035): n is a, c, g, or t
gcaatggttctcataagcgtattttgcgctcagctgctcgattgccctgtcaaattgttgcgagaacggctccaccacccccgagggacgcgcactcgtgctgaaacacctaattgggcgcaaagtccgcccccctctacaacgaccgtaacgggctcaccaaaacattcttcattgctgggatttcggcacggggcgcagcatttcttcccgcttatggccacttgcgcaacccgttcaacatcaatgtggctgctcatttttacgcccgccaccgcataaagctgcactttccttatgtgccgtgcattgttgaacgcttttcggggggaggggaggacaggcactacccaatggagctgcttgagctgattgatgacaacatggacattgacaacaattggttgggtaatctttcaccgaaattgacgacaatgacaaatcaagcacatcatcgcaccacacatcactgcacctaatactggaggacgatgacatggacattgggcgtaatgagtgcagtcaagatgctgcaccatcatcctgctggtgaaactgtgtgcctactaattatgcaattttctacccaaaatgttcatttccatttttaatgcattttccattgctcattttcttaaacaaattgcatcttcgcgtgcttaattatgcatttttctacataaaattcacttcttctaatgcttaattattttaaaactttatcttcaattctttaattatacactaatttttttattaaaaacgtataaatggcataaaatgtacacaattagatgtacaaatgaaataaatagtcatgtgtatgtgtgtgtgtgagagagagagaatgtacaataaattacggtgtgtgtccaaaattcagcacattgaatgctgcccctattatgccctttcccacaaacggacgatagcacttttgcataggcatggaaacgactcggcctccctccctgatgttcgggcgaaggaaatttgggtacgtgacgattatcggctcatagtcgcccgtcgttgcgaagcggaccacctcttctttgaatgagtcgtaccgcatcccctgattgttgagcacatcatagttcagggttagcccacgcactttgagcacatagtccatttgggctcccgcctccgcgcccttcttccgaagacataggccatactaaagcgcgttaaaattctcaaaagtaaacaaaaaagtaatgctaagattcacctgttttgccccaccactgcaaaattccacaatgtcgtggtcggggtactcgtccgtgaattggcccaggtgggggccagttttcagtgggcactgctcctccgggtggaccagaatgaggctgtcagtgtctaaaataattttatttcttcggtttttgtgcactgtttgctttacccgtgtacaacagctcggatcccggcgatctgaccaccttctgcatggctttgagcagcacgaggcgcgcagcagatgttgtccacagagaaatgactgaaacaaaaaattagtaggaattttgtgtgtgtgtgtgcctcaccaatatttgagcaggcatgctcatccacccagtcctttttgtggagataggtgatgagtatgtgctcctcatccaattggtcgattgatgtcacctcaattgatttgttgtccaaatattctgccaaaatcgctgggtcatccgtgatcagtgtctgacacagtccgaagttgcgaagcgaaaagcgcccccctatttttttggatcaaaataattctgaaaaatgacacttacataaattgttcaagcaaagcttggccagcgaccgcttccctttgttcagcaccatttttgtcgggtcgattgtgatgccgaactgctctgcgcactcccgcacgaactgctcctctttgtcggcgttccctctgatgttgttgtcgaagccgctggcctggatcttctgagccatgaattcctcaatgtacgggcggaacagtttgtcgtcgctctgctcgtactccagcacgcggaataccctncgtgacgatgtagccctcgtccagcgccgtgttgagctcaatcgaagtgcacgtgctcacccatcctcgttgtctgtcattgtgctcacagtggtagttgggattcacaccaccagtcggattctctttggcacaagtgctgcagagcgggaaacaaagccgctctccaactttcaccggcagaacgggcacgtcgacgcgacggggtggcacaacccacactttgagcagtgccaatgggtaggggttgtctgctgcgttgcgccaatccacttgccggttcaacacatgcacttttggatggccaatggggtagcgagtgacgaaactaaatttcaaaattttattatttaaaaacgacgagcaccacacatacttaatatacgggtacaaggacgtgaagtcgtagtaggagatcttctctcctggtcccgctttgcgcagcagtttcagcggtcccgtccgccctcccatgaacgcgtcccggatcaccaacggcccatcatccacataatcagcaaacgacttgcgcatttctctgctccgctccagcatccgatggatatcgcattcccagtgtacgtccacgcggttcacttgccgccgcagaaattccagacgtttggcgtcgcgctcgcgcacctcccccgctgttttcccactggggagcaacatgttgtcgttgggatagcactttttgcacccgtgccaagtgcagcctaaaattatattcataaaaataaaaataaaaaataaatttgtgtaccgttaacttcaatggcgcacccttccgcctcaatccacccatccagcgaatactgtcctattcgcttctctcctccggctgagtgggcagtttgcacctccgctccgtgctcctccgcgtaccagtggaagaacctgaacgcgagcaggctctggttctgcgcgttgtcatagccgcgctcagggacgatggccagatgctcagcgggcaggtggttggtgcggaagtgacgcatgcatgcacccgcgatggtcatgcattcgcgcagaacgtcgattccgttgtggttctccctatcgtctattccgtccacgtattcttgccgccgggaaatgtcgaagaattcacggcgaaacgcgacgagagcggccatcaagatttccacatcattggtgcaatagctgagagagccaaaatgagtgggctttggcaacatttttagaaacaccaccttgctaatgcctcatccagcttgaacgggtgatgacggttctcggcgtaccacgcatcgaattgccgccttttgctgggcatcataccgctggccatgtagtcgtcgggcgttgggtggatttccctgccgtagttttccggtcggttcgacaggtgggggaagaacggcttgtcctcaacctccagcccatatgaagggacgagcgctgtcagtgagcaaggcattaggttgaaggagtcccggaagacgacgtttgggttgcgcctcttctgcttacgcactttcatctcatacattttgttgccctaaagatttgaaattttatcaccataaaaaatgttttgcttttactcgtctcagcatctctgggttaaagccaattctgaagagctcgcgaaagacgagcaccatgtcgaaccgtccgccaaagtgtgagtaggcgtatgtgtcgtagctcatcggcagttcgaagacgagccaatgcacaaatgccaccaatggattgtcgtcggccaccaccacctgatggtccacgtgcgtgtccacaaagcggcgttgacaaaaggcaacagttcgatgcggcccacaaattcgacagcctgctgttgtcctgctgcgccagctgccgttgtcaatgcactcagggcaagcaacttgggcagcgatgaagttgggctggtgctctcttctttcgggctgctgcgggctcaccggatggtgcggcatggtttccaaatcgaaggcacaatgcggtacgg

SEQ ID NO: 2547 - DNA, 2463 bp, Heterodera glycines
  misc_feature (2451)..(2451): n is a, c, g, or t
ttttgttgcaacccgcgcaattgtggaaaaatacatccatggggctgcagggaaatgttggtccgactcgtgaacacagcatacagcgcgctttgcaggtgttaaggtgcgttgatggtcgctgatacggcttttcacattgaaggcaataaggacgaccaaataagccatgcaacttttgcactccatcaaagtgttggttgttgaagtagagcacaatgggagtgtcgtaatgatcgttgacgtatttgaagagtggcttgtactgtcccgaagcgccgaagatgaacaccgcaaagcgatgctgctgctgactgttgttccagtggtcaatcacacgcggcacacaaatttcggcatcgtatgcattcagcccgatccgtacacgaatttgctgcatcagttgtaaagcatcccgcctcagacatccctgctgtcccctccgactgtgcaagtaatcgtagaatttccaacgaggccaaccgcgcgttttggccaccatcgttgcctgcaacgcgtagaacaggcaatgcccgtccgggttgcaaatcttaaaacaaattgtcaatcgaattgtttgggtttggtggcgcgacctgaccttaatcaaacaattttccgtcactcggtgatgcactggtgctaggcttcgccgagcaccgcccttcagggttctccgagcgggaagattggagcgatcgactgtcgtcactacaacagtgaagggctctccccaaagcgtgacgttttgctgctgtttgctctgcgccactttggtgaactgattcagtatggtgtctacggtgttatcggtgatctgtcgtatggggatggggatgtccccgccagtcagcaacggactgctgatgagacagccgaggtgagttggctccatgccccgttcccggctctcccccaaagccgcatcaatgcagtactggaagatgccagcaagaagcccctcgggattggctgctggcacatcgacaatgctgaactgtgacttcactttgctgtactggaagcggggcacatgctcaacactgctgcccagctttttgacgtagtccggtgccgattttgaagaagcagaggatgcggtgcctgcaccctcttgaacatctcccaataattgattaatgaggaagccgccgcgccgcggctttttgctcggaacagaaagaatgtgggcaattgaaaagtcagagggatgcttgggagactgattttgcattttatctaggagacaaataatgcgtgaaaatggggcaatttacagcactaggcgtttgggcatggaaatggcaattgaaattagcatatattaaatttttgcgaattaaaatcaatcttggcctgatgagctgcgcactgccacccatgaagcacaagacgacagtgcacctaaacggctcgggcaattagaacagaaatttgaacaaccccaagccctaaaagacacaaaaaatgctgccaggataaacggtgcccaatagtttgagcaaccgccctggttaacagcctaacaaaaataaataataataaaaattttaattattactattttttattaaagtgaatttgagcgagaatggaaatgaatgtaatggaaaatgggatgagcttttattgagtgccaaaaatttgttcgtgtcttcggccactaattaatttctcggctcatttccggcaaattcaaatttccattgtgaccaccaccaaaataacatgctgaattattaatgcgtgttcatcgcggcgacgcgaccggcgaaaatcatgcactcattcgttcatttgtgcctaaaaatggggaagcgcttacccgccgagcttctctcccaaattatcgactcattgccaattatgtatttatttggcggggtaacacccaaaccaggtagaacatgtgtttttaaaattattgtttcacatttccttcacaatttaaaggccggccactctccggcattggtgtgcttaacgcaaccgttgaggtttttcgggccaaacgtcaccaaaaatttgcaataattgtaatgcaattttctgttttttcattttaaattttacacatttagaaggaattggcttcaaaatttgatgtgttcagtttaaaagggtggatgtcagacggacagctctacctacatttccgttacaacaacaatgagctgtgtgagccggcctttttcaatgagttcgctcaatatatttgcttcggcaaatctgggcgcatttgttgcacccgcattttggtcgactcgcccaattcgcgcgtaaaatttttgaactattttttctttttcaattttgtgataaaaaaaattaaggaaaatggtgcactatgtgatgtggtgctaaactgcttaacaaaaagcgcgaatcctttcacaatgaaaaagtgcacgtccgtcgatctggtgcaccgcgacaactttccggcaattntgaaggcagcgc

SEQ ID NO: 2548 - DNA, 4459 bp, Heterodera glycines
aaaaatgctgccaggataaacggtgcccaatagttccattaaccgccctggttaacagcctaacaaaaataaataatacttaaaattttaattattactattttttattaaagtgaatttgagcgagaatggaaatgaatgtaatggaaaatggagtatgagcattttattgagtgccaaaaatttgttcgtgtcttcgggcactaattaatttctcggctcatttccggcatattcaaatttccattgtgaccaccaccaaaataacatgctgaattattaatgcgtgttcatcgcggcgacgcgaccggcgaaaatcatgcactcattcgttcatttgtgcctaaatatggggaagcgcttacccgccgagcttctctcccaaattatcgactcattgccaattatgtatttatttggcggggtaacacccaaaccaggtagaacatgtgtttttaaaattattgtttcacatttccttcacaatttaaaggccggccactctccggcattggtgtgcttaacgcaaccgttgaggtttttcgggccaaacgccaccaaaaatttgcaataattgtaatgcaattttctgttttttcattttaaattttacacatttagaaggaattggcttcaaaatttgatgtgatcagttcaaaagggtggatgtcagacgcacactctacctacatttccgttacaacaacaatgagctgtgtgagccggcctttttcaatgagttcgcccgatatatttgcttcggcaaatctgggcgcatttgttgcacccgcattttggtcgactcgcccaattcgcgcgtaaaatttttgaactattttttctttttcaattttgtgataaaaaaattaaggaaaatggtgcactatgtgatgtggtgctaaactgcttaacaaaaagcgcgaatcctttcacaatgaaaaagtgcacgtccgtcgatctggtgcaccgcgacaactttccggcaattttgaaggcagcgccgagcgtaatggctgaaagtgggattgtgtcaacggagcctttgtccgctaatgatgatgatgaagcatatattttgaagaatccgcattttggtgacgatgaaattgcctacttagacatttacgcccgatcatcgggcttttattttttctttttttcaactatttaatttaaaattttgtgtagtacaaccgtgacatataaatcgggatttgcacttgaataaaatcgattgagaaattgatggaatgtgtcgcctaaggataagtggtaaataaaaacaatgcaatgggcggcacaagtggagacaaggggggactggtatggacgcgaattcttcattacgccccctgggaaatagcgtaaaaatgatgacgtaatggtgggcggaatgggctgggcaaggctgtcatagtagagcgctggcgcttccactccctttgcgtaaatggcgcaccaatgagagccctccttgtggcgggggtccctgttcacaacgagcgcagcgggatactgtatcgtggaggggggcggcaactggtcactggcgaagcagccccgaaacactcgccctgtccgctgattttcgctcaatatctttgtgatttggaaactgtccattctttagcataaaaactgagcaaatttgatgtagcacaagactgatgatgagcattaaataaagagcgaacagtgcccagcaaattgcttgccgtgacagattgctgctctcttccggcctatctttgcacaattgaatgagcggtggcagcagcgcggacacttgttcatcgattaacttgtcgtttttcagaggggtgcttatgtgcggcggggtaattgttgttgttgttgttaatgctctggtcgttagtggtattgttttggttgaaaaataaattttagacaaagacagtcttctcaaatattcactgtaggaatatgccggctcattgtgttgccgagacaatgtcaaatttcttatataagcagaataggtgttctctagcggtggcttttgcggttggtctcgataagtggaaacaactggaagcgaaactcggagaaagaacaaaatgatgcccaatttttttgaaaacattttaattgcaaaatgatgaaatgacaatgtgctgagcttaaatagtggtgtccgtgcttatcgatcgatttttgtccagcatcaccagtgaatcacactcacccatcactaccaacattacacctccgtctggcactgggtggttaaatttgatgctcaccgctgtagtgccattctttatcagatcaaacagtgccgcttgatcatccccgctgttggtcaaattgaacacgtaaatgcaatgcgtttttccgtattgggcaaaagttattccgttgctctccgatgagtttgcgaatcccaccgcttcgttcatgtcattgaatgggcgaacataccttccgctggggtagtccaagtcatagggcgcttgtgggtacgagcgaccattagcaacaatggaaatttcgcgaacattaaatggctgaaaattgaatggactgcgccgaattgagccgacataatcagcattcgccaccaggcccattgtcacacgccgggggatttggtccatgaacaaattggctgtaaactcgtaacggcctggactgatgaacagtgatttcatcattgttttcctcacagcgtagcgggcaggcttcacctccaactttcgcgcaatgtccagcgccaacccatccatcagagacaccttcttcacatacaatttcagtcccacaacctcgaaacggtagcggggtgcgcccgcgagcggcgcaattagcacaaatttgttgtcgttgggcaaaatttcaatgtccagctcacaaaagttgatcagatacagtggctgattgaacaggtcggtgtcaattttggcaatgaactgagcaacgttgctgagcgcaaacaaatcgcgtcgcgctgtgcatccgtctcccgtctcaagcacatcacccgggtcccggtagtagcccgctgcattcaggtgtgagtcctttgccgttgttgaataggagagctcatgtgaaaaatatgttttgtaagccatcagagcattggcattaaatatttcgcgcccgttgatgctcattttaatgttgcggatgaaagtttgaccgatcatttgaattggcgcaatgtttatatcatcagcggttaggtcaacaagttgtccattaacgttttccttacggattcgaaactctgtgagcaaatagcatttggagaggtcaatgaaattttggcttgagtgaagtttgaagtggtagggcgtgtcggtcagagggttgctgggcagaagctcaaacacttttgaagacgagacgctcacatttgtagggggtatacggaaaaagtccaaagcattggtaattgagttcacggagtcagtgtcgattttgtgaaatgccattatttagtaaagtccaaatgcgtctgagcgaactcgttttcttgctgtctttgcaactggtcgtccaattattgtttgatgaccaggcacacgtgctctctttctttttatacccgttcgtccgcttccaaactgtttgggcaggccgcctttctccagcacagtgtcaattccgcgctttccctcactgaccaacgcctccttgagcggcaccccctcatgcccgactcgctccagcacgcgttgtccagtgctcagcgcctccgaccctaccgtagttccaacacgacgcagaattggcaggaaaaagcgccaaagcccccgaaacacgtctccaacgcctgcccctcgctgaacaccgtagcccctctgaaaagggctggtgccccggaagtagtcgaattcctccttctctaagccgctaccgtactgcacgtactcgtcatactgcgcaatgcttggatcaaacacaatatgaaccatttattagtgtcaaataaaaacaaaatgaatgatgaaatcagaagtttatcactttcttaaatatcagtacgaccatcgttgtcccataggcgaacggcacgagacggcctttgtccattgtgcgcagttcaatctcaatctcattgatctcccgtggtaacacacgggcaaatattggcgagtcgtaaatcttctcgttgtactcccaagggatggcaccgctgatagacacaacgcggagcaaggagctcagtgaattgccaatgatcatgttttcggtcaaccctttcgagtagacagcaaagcttgagatgcctccgcgcaaatccacaggatattttgacagttcatttgacacgacatgttgagggttttcaaagccaagcacatagcccaactgtggtgagaaggacacatgactgacgatcgcctcatagaacaccagcttgaatcgttccatgttctcaagatattggaagagacggaattgggcacatatgagagagggtctatttgaa

SEQ ID NO: 2549 - DNA, 8519 bp, Heterodera glycines
ttattatttcttttaaatagaatttaaatgattaaaccattcatgttaaattctggccacaacgaaatgataaaatgacaaaaattatcatttttaatttacaacactgtgtacatttttaatttttaacttttttaaatttttttaaatttactaagacatgtttatatttccaaaaatataaattcactaataataattgttgataaaataataattttcgctaccatacgtcatcggctggctcctaagatacgattgcagacagaaaacttattaagacaagaaatatactcaaaattcagaaataaaaaattattaataaaaaaacagggctggaacgcggacagaaagaaggcgtgagtagttactagcccccttttccgttgttggaaaaccaccgttccaaaccaaagcctattggttaaccaaaacctattgaatgggtgtaggagtgaacctaaacctattggatgggtgcgggggtgaacctaaacctattgaagggttttgattaataaaaaataaattaaattaaaaataaattaaataataaattataaataaattaaataaataaattaaaaaaaaaaaaaatttttataatttaaaaaataattgaataaaaaaagctaagattcattctctctctctctcactatctttcttttctttctctctctcactctctctcttatctctctctctctcacactctctctcttttttctttctatctctctcattctctctctctctcactatctttcttttctttctctctctcactctctcttatctctctctctcactctctctcttttttctttctctctcttatctctctcttttctctctctctctcactctctctcttttttctttctctctcttatctctctcttttctctctctctctcactctctctcttttttctttctctctctctcattctctcttctctctctctctcactctctttcttttctttctctctctcactctctcttatctctctctcactctctctcttttttctctctctctctctctctctcactctctctcttttttctttctctctcattctctctcactctctctctcttttctcttgctctctctaataccacacaaaaatataaataataataataataaataaattaaaaaattaaatttaattaaaattaaattgttaaaataataatagttaaaaaattaataaataaatttaaaataatagataaaaatttaaaaataaatgaaaaaaatttaagaaattgataaattataaaaaataataataataataaacacaaattataatagtcaaataaaaaaaaaagctgagagggcgctacctattgagtcctaccgtttcagtccttgactagtcaatccggggtcaaaattttgaatttggcgccaaaactttaatttttcgttatttttgaatttgagaaattggtttagttttggcggatgcctattggaatgtttttatagggcttcgctaatgtttaaaaggggaggggtgggcgtcagcttcgggagggaagcgacgccgggtcatttgagagcacgcaggggccatttgagcgctcgcacttgtcatctatgcgcccgcaggtggtcatttaaatgtccctttactgtcaccaatactccatcctaatggaggggtagaggccgtcccttatgacatctctccccaaatgaccatttcgttctcaccatctgtcgcgaaagcgaagggttaaatatgtctctttggcaacctgccaaataaccattttagctttagccccgcccactttaactagtataaatagccgcccatttccagccaaaagtcaacttctcccattcattcgcgaaaattctacccacattcattgcttgcgcgctccgtcaaaaaaatatttaaactaacaaatttgcaactaaattaccctttcatccaatattcaacttataaaaaaaatattttcaataatttttctattacaactataaaatttacatttttctaattcagaatattctttcatattatcttatatcatctataaatcataaatttttcattcatatattattattcaaataaaatgaagcgtttttccctctctcaaaattcttcctcctccttccccaaaaaatcccaaccaaataaatgcattcgtaaaattgataacctcacttcaaaaagtaaaaaatatcaactggtgcgctcaaaatccaaattcgtcatcgaggaaattgacaaatgtgctgaccccgctgcggagctgcgctcatgtgtgcaccattcgatcgaggaggcgatttcggatggacaaaacacactaggcgcaacaaataaggtgggggttataatttcatcggaacttttagaccagggtgacatcatcctaccaattacaccaattaccgcaaatgtcgtggacgctgttttcaaccagttttgcagtggagcagagcaaatcgaaacacgtcaacttatatggtgctccctttataataaccgtcaccgttctaaacaccaatggactaccgcgacaacggacaacaaagggaaaagggcgaccgcctgtctcctcacaatcgcacattttcaaagtcaacaacaacgacaactactgtcttttttacgcgctggaactgatgcgctactactcattatatatcaggggagtaatttcaaggaaacaatttagatggctcaaagataaccaaaccacggttttacgacaaaaggcgctacaactactccgcgaggcggggatccctacaacagagacagagtacgacgcggaagtttatatgcatcaagtgcaagggttgtggaacgtcaagtatcccggtgagtacaaaatatttatttttaatgactatcagatgcgcccaatcaccaaatccgatatcaccgactaccagtttcccattcttctctaccacaacaacaaccactttgacggaattaagacaatatcgaaatttttcaacaaaaaaaactactgtctctcctgcgagtctccgtactacaagaaaatcgagcactcattaaaatgcacttcactctgtcacgggtgccgtgaggtgggcgtcgactatccctgcgatccccagcaaggatacgtcaaaaagtgtgagcactgtaacaacaccttctacaacaataactgctatgggcgacacctccacaaggatttgtgtaccaaatttcaacgctgtgaagattgtggggtaatttataacataaaggttcatgggagtgttgggcataaatgtggggaacagttttgtaaactttgcaaacaatttcatataaaagaagacgaagatgagatgaacccctgcacgaaatgcttcatccaaccccttaaacaacaaagaattaagtcatacaggatcatcgcatacgactttgaggcgacacaggacaagaaggtggagaaccggttcgagcatgaagttaactttgcagcggctaccatcatctgcacagactgcattatcaacggcgactggaacaaatcacttcagggaaaaaagtgccaaatttgcggtcctcaccgctcaatcaccttttcaccctttgactacacggagacaacagtcgaccaaaaaatcatcactcaacaagcgctacgcgaattcgttgaatggctcctttttgaccacaacaaaaagtttccaacagtcgcgtttgcacactttggggggcgctacgacatgacgatgatcatcaaggaggttttagcgcaaggaattcacaacccggacatcatcaaacaaggaaatcgcctctacgagctgaaaatcagggaaaacgagcacggcccactcaccatttttcacgacagctacaacgtaatgcccatcaaactatctggcctcatcaaatcttttgggcttcatataaaagataaacagcactttccccatatgttcaacaaatcatcaaactacgataaggtcctccagcaccttcctccacgtgaagactattgccctaaccaaaagaagaaggcggatctgcagaaatttgacgactggtacagcaacaacctataccaaaaattcgacctcaaagaaaaattacccgaatactgctgcaatgacgtccaaatccttacccacgccctcgtcgaattacgccgggaattcaaacaactgacacaacggaacggaaagcacgggggaatcgacattctttgacaagcaatgaccatagccagcgcctgcgtcaaaaattatgcactcaaccatttgaagcccaattcactcgccatcgtccctgaaaaaggctatactccacaacagaatcaaagtgcactggccatcaaatttatcgactggtactcccacatcaataacgtcaacattcaaactgcgcactcccgttacggcgaatatgtgtttaagcgtgaaggacagatataccaagtggacggctacatcaaagggactaatgggaggcgggacaaaataatcgaggtgaatggctgtctgtggcacggttgtgaggagtgttttgacgagatggacgacgaaacgaagatgccaaacggaaagacgctgcgggagattagggaaagggaagagaagaaacatgaaatattaagccgttacgtcgacttggaggttatttgggaacacgaaataaatgagaagctgaaaaaggacacagcaatgagggagtttttcgacaactggaaggaccgctcgccaatcaaaatcagagacgcttttcatggaggacggactggaccaatgaaactactccacacagctaagccgggacaaaaaatcagctacaaggacttcaccagcctctacccgtggaccaatttctctacagactatcccctcggccaccctaaaatcatcagtgtcccaccaaatgagcagacggtcaactggcgctctccatccgacaacccctacaaaggacttctcaaagtgctgcttctacctccaaacaacaacgtcagcgtcactgttatgcccgtaaaatttgatcaacgcctcctcttccctctctgtgagaagtgcgccaaatacatcaccaacaaatacccaaatggcctcaaggacgacaactactccgcccacacttcaaccccaatgaccgcgccttcgtgtccacttgcacccatcttgagttaaacgcagcattggaggccggctacacagttcgcaaagtcttccacgtcctccaatacgaccaatggagtaacaatgtcttcaagtcttacgtgagcgaaatgatggccctgaagatccacgcaaccggcttcccgtcatggtgtgagagcgaagaggagaagagtgaatacattgaggagtgctggatgaaatttggaattcatctggagaaggagaagatgaaagctgaaccggggaagcggtacatcgccaagctctgcctcaactcactttggggccgcttctccatgaggaatctactttcgaaggcggtaatcaacaatgacccttttgttctccgccaatacaccgacgacaagaaaattgatattatggacattgagctgatggatgaggacaacgacgtattcatgctcacctacaagccgaaagaggagtttgtcgacgaaaacaaatactccaatgtcgtcatctcactctacacaacatcaatggcgcgtctatacctttacgaagtgttaaaaaaagtggccgacactcccggatgtgaaattctctactttgacacggacagcatcatctacgtgcacccagaagccaacgacccactcccgacaggaaaaggacatctcggtgagctgactgacgaaaagccggaccacaacattttggagttcatcagcgctggctgcaaaaactacgggctgaagttggaacgtaaggacaatggggaaattgagtacgacttgaaaataagagggataacgctggatgaacaaacagtgcaaacgatccattatgacagtgttaaagatcaaattttgcgttatgggtccgatgaccccgcggaccccattattgtaacttatccccattttattcgccctaatctaatccaaggcaaagtgtacactcaatctctaactaagcattatcaacctgtcttcacaaaaggtattattaatgattcattccaagtcctcgaatttggttatcgcaaatgataagtatgcattctcaattaaattttctaaatattagttttcttatggttcccttcttttctttctctctgtttatatcactcatgtgggacggaatgacccctggttgatcctctccaacactccaggccatccatctgagatgaaggtggacgagcttgttcattattgtaatgcacagcctggtgcgtgagtgtttggattggggaccgaagggtgaagccgttccctgggtgtgttttttcacttttttcaaagggaactctaagaattctgatatgccttcaaatctatcaaaagagttgcatactttctttttataatttcctttattctctattttacacttgtatttttcatttgaatgtttattcagaaataaaattgaaaaaatgtgtcattactaatattaaaaggtataaattaaaaaggtatttaacgagaaaaatagtcagggttttgtaacacaatttgtaaattattaaggaatagaagatacaatttaacaaaaattaagaaaaataatgattaaatgaaggaattactcaaaaatgtgtaaaaattacacacatggggtgtgtgtgtatgcgtatgtatgcatgtgcgtgtgtatgcgtatgtatgcatgtgcgcgtgtgtgcgtgtctatgcgtgtgcgtatgtgtgtattgtatgttttttcgagggtgaggataaagtgtgtttgaaagttctgcataatatttattaacttatataaaacttgttaattttaatcataaacacaaacaatgctccttgcctaattcaacgtaaaataattctaattataataaggaacatttacaattccattgaataagtaatattcaaaggaaacaagagaaatagacaattttgaatctaagattgaaccgagaatagaaagtaggtttgacaaacagctgactgactgtatgtgacgagaaagggtagataagggctaaatgtatgcgtgaagcaggtcttgtaataggaataaatgaagaaatcatatgaggatattgtagtgcaccatagaatcaaggacaattaataatgggtgtaagagatagagatagagaactcagaaatgtggttgaagagagtcaatattaaatagtgagaatttaatatgagttagtaaggcaaacattaggtaatgtatagggaagagaatagtttgataaagaacaagaatacgaacacttggaagataacggttcgagaataaaacatagtgttggaagaaaatatattgaaaaatagctaatggaaacgattatttagacaatatgtaggtctgaaattaataaggaataacagtgaaagtaaacagatatagaagagtagagaaagtgtattacggagaaaaggaaaataattcaaataaacccgaaaccaaaatctctaaatataggattttgttaagaaaacagttggcgttagcctctttccatttgttccttttagaggaatcgatttacaggataagatgacgcagtgacctcacccccctctccttcacttatttggtttcctcaactctacccttcctctccaacacatattcggtcattattgctccttaccatcgcaaactcagttattggctaccggagagccgagccttgtgaggtattggttactggcgggccaagcttaattaggtattggctaccggagagccgaacattacgaggtattggttactggcgggccaaacttaattaggtattggctaccggagagccgaaccttacgaggtattggttactggcgggcaaagtttaattaggtattggctaccggagagccgagtattggctaccgaaaattcatcttttattattttccttgtttttatacatttctaaaatccttgcggctgtaataattagttacttacttaaaaaaggtttatcgctacccaaaaagttgcattctttttcagatattttagaattaattgccatatttcctagccatcaataccataactaagttaatctgtcaacaattatcatactcatttagtgttcatcatttcctttgtctcagcttcaagtattctgcttcattgaattacaacaaaaatgtggcacataatttaagttccatcataacccttctttcccctagaaatattcagtttgtaaagattaaagaataattggttataattataattaatgcagatgtcataccctatcagcaattggagtattttaccatgggattcgaccataccaaaacacaaatgtaaaacatctcgatcaaaactttgttaataattttcccgcattttaatgattaattggttcttaattaaattaccc

SEQ ID NO: 2550 - DNA, 6454 bp, Heterodera glycines
  misc_feature (85)..(85): n is a, c, g, or t
agcatttgattattttttgttaccagtttcttaaaatttgttggtttacctcaatgtaaaatgagtcaagttcttcgattaagcnccgcttgagcatgtcgtcaactcggctgttcaaccgctggcttagtacttctttgtcggcgtccaaagtgaagagtaatgtgctttttgtatggagacggccagccaagtgaaaattcgcagcttaattggtttatatgcataaaaagatgtatgatttttctcgtaaaaagaaaaattacatttatttccgctttataaaaaaaaataagaattttgtttttttaaatattaattgctttggtggtatgtttccgtttgcgggcccacattcgaattaaaaagctgaagcgctgttttgaatattcacatgcgctttgttggcttttttaaactttgaatgtgtgacccccaaacggaaaagtacgatttgttcataaatgtgctatttttgtataaaattgaaagttcattcgcttgccttgtccttccctttgcattttatggtgttcgctttttgtttgcccagttgaataaaatatttccaaagctcgcagcactttaaactttgcatttttgtgtacttcccctgctgatattgggtcaactctcttgagttcctcgtgtaataagtcgcaggtgggaaatttttgtaacagctcatttcttaggtcgtctgaaatggcaacaatttgaatcatcaaaatgttattaaagacctgatttttgggcgtttgtttgtaccaaattgtcataataaattgctgcttccatataataaccagtgccaccaactaataaaaaaaactgctgtttgttcactatatgtatgatgaaaaaattcgtaattagaaagcactcataattttcttagattaagcattagaacaaaccaataattggcaatttgccattcgcccatagcctttctatcaatggcaaaacggcgttgcggtagtgatggacgttgtaattggactcacacggatcacaaaaactcatcaaatggtgagttacgccttgcatttcttccgttgtcactttgttcgtcgctatgtcaagaccttgtcgtatagcatatttagtgatttatattatattcgagacaaacctttgtaaatttgcattgaatccgcatttattacttcgccattgaaatgctttgctaattcaatgccgagatcactttttcccgtcccagtacagccacaaattataaaaagtggttgaaggcttttaatccgttcagaaaacttgctcgtaagcatatttaactagagctgacaatgagcgggaccgggtttttcaggtctcggcctcggttttgccagtcccggtcccggcgggactaaataagcactggtaatgggggtctgggtgaaaactagtgaagtttctgggggttatcgagggtgctgattacgaatctgaactttgatttccctaatttcgagccccggacccaaactcgaacaaaaaaaatgaatttttttccaaaaatacacattaaaatttttttcaccaaaatccacctttattgttcaaaatccattcaaatacactgaattaaatagaaaataggagggattcatgaatcatgaccattccatgcatttgaatcaattttggacaataaatatggattttggtgaaaatgaattttctactattgttcgaattcgtgtccggggttcgaaattgaccaaatggatgttatattcatgatcagcgaccccgaatacccctggaaacacgtttttatcattttaaaacaagaaaaaattttaatttttttatttttaatgtggtctaaactagagcccggaaatttcaaatttgcggatcctgttgcaggattggaattcaaaattttttgcaggaacggatccggtcggattaatcctgcatttaaaatttgccggatcctgcgcaggattgcggatttttggaaattttgaaaaaatttcaattaaaaataattttttattgcatttttttaaagaattggtgaattttacatggaaaattcgaaaaatgctaatattttttaaaaatattgaaaacccaaacccaaacatatttcttccgatattttttggaaaatttctcaacaaaaatcaagaaaatcaaaaaatacacccctaagaatcgacctaaaaattttcaaaaaatagacccctaagaatcgacctaaaaattttcaaaaatacactcctaagactgacctaaatttaaaataacttaaaaattggggcaattgtaaagttttgtgatttcttcgaaaaattatttaaaaatttaagaaacacattttataggctggaaaaatgtgctgatcacgaatctgagctcggattttgcaaaataattgattttatctatgatttttttttatcaaatactagattttttccaaaattttttagtcgggcgtaaaaaaaacccacaggatgttgtagagatcaaaaagagctttcgaatgagctattgaatgtatggagaagtcatgtttttagttatttacgattttttgaaatttaattactagcccttaagggtcatatgagacgggggtctggggttcgagcccgcttggctgtgtttattaaatctttaaacttatttttcgaagaaaccacaaaacttattgccaaaattggtaaatttctcaaaaattcatcctcaaatttttttcttaacaaaattatgtcactattcgtcattattttggcattttttttagcatttttactatgtttttcgaaaaaaatggtttgaaaaaaattccatttatccccgggggggggataaatggggacgggggaattaatggggacggggggataaaaagagcaaggtatatagggtttgatattacatggaaatccatattttttcctggactgttggaggcttgaaacgcatgaaaaacatgtttttagcttggtttgaagcagggctggagcgcggccgcgatccgcgatgcgcgatccgcgattcgcggcgtttttttttgcgcgatccgcggtcgcggccgcggcaatttgaatgcgcgatgcgcggtgcgcggccgcggtttttttttttgcgcggtgcgccgcgcatttttaagcactggtaagaatgggggtctggtgagaaaagagaagggaattggagaggaatgagaaattttttagaaaaaaaaatattttttttatttcatttaaagtattcctccataatcttatgtgttgtagtggctaaaccttctgaccttcagtgtttgtctcttgggttcaattcctcaacggaacagaaagttttttcatattttctttacattatttcaattgaaatttaattaataaagaaaatattccaacttttatttttctttaatttttaaacagcctaaaatcacaaattaaccttggtcattttttgacaaattatgttaactaatctcgctgaaaatatcaaaatattccggcggcgcctatcggcaccgccgccccccccccccacaatgttcccaaaaagttttttggaaccgcccacaaaaacgcgatttaaaaaattaatagattgttaatttattcaaaaaaaatccagaattttgggactcagaaaatccaagattccccccccccccccgcatgaaaatttaaaaaaaaatttctatataatggaaaaattcttcgaatgcctcccccaatgagtacatattttaatataggcaattttcgtaacaaagtgcagtcaaattttcaaattttttttcaaaaaaactttcacttgggaaaattttattgattaaattgaaatttttgaaaattttgtttttaaatgcgcggtccgcggccgcggcaatttgaatgcgcgatgcgcggtgcgcggccgcggttttttttttgcgcgatgcgcggtcgcggccgcggcaatttgaatgcgcgatgcgcggccgcggtttttttctgtgcgcgctccagccctggtttgaagcttctaggaaggagttctatatccatattttatgtacatatattttggcattttttcaaaaaacccctattagaacggcccccatcagctaaattcggaaatttatgtccatatttttgccattttatgtccatattttgcgatttgttgtccatattttatggccatatttcgcgtttttatatccatataattacaaaccctagcaatatatatatgccaacagaagagattgtattaaaatattaattaccataaattaacatgataagcactcatttgagttggacgagacaagtttggatttctcgattttttggcatgggaccgattacttttgaccaaaaatgcatgtctcgtccaacagatatattatataatcagtcaaaaatgtgttttgctcttttgatcattgaataagaggagcatcagaacgagcgcagtgccaatggaaaacaaaacgttgggttcgttcctccgttcatcagttgctgctgttggctgtgctggtgatggtttttgcccgttgttttgccattggtggtggtgcttctcctgttgctgctgtttcgtcgcgctgtccaccgaatccaaaaatgccatgccgtaaaattgggcccgctctttcaaatttgagtacagtccatccagcagcgatgcccgagtgcgttcctgaacaaacttttgattaattttcagaaaatgaaaattgccataataccgccaatttggcaaatttttccgccttataagccgcgttttccgcattgatcagtttggtgagcaaaaagtcgcgcagttggcacttccaaattatggaagagcgcggaagcgtcgggccaaagaacggcacgtcgtctcgcgctgtcatcgacacgcggtaacgcgtgcggtcagtgcccggctcaatgggatgaaccaccaaataggcgtggagaaagctttggaaaaaaagaaaataattaaattaggcactgaatgttgcccttttttgtacttgctcgcgatcatgtccggacagaagggtgtgttctgctcttggaaaacaatggccacgatgtcgttgccaatgtgccgcttgcgctgcaattgttgcgcgtcgccaatggtaaacggcaaaagggtggacacatggaacctgaagaagccggggaagagctaattgggctaatgggatgtccgaattaaaaggacaattaagtttttggttgaaatacacaataaaatggatttattggtttcctctcactctcctatttttaatactaattatttgttaattgaaactgacatgatctccttctggcgaaactgtgtgtacaccgactgaaaaaggaaattaagcaaacggtaccgtatgcccgccccactctgccccaccgtacctcggtgcccgtctgtccatgaacggtgtccagtccgccacgataaccgtcaaaatgacgcaactgaactcggtggccgatgacggagagaaattcgtcgaaggccgcgcagttggaggagtcgttgctgaacagctcctcctcggtggtctgcccaaacttttggtaaattgcacctgtgaaaggggggcaattaattgatcagtgattctattttgagtgttaaataaacggactgaccaaatttgtaagtgttgcttatcacgtgctcgtcgaattggaggatcagctcacttccccccggaaaagcgatgggatagaaacgttcggccgtcaattcttcgcataacaatttggccattcgacatgcgctgggacggtcggccaatgccgaggctgggacaacctcatggaccttacaaattaggaattgatatacacgcgcaaatgaattgaacaacgggcgggaaactcatttttggcttattagccaattggccaaggcattggccgttccctctgaaaataaaccaacgcactgtgccgtgacgagttcgcagaatgatgcggaagtgattttggcaggaaattgtctccgtgcgaacactcagcaccagcggaccaatcagcgggtcattcccataaaagttgtggtgttcctatgggaacattcatttatttatttatttgcttctcgggagtattgacactctcccaaatatttaaaattaatggccattacgaactcggcattgcccactgttaatttgtcctctccccccccccccccctcctccaatggactgactcttcctaagaaatggcgtcggtagcacagtgccgtgtcgtccgtctccaacttcgtcctgccacagcttccccccgtcccattctctgtcatttcttcctccatctgaattagttagcttttatttactttccaattctaaacaacaaccttaatgaggaaagtgctcgcctcggaatgcgacttgataaacattgccgcttgtttagacacctaaaataggcacgaaattaaggtaaaatggttaaaatat

SEQ ID NO: 2551 - DNA, 5118 bp, Heterodera glycines
atgcaataaaaatgataaatacaccccctaagaatcgggccaaaaaaattttcggaaaaatacaccccttagaattgacctaaaaattttcaaaaaatacactcctaagaatcgacccaaaaaatttcggaaaaatacgcccctgagaatcgacccttaaatcctgaaaatttctaaatgtacttcatttctaactgcaatcagtaaataaaattgtttgacttaattttaactaatttacatagagaaaacagcaattttaacaaatttcacctctacatttggaattttttcatgcttattttcgcacttatttcgcgcttttttcgcccttatttaagcacttattttggactttttcgcgcttaaaaatccgttccctattgataagcttaaagtctaagaattgttttttttaaatttttacctaaggctattggaaaaaataattcgcaaatacactcggaaaacaaagttgaatttcgtgttttctcattgtatttttttatgaatgcttggtatttgttcttttcttgcctctataaaatcccgagactttaaaagagaaaaattttgttgacacaaaacccacaagtaccaaaaaagtgccaaattttcaattttttaatagcaaaaaatgtcagcgtcaaattgaacaattcaaagagcaaacaaaacatcatcaatcaatccaattcttcataactcgataatgatcggccatttcccaaaatgatcactttttcttcttccgctgatcactggacccggaaaaagagaacactttttcattgctttgacctggcggagacagcggcctaaattaagcgcaatttgaatcggataactttttcgcaagtacagcccgtaattattgcaaaaacccggaccagcagggttttcgggatggaccagagcaaaaaagacaaaacaaggactgaagttctgtcttaacagaacccatggccctgccaagattctgggaaagtactgtacatgggataccgttccctatccgtgtttcatacaaaaaaggcctcctttctgctcacccaatgtcatcgtaaaggcggaagaacactttgttcaaattggcatccgaattttcgtccttcttctgctgctgtttctgaaccgccgccgcagtctccccaataattgggcatctctccaacagccaattgaattcaccagtgccattttcatccttcgtcagtgtcagcttctcatttgtcacttcgttcaccaattcaaatggttcaattggcattggttccacacgaagataaaattgaatattgtaactgacagaagtggtggcacggcgaaatgtctaaacaagggtccatcgtcagcaattccatcggggaacagaatcgatcagaacagacagtttcgcttttggtccttcgtccttgcgaattgtgattgttctccaaattgtcaattcgcttttgccatcgaaatgtttgtccaccaaaacatcgaaacggtcggaaagcaatgccattttgaggccgagttgagcatggtcaaacgatggcataatgtccatccacacgtcgctacaaagccaactgagattcgtaaaaaaatgtatgggtaaatgaaaattttgtaattttaaaaaattccttaccgtcgattcatttttgtggctcaattttccctttttccaattgattggtgtgtcaaaaaaggcaaggcaaaactctgttgttatgtaacttaaaaagagagagttgggaaaaatgagagagcaaaaagaacgcaaaaacaattttgaaacagaaataaattcatcacattttttggcaaaaaacagacggagtatttgtaaaaaatattatttttttcaatttatccgctcaatcatttttatgcgtccaattatgtaccgtatatgctctaattatggcccagtctctattaataccgcagtctccaattatccccccccccccctttgaagaacattggccccgaatgattgaatttaaactgatatcggtgaggttgctgagtcattatataaaaaccatcaatatgggcgttatataaaaaaccatcaaatggaaattttcaacaaaaaactggtcataagttgggtcaacgtgaaccaaattaaaaatttggtattattcaaaagcataacattttctatttgctcatctaaatttcaaaaaatttggccaagtttgagcaaaattatggccaaaagcacacaaacaaccagtttttacacatttttggccataacttttttgaaacttatctaaattttttaaatttgtaaaaataggaatttgagttgggttaacaataaataaaatttgaacaattccgtcgttttgcgatcaaaaatgttaaaattttgaccaaaattcaaaaaatatatacaaaaaaatttaggaaacctaatttctgcatcggttgccttggccttacccattcgcactgaaatattgttttttcactctaattcactttacctattatctctaattagcccccccccctatctaaggaggttgaacaataatcatccggggggataatatgaatttaaataatttacaacaaattttagattaattaaaagcactgaaaattaacccaaaaatgcatacaaaaataatgtacaccgcccggattcgaacttcgccctcgcccctcaaaatgatgcctcagaatcagggctggacgtaactgattttcaattacggaaatccgtaatccgtaattacggcaattttttcagttacggtccaaaccctggcgtggcattcacctggtactgaagtgtactttttaaaatgcgttatggctagggcttccaattatatggaaatccttatttttttttcctgcactgtgggaggcctgaaacgcacgaaaaacatgtttttagcttggttttaagcttttaggatgggtttccatatccatatttttccatattttggcattttgtccatattttgatatttttccaaaaaacctctattagaacggccccagcagctaaattggcctttttgagcccaaaaaccggaaaatttttcaaaaaaatcattttttcgccaaattttctcgggaatattgaataaatttgaattttcttaaaaattaataagtttatgtcaaaaataagcaaaaaagataaaatttcacttttctggttgatttttcgctaaaaatgagtaaattttagctttatcgtgttttttcttctaaaatgatttttaataccatatttagccatttttgaagggctttactttatattaacaaatttaaagaaattttgggaaattataccctcaatttgaaaaatttatgtccatatttttgccattttatttccatattttacgatttttggtccatattttatggccatatttcgcaatttatatccatataattacactccctacacataacaggaaagtaccgagtgaaagaccgtttggccgataattaaacgacgcaacgcgcaacgcgttgtcacgcgttgcgccatcgcattgagcagcggagcaacagcgagagatgggagggagaatgagcgacagacacaagcgatcattactgctctaattagccttaatgaatttaatatactttgtgatcactgatcattaatccccccccttcagttccatatactatagaccatttgaaattaatggtactaattgaatctcaattttataaatttttttgttcaatttgaggaaatttgcgaaattagccgataaactcaaaagcccaactgaatattttagtgataccgcaaattttttaaattatttttacatttttaagagtcattttcagctaaatttttaaaacaaattgaaatgtttgtcatcttctcttcaacggcctttctgaaatgaataaatttgcttttaacctgcttccttttttatttattcatacatataaatttgacgcttgctcatcttcaatgcgtcagtttaatgtcataaaaacaagtttcttaagttttcgagattattgatcacgaatttggtatccctttcggccaatcccgaaacatggacccgaattcaaacaaaaagtcgaaagtccaaattttagaatttagcattgttgattcaaaacgccgtaaacgatctaacattgaaggaacgaattggtttatgtagtttgtttccgtgcatttaaaccggttttgaatcaaaaatgctaaattcaaaaatttgggtttttggctttttgttcgaattcgggcccggggttcggaattcagaacgatgttattatagaattctactttttatacctagtacaatgcttaatgctgcaaatctttattttaaaatattttttatcactgactcattttccgggcacgcgttagatgggacagaataaaacgaaattggaaaatgaataattaaacttcaaaattttcttcaataaatcttttttttaaatgttttaataaatgaataaaatcaagcccgtagccaggaaaaattttcgggggggggggggggaaagggaggggtccggtccgaagacctttttttttttttgcaaatttatccataattttttttgctgaataaaattgataaaagttgtttacgatctgcaaataactgcaattttccacttgtagacttttctattgtggcggcggctgcttaaaaaaactttttcccgctgttgggtaaaaactccactttttcactaaaaaaggaaccaatttaggccgttttacggaaaatttgagtgctatttgttacgaaaattgtctataaaaattttaaattttcgtttgggcgcagaggggaattggaatttattttacttcagatcatcaaagaagtgaatgacatctacgttatctggaaattggcaaatattacgattggaaaccattggcaattccgccaattcaattgccacacaaagtcagcggattcggactgatcagcatagcgtaaaactggcgattatggcgattaatgcaacatttcccatttcttttcagtgtcattgaccaaaatgtcttcgacttttctccgccgtgttcgccaacttttcaccatatgtacatgtagtttgtcattccgcacc

SEQ ID NO: 2552 - DNA, 3948 bp, Heterodera glycines
  misc_feature (20)..(20): n is a, c, g, or t
ttggagttttcataaataanttttattgaaaaaaatttaaccattattaaattattgcctctaccgaatcagaagagtgacccaaatcgtcagtttttgaagaacacgaattgctctgatcaccggcttgtttctcgtcaatgccatcactgatcatttcgtcgtatatttctttttttggaaactttaattttgtccttacattcattgcattttgttcttcgtccgaaaatgtctcttttttgatttcttctaatatttttggcttaatatcttcttcattttgacgctcactgctaacatcttcagcttttaagcttgtttttaataaatttttatcagcattacggatattttgatgaatccaattttcgcgttttaagtttctttcgtaattttttgctaacttttgttgcttcatgggtatcaggtttttccataaatctgcgaataagtcttcttcagttccttgaatgccaataaaaaacaaatggacgaagaaaatggcaatcatttaaaagtttatttatgttcagaatttttaatgggaatttttttttataaataataattttttttgaagcttttattatatatttgaaatgatgcaatatttgcaatattttactaagcttttgagttttgccacagtttcctgtaaaattgctttaagcttaatacagggcataatttcttggaatttccgtttcgagtttatttcttttataaatttaaatttgttactttcactgcattttctggaatgataacgaaatgttggggcaggggaagggtggaattaattgagtgccaaattcggccttaattacagagtccgcgtgtgccttcagaaataaaattcggtatttttgggctattatctgtcaaaaaaaatcatcaaaaaactcaaaattctcggcagcgaatgatgacattgccgctctccccccccccgcccaccttattcgcaccaaaaaaagaaaatgtcgaataaattccatgccgataatttatttgtataaaataaaaactccgatgtgtacttggaattgaaaattaagatatttacttgcaaaacggcttacccgtactttgaaattcagtatggtcaatggaagggagccttgtcatacactaatgtccatttgtcattggttaattagtgtctcttcaatttcgctaattaagcataatcgcccgattagagaggcgtacattttatggatttaacattattttgggcatttatttttttggtggaccgtgccgggtgccgcggggtaagcatgaaataaaaattcgattttttcaagtattgtaccgttgtccttcccttgccattcgcctcttagcccatgagttagcccagcatttgacacagcaggttcctcgatgcctttggcatcacctgctctttccaaacttccgcccgcggctgtttgtcagatttaaccgccgcttaagaaaccgtcttaaacaaaggctcaaacactccgcaagcagcgaacgttccgtcaaaacaaacgttggttaacttgcaaagagaacgacagattttaattaccctggaacgtggaagaaacggggcaaaaagtcaaaatcctaatatgggcaacgataattggaatccggtgtaataaaatataaacacaactcacatattgatagaattcccggtaatgaacttttgcctccttcattttctttaatataccgttttctctgttttaatttgctctctcttctcttgttgcttttctacctcgtcctttgtggtgtcatttggacaagcagatgtcctctcaaggctaatagccaattatccaaagaaattccccgtcaatgctctttattaacttaatcattttctttcgtttgattgtggcccaaaaaattaggaaattatgagaaaataacacacaattttatatggtataaaaatgttttaaaattatattagccgataaattaataattcatgcttttgacaatttcgaatcttttggctttataataataaattttaatatatattttttggggtgaacaagaagcttcccaaaaggatgattaataataattgaatttattgaagcaattaagtaaatgtctaaattttttgaaaaacccgatgagaaaaatgtcaacgacctggtcaaattgaattccgatgagaaattcagagaatttattgacttgtttcctgatttttggaatcccaatcccgcaacaggatctgaaaatttggtttttgtacgggattcaaggtttccccagtgtcgcctctcggcaccgcccacacacctcttttttcttctcattttcctggtggtgcctataggcaccaacgggccctcctcccccacgactcaaattattggttacttaattttggagaactttttatttcaattatgagtttttcggaatttcaatactgcaccaatctagcagcgggatcagaaaatttaatatttccggtctcctgatgatgcaaaaaacaaaatagggataaaaaggcaaataatatttaaacacttttgtcttaatttttttagttttataaattttgtcgggcctttttcattttttggcaattccttttcaaaatgtaaaatggtcaattttacaaaggttttttgccctatctattttcatcaaattatgttcctttgacccactttttccttcgaccactctctcattttctcattaacaaaaatgaggctgccattaaatttataattgtccctcaaatgcttcgctttgtcaatttgtcctcaagcaatgaaaaattacctattttttattgtcttgcataatagtggaaaatgcttcttgtcaattaaaaagtcattttctcatataaactgactgcttttccctcttcttcgttataatcatcattcatctcagggccttctggcacaatttcattaagggctaaaggagatttaattaattattttagaaaattttttatgattataaaaaaatatttataaaaattaaacaaacttaatgattttattttctaaattaataaaattaaataaattcctttataataattaaatgaattaaattatatttttaagtatgatttacaagccaaaaattgttgaagtggccccacagcccctaatggggggggggggattcatagcccgtctcatttgcgtactgttgctgaattatttttatccaataattatgaattcttatcctattcttgaagcaagaaataattacttttgtcataaaaccagcagttcggcctcttgcaagccgagaaatctcacttttgtaatcaattatatgcttgagcctgagcaaatcatggcttcccgtaccttcgaagtaaagaaaataataattcgaattcttacagtttcgtcaaagtctttcaatgaaagacaattttaaaaagtcagaaaaaaacaaagttttgttttagttcttattactagatgattcataaagagtaaccttataactttataatcagaaataagttagtaagtaatgtaaaattttattttcccgagcgcgaaactggggacccaccaaatgggaattttttttcaaaaatcggtcgaacaatgctaagtcatctttcttaagagaaaagaattaaaatcaagaattattataaattatcgtaaagaattagtcaaatttatcaaatatcgagctcgtaaaatcgagtagccaccctttttacacttttaaaaaaattccaatcatttcagaacgtgataaaaatttcattagtttcttaatttcttaagagaaaaaaaatttaaatacagattttataaattttcgcaaatcattttagaactcaatttcattaatctttttaataatagtaaaacatacaagatattaaagcttgggtcatcaacgacatccatagttaatcgaacgtgcaactgcctatactta

SEQ ID NO: 2553 - DNA, 1570 bp, Heterodera glycines
ccttaacatcatcatttatttggtttcgaagttttacctttattatgacttttattatagcaaaaaacagcttcaaaaccacttaaaaattatttacatattatttatttacctattcatatttcgtatacaaaaaattaaaattaaattacctttcaaaagtcgtgatcacactgtcgccaacaccgcaaaaggtgaagcggactaagtcgttgattggtattcttaggtcagttaccgttttggcagaaataaggttgaaaggcgatccttattttaattaaaatggtatactatccctaataataaaacaattagaagcatacataacaaacattaatatggtagttaaataaagaaaatttcaaaaattttaagtttaaaaataaaaagccttataagtttactctattttagattttttgatagataaatatgagtatcaacatttttttagatttgttaatttgtaatttaattaaagttacttaaaaacaaacatgaagcaacttaaaaaagaaataaagtcaaaaatttatagatgataatcaattttaatcaaagagatttgcttacctgagtccatcattattaatgattccccgaacgtaacgggtcctcggcggcaatggtgacggagctgatggaactctatcggtgaaatttatccaaaaaacgggagtaaaaataccctgacatgaaaattttcaggacccggtttgaccccgattgaaaaacttggacccggtttttcccaaatagccgaacccatgtaaccctagattttggactaccaaacataaatgctgctctttttgcattttaagcgtcgaatcaatgaccatcttaagttttgttaaattttggtaatgtattttcccacaaaaagcaaacaaataaataaacatatattcgaacaaaaagaatcacaaagcatttcttaaaaaaaaagagagcatcaaataaaattccaatggtgagatcgtcgagcatttctcaaatttaattaattaattcgcttccgcacagtcagacgacgtttcgatgctttgacccgcttcttctttttcttcgtccgctggtggctgcaatggcttaaaattaaatacaatttgaattgggtgtaaatttgttaatattttgcacttacccagtcgaacttttgccaccccgcaaatcaaattggacactgttcaatgtgtcgtcccaattttcgtcgtcgtcccatggaaacgccgtcgccttttcactaattgggcatcgcttcaacagccaattaacatcacaacttgacactccgggacttaggtagcagttgtaagttttttttcagtaccagtcatggtcccgtacaattctagttaacacctattcgattaaaaagaatttgaaatttttccaaaaagggaataccataggtaattatttacccaaaattaatgcaatatgacctaatataccggtttaattactcaagttttagataaaacattctctataaaatcgattatcgacaatgaaacgaagcaacacaacaaaagacactcctcatcaatcaaaacgctcaatg

SEQ ID NO: 2554 - DNA, 7411 bp, Heterodera glycines
actccgtcgatccagagactgacggaagtatctttcaaaaattgaagagctgagaggttgatcacaaagatatctgagatcaagcaattcagcacgccaaaaaacttgaacagaaaagatttgacagtgtggaaacgcaaactcaacaacatattggaggcaactacaaaagctgtgaaaggggaagagtttaaccgaactctgatagaaaaattagttcgtctaattcagtcaacaggctactcaacaaaagctggtcaagaccaagcacttatcagcctacgcaaaattgaaaacaatttgaagcaccaaagacgctaccttaccgcccaagaaaggacgacacattatttaaagaagacttttggcttaccaactgaacagaaaataaaatcgaacaacgattccgacactgcgacccaatcaactagttctaatctgtgatcaaatttttaaaattgtgataataattgttaattccataatcaataaattgtgattagcatttaacctgtgataaaacaattctgttaattccttttttgagtaataaaatgttcatttcattaattattttaaattacggtatttaacaaaatttcaaactgtgtcctaaaaatataatcgatttaaattcaattgacttgtcaaatcaacccgatcagttaaatcagatcgagaatattgaaatattaccggaatttgaggaaccaataattatagagaacgaaaatcagaatatcgaaatctttgaacctaacgaaattgaacaaataacaaatcaagacgatttaatttttggaaatttctacggggctttaatcactgaaccattgtcaaattattttaccattaatcaagacaatattaccaaagtcaaaaaatttaaatttaatccttctaaatatatatttaaaattactattgctctcactgtgcatgtacacaaaaatttgtcacaccgtaatatagaaattttctgtcaaacaatttctgaagaagtaacaaatagcatactatcagactttttacacacaacagaacaaaccataattgactcaatcgaaacggaccaaagaaaaatcaaattaacaaaatttctcaagagaatagaaaatcgaatatctaagcagattaaaaaacagtggggtccatattgctatcatccaattcttgtactttcaactcataagtatattttttaaatatgtcgggtcaactcagagcaaaaataccgttacttaaccgagtgttaataaaagaaatacagaaaattaagtcaaaaatagaagaagggaattttgagtatgataaaaataattttgatgattgttctcgaatttttaataaaactaaagaaatcattcaaagaattgaaccaaattttgaaaaattaaaaattttgcaccaaaaatggcaaaatttaatgaggcaaatgaataaaacagaatggaacagtgaatggaaactacaaaaaatattccgggaaaagcataattatttaaaaacaattaaggaaattgacgaaatccttgacacaattaaggatataaatttggaggtaaaaagaaggctgaaagcgctcaaaccaaattccccttcagaatccgaccaagagaatgaatcaattgatgagagcaagaaaacgatgatgaagaagccggagaagaagaagatgaagatgaaaaagaatatgatagtgatcaagaggacgaatcacaagaaatgcattcaagtgatcaaacacatcgtaatcgcataccatttgttcatcaacgatcaagaataaagcttccggcacaaactctaactcatttttcgggaaaattttcccaatggcccagtttttgggacgattttaaatcctcagtacataatgatccgaacatggaaaatatacaaaaacttaagtaccttcgtggactgttacatgatgagccttatcgaattgtatccccatacccccttattaataaaaattacccaataataataaaattgctgaaatcacgttacggtaaccccgaattaatcagagaaaatcttcacagtgaattacgtaacttgaaaaggcctattgaatccacgattgaattaagaaaatttattttactaattgatcgaataattttgcaattaaaatcccaaggcgaagacataaatcatccccaaattaagcagtctatagaaacaaaacttccatataatttaagacttaaattgagagaaaaatttaaaatttattcaacaaagcagttaatggactttttaaatgctcacacacaagcacgtgaagacatggaacgaatggaagactcaaatcgtcaaatccggaactttccttctaatcgaccaaacccaaacaagatacagagacaaccatatcaaaatttctctcaaaacaaaccaaaatttaaccaaagaaatcaatatcaaaccccaattacaccttttccatatacttctgcattaacaacaaagtcaaaaccattgcatccggcacagattaaaccaatacctacacaaaccaaaactcaatataaaatattttgtcgtttctgtgaaagagaaaaccatacaagtaaagaatgtaaaatatattcaaccccggagaaacgaaatgaacgagtacgtgaactcaaactttgtctcaattgtctaaataagggacatatggtcaatgaatgcaaatcgacctatttatgttataactgcaaacacaaacataatactctcctgtgcactcgtaaacaaactcagtacaaaacgaaggaacaaaaaaccagagtgaatatggctcaaaattacgaaaatcatgaagagactcagacattcatgacaatggagggtgataaaaatttaccaaattctgatgaagaagaattgcttatgactactgaagtaaactgcataaatcccaacaaatataaagtaaaaagggaaataattttgtttgataatgggtcacaaaaaagctatataaccgaagaatgtgctcaaactcttcaattaagcacaattgaggaaaaattattagcaatttccactttcaatcaaaataagccaaaaataattaaatcaagactagtcaaagttggcattaaaacattaaaaggtgaaatagagtacataacactacaaacagtggaaaaaattactgatgttacaaaaatggttaataaagaaactgttgatgtacttggagtaaaaatcccaatcagtcatgcacgtcctcaaattttaattggaatcgactattactggcactttatgctaccaaattcacaaattcaattacttccatcaggattttactcaataaatacaaaattaggaaaaatattatctggaaaaggaactattgaggacaccaattgtaactcagtgaccgaaaaaagaaaaaaagacgaaacgaaccaaatacttcagaaattttgggaattagaaaacattggaattatcgactcaccacatatgacggatgaagatgcagcaatgatacactttgataaaaatgttacatttaaaaataacagataccatgttcgatggccttataaaagagagaacccgaatttaccaacaaattttggattatgcatgggaagactaagaaatgttgttaaacaactaattaaaaacaaacaattggaaaattatgacagaatattgcaagaacaaatggatactgatgtaaatgaaattgctgaatttaaatcaaataatttgcttcattatcttccacatcatccggtaataaaagagagctcaaatacaactaaaatacgaccagtttttgatgcgtccgcaaaacttaaaggaaataattcactaaatgatgaaattcaccaaggaccaaaattactaccagatttgtgtggaatgattctccgatttagacttaaaaattacgtattaattggtgacctggaaaaagcatttttacgagttggattaaatgaattagacagagacacaacacgatttttatgggtaaacaaatcgtacttgaatgaaataagacaaaattatcgagaaattgaaatgagagacatcgaattgagacgattcacacggataccatttggagttaacgcttcaccatttttattaactgctgtagttaatctccacttgtcaaagataaatgaaatgtttgaaaaattcaagacaattcaagttaataaggaattatgtctaaatgataaagaagaagaatttaaaaatctttgcatagaacttaaacaaaatgcatatgttgataatttcgtaatgatgtgcgatgatgaaaaagaaatacaattcaaacattattggagtaaagaaatatttaaactagcatcaatgaatctgagagagtttgtctctaatcatgaacaaagtaataaagaaattcaaaaattggaaggatcagagataccaaaagtaacaaaaatgttgggtataaaatggaatgtcgattcagatgaacttgaactccaaataaaaattccactaatgagtaaagacacaacaaaaagacaaattttgacgatgattgccaaaaatttcgatcccatgggatggatttcaccagtaatactgaaatataaactatttttccaaaaactatggcgatcaaacaaagattgggacgataaattagatgatcaagaaattattgaatggaataatatttcaaacacagaaatgatagccataccacgttcacctttcacaagccaatatttaaatcattcaatattacacattttcgctgacgcttctgagttggcttatgccacatcagcttatttacatacaaacgatcaaataaatttattgttcgcaaaaacaagacttactccacttaaaggcttaacaattcctaaactcgaattattaggtttattgatagccgcaagagccgccaaatttataaaaagggaatcaaaattgaatctcgaaaatacctatatttggtcagactcaaaatgtgtactcagttggttgaaatgtaaaaggaatttaccaatttttataaaaaatagagttgaagagataaaacaaattgccttggaattacacatcacttttcattatgtaaaatcagcagataacccggctgatttggcttcacgaggagcaaccatgagtgaattaaaacacaacaaattatggtggaatggaccaaaatggcttaaactgaaaaaagaaaattggccacctcacagcttttacagtcctgatcaagaagaggctccttatttagataatacagaggaaataattaacactcaaataaatttaataaaaaacgaatataaaggaattatcgaatgggataaattcagttcatggcttaaaataactcgcatttgtcaaactttattaaaattcatatttttcaaactacagaactctaaaaagttcaaagaaaaatttatttgctctaaattcgaaaatgcattacaattaaaaataatggcacaaaaaatgctaattcgaattattcagagggaaatggaaccaaataaagaagaagaaagacagttaagaatttatctcgataatgatatgatactcaaatgtgaaggacgattaaaaaatgcacaaattcaaggtgtcaatcccatttttttaccaagaaaacactatggaactcatttgataatcatggattatcacacacgaaatttacacgcaggtacaatgacaacattatcggaaataagaaaaacttattggataccgaaaggaagaagaattgttgatcaaatacggagacaatgctaccattgtaggagatataatgctaaaccttttcaacaaccacaaatgcctccattacccaaatcacgagttgaaataactgaaccatttcaaaacgttggactagattatatgggaccaatacaaataaaaaatttcaatgaaaaatgctggataattttatttacatgcttcacaacacgaggtattcatctcgaattagtcacttccttatcagttcagcattttctcaatgcatttagaagatttatatcaagaagaggcacacccaaacatgtatggagtgataatgcagcacaaataaaacttgcatcaaaaattctaccagaagtgttaaaattaagagaaattctcaaacacgaatcaattaaaagttattttttaaatgaaaatataaattggacattctctatagaattagccccttggcaaaacggagcaattgaacgccttaatcagaatgtcaaaacagcaatgagaaaagtaatcggtaaaagatttattgagtttgattcttttcaaactctgacttgtgaaattgaagccctggtaaattcacgaccaattacctttatatatgatgaaattaactcttatcaaattcttagaccaatcgacttcatacttccacataaaaatttatgtattcctccgattttggaaaatcaggaaactaaagacccaacatattacccaaaaaagacttcattcgaccaaacaattgaattatggaagaaaaccacaaaattattagatgactattggaaaatttggactgatgaatatataccaagtctaagagaacgttataaaatcgaaaacaaaaatccacgaaattgtatgaaatcttttccagaattgaatgatatcgtaataatacatgatcaaactcccagagcaatgtggaagactggcattgtcaaaaatgtcataactggatcagatggtatcgtaagaggcgctaatatcgaacttccaaataaaacagtactaaatcgacccttaaaattaatttacccgttagaaattaattcaaatgatgataaagagcaagaaactctctctaatctaataattaatcaaaaacccaattatttcaacagaaaaaggaagatggataatcccttagtccctataaaaatgaatagactgtttcaaaactcgttaacaattatatcattattaacattaatttcattatgttcatcttattcatacgaatgtccaaaggaacctaaaatatggaaaacgagatatacaactctatgtatcgaaaacggttttacaatcagacaaaataaaataacaaaagaattttgctataaacaattggtatgcaatgacaaacatattattaaacgacgaccaccgtattgtggtaaaaaatgtaattgtcccgagggattcaaattttgtagtttcgcatcttataataaaatcaaaaatgaatcagttggaagaattaattaccaaaaaataatttcgttctacaaaccaaatatctgctcactaaataaaactgaaaagtgtccaaatatgcagataaaattatttaattcaattgttcttcatgacaattcaattcatatggtgaaaactttaaatttacttttttcccaaattgactcgataaacaatt

SEQ ID NO: 2555 - DNA, 3526 bp, Heterodera glycines
catataataaacaaaatattacagaaaattgtgaagttctatgtcccgatggcaagtctgaaattactttaaaagctaatttggaatacatatcacaacaagatactaaaattattcccgctaacaatactaatgaaaaccccattatcggaacttccttggaccaagtaattgatataataaattttgtttacactcttattaaaactaattttttcaccatatttattattatcatattcatacttattctattttttctaattccatgtctactacctattatatatagaattatgtgtgcttgccttcttcgttcgcgtgggagtgtcgcgacagcgcgaaatcccaaaataaagaaaggaaaaaataaaaaacactagaaaacaaaatggggaaaaacaaaacctacataataaaaaataatttttcatttaatttggaaaaacatattagaaaaaactatcaaaaatataattataaaaaatgggaaaaccttttgaaatgaataacggaaaattgtttgaaaatgaaaagtgcatttcctcaggaatgaaaggaacgaaaattaattaatattaaatggcgaattctgttaaggattgcgttcgtaaacaaattattaataattaattgaatatattaaaggaattggaattgtaaaggaaaaagtggaaaacaaacaattaatgggaaaatggcaaaacccaaacggatataacaaaaacagattttaattaaaaattataaattggagcgtactatggtttcaaaaaagccgtataaaaggggctgggttttcagtgatttcagatcgctcattggttccctccgaagtttccattccttccccgtgccgtgctctgcgccttccctgtgccgtgccctgcgccttccccgtgccgtgcccgtccgcctttcccgtgccgtgccctgcgccttccccgtgccgtgcccgtgcgcctttcccgtgccgtgcccgtgcgcctgccccgtgccctgctccttccccgtgccgtgccctgcgccttccccgtgccgtgccctgcgccttccccttaccattcccctttgtgcccattttatcatgtcggattatatttgttcattaattaattatggtttaattacccaagtttgagggtacaaaataaagtgaatttttggcgcctttggtctttaatttttgtcaactcgctctgaatacgtccgcccagcccattcaaacttttttgccgtcatcagaacgacaccgcccgcgagcagtcattttatgttctaatcacacgcgtgtgatcgtttggcgcctggaccgtccgcgagcggtcacattatgttctgatcacaagcgtgtgatctgatgtcgcctggaccgcccgcgagcggtcactttatgttctgatcacacgcgtgtgatcgtttggcgcctggaccgctcgcaagcggtcacattatgttcggagcgcacgcgtgtgaatttgttgactgtatctctcgcgagcggtctctttatggtggggcgcatgcgtatgatcgtttgtcgcgcaagcgagcggtcgctttatggtggggggcgcacgcgtgtgataatctgttgactggaccgcccgcgagcgataccgatcatttgtcggctggagcgctcgcgagcggggggtcgtacgcgtgtgtgtgtgtgtgtgtgtgtgtgggtgtcccgatttccgaaaaagtttggaccccaggaattccgattttcgatttccgaaaatttttggggctcggaatgccatccctaatgtgtatgtgtgtgtgtgtgtgtgtgtgtgtgtgtgtgtgtgtgtgtgggtgcctgagcatacgcgagcggtctctaatgttcgggtcgcgctcgtgggatttttatttttcattcttaagccgcggcgaagcgcacggctccgtgcgcccggctatcgtccgctgttccgagtcgtcttccaccattcgtcgaccaccgggaaccccgtggcggaacgacgcaagcagcaacgtcgctcaaaacgacgttgtcgacagcgactggagcggcagcgcctgcgtgccgaacggcagcccttctggcggttgctggaccaacagtgggccgacgaagcgcatcacagagagctggtggaagacgactggctgctgtacggcgaccagctggcgaccgcacgcgacgtgatcctggccgacggccgcccactggacgattggcttcgtcacgacgagaccgtcgccgattggacaccgctcgaccattcggagctcaaacgactgtccgacggtgtgcatcggacggcgggtgtcggagccgaagcgtgccccatctgcatggagccgttggcggacaatgtgctgctatgtacgggctgctgcggtcagcgcttttgcagcgtctgcctgtggacgcacgcgtgccagagccgggcgtgtccactctgtcgtcggcatctgctgacgggcgaaccgttgacagtcgtcgcggaagacgtcagtggtgatgacgacagtcaagtggacgacgacgacgacgacgacagtgccgacgacggcgacgaccacggcggagccgaagcggccctcagccccccacagcagcacattcgtccgccaaggcgtcgccgtcggcatggacgcgcgacggagcccagctgttccggcttcggcacgtggggttcgccgtcgtccaacagcacggagggctcatttgtggagttggccgagtgggccgacgaatagtgatgatgatgatgattgatgacaccgaaaaatttgccatagttgaaattttttaaataaattaacataattctaagacgcggtgtaagcctagttggttgaacgttggcgagcgattgcgggcgtacatattttgtagtgtatgagtgtatgtgtgtgtgtgtggcgggtgtgtatgtgtgggtgtgttttttcgtgcttgaatagggggtcagggatgaaggacggggtggggtaaattttcgtgattttaatagaaatgtcaacctatttgtgctccttttagagaggcgtcggtgccgtccaaaccggacacggccgtcgtcgtcaccttcgtcgaagcccaaaagcggaggtgagagcatccacgtctgcattagtgggaccagcatacggtgggccgcccactgactatgacgacgacgacgacgatgccgaagaatttgggggcaacggcgttgacaatgacgacacatctgctgttgacgatgtcgacgacttcttcagcgtggtcggcgtctgggagcgggccggctcccggtcgcgtgccacgcagaccgagaccatccaagtgcgcttccacaactgggagcgggcgcggcgccccgacctactgctcgcacgctgcatcgcccgtctgatggcgcgcgtgctggacgggcgtgcggagccgctccgcgtcgggctgtccgtgcagccgcccggctgggacaactgcttccacgtgccgatacgccccccacagcagaacagtgcgcacgcgctggcggccgctctcgaaaca

SEQ ID NO: 2556 - DNA, 6404 bp, Heterodera glycines
agggaatggttaattgtcactcacagcaaatgaaatgaaattggcatatccccagctgctctctttattgtcaaaaacatggccatttaattctaatttaaaatccgacactccgctcttttgcgaaacaattcgaaagtttgccgaacatttgcaactccaattttctgctcaatatcaattaattaattgcttatatatattaattattagtaattttgcaccttcttttggagcatcgcaccaaaggtaaatacccaaacttttctcattgacagtgcttccacttttcgcttttatttttgccaatattttccatggaagtccatttatgtacactttttcgctgtaccgactgctctcaacctcctctcgtgcaaattctgacactttttcaatgtccatcaaaactgtgccttctttccgatcggaaatccgtccattaatcgaaaatggcattgggaaaattccgtcggaaatcccatgacaatttggaagggatttgaactgataaacggcgatcacttcatcttttgataaaacaccgaagggaactgtaaatatgtattaacttattgaaaaataaattttaaaaaacatttttaaaaatcgccacaaaaactatgaatattttacggcatctcatcagagaacgagtttgaaattttgacttattttttaccaattttcttcgtaaattcctcatttgacaaaagcggaaagcgaattttgaacagtgccgggccaagcatttgacggcgattctctgctgaacaatcaatgccattttcacggcatttttcatcggcccaacggagtgcctttaaaaaaatttaatggaaataattaaatgactaataaaatttagtttttaaatttaattgttaaaattaccgcattccaaattgaaatttctccactgatttgcaattcgtcacactccaaaatttcgcacaacaatttttggtcaatttgcaaaaaagcatccgatttgagcaaagtgtccgcatttttgccaatgtaagccaaacaacaattggcaaaattctaaaatttaaaggaaaaataatctttaaaatgtagtctttctctgagagtgccaaagcgagaaaagaatcgagtttttctggtctaggttttcgagtttagaagaccgagatttctttaagccctctaatgattgtttggcttttgacaaacttaaaaaaacattcattttttgaggaacatattttacaaaaaaaagtctaaagtcaatggtttttcggtctcacaatcggacagcagcaattaattggtcttaaaatccttaatttattatacattctaaataaacgaaaaaatgtttgtaaaaattttagtgtaggaaaatatttgcaaaaaaatgcaaataatagcgaaattcaagacggaaaaattcacgagattgagtttaatcattcaaaaaaatcactctaaacagtttattatgtattttatttatctggaaaatgtaaaccgacaaaatagttaaaaattagcaaatttttaattctttcgcatttttcaatttttcctacccactttcaagtcgagaagacgggcctgggcaaaagcgaagaaaacattgcgcaattcggaaatgggaatttgcgaagatgagccgaccagagaggggatattgtactttttggctaattaaataatttatttatttttgtcacataaaattaaatccaccggcgtaaagcacagccattgcattttctccgttcagttcgctcaaatcatctgtataaatgaagctcaacatcactttgaatgctgctgcttcaacgtcggggacctccacgggacaatcagcagaggctaattgaaaattattagtgtaattagcggcggctaattgaaaatttaattagagcaattagcggaggactattgaaaattaattagggtaatttgcagagactaaattgtaaatgtcattcagtaatgtttttaccgaattccgctttttcctttttggcatcaaaacggaacatcgcctcaaaaacgtcggaagcgtgtttcaaaatgagcttatgggctggcacaagcttaagaggattaaattttaaaaaacacaacaaaaattaccattcactaaatttccaatttttaattaataaattaaatttttattttaaattaaactcgcctcttttgcgtctccgtcgcccaccaaaaaataaacatccgcgtcctctcccgtgctcaacaaatgcttcatccgatcaagcactgattgggacatgataagcaattccatcattcgtttaattatctatttaaatgcggtaaaattattggcaatttcaaaattggcaagaaataaaaaccacggcacaaaatcagcaaaactttatgttcagttgggctttgtgattattttgaggaaatttgtagcaaaaaaaaacatgcaaatgtttcgttgtgctccttccccccctgtttttatgcattttttcatcgctttgccatcggtaaaaaaaaattgatccgactaaaatgcaaacgtaaacaaaaagaattttggattaccaagtaataaaaaagttatcctatataataaagttgagtgtttgttgtgtgtgtccggtgtttgaatttgtgtggcgttttgtttgagttttgcgttaaaaatgaatttgaaaagagatgaaaagaaattgttttgaaaaagaagagaatataaagaaaagagacgaaaataaatagttaagaagaagaagaagacaaaagaaatagcacagaaaaagaaggtaaaagatttctccttctaggatgtagaggttagagggagggatggtgggaaaatagtgcactgtctgattgtctgtctacgcgggcagggcgggtgagaggggcatacagtgaacagacgcgtgctgctgtgcagcagcagtctgttggacgcgtgcgtgtgtgtgggagaaggagggagtgggaaaaaaagagagtaaattgcaatggaaaagaaaagagagcaaaagaaaggaaagggagagataatgggaaatttgtctcgcatcccttccttatttataacccatcttttattatataaaataattaataaaataatgagcacatttttgtgtttgtttgagtggaaaatccggtatatgaagtttctgtttttgtgtgtaagaaaaaatttgtggttttgctgttattattattttttgtctaaattttcgtttttgttaattgatttccattttgatgtgaaagctttttgttttgcttatgtaaacgataatggagaattgtttgattaaaaaaatacattagaattcgtttgaatgaaaaaggtttgttacttaaaaaagttttttgtacttttccttgcttataatatgaaaagaatctgatttggtttttgatatttgttttgaataaaaagcatgttatgatagtaataaaaaatgaaagaaaaatcctttgatggatagaaaaagcaatataaatgtacaccatagtgttttgatttatgggttatatttcaatttctggattccttttaaatagttctgtattccgttgctgaggttgttttccggtgattgaaatgtcggagaactgagtcccggtaattgtgttgctgaaggattgtcccggcgattggaatgttggtgggttgagtccccccccccccccctccattccatccttttgcttcatcattttccaatcggggggataataattgggaagcaatgagttggccaaaatcaaaaatccattcagtctctgtcattttatgggccagctaattaaatttggatttatctgtttaagcattgtactttactttactttttatttttgcattttcttttgacaaaaccattttaaaaaagtttttcattggtttcacataaaatttgcaattttttaaaatttcagatgctaaggcgtcccagggacagcagcagtggtcctgtgctccactttttcttcatcgtcctctgcaatttgccattccaaattgatgctgtcggattggcaccggggctttactgtggcacggtcacttgctacgatggtgaatttgaagggataggaaatgcgatttttaatttttcaattttaagtgctcgaaatttctcgggatgacttcaacaagacggatttgccgaaactgtacagaaggatggcacgccaataccatccggaccgggtcaaacgtgaagtgagtgctctactaaaatggcaaataaccaatttcggaattgactcctgaaaagaatttcataaaaattgggaactcttccagtttatatggcccgaaaaaccatagagaggggggactcttttggtttgcaaatttttttatgataaaaattcatgaacttttttatagaattttcggcgtcgctaatcacgaatcagataccaattttgacaaatctctaacccaaattcaaataaaaagttgaaaatttaaaattttcggatttttttttgttgctcaaatttaagttaagtattcgaaattggattaaatagatgtcaaatcttgatcaggccccaaaactccccgggaacaagttttcataagttattagcacacaaaaatttagcaaaccaaaagggtgggtcccccttatggtttttcgggccacctaaactggaaaagtgcccaaaattgtgtcaccttttctccgccctccaattccatttttcatgtttggctttattttcggtcattaattttgcaattttttacaaatccatcccctaattttaaatggattcactgtttttcccctccaaaggatctccgtgaagagacggaggaaaaatttcggctaattgccaccgcttatgagacgctgaaggacgacgagacgcgcacatattacgactattatttggaccatccggaggagcgctactacaacttctaccagtactatcggctgcgcaccgcgccacgcgtcgacgtacgcattgtgatcgcggtcaccattctgctcatctccgttgtgcaggtgaacagcagggccgaacaggacaggacaagatggtcttgtacatgataggacgggtcctttgtgtttttgaaaaatgcaacagggccagaaattctaaaaaaacaggaatttagccatctgaaaccatggtccgggttttcaaaaattcacgactatgaaggtggacgctccgccggggtcggaaaaggtttgagtcaagcccggattgtgaaaaaattttctcatttttttgctgttatttgcaaattgacattaaaaaatatagctaccggatatttagaaaattgaccaattttctgaaatttacttattaaacttgtctttgttttacagtatctcagcgcccatcaaaagtaccgtgaggcattacggtatgccaaggagcaggtcaaattccggcacatggccatcgaaattgggcgggagcgcggggtgctcgaatttgacaagcaaacgggcaaaatgaagaagaagcagcggaatgggcaggactctgagcaaattatcaggtaattgggcattttaatttgtaatgtgccgcggaatgcttttgccaatgtacggaaaattgggcaccactgccacgtttttggaccataaactcaacaaaattggtaccatttgaacgctattcaatttactaataaaaactaactttatccacgttaattttggccgttttaaggcaaaaaacttgtaaatagcggaaaatggaggttcggcggtgccgataggcgccgtcgggaaaaattttgaaaacttgagtgctatttgttacgaaaattgcctataaactttttaaattttcgtttggggggggggaattcaaaaaaattttccattatttgctggaaaattttaaaaaattttcatttcgggggggggggggaggggcctagcaagtcaaaaacaacgtttttggggtttatccgggcaaacccgtagcttgccatttttccctttcaacaagggcaaaagacaaatggttagcatcttaatccaatcagtgacctaaagaaaaaagaaaacaatattcatcgagtgcgcacttacacaaactcaaaaagtttgtccgtttccctctcaaaacatcgacatgttttgttccccgcggggctttttttctttcaaaataactctaacttttttgcactagctgctgacagtttacaatcaagttttatcaaacaataaacaaacctctaaaacagaacaccacacaatttcgtcgaaaaaaaggagagaagagcataagggttttttgttcccaccaatagtgtgaagtgaggcaaagcctaacaaaatcatgggtacaacagaatcatcaaaaagtcgacgcaagtttttcaaaaataatccatttctcatctaacatgctacaaa

SEQ ID NO: 2557 - DNA, 2518 bp, Heterodera glycines
atggaattatgacccattaacttacatttgcattggtgtccctccctttttttgaccattcgaaaatttgaaactaacaaaaaaaaatttttgttttagtggcataattgaggagaatatcagcattagcgggggctatcggccgccacggatattcgacactttggcggtgcaattggtgggcaaaaacgggggacaatgagactttatgcaacaaaaaacaaccctttttagttgttttttccgataattggggcgaaactgatagcggtaagtgtcgaaggttgtcggtatttcaaataaaaagtgccaaaaaacatttcttccatattttggtgtcatatttacagtggtggtcccgctgggcattcaaattttggatacgccggcagccctacgacgaggaggccaagctgtacatgatcaggaagaacttgaagcagtccgaggagcaatttcaggtgcagcaaatggcacaattatccccgggaaaatttctcaagctataaataattcaagaggcattttccactaattttaagacaccggaaatattttattcccaaaatttaaaaaaatgcgaaatttaaattgattttggcttttctatttgcttttaaaatcaatttccgttacttcccggcacaggcaacggagccaaagctgatggaggagtacatggcttgcgaactgtggaagcgggccgagttcgaccggtggaaggaggacaaggacaaagaggagaaggagcggctgtccaactcgggtcgctaccgccagtacaaacggttcatgaagaagcaggccgggtgagcatttttacaccgcactttttattgtacagtaccattgaacggcgtcgaattttgcaccgaaataattcaattttaattttaaaaaatgggaatttggcctgactttaaggggtctattgaaattgattcagaattttgccgggattagattacataattcttggttatcgttgtccccgcccctccatcctcactcaaaatccaattttagggattgctcattcttcaaacgaaatgaaccaaaaagcatgaaaagcgaaaaattggatgttgttgtcaaaagagcactataaaacagagagagaaaatgttttgttgttttttgcagaaacacaatttccttcctggacgaaatgtgatgagaagcgattgattgaccaccgacggcaaaatttgggggcaaaacaaaaacggaacagaaacaaaagcaactgtcgttattttccaatttgttattgttgttgttattgtattttaatgtgtagctgctcttttttgttgggtacagtccaaaccgacggatttcagaaagccccggactcgaaaacctgtaacattggctaaaaatcggagaaattttcacaacgggtcgaaaatttgtgttttttgtggatgtagttgaactgccccaagccctggtcatgtgacagtaccttattatccgttttccccaatttggttagttcccttctgttcaattcctttcccttgcctgtaaggtggcggtgctgttgatgaaaacaaaaattctcatttctttttttccagcatattttgtattgtaattttattgctttttgtatggaatttttcaacggtccaaaaattgcaggtttttctcctaaagtcctaaacattatgcgcattaaattgtttcctgtctctccatttttgttttcttttctgagttcatattgcatttttttattattcgatgaactttattgtttgttaatttatgggaagtcttgtttaaacagcttttaacaaaaagacaaaaaaaaagcatttaccatatcataacattagacattcggccaatttattccaaaacattatataaattgtgtgatacaattttggatggatgggataaaaaaacattatcttggatcatttgccatcgttcaaaaaacgtaataagaaaaatgacaccaaccaaacgcacatttattttgtgtcgtcgttgacttacttttcaccatccatccaaaggaaaactcgcggcagagagcacaacaacaaacggaaaagagaggacagaaggagaaggagggacgacctaagaaacgggggtttttaaacaaaactaaaagtatcaaaactccgaaattggatgtattgcaatgttaataacaatacaatagacaaaaatgagagaaattttggggaggaattgtgacaattttgttaaacattttgccaaaccttgagcagtgagattttgagaatgagcttaaggattgctgttcctttatcactaaccttgcgcaggatggcacaacatcaaattcccattaaatttttcaccaaatttcattttcccgtaaaaaagaaagaaacaacaaaatgaaaagagtgaaaaagcaattattgtgttgtaagtgagccaaccttcacattatggactcatccgaccacaatttttgattcaacaacatagatggcgataaatgaatggcacagaaaaaggaagagaaagt

SEQ ID NO: 2558 - DNA, 2321 bp, Heterodera glycines
ggaagagaaagtgcactcggcatctggaaatgcgaagacttaccgaaaagccctcgtggggaaacactcagtgacagacagacagacattcttcgccttcgttgttgcgatccttcggctccgctacgtctcaaatggcatcagcccacgtgtgtaggtcggcacaatgcgttgggccatcatctcttcctattgtggggaaaattgggggaaattagctggtaaatcccccgaaaattccagaaaactagaaattcatatttttcaaaattgcaaagcttttgctgtccatctgttaccagcgatgtctgttcatcttggcacacaatgcgcgtcttggcacccaatgttttgaccattgttgacgacgacgcggcagaagtagagggctcgtccctggtgccatactttccaccggagatgcttttatcctacaaaagttgccaattttacgcatttcgtttatcaaattgtctgatttttacgaggagacgtttaaaaattcgggaaatcagcaaaacaaacatcaaaaatttcgaagtcggttgaaatttcggctcgtccaattatgggtttttatccctttccagcgccatcgaacctggtaagcggcgaatgccgcttgcggtggcatcggaatggcacctcctgacgcaggcgacggtattccggcggggagcggaggcggtggcacaatgcccgccggtggtgtcggaatcgcgccaattgaggcggctgtggacgtcgccggcatccgcccgcccgccgctgctgcggcagccgctgccatcattgcggccatttgttgctgctgttgttgttggtggtgaggaagcggaacagtgccgggacgcggcatcccttcaaaagggaaaagacttaaacaaaatgccaaaattggagagagataaaaatagaatttttatgaatggatgaaggaataaaatttcatttcgttgcctaagtgtataattgctctgttttatagggcttacaattagcaaacacacaaatcaaaatccatgtccaataataagtgttgctgtgttttgctttagagcagcattaatgccgagtcttacaattctttggaagcaagcaaatgacccttttggccgtaatttcgacgtcaaatttggagtgagtattcacaaaaatgaccgaccataggacggcataccaaacggtgtgcgcggtgtgtattggttgtacgccgcaattggtggcaccatgccggacatcgacattccaggcggaaaggcggggcgcggaattttggagggtggcatgtccgagtcgtcctcgacatggccacgagtgctgaaaagccatgctcttaatccgttaattccttgtttttcatttacgattctggcggcaagccctccattccgtacacttcgatgttcacattgtcacggccgggcaacgcgccgggaatcttatcaatgctttccttgtgaacctgcaaaatacaacgggacgaattggtggaattatttcgcaatatttggcatttttcaaggattattcttcgacctgcatgcaatggatggccaagcccgggccggtgaacagctttttgttgcaaatgtgacatttgaagtgtttggcctgcaattaaatagtcggaatgaatgtgtcatcattcttcaggtgcattttcgacatttattattaaaatatagcccaattttgaggggggagttgaaaactaatcgagtgaattattctcagaaatataatctaaaattaataacccgagctaattaaaaggcaattaaactctgtcattgaaatccgacaattccatttccaaattaagttaccgtacaaataaaacaaaccttttgatgttggatgagtattttttcgtcctcaaattcgcggttgcaataccttaaacaaaaggaatgatgcccatcaaaactaatttgatttcgacttaccaacaccatggcttttgcggcttcttcttcttcctacccattttttagcaaaattattttaatacaaaaagctcaaataagaaattatcatacaagtgcacataaagggttaagttagttatagcttttaattgcgtgaacacatatacatacataggtaaatttgtttaactttaatgtcttttttccttcgataaaaaaatttgcgatttttttaaatttaaacagttcgccagatataaattatttaagtctttttaagttccatttcaacagcacaccatatggtaaaggaaacgtaaatttgctttcattggcagagaaatcccgtggagccaatggaataggacaaaagcaaaatgatcctcggca

SEQ ID NO: 2559 - DNA, 1846 bp, Heterodera glycines
  misc_feature (10)..(10): n is a, c, g, or t
aatttaaatntcggcacgcacttacaaaagtcagcgaccgcctgcgaaacgagcaaaaggttggccggctgagccttgagcttacggacgagggcaatcgcaacacaaaccatcaaattgccaagcacagtggccacgatcagcacaatgacaagggcactgatcagcagagcggcaagaggacgagaagagaacagagaaatgggaggggaaaggacggcaaatggggagggggcaaagagagggacggacgaaggagacggtggcaaagtgcaaggggcactgtaagtggcggagttgggtacggtaggggagggaagcgaagggatcggttgagcggaggagagattggaagtaccaatgccagcagcagcagaatcggaattgagcattgcaaatgacgaagagatggaaaggaagggacaaaacacagagagaacccgccgacagtccatcagaagaagacggactgagtcggcagtgccaaaaatgggagacggagacgagatcgggactgagtcagtcgttctcgggatggtgcgttgtcctcgggaacggaagagcagtcgttttgggattggccaattccctcacgctttctgagggcattggaataaaagtttaccctcaattttatttggaatttactagacgaattttgttcttctgtataaagacaaattgtccacaacaccaataatagaatcgatcgaagattgcttaaaaattcttcgatttggagagataattatggcttaatcgatttggcccaattcgggtggatgtttttcatccgctgtatgcgaaggttggccaaattggacgaacgcaaatttgatggaggcagggccaagtcaagcccaggctcctcccattcattcccttcccccaataagcttctccttgtcttggccaccggcgtagaaagcgacacgcaaaatgacgggagaggggggggggggggaaggtgaggggaaacatggagcaatgacagatggtggggatgagcaaagggatggatggataaataaatggaaagggagggaggaggaggaagaaaaacatgaaggaggatgaagaggaagaaaaacagggaggaggagaatggagagaggaggaagaaaaagagggacgaggaggaggaagaaaaacatgaaggaggaggaagagaaaaaaggaggaatgggaagaagaaaaagaaacgagaaggaggatgaagaggaatgaaaagagggaggaggagaatggagagaggaggaagaagattgaacaaggaagaggaggactaaaaggaagagggaagaggaaagaaaagaagggaatcagaaaatgacaaacagaagaaacggtgaagaaaggaaggagaacgaattgggaagaaaggatgggctggtgaatgatatggaaagctttttccgcatttgatggcctcattaaggccaatggaagcggatgatagggagggggaaggaaaagcgggggggggggggaagggacggagggatggaacccctgggaaaaatcattgcctttacgcattccgaagaagcccaaattgggccctaaaagaaggcaatgaacggacggagaagcaaagggagcggaagagcagaagagcgaatgatttgcacaattagaaaaaaagaaagaaagtgcatttgattaatgaatcatatttgttaatttgaggaaatgaaattcagggaaaggatggaaattgaagaaaattaagcggaggagggggggggggcaatttgacaattgagaagggtggaaataatgggggaaaggcacaaggaaatggagacagagcccggggttttgtatgggaaggaaaatcggcttt

SEQ ID NO: 2560 - DNA, 1807 bp, Heterodera glycines
caaatttcgtaaattgcttcattgtccacctgaattataaaaaattgccagaaatgcatccgatcagataacggttgaccagaaaggagcagtccgaatattccaacgtcgtgtgagtgctgagcaccgaattgtacggttcgaccatcgcttttcggggaatggggcgaatacggtaagttacggtacacgggaaggaaacgaaagttatttatttattttcttgtttaaactccgtttctacaggtggaaatctgtggtgccgggtaaacgctgaattggagtttgcactttttgccaaaatccacggaaagactgaacgattttttgaaataaaaactgtgaaacggcgcagcaaaccgttccatcatcagagaagtgaagccggaactgaaaagggggggggggtgaaagaggatggatgaaggagaaaaggagggggggggggactcactgaccccgtccctccgccgaacgaatggaaaatcagaaagccctgcagactttggcactgttcggcgatttcttaagaacggaatggcactgtcaaatcggcccaacacccacttctgatccggtccattgtgacctgagttcgcaaattatgcccaattaattagctcattctcttctccttacatcgattaattccttgccaatggtataatgccctcgggcgtaattgttcgccgcgtcttctttgccagtgatcactgcaacagtttcagcccattaacacgtcaaaatgaatgcctcgacaactctcacattgttcgggatggaaaagctaaaaaaggaggtgagggtgtcatttcggcattttccgggggttggggtcaatttggcatttccaatggtcattttggcattgcaatcggatgatttgtgtgccattcgttctgttcacctgtctgtaagtgccggttcgaatttcgtctgaacaatcggaggatataaatgatgtgaattcgttggccaatcgcctcaccgaccaccgtcgactccaaatcgacgaaaatcgaccgtggcacgtgctttcctaaaatggcacttcgttgctttcgctgcctttttcacagatgacctgagggcgtctcggagaagaaagtgttgtacgaatggtcctcgacgccaacactacgccaaacattcgtttttttgaatcaaaagcaatcggcccccatttccttttcacctttcgtcggtcggcattcgcccgtcgggctaaacgcaattcaatcgacggatggctaattaattagcctaattaacccgcggcacttccctttcacctgaatgccatgctcaaggcaatacaactcccagcacgccttaaccgacgaccgctgctcaattggccacccatcaaaagtcactcacattgccaatttgaacccccgcttggcccatgtgcagcgaaatcacttcgcgcattttgccacccacaggcattttgaattggaaaaaacaataaacactggaggagttaaaggcccaaagcaaaatgatgacaaaagaggcggcgaaaggcaaaaatagacaaactatcggacaaatgggggagggagaaaaaaggcgcctgaagggattcggacccagcggagtaatttagacattgccacagggaagcagcaaaaggtcgtcatggagaatccccgcaccaatttaaacgagggaatgaaaggggagggaaagtaatcgcaaaacaattggacaaagggaatgaccgcagaggaaatgtaattaagggcatagcaaaacaagcggagccatcattgaatttcactttttaatttaaaagatcggt

SEQ ID NO: 2561 - DNA, 1401 bp, Heterodera glycines
  misc_feature (1381)..(1381): n is a, c, g, or t
tgaaaaatattccgatttttcttttttcacttgacatcttcctgttggtgtttgcgtttccgctctccacgacttgacttttcggaggagctgggtgcgtcatgaattcgcaagggcaagtcaaactcttggtcagcgcccaaataggaatcgcaaatgaagtacagcttgaagttcgacttggaactttgggtgggcacaaagtccagcacatgttgggcttttacattgacagcaagcctgaaattaggatgtgaacctacagagaaaattgaagctgaattgccttttaatggagagcagttgattggtgtttggatcgccgatgaccaaataccatccctcttcgagattttcagggctgtaatggtgtccgtagaagggcactcgaccggccgggtaaggataacgagggaagaacggagcaattacaggcggtgcaaacccgttgaaatcgttttcacgctccaaatcaatccgaatttccacgggttgtcccctaaatggcaaatcaaaatttaatgttccaactgaattgtaataaaatgatcatcactgacactgtcgacttttgcgtggtaatttcatgtcggacttcaatgctcgggtaattgttacagaagacggcaatatccgcaagctgtgcctgattcatttgcaacagctcgtctctgtcctcatcattgagctcaagcagttcgaaaatggattcgactttctaaaagaatacatgacagacataacaacaattgctacacaaacatcactctcactttttccttgcaacgttcaagcagttcaggcgtgcagtggggcaattgcttcatgtacgactcgtttgaatacatcgcttgagtgagcatttgggacaattccatcgcgtggatggcgggcgaaagccaaccgttgctggaatttgaagcacaaagttgattttcaaagtgaaaactaatttaagcatgcctcgaaagcacatcgacacacgcctgaacaaggcgcaccgttttcagcacaatccaatcagtgtctttggtcaactcggcgctcaactgaatgcgcattaaatgcgcatggagcagcaaattgacctgaacgaggaaacaaagagtcaatgtgaattggatacttcaaaatgcgcaattcccactttgacttgaggactgttccacttttggttcttcatctgtccctgaagtcggtcggccaacttcttcagcgtcacttcctctttgtgccgaattgggagagtgctgaattcggtggcattggacacaatctcaatgagtgcccgcaatttggtcttcggtttcaacgacaatgagaaaagttctgaaatttaatgaagtaataaaatattaaaaggcgattttctaaccgatgngttgtgtagctaacataata

SEQ ID NO: 2562 - DNA, 3355 bp, Heterodera glycines
  misc_feature (71)..(71): n is a, c, g, or t
gcataggtcagcagatcgacggcaagcgaacgagtttgacgacgggttggcacaaaaacgagcacgggctntggttcaagtcggccaccgtgccgaatcaccgccgagtaaatgggccgaaccatcgcagcgaggcgagtgggcgtatgtgacagattgaacccctaaagcacaaaccgacaaatttaaagattttaagtgtatttgaatagtacatcaattcgtaagtctaatggaactggtcgcgcatttggagcaaaattgaaaagagtgcagccgagccaatgggtgacatcccggccattcatcaaagacgtggaaagtgcgacaattcggagtttcgagtccaattggttgcccatataacgcatccgcgaacacaccacctcgagaactggctgaaaataacgaaaaggcattagatttgaatgtgtatcatttttgcttgccccgttgctcgctccgatcatgtgcaaattgtccacgacaaacagtttgactttttgcacgtccgaccgattcttccaacggcgggaaatgttgtcccaacgctccgcagtggtcaccaccacgtccgcttttttgagaagtttaatgtccaccgatggttctccagtgagcagaacaacaattttcttcaacggagcagcaattcgttcaagccaatcgaaatagagctgaattggtcgaattattttaataaagaaaacaaattcgaaattaatacatttttggccaagtcatccaacggcgtgcagtaaaccgccttcgacccaggagggttattctcaaagtggcggaggagagcaaactcggcacaaacgccttttccactgccattcggagcaccgatcaaaacgttttcattgctttcgtagcaagttcgaaagactaaaccaaacaaattgaatttatatctattaagtaaagtgatggttgattatttgccttgggtttggatggggttgaacaaacgaattccacgtttcgagaagattgcttcaaaggtcgcgttgttcaacgcggacaccggcaacggctgcaagtccaaaagttcggtcggaggaggatatttctcaggcagaattaaatgacggaatgagacgggcaaaacagtttcactgccaagccatcggtccgatacaattcgaatgaaatataacggcgggagagggtcgaacacgggcacgaacatcttcaccacgtgctcctcttcgcaatattttctgaaatattcattattagtgacattattaaacaacaacctatttattgtactcactgtttgagcaaaaagtattcatggtgcagaataatttcgccgttaacgtcttcgacgaaaatccaaaatccctctgagcttccatgaaccttttcgtcccattgaaaatctggcgtaattgtcagttccacgcggagagttgaacgagtgattggcaaaatcaaagtggtcatgtcgagcttaggaatctgaaaagcgaacaaatgcaaaacaatagtcgtaaatgggcgttatcacctgtcgtatgaatttgtacaagggtttgcccatctttggcactcggacgagttcgcccaattgatgagcgtccaaatcgtacagacggtcaaacgataaatttttcttgtccaacgtacgtacaatgtctaatggcagttttttgaattgatggagagggttcaacgattgccactggcgagcattgaccattttgcaaagaccgagcactttctaaataattttttttgtttagttttagtttgaaaaaagagaacaccaatgccagttgggcccatccacgccaaagaacgatttcgaagagagctcggaagagtcgacccgcggattgggagatgaacaccatgtcactttgaagcgcaaaaccctccaatttgagttgagaaacatatgcctaaatgacaatgagaaaacgcatcatttgtataaagatgtaaacatcatacttggagcaaaacattgactttggcacttggctcttccagtgactctttgatgggtatcggcacacattcggccaatttttgcagctccaacttttcctcctctcgcacatggatttgtttgaactcggatgaaagcgaaaaaatgcggaagaggtcaatttcagtggccgtttctttaagcagtttgttgtaagtctccatactttcgtaagtacagtaataatgcgaggcaattcgacccaattcttgtgcctaaactcaacgcaaaagaatattccagcaattcttgacaccgataaacctgaattaagccagtcttcctgtcgtatttgatcagatttcccttgtccaacagcaaacaagctgtgtgaatcaagtcagcccgcggtttctccagcaatttgtcattttcctgaggaacagaagtttggcttttgtgtgtctaattgctccaatggacttacatctgcgacaattccgtacagtgctggtgccttgcacattcgcacgtgtaaatatgtgtaagtgagccattccatcgcttccacaacgtttgtgacagttccgagtacaatttccgcgttaagagtgtctggcaattttgcaaccaattgactttcgatcggcaactgaatgaaaaagttttcattacgacaaaacccaaaatcggtgtttgtaacctgttggttcatcaacgacagataatattgcagttcggtgttgtgggtcatcaaaatgccttttccgagtgcgttatgttgaggacgccctgcccttcccatcatctgcataatatccaatggaccgatttcagtccaagcacccttttgagggttgtaaatttgagtccctttaatgatcacagtcctaaaaaagagaataattagcagtaaatggtttattctgtacaaaatggctatgtttcacggttattaaacttactgagctgggaggttcacaccccacgcgagggttgcggtagagaccaaaacctaaaattaattgaacaattgcaatttgaatgaaaatgtggaatggagaacaacaaacttgaatgtggcggtcggcgaagagatcttccaccaaggatcggtcgagtctgttcatccccgcgtgatggatggcaaatccatagggcagcaagtccttcaggtcaaggttcttcgcttgttccgcctcggtgcgcaaaacttctgtcgacgcgcttccctctcgcaaaaatttgctaattgtgtcgcgttccaaacaaacgtcgcgcaatgccttcgcagtctttgcagtttcttttcgtgagtgaacaaaaacgagaatctgtaggaaatacgcattggaatgcactttaattggagtatagtttacaatggcatcgcttaacctccgccccctccat

SEQ ID NO: 2563 - DNA, 1515 bp, Heterodera glycines
  misc_feature (16)..(16): n is a, c, g, or t
catattttcagcatcntgtagtaaaaattattatcgaaaaaatgatgataatagggtgacatttttttttcttggaaaatcaataaaatgtaagatgcaatattttaaaaatttggggtccaaaaaagaacaaatttttcaaaaacaaattcttacttctcaccaaaaaatttttttttttttttgcctttttaaaaccgaaaaaggaaaaatattttaaatttttgccttaatctggccaaaatttgaaaaaaatagatttattaattaattctaaaacttacgagctcatcaacgtcctttggtgcttcaaaatttgtccatttttgtgtcgttgtgcccaaatcgatgccatttaatggcagtgaaatttggcccaaactttaaaaaaaaaattcaaaaataatttttaaattttattttatttttaaaaataaattaccgatcatctttgctaagccgatcaaaatcataggcaacaatttccaacgttttgcccaataattcggaatacggaagctaaaattttaatagaaatttaaatttgtaaaatgtttatttgactctttttttgaaatatttcatcaattataatagattgtataaaataatttatattaatttaataaaaattaataaatatatgaattgaaaacgaaaagtgacaaaaatttcaaaaaattttttttaattaaaaatgtttttgatctgagatactaatttggcaattgccgagatttcttaacaaaaaatgcccttaacttgagcaaattatttatttaatttatttttatttattaaaactcactttgaagatgaatgtctcattaaaaacctgacaaaataaaaaattttttaaaaaatttaaaaattcaaattcaaaaattcaccgggtccaaagtgttccgtttgattcgtgtttcaaactttggctttctgtctggcaaaattgttactttgatgtacgggtcactaaaaaaacaaaaaattttttagaaaattcatcaaaaatgccatttttgcctcattccgttacggtccatggctggcaaatttttgcactccaaaatggtgaccatcaactaaattcattttctgtcattaaaaaattagaacaagaaaacatgattggtaaaattaaggacagttgattaaaaataaggacatttaaaggacttggccttttcagagtcggggacaaatagggaggggctcagccgtttgggccaaaaccaaaaaattgtttttttttaaacttttaaatttttgaaaaaattcctttttccaccattgagaatcgttccaaaaaaagaaaacatcattggtcgaaaaataaggacccgctaactaaaaataagaaggacattcaaggactttttattccattttagatgctcgagaatcgaaatatgcaacagttttttggatttcattttattatcgaattttcttggtattgaagtcttgatttccgatgcctttttaggcctttaaaatcgaaaattccccaaaatt

SEQ ID NO: 2564 - DNA, 2132 bp, Heterodera glycines
cgagggtcggtacttacccctagctttcaaatccttctgtttatttttattttttaaataaataatttcaaaaattttgtttaagtagaaaattttcaagaccatgaccccgaaaaatgagaaatttctcgagtcaaaaatctcgaaacccgaaaattctcgaacagcctatgatttttttaaaaatttttttccacctcatccattggtgttgaatgcttccgcgaagacggactctgctgtgagtatgggagacagaagcggaaaatgcgaaacagtgcatttttgccgcacaccgttgtcataaaaccgccaccaacgcggccggcggaagagccggacacagtgccaaacatttgttttttaaataaatttttgaataaaaattgaaaccctaaaaatccaaaaataataaattgttcatacatatttaaaaatataggttaattcggataaatttgaaatttaaaaaaaacggattcaagtgagccaacagacgggaggtgagaaaatatttttaaaatttcgaaaaattttgaccaaccctcgaaaaaatttaattaatttttgaaaattgaaattgtaaccagcgatttagggggcaatgttaattgaaggaattttcaataaaaaaaaaatctaaaaaatagatagaaaaatttaaaaaaatttaagaaaaatttttttgtttttttttcttacctaattaaacatttctttgaaatatttaattatttttttcaaaaagaaatcaggcacgaattcacgaacaaaataaagtttttttttgacattaggagaggcgcgtgtgtaacctaatggcacaaaatgccaagaatgtttagcgaaaacaaatgcggaggatagggagacgggcactttccctagcagagagaatttcaaaaaaaaaaatggaacggaatgccacacgcatacacaaataagcgaactctctctctttttctgatgggttgggttgaaaatgccattcaatataaaaggtataattaaatataaaaatatatatttatacatggagtttaggactcccgaattttttgtgggccattttgatttcggggaggagagagtggattgaaaatgaatttttggaattttttgaaaatcgaagaaattgaatttaaaaaattttctaaaatattcggaaattcggagacgatacaaaaaattgaaaaaaatttggaaaaaaatattgggaaattcggagacagtcaggcggcataaaaaataaaaaaattggggaaaaaaaaattcaaagacgacgaggcataaaaaatttggcaaaattttaaaaattcggagaaggcgaggaacaaacaatttttgtaaaaagctaataattcactttttaagcaaaaaacatgaaaaaaagagatgcaaaaatttaattgttgctgaaaaatgtatttgtaagaaaaaggagcggaaaataatttatttaagtgatgctcaaatggggggtatttgagcagccaccaaatttattggttgaacaaaatgtcctcaaatttctaagtaaaatttctttaatttatttttctaaattttttgactgtaaatttaggaaaatttgaaaaacttaaaatattttctatattatttagataaaattgatgggaaatttaaatactttatatttaaaattttattaattatttttttacatttttattggtaaacttctatgtcaaatttcgagaaaatatttagacaaacaaaagaaattgtgtttaaaaaaatttcagtaaaattaatgcattttttaaacataaacgacaaaaaaagcaaaaattaatttaaaaacatttaaaaaccaattaattcccaagagaaatttaaaaaattaaattcaaaaattaccaagaagttttctttcttcaaaaaatttaatttaattcatttttttattaacaggtttccaaaaattaaatgaatattttcataaacaaaaattgaatttctgttaaataaatttaattatttaaatttaatttaattcatttttaattttttgttttacttttcccaaaattaaaacaaacatttacacaaataaattcattcaatttcatttaaaaataatttattttttatttaaacatctttcaaaa

SEQ ID NO: 2565 - DNA, 2432 bp, Heterodera glycines
aaaacgacccattttgccaaaggaacgtttttttcccccgttttatccgctccaattttttcaaattttttggtttcattcaggaaaaaaaagggaatatttgctttttttggctttaaagcgtgacattaaaaaatcggaacagataaaaaaaatgacacattttgccaaaagaaagcacaaaaatgggaatttttttcctttttatccgctccaatcttttcaaatttttggattcattcaggaaaaaaaattctttgcttttttgttggcttctctgcggcatttaaaccggattggattaaaaaatgacattttgccaaaagaatgtacaaaaatttgatttttccttttttgtccgctgcaaattttccaatttttggactcattaatttaatcggccggcatttatctgctgatgaaaggggcaattaattaatggcttcttagaaatgctaacagtaaacacacccacacgaattcgttttgcgcaccgggaaaaagagaagaaagacattttggagttattaaaaaatgggaaaaaaggtaaaaatcgaattttaaaaaaagcggaattttgcagaaaaaaaaacgattactttttttaacacttgcaaaactttaaatttcagaatttaaaaaaaggaaaaagttttattaaaaaaacaattagctaaatcgtttttattaaagaaacaaatctttttttcatggatttaatagttttaaaatttttctcatttttttaatttcaaaaataaaaataaatgccctaatttaatggtaattatagtaattattgaaggtaagaaatgattttccttatattaaatgttgatgtattttatttatttaaaaaaatggaaaaattcacgtataaaattttttttccaattaaaaaataaaaataaatgccctaatttaatggtaattatagtaattattagggcggggatttatatggacataaaatcgagaaatatggccataaaatatggaccaaaagtcgcgaaatatggacataattttttccaacttaagggtataatttctcaaaagttctttaaatttttaaatataaagtaaaaccttcaaaaatggctaaatatggtattaaaatcattttagaagaaaaaaacatgataaagctaaaatttactaatttttagcgcaaaatcaaccacaaaagcgaaattttcgcttttttgcttatttttgatataaatttattaatttttaagaaaatttaaatttattcaatattctcgagaaattttggcgaaaaaatgattttttgaaaaatttttcggtttttgggctcaaaaaggataatttagctgctggggccgttctaatagaggtttttttgaaaaatgccaaaatatggacataaaatatggataaaaatgccaaaatatggaccaatatggaaatatggacataaatcgcgaaatatggaaaaatatggatatagaaatccatcctagaagctccaaaccaagctaaaaacatgttttcgtgcgtttcaggccccctacagtctaggaaaaaaatatggatttccatataattccccgccctaatgatgatgatgttattttgctcccaaatttacacaaaattggcaaacaaatgcaaattattataagtaaataaaaatggaaaaaaaacatccccgcggggatgggactttcgtcgaacggcggacaattggaattttgtcgaggacaaaacgattgacggtgaattgttgctggagaatggtgggcgcagcacagacagatgacaaacaatttggcagcaatacataacaaaataatcaggggacagaagactaagaaaaggacaacgaaatgtcctaaaaaaaatcaatgagactgaattggaagttgaacagaatgggaaatcggctcttatgcagtttaaccagggctgccatatcctgaggctttagcctcattttgtggttttttgataggtcaatgaggctaaattttcaaaatgaggctttgaggctttttgtggttttttgagaaattttgaggctttttgtggttttttgagaaattttgaggctttttgtggttttttgagaaattttgaggctttttgtggttttttgagaaattttgaggctttttgtggttttttgagaaattttgaggctttttgtcgttttttgagaaattttgaggctttttgtggttttctgagaaattttgaggctttttgtggttttttgagaaattttgaggctttttgtggttttttgagaaaaaccgcaaaataaagaattttttaatgaaaatatggtaaaaattcttaatttttcccccggcggcgcctgtcggcaccgccggaccgtaaaaatccttaatttacaagcaactaatttgcttagaatcccaaaatttggacattttccggacaat

SEQ ID NO: 2566 - DNA, 3352 bp, Heterodera glycines
  misc_feature (42)..(42): n is a, c, g, or t
  misc_feature (52)..(52): n is a, c, g, or t
  misc_feature (60)..(60): n is a, c, g, or t
aaataaaattaagcttttacagagcgcaggtcggttgagtcncgcgcacaanctgagtcnctgttgtgaattttgaactcatttttttgcggggggcgggggtggtactgaaaaatgaggcataaaaattataaaattaaaggacaaaaaggagctttttggtcttatcgtcattttattcagtcaaaaaaagactggctttttgtaagtccttgaatggtcctgaactgtacttgaaaatcagaaaatatgtaagtccttgcattgttttgaaccagttttatagtcagtccttgaatggtttttagtcagtccttgaattactttttgtatgtcattgaattttctttatctacatttgaaaatcagttagtccttgaatggccttttgtaagtccttgaatggtcttgaactatgcttaaaacaactctttgttctgtagattaaaaaataattgcttttttgaaatcaaattatagaaaatgccgttggaaaatcgtttttaaatttggtttgaatttgtcggcacagaaaaaagttatgacggattaaaaaaagataaatgtgaaataaaaagtaattaaagtggtcccattaaaattattcatttaattgattttgcacgctaacaatgatgatattcaattgttgaaacgtaaatttaatttttaatttaatttaatgacaataaaaaatcggtacaaaattaattaaatttgttgataaatgaatgatgcattttgttaatatgccattgaaaatgaacaaaaaaaaatgaattatttatatgcaattaattgtgtgctttaaaaaaacaaaaaaataaatgtcaaattaaatattacaaaaaaaacccataaaaaataatagggcccggattttgtgaattaaaaattcataatttttggtcaaacaaaactttgacacataataatggccgagattcacaagaggtatctttgtgtatttttgaatttttgttaagtatatatatatattttcaaatcaaaatttccaaaaaaaaaaaaacccaggttccctaacaatccctcaattttttcacattcgcaagtgtgaaaatttttttttttgtgtcttgacaagaaaaattaataaaaaattcgctattttttaaattttcgcacatttttcatgtaatttcaaatacgacagggcttatgacttttttttaatttaaaaatcccgaaaaaattttcaacaactctcgccatgcaaaaaaatgatgatgctgtgagattgatgcttgaataatgatgacggaggatggggggagggagggattggaggataggaatttgttatgcgagaaaagtcaggagggcctgggcggcacattggcattggcacggaacaaaaaaaaaaggattggccaaatgatgcggtagtgccaaaaaaagggacgcgtgaaaaaatgtactaagcacacagcggaaggaatttttggcaaaattatgaatttttaaatatggtgatgagttttgtgttttacaacacccaaggaaaaaaaataaggaaaattttagtttttcattaaattttagggagttgaaaaatttaataatttttaatagttataagttattaaaaagatacaattttaagatttttttaaaattggtttttttattttttaaatggagaaaaaaataaaaaattcgttttcggaaaactttagagcgaatttttgttattttttgataaattttttgtaatctctaatttgttaattcgccccttaaaattaaatttaataattttaatttaaatataacttttaaaaattaaatgtgtaatgaaataataaaactatttattgtacaatacataattaattagttatttttgtggtgtctacaaaaaacggaagaataaatccaattttaaaaaaaataaaattttatgaaaagcaaattaagaaaaaaaaaagtaagaggaaggaaatgaatgaatatgaagtgatggaagaagaatgaatgaattaaaaatgaataacatgcaaattaggggaaggaattgttaattttttgtttgttttttttcttagaaatgcgcgattattattttttattttggattttttttactttaaaattgaaaattttatttataaatataataaaaatgcaaaaattgttttatttggagtcgaaagttcaacaaagtttgtttgttttttttatttcttagaaaatttgaaaaaaaaacttcgttaactgaaatactttttttttgaatttataattatcgaaaaatttaaaaatttatttattttaaattcaatattattattattttttgaatttataattatcaaaaaatttaaaaatttatttatttattttaatttcaatattatttttttttttggttaggattagtgatttttgttgtcaatattaacaaaaatactcatctccatattaaaaaatgaaaaccctttaaaataaaaatttcatattgctttcaaaattcgaataatgcaaattttttgaattaaaatttattaaaacaataaaatttaaaaatgggagatttttattgttttctgtgcatttaaatgcattagaaaattttgaaatggccttaaaataaaaaattttattgaggaggggaatggaaatcattattagttttatcgacgacgcatcagcggaacgataaaacaaatattttttttcgataagcctctcaattcttatgttttaattattattataatttaattgcgtagcaaaatggaattaattagaaacaaaaaggttttttgtggctaatttataaaaaaaaatcgggaaatttttaattaaagagaatattttcttattaattttgatttgtatgattttgaagaaaaagaaaaaaaagcgtttttaaattttataacttttttcaattctttgaaatattttggcattatatacccttttcgaactaggttgaaaaataatctcccgtctctatttatctcaccggggggataaatagaatttttttttttggaaaaatatcttcgatttttataaaaattaattaattctaaattggaatttgtttcgagtttcatttttaaactttcttcaaaaaagagataaaaaagacctcttgtaatttaaaaatttcggattttctagtattttaatttgtgaaagttcactttcaaaaaacggcgttctgaattttttctgaaaaatcgcaaaattccaaatatatggaaataaaattctaccaattttcttcattttaagctttattccactaacattgtccaaccctgaagtgaattttgagttccaaaaatttgcataaatttcccgggctcaaaaaagaaaa

SEQ ID NO: 2567 - DNA, 1816 bp, Heterodera glycines
tttttcattttttttatttaggacgattttaattcagaaaaaattgtgtttttattatttaaatatttaataaaaatatataatttttgcatgggagacgaataactctttctccagtctaattcggcatttatactaacaaaaaattttttttgtttcactaaaggcatcatttccgctgccatgtgttgtgggtatgtgtggaattggcattttttcatttaaaattggcactcttttttatgcatgtacttggcattggcattttgaggggggggggggggacatgaaaacgaatatttccatatattgtgccattttgtttgtgggcttggccttctaaatttcacgccccgtctctgctgtttttgactttctcctccccaccccctcccctcgggcgctaaaaaaatccaatttcgccaatttgtgaatgtgccgatgccgtcgtcgcctatttgctgcagcacattcaatttggcacaaataaatggaaaaaaaaattggttcccttttattggcacaataaataaattagcggcggcggcggggtgccgtgccgacgacggcagaccccagcagaaagtttgcaaaaacagcaacatgaaaaaaatgaactagacttccccaatttttgtaaatttttttaacctagccgaacccctggggcctgttgaagaaaatcatgaaaaatttatatttgtgtgcgtgctgttgacttatttttcgtgcttttttgtggtgtcatgggtgttccgtataacgaatgagtttcgtacaaacagttttttgaggattttcaaaagagaaaaataaaaaaaatttttttttcaattagttttttttttttggtttttcgacatagattgaaaattatttgatttttttttttgtaaaaattctaagttttaattgaaattctttatcttttctttgtaattatttaagctttttctagttttgaaaattgattctgatttttttttgagaaaaaattctaacttttaacttaaaattaaaaaaaaaaaaattttttactaactgctattgaattgttttttatgtgccccctatttataggatttttttttgtgtatccttcagaaatccttcatttataaaaaaacctattttatggcgttttgtcctacatttatgaacaaaaaaacgtaattatggtaaaatatagcaaaaacgaaaaaacaaagaattgaatcatccatcgattcttcgttcgcactttcttcaaaaaacacaacgccgcaccgcctgcacaaagtcgtgatggcatttctgccgttcggcatttgttgccgccctgaatattaagtgtggcaattaataattagaattattgtaattagaggagtggcctggtggggcaaaaaaaaaattttttatcaaaaaatgcccaagacgaatgtgccgaaccacacaaaaatcttggtcttgacataataataacgcatgcaatacgttcacgctataaaaaaaatttttttttttcaaacagaaatagttaaaataaataaaactttatgaaaatttcgagggaaaaatttttttgaaaattttttccagaaaacacacggaaaataacattttttaaaaatttctaattaaaaatttttctagattagaatttaaaaaatatatacaaaaactcacttaaacaaattgtgccggtaggtcacgttcaactcactcaattcgttcagaatcgcatgaactggaaaaatttaaaattaaatatggtttttagtagagatcgacatttaaaaaaaagcctgaacctggattttttgaaatttatttt

SEQ ID NO: 2568 - DNA, 2180 bp, Heterodera glycines
tcaaaaatcggtttgaaaaaattaattaatttgcttagaagcatctaaaaatatctaataaataataataatgtgtttttaaatttatttaatctgtttttgaaaacttgaaaaaacatcggtcacttgaaaaaataaattctaaaattttgtccaggtaaatccaggttttttcctgttttgcctggacctggatttttttttcacatttgacctggaccttgatttcctggacaaaaaaccaggttgtcgaaaaatggcctggacctggacctggatccaggtccaggccgagctctagtttttagtgttcctaaaatttctaaaaaaaaattaattttttttagtccatttgtccggatcccgtcgcccagacaatccgtcagtggaaaattcgtcagtaatggacaatccgtagcagattttttttagcaatgattaaaaatcttgggattgttcaatctaataaaaaaaaatagatgggattttacaagatttctagttaattaataattcaatttttcataaaataattttaaaaataaaatcccgggtctcgccgccgaaacgtcgccgggacaaaacgccgcgcgcggcaaaaaaaaataaataaaattttttcaaaaattttaagaaaatttttttgaagattttttttttgaaaacttaggtgttactgaaaataaatttcaacaaaaagaaaacttgatttttttcccttttattattagtcgatttttttctaatttggctagataacttaaaattgctggtatttttttgaattctttttcaaactttaaaaaaataataaaaaaaatttttgcgtcgacattttgtccggcgacgcttcggcgctgcgacattttgtcctgctcccgtctgtccccaccaccttggtaccgtccctgtgtcctactgtaccgcccgcccccgttccttaccgtaatttgttttggcaccaccatcactacggtagttcttgcttttgtgaccagtgtcgttgatggcacggttcacataaaagtgcatcatgtgctgtgcccggtattgttgttgggccccgccggtggtccacaaatgcatggcgaacagcagcacatcgcggaaacggaaattggtcgggaaaagcgctacaaacaacaacacacagaacatggaaatgaaaaaaaaatgtttaaggaaaaaacaaaaaatggaaaaatcagttttttccaacaaatttctgattcgaagaaaaaattttccaacgattttttggaaatttttttgagaaaacttagtaattcatcattaaattttgaaaaattgttggaaaattttttgaaagttttttttttcttagaatcctaagaaaaatttttctatgatttttttcttgaaatttctaacatttattcccggttgtatctgatttccgaaaattttcggggtctcggaatgccatccctggtctgcgcccgctgggagactcaccgtgggactgaagccgcttccgaacgcgatcattaggctggtgaagcggtggttcttcagcaacgagactccttcaaaaatacaaattagtaaaaaaaaaaaagaaaaatggaatgtcgcgtaaatttttagtttttcccgtttcataaaatttctcttctttaacagtgtgtgttttttttctcgatttgggcaaaattttactaaaaactgcctcgaccactcgttggatttatatataaaaaaattgctgaaaaatgtttaaaaatatgctcccccttgaaattttgtgttgaaaaaaatgcataagatttttttttgaaaaaggttgaaatatttttttttaatttcgagagcaggaggtggggatgggaaccacccctcttttccaagacaatttttttcctgaaaattttttagttttattaccctccgaagcgtcaataccaaggtttttttgtaaaatttttttcattgatttttgaaagttttcgaaatttttttttcatgaaattttcttataaaaattctaagattttttcttgaaaaaatttcaaagttaattttatttcggcggcgaaaattttgtcctgctccagacgggaagcatcattcttctcagagacagattttcagaaaaaattcgttttatttttcaaattacccaccctccgtagcgccaaatttggtcggccgccacaaag

SEQ ID NO: 2569 - DNA, 5900 bp, Heterodera glycines
  misc_feature (5868)..(5868): n is a, c, g, or t
  misc_feature (5877)..(5877): n is a, c, g, or t
catttttaggtagaaaagtgcagaaataagagaaagaagacacaatttgtaaattattaaggagtggaagttgcattttaaaaagtgcacgaacttgtcatttttaggtagaaaaatgcataattaaggagtgaaaatgcatgcagaattaagcaatggaagttacaatttgtaaattattaagcatttgggaacgtcatttttaggtagaaaagtgcagaattaagcgaaagaagacacaatttgtaaattattaaggaatagaagatacaatttaacaaaaattaagaaaaataatgattaaatgaaggaattactcaaaacatgtgcgtgtgtatgcgtatgtatgcatgtgcgcgtgtgtgcgtgtgtgcgtgtctatgcgtgtgcgtatgtgtgtgtattgtatgttttttcgagggtgaggataagtgtgtttgaaagttctgcataatatttattaacttatataaaacttgttaattttaatcataaacacaaacaatgctccttgcctaattcaacgtaaaataaattctaattataataaggaacatttacaattccattgaataagtaatattcaaaggaaacaagagaaatagacaattttgaatctaagattgaaccgagaatagaaagtagttttgacaaacagctgactgactgtatgtgacgagaaagggtagataagggctaaatgtatgcgtgaagcaggtcttgtaataggaataaatgaagaaatcatatgaggatattgtagtgcaccatagaatcaaggacaattaataatgggtgtaagagatagagatagagaactcagaaatgtggttgaagagagtcaatattaaatagtgagaatttaatgtgagttagtaaggcaaacattaggtaatgtatagggaagagaatagtttgataaagaacaagaatacgaacacttggaagataacggttcgagaataaaacatagtgttggaagaaaagatattgaaaaatagctaacggaaacgattatttagacaatatgtaggtctgaaataacagtgaaagtaagcagatataagagtagagaaagtgtattacggagaaaaggaaaataattcaaataaccccaataccaaaaatatcttaaatattggattttgttaagcaagcagttggcgttagcctctttccatttgttccttttagaggaatcgatttacaggataagatgacgccgtgacctcacccccctctccttcacttatttggtttcctcagctctgcccttcctctccaacacatattcggtcattattgctccttaccatcgcaaactcagtttacacactcccttttccatcctatgcgttttgccaaatcaataggaaaggtatattttattctcatataaattttagaccacgaggataacaatttgcataaaaataaaaattcatagtcaaaagaatgaagttttcagtgttccggagatcagagccttgcgaggtattggttactggcgggccaagcttaattaggtattggctaccggagagccgagccttgtgaggtattggttactggcgggccaagcttaattaggtattggctaccggagagccgagccttgcgaggtattggttactggcggaccaagcttaattaggtattggctaccggagagccgagccttgtgaggtattggttactggcgggccaagcttaattaggtattggctaccggagagccgagccttgtgaggtattggtgaccggagggccgagcttaattaggtactgactaccggagagccgagtattggctaccgaaaattcatcttttattattttccttgtttttatacatttctaaaatccttgcggctgtaataattagttacttacttaaaaaacgtttatcgctacccaaaaagttgcattctttttcagatattttagaattaattgccatatttcctagccatcaataccataactaagttaatctgtcaacaattatcatactcatttagtgttcatcatttcctttgtctcagcttcaagtattctgcttcattgaattacagcaaaaatgtggcatataatttaagttccatcataacccttctttccccagaaatattcagtttgtaaaaattaaagaataattggttataattataattaatgcagatgtcataccctattagcaattggagtattttagcatgggattcgaccataccaaaacacaaatgtaaaacatctcgatcaaaactttgttaataattttctcgcattttaatgattaattggttcttaattaaattacccaaaaattgatttaacaactgtcactattaattaaaattctttgattttttcatacttcccacttataatatgttcaatgcttcatcattaaattcatcaattactacaccttctcatctaaaaacaatggtatatagatagtgattagttgtgaatcatatatcatgtcgttacaaactgacactaattagaccttatggttgtcgaggactcattattcacaagcatatactagaaaccattcttggtaatttgtcataattaatcacataagtttgaagagtctcacccaaacgataaacttcctatgtaaaatcatcccaataaaaaataattaattcataaatttcccaaatttaataattggatgttaggagctgatagttagttaaacttacaccaaaccgtttcaaggaagataattaaaaatgacagttggtcaatgagacaattagcccactacaccgctactcaccattattggtaatttgtcataaatcattaatattatttctcacccatgccataaaattcctccgtaaaatcattttgacaaaaaaatgttattaatttctcaccatttaatgattaattgcttcttaattaatattacccaataattaacaactcgtaatcattgattataatccttgattactttcagatttccctataatattaaatgtttcctcattaaattccatcaaatacccctgccttcttctcactgaagaaaaggccagatggctaagccaatagtagtaagtggcccgtgaccgacgccgcctgtcactcctaattaatgtcaaacacgccacctgtcacttctaattagttatttttttcaattagacattaatatacatcttctaggtagcgctaattgcaggcatgctaaacatatccgcttacttctattgcagttctctctgtttccaactattcatccacagaataatgatcaatttgccaagtgttcagttgaaaagttattgatctagaaatatcgcatacaggccgtatactagtcatacattcctttagtacatcaatggatactaaaagacgctgcctttccttaataatgccttagttcctttgagacatcaaataattccctcctaaacgataccagcgctgtcattaaaattttgaatgtcattacattttttctcattaattgcctctgtaaatacaaattttccagttgagaagatagttgtggtagaatttgtacctagacccttcattatatttgaaagatttatgtggttgtttttagtggatggggatattaaataaattgaggagaaaagttttactatttattgtcagtaacaccataaattgaatttaattttagatataatttacttaattttaatcaatactattgtatttattatttttattatattttaatacaactttaatttaatttttttattttatttttatttaacttttatttttaattttaatcttttttatttttattttactttttatttgaattaatttgaattttattttactttatttattattcagttaatttaaaggagttgttcagaacctctatccaataaaggctatttcgccgctcagcacggcataaaaggtattttaaccgtgcaccgtttagcattgtatgatatcctcactattttcaatatttttacttgtttttattgtttatttctttgaaatttctattaatattttacttttgtagtgtttaatgcaatcaaagaacattttaacttgaaatttttaacaaaatgaacttaataaaatattagtagttaattattgtaaaatataatttattaataaataagtttaattcatttattaaaatctaaaaataatgataagaatatatgtatacttcatattatatatcattttattaattaattttcaatataaaatttctttcttccatcattaaaatgtttttgcttagtaataagtaaaaaattccaatgcacgctacccctctccgcctcccatctgatatgaaattcttaacgcttttttcttaattattattatttttttcatttatttccttatttttagctatcatcaccattattattattttactaaatttattttaatatttattttttctacaactcttcatctcttcattaggcttgggttatgacacaagtaccatttgccacccctccagtcgccacatgtcaccacacccctcaaataagttttgggttatacgaccacaatttggcaggttgccaactaaattgttcatgctatgccacactacactaaaatgagtcgccgtatgaccaacattttatgccatccacggtcagtcattagcgcttaaatgaccaccagcgggcactcagatagcccatgcgggcgcttaggtgacacgtgcgagcgctcaggtggcctggcatcccttccctccccaaaggccacgacagttgatgtccgtccctccaatacgatttgactttaataattatttaattaattaattttatatttcatttatttttaaatttttatctattattttaattttattttaatttatttaatttacctaattttaatttaatttattttattttaaatttaatttgaattaaatttaattttttaattaaatttaattttttaattaatttattattattattatttatatttttgtgtggtattagagagagcaagaaaaaagagagaaaagaaagaaagagagtgagagagagaaagaaaaaagagagagagtgagagagagataagagagagtgagagagaaagaaagaaaaaaaagagtgggggagagaagaagaaaaggagggggggagaaaggaaaagaaagaaaggggagtgcggggagaaaaagggggggggggaaagaaaaggggggggggaaaaggggggttttgggggggaaagaaaaaaaaaggggggggaaaaaaaaaaggggtttaaaaaaaaatggggggggggggaaaaaaaaaaagaggggggggggaaaaaagggtttttttgggggagaaaaaaaaaaaaaggggggggggggagaggaaaaaaaaaaaaaaagaggggggggggggggggaaaaaaaaaaaaagggggggggggagagaaaaaaaagaggtttttttttttgagggggggggagaaaaaaaaaaaaaaaaaaaaagatgggggggggggagaaaaaaacaaaaaaaaaaaaaataaaaaagaaaaaaaaaaaaaaataatttttttttttcttttttttttttttttttttttttttttttttataaaaaaaaataaaaaaaaaaaaaaaaaaaaaaaaaaaaaaaaaaaattctgtccccaccggccccgcgggggggagcggggggggggggggggggggggcgccccccgggggggcccgtggggtggttttttttttttttttttttttttttttttttttttttttttgtgtgggggggggggccccccccccccccccccccccccccccccccccccctcccccccccccccttcccntaaaaaaanaaaaaaaaaaaaaaaaaaataaa

SEQ ID NO: 2570 - DNA, 5692 bp, Heterodera glycines
taagttttgggttatacgcccaccatttggcaggttgccaactaaattgttcatgctatgccacactacactaaaatgagtcgccgtatgaccaacattttatgtcatccacggtcagtcattagcgcttaaatgaccaccagcgggcgctcagatagcccatgcgggcgcttaggtgacacgtgcgagcgctcaggtggcctggcatcccttccctccccaaaggccacgacagctgatgtccgtccctccaatacgatttgactttaataattatttaattaattaattttatattttttcatttatttttaaatttttatctattattttaattttattttaatttatttatttacctaattttaatttattttatttttaatttaatttgaattaatttaatttaattttttaattaatttattattattattattatttatatttttgtgtggtattagagagagcaagagaaaagagagagagtgagagagaagagagaatgagagagagagagagaaagaaaaaagagagagagtgagagagagataagagagagaaagaaaaaagagagagagtgagagagagataagagagagtgagagagagagagaaaagaaagaaagagagtgagagagagaaagaaaagagaaagagagaaagagagagagataagagagagtgagagagagagaaagaaaagaaagaaagagagtgagagagagaaaaaaaagagagagagagaaagaaaagagagagagagaaaagagagatataagagagagaaagaaaaaagaaagagagtgagagagagagagtgagataagagagaatgagagagagagagaaagaaaagagagagagagagaaaagagagatataagagagagaaagaaaaaagagagagagtgagagagagataagagagagagtgagagagagaaagaaaaaagagagagagagagaaaagagagatataagagagagagagaaagaaaaaagaaagatagtgagagagacagaagagatatagagagaatgaatattagcttttttattcaattattttttaaattataaaaaattttttttttaatttatttattttaatttataatttattttattttaatttaatttattttttaatcttttttttttatttattttttttatttcaattaatttgaactttaacttttatttaattttaatcctattttaatctaatttcatttattaatttaatataattttagttttatcaactttaattctaattcatttaactcgaattttatttttagcgctcaaatttaacaagtgggctcacaaaaggcccctgcgtgcgctcagatggcacgcgcgagcgctcaaatggtccctacgtgcgctcaaatagcatacgcgagcgcttaaatggcacacacgcgagcgctcaggtggcatgcgtcccttccctataaggcatgacagctgacgcctatcctctgcctccctttccttctctaataggatttgacctcgggttttatccttcagatgttttttcaattatttacctcttctgggattggatatatttattataggtgttttttaaaggtttaaatttggtactgaaatgtccctttccagtgggactgaaatggcggggctgaaaattaagggccaaaatctggtggggtaactactaaaaaagatggattatttgcttttatcaggtaaaaaaggaaacttaaataattaattaacaatgttttaatgcactgtcaaaaaaagtatcaataaaatgatttttattattttaaaacaataaatctaaattttaaataagccagaagaaatagaaaataaatgagatgaataaaataattaatttcaattattatttattagaattaattatttgaaataaaaatctcgtccgtcaacaaagaatcacagtgaatgcatgaatacaagagattatttatgattaattcataataaatttttttttggtttttataaaatgttaaaaaatgattttaaaaggaatatagtaatatttaaaaacacttttaaatataagaaaatttagaaaaattctctaatttggtaatgattttccaacaaaataaaacttattcatattttacgatgcaaagcgtctccatctaatattaaagtgaaaacactgaacttttacgagccatgagataaaataattaaaccaaaaaactggtaaaaattaattgttttcaaatgaaaaatgaaaaaataaattaccaatttttaaaaaaaaataaaaaatatattattatccagagtttcgatctcaaaattttgataattctcatttcatccataaaaaagcctcatttggaatgaaaatcttcattttttaaaacatcataaaattgcgaacaaaatcagtcaactgtcatatttttcgtttgaaacaaccaaattcatcaatttcttgtcatttataacagggttgccgcgggtccaaaaaatatcgggtaggtttcgggacgagaaaaattttctgcgtcgcgcttttttactcgattttccaaaaattttggggaaccggtggccggcggtgccgataggcgacccgggaaaaatttttgtaatttataatatgatttgttaacagattttgcccaaaaaacagttatttccaatttttggcaactttttttagcaactattttgggaatttatcagctttttagcaactatctaggcaaatatttcgcgatttttagaaactaaaaatctatttttttttgtataaaaaacaaaattttttatttgtatttaattaaaacatggcttctgtttcattattattgacgaaatgttttaatttgattatttcgtttaattaaattaaaaataccatagcatttttttgtagacttatgtttctttaatttcactcatttttcttttgttatttatttttttcgtatttattcaagctattttctagttcttaatactttttgttgctaattaatatttaaaagttattttgattggtttttttaaaacttttactaaattgtttttaacggaattgaacattagtgcctattttaaccattattgtcaacttcactcgatggtaaaaaggcgaaataatttaatgttttaattataaaaaaattaaatttacattattcttttcttttaaataaaactttgtaacaattattacagggaaagatatttaattgaaaaataattattatttttatcttaccttcgttatatatagtcaaatcaaaatttcctaatacacaaaaagataataaaatgccgtagccgaaggggaccgattatgctataatccacaggacggcattgtgctcgaggaatggcaagaaaaagcgcttaaaattcatcaaatgtgtaaccgtcatttataaatgcaaacccaatctaatttgcaacgaaataatgttttagactgcattcgcacttttttatttgcctgtttttttcttcttgatatatggcacaatcggtcccttttggcgatggcattttattatctttttgtgtagtttactgaccatgagaataacaattattaaaaaataataaatattaaaattattatagcacttctacataagttattaaaaaaacttaaatttgatttttatatagaactgattaggaaataattataatacaaattaatataattaatattttaaaaatataatattctatgaaaattatattcaaatgttaaacaaagaaataataaattctataaatttatagatagatattatattattatatgatttctagaatgaacatttactaaaattctgagatgttgaaaacactttatatattaataaaaaagatggattatttgcttttatcaggtaaaaaaggaaacttaaataattaattaacaatgttttaatgcactgtcaaaaaaagtatcaataaaatgatttttattattttaaaacaataaatctaaattttaaataagccagaagaaatagaaaataaatgagatgaataaaataattaatttcaattattatttattagaattaattatttgaaataaaaatctcgtccgtcaacaaagaatcacagtgaatgcatgaatacaagagattatttatgattaattcataataaatttttttttggtttttataaaatgttaaaaaatgattttaaaaggaatatagtaatatttaaaaacacttttaaatataagaaaatttagaaaaattctctaatttggtaatgattttccaacaaaataaaacttattcatattttacgatgcaaagcgtctccatctaatattaaagtgaaaacactgaactttacgagccatgagataaaataattaaaccaaaaactggtacaaattattgttttcaaatgaaaaatgaaaaaataaattaccaattttaaaaaaaaataaaaaatatattattatccagggtttcgatctcaaaattttgataatcctcatttcatccataaaaaatcctcgtttggaatgaaaatcttcatttttaaaacatcataaaattgcgaacaaaatcagtcaactgcatatttttcgtttgaaacaatcaaattcatcaatttcttgtcatttataacagggttgccgcgggtccaaaaaatatcgggtaggtttcgggacgagaaaaattttctgcgtcgcgcttttttactcgttttttccaaaaattttggggaaccgggggccggcggtgccgataggcgacccgggaaaaatttttgtaatttataatacgatttgttaacagattttgcccaaaaaacagttatttccaatttttggcaactttttttagcaactattttggggatttatcagttttttagcaactatctaggcaaaaattttgcgatttttagaaactaaaaatctattttttttgtataaaattatctaaatgaaatacctaataaaaatttattgcaaaatgaggatttttcgaaaaaatgtttaagatttgaagaaaaagttaaaacattttgccaaatatgcctaattttcaaaaaaatcatatcgtttttgtcactgttttatcaaaagaccacaaaaatactcaaatttctcaaaagaccacaaaaatccgcaaatcctcattttccaaaaaaatcctctttgaccctctaaaagaccacaaaatgaggaaaaatcctcagatatcgaaaccctgttattatcagcataaaaaaacttaattcttcaaatgagctatttattaaatagaaggaaatatttatttatattattaataatttatgcattaaaaaaagaagaccagaaatattcatttactatttttggaaagaattttttaaatatttcaaagtgtttacgctcactagtgatagcataattaaaaaaaaaaattattttacaatatatatttttggttttctttttatactttcaattttgtattaatattttattaaatttttgttacaataaattttgtttttattatcacatcgggatcaatggctaaataaaatatctactgctttcattttttaatatacttattcgtaccaaaagagatttttccgctatattgataatattttatttgactattaaaagcgacattcagtaaaataattatttatatgaaattttttcaaa

SEQ ID NO: 2571 - DNA, 1292 bp, Heterodera glycines
  misc_feature (1179)..(1179): n is a, c, g, or t
  misc_feature (1192)..(1192): n is a, c, g, or t
  misc_feature (1233)..(1233): n is a, c, g, or t
  misc_feature (1241)..(1241): n is a, c, g, or t
  misc_feature (1250)..(1250): n is a, c, g, or t
aagaggtacacagtgatcagaagaggtacagcggtgattaaaagaggtacaacagtgattaaaagaggtacaaaagtgattaaaagaggtacaaaagtgattaaaagaggtacaaaagtgataaaaagaggtacaactgtgatcagaagaggtacaactgtgataaaaagaggtacaacagtgattagtaaattcattaaattaaaatgaaaatattttttaacaaatttaattaaaaaaatacatgaaattctatcaattaaaaaaaattaatttaaacttataaaatttattcatcaaaaaaaaattaatttaaatataattttttatttattaactcaacaaaatgaaacgtccgattttgtgttagtaggcgaaatgaatgtttttgggattgatctattcatgacgcatcaaagataaatttcccatttttaaaccatcaatttaacatttccttttacaggtttaacacaaaaaattattccagtatttttgtcttaataattgtctgatcactagggcatccaaaaatatggatataaaatcgcgaaatacggccataaaatatggaccaaaaatcacaaaatatggacataaaatagcaaaaacatggacataaatttcccgaaatgaggggcaaattttcaatttttcaaaattcattaaattcaaataaaatacatttaaaatggctgaatatataactcgttttagaagaagaaaaaaagcaattttttgagaaaaccgaccaaaaacaaaattttccatttttttggaaaattttccggtcgttggtgtcaaaacggccaatttaactgatgggggccgttctaatagggttttttggagacatgccaaaatatggacataaaacatggacttaaaaccaaaatatggacaaatatggaaatatggtacaggaaaaaatggatttccatatttttggatgtcttactgatcactcatacattttttcatttgctccggcttttaggttttagctcatttttcctgatttcccagtgacttaaaacgcacgaaaaacaagttgttttctttggtggttgttaggtaagttactttttgtattgaatgagaagcaaatgaaaattgtttctttaaaactttttccaaaaatggagtttcaatcttcagtacccataattgttttatganatttctcatgaangttcaatttattaagtgctcatttaagttcaatttattagntgcttttncggtatcgnaaattcgcgaaatctcagaccgagagatgacactgagactct

SEQ ID NO: 2572 - DNA, 6007 bp, Heterodera glycines
tagaagaggtaaaatagtgattagaagaggtaaaacagtgattagaagagatacaacagtgattagaagaggtacaacagtgattagaagaggtacaacagtgattagaagaggtgcacagtgattagaagaggtaaaacagtgattagaagagatacaacagtgactaaaagaggtacaacggtaattagaagaggtacaacagtgattagaagaggtacaacagtgattaaaagaggtacaacggtgataaaaagaggtacaaaagtgatcagaagaggtacagcggtgattaaaagaggtacaaaagtgattaaaagaggtacaaaagtgattaaaagaggtacaactgtgatcagaagaggtacaactgtgataaaaagaggtacaacagtgattagtaaattcattaaattaaaatgaaaatattttttaacaaatttaattaaaaaaatacatgaaattctatcaattaaaaaaaattaatttaaacttataaaatttattcatcaaaaaaaaattaatttaaatataattttttatttattaactcaacaaaatgaaacgtccgattttgtgttagtaggcgaaatgaatgtttttgggattgatctattcatgacgcatcaaagataaatttcccatttttaaaccatcaatttaacatttccttttacaggtttaacacaaaaaattattccagtatttttgtcttaataattgtctgatcactagggcatccaaaaatatggatataaaatcgcgaaatacggccataaaatatggaccaaaaatcacaaaatatggacataaaatagcaaaaacatggacataaatttcccgaaatgaggggcaaattttcaatttttcaaaattcattaaattcaaataaaatacatttaaaatggctgaatatagtataataactcgttttagaagaagaaaaaaaagcaattttttgagaaaaccgaccaaaaacaaaattttccattttttggaaaattttccggtcgttggtgtcaaaacggccaatttaactgatgggggccgttctaatagggttttttggagacatgccaaaatatggacataaaacatggacttaaaaccaaaatatggacaaatatggaaatatggtacaggaaaaaatggatttccatatttttggatgtcttactgatcactcatacattttttcatttgctccggcttttaggttttagctcatttttcctgatttcccagtgacctaaaacgcacgaaaaacaagttgttttctttggtggttgttaggtaagttactttttgtattgaatgagaagcaaatgaaaattgtttctttaaaactttttccaaaaatggagtttcaatcttcagtacccataattgttttatgaaatttctcatgaagtttcaatttattaagtgctcattaagtttcaatttattaagtgcttttcggtatcggaaattcgcgaatctcaagaccgagagatgacactgagactctcgaataccataagataaataaaaaatattttcataaatcattgcattagaattaattgcaaaatttaatatttttccctcattattttataataaaattataatttatttaggggtttagatttatctaaaaagattcaatacaacaaatagtttaaaaagttgtggaagaaatttgttttgaaaaactaataaataaaagaggatagaataaaatctgaaaactaagcatccattctttcttcctccgttagatccatccatggccctaatgatgatgtgggtcgggtccactcggtgacagacgctaaatggcataataaaaagacaattactgaagccgaattcctaccttcgattcattgaccggcattttctcagcaagttcgcgtaggtgtgccctcattttttctaatcgatttgcccccatttcaaattgcacaggaggaggtggtggagcatggaaaagtgaattacagtagtatcatgttaacttggcacaattagctaccattgagcgattggtcacatgcgatggcaccaatccggcggcatttcctccctgagcattgcttcgcccaatcgcttccgccccacccgtcgccagggaagtgaagagcagtccagcggtgacaattcttttgatcttcgtaccaatcccagctgatgagttgtttccactcccatcattagcagtttcttaaagcaaataccaattttatgtcaattatttttagggttcatcacagaataaggatttccatggccaccaaaatggtgaactttgacacaattggaaggaatattcaaaagttatttcaatattttacttttgtcaccagtagaagccgagagacggaatgagacgacggccaaaagcacaatcagaaggattttgaaaatgtttggcattttttcggatcttttaatattttattactgtgccgcgttgatttggatgattttcagttaacatatggacagtatttatatacatttgctctcttttgcttgtctcgttggaaaacaaattggtttccgatttgttgatgttattattaattttcatatatttttctgatttcctccgacataatcgacaaaatcgtgtaattgttttgccacttttaatttttttatatttattaaaaattctgaaaaataatttaaaagtggcggattaaaccgctgggttgctcttcacttccttgttccaaattaccaccatacgactttaactcatttttaccaggctccaccgcctcgttctagtggtcaaaatatatacatgaatatgtaaaaaaaatcatgaaatatgtacaaaaactcaaaatatgtaaataaaattattgtaagagtctggatttgtaagagatttggattattcgtttaactgccgaagcgctaggatttaacatttacacatttaatttatctcacatttaatttcctttttgcttaatgtaccgccccttcccgacgataattgatcaatcacatttcactttcatttgtatttaatgttcgccatttttctctgtaatcactccagtcactccggaataatgccacttatcccagtaagtgtttccatcaaaggcgggatgggatccctgctgggcttgatcaccccatggggcctttccttcgggagtttatgagtgtcctatccctccccaatttggaaaccccagtgtcccaatgccagcacgccccaccgcgcacggacgcgctcctttattttaaagggttatattttaatatgtataaaaactcccaaatatgtaaaaaaaggttgtcttcgaagtttaatgaaacagttataaatttatggaaataaatttttaaaaaaaacataaaaaaaaatacaatataagcaagattattgcgaccccttttattgtttcgacaattctaaggaaattattcattaggtacaaatcgatttctatttaaattacaaaaaattcccaatttcccaatgattcaaaaaatttagaacgggaatagctagagcgctgaaagtttgcagtcggggctaacttttggttgtgcatctcctgaattggaataacaattcgaaaatccaaattttcgattaaactttttggttcaaaatcggtttaaatacactgaaacaagctgaaagccatcaatcctttaataagcgatcagttccgcctcttttgaacaaaaaatgttaaattctaaaattttgactttcgaatttttgttcaagttcggacccgtggttcggaatgggccgaaatgctaccgggttcgtgatcagtgacctttaaaaccctaggaacttgtttttatgacattaaaactttcactaacgcactgactcatttcccactgacgcactttccgggagcccctagtgctattaatgattgggcatcggatttttaaagtcgaaaaagtccaaaataaggccctaaataagggcgcaaaaaccgaaataagggcaaaataaagtcgaaaagttcaaaatttagggggtataattttttaaattgctgtttttttatatgaaaataatttcaaattaagatacatttgaaaattttcgagggtaaaagacatacgattatcgaaccaaaatttgtttgtaaatgaaaaaagatttccacgtcacaagatgccaaaggagtaaaaaaaattttcgagatattttaatgtgttttttcatgtaaatgctgatttcctcgagcataaaccacaaaaaggtcgctaataattttctcaacagatatcttttccatgttcatatcattttttatttaattaaaaattctaagtttgtatttaaatataataatacaatttgataagaaaattaataaacatttttattgctttcaatacggatcaattgtttcttaattgttgaatttgaagtgaatgattaaattttttgagattttataggaatttagagccggctgtagagttgtttattggaaagcgagaagaaactaaaaaaatgtacgtagttcgtcctgagcctacaattcacttcgcatctcagatttgatttatattgtatttatttgtttgtaaatgaaaaaagatttccacgtcacaagatgccaaaggagtaaaaaaaattgtcgagattgaatttttaagaaccttttcatttcttatggatgtcctttttgtaaatgttagggtcgattcttagggctatattgttctcaattttttgggaaaatcttatatgttatttttcgtttttttattgcatttttgtcaataattcttaaaaacccagtctctaattgtcgggttcacttgctgtcgaaatcacgcatagaaagtgagaaaatgcgaaataactatgtcgaatagtcaagaaattcgtagtaagattttggacaacaaactaacagcaatctcactcaaccgtcaaaggcaaagcgacttgccaagaatttaatcatttatacgataagccacaaaagaaggagaaaaaaaaatggtacttttatttcgggccaggacgttttcgcgtggccattttcgcgtggccgttttcgcgtggccgttttcgcgtggcagttttcgtgtggccgttttcgcgtggcagttttcgcgtggccgttttcgcgtggcagttttcgcgtggccgttttcgcgttggcatataaaagagaattcataactcgcgttttatttaacgcgtggccattttcgcgtggccgttttcgcgtggccgttttcgcgtggccattttcgcgttgccattttcgcgtggccattttcgcgtggccgttttcgcatggccgttttcgcgtggctattttcgcgttgccattttcgcgtggccattttcgcgttgccattttcgcgtggccgttttcgcgtggccgttttcgcgtggccattttcgcgtggccgttttcgcgtggcagttttcgcgtggccgttttcgcgtggttgcatataaaagagaattcataactcacatttatttaacgaaaatttgtttcactcttttttctaacgaatatttattttataattaagtgagtttataaactaaattaaggttctttcaattatataatatggaccagcagcaaaaaattaaaacaaaaagaaacaaagttaagttagaacatgacggcgcactctatgttttcgaccaattgagcgcagattgacttaagaaattttggcgatgtgagtttcatggcccgtcagacaagtgcaagggtatgttaatatattattttgaattttgaaaatcttttaaaattcaggacgtttgcacacggatttaaataacgttgtgcagaagttggtcgtgagttcaagattagaagaggtacaacagtgattagaagaggtgcaacagtgattagaagaggtgcaacagtgattagaagaggtacaacagagattaagaaaggtaaaacagtgattagaagagatacaacagtgattagaagaggtacaacagtgattagaagaggtgcaacagtga

SEQ ID NO: 2573 - DNA, 4961 bp, Heterodera glycines
tgcactgaaagatgcgacgtccgctttggtcggcatcggcgtaatattcgccgtcattagattgtacgaaaggcactataaactcaggtaaaatgtctaaaaattaagttttacggggaatgggaccaaaaaaaaaaaatttataaaaagaaaaatgctgctaaatttcttgccaatttcaggcaccacaaagcaatgaccgcttcctaaccaactcggactctccaaaaaacaggggtcggacaaagtgcgcgtcgactcgatgttcttccggcgatttttgtgtatccacataattctcttccagagcctctcagtttgctgctgtgcaattacagcgacattttgatgtgaaaatgatttttaagcgattataaaatttgatttgaaactctaccatttttgtgtttgattcaaatataacgtaaaaaaggcatatattcaagagcggaaaaaaaactttgtaaattgaacgacccaaaagacttaaaacaataaaatgaaaataggagtactaaaaaggaaaaaaacaatttttttttgtttttttgctagtgctatgtggggcaaaagcaatggagtgctagcgctctgaggggcaaaggtaatggggcgctagcgctccaaggggcaaaggcaatggggcgctagcgctccgagggccactatgtgtaagttggattaatcaaaataaaaaaaaataaaatatgaaaaggaagaaaaattttggccctcaggcgggttatattgtaatgtttgactgagaaatagtaaagataattgggtctttaaatcaggtaaaatgcaattgtccggaaattcgagcaatcgcccaattttgtcagactaagaactttttcaaacattctttggtcacttcaaaatttttgtatgcgttttttcctgcccacaggcatgggtgtattgggagtttttgataattaatgacattatttgagtataaacaaaatgattctaataacatgttaaatattcatttccattagtgttcgagagaattcggagtgtgctcacatttggaccatggctgagcttggtggccatcttcagcaagaaccatgatactgaaacgaaaaaatatagattacttaaggatggttctgcaaaaaggcaatactttctggcagaatgaaatatttatgtcaattaaattttgaacttttaaattagtcaattataaatttaacactcctgtccttttaatgttttgtgtgcttttacaaaagcgcttttgttattttggcccaccagcttggaataaagtggacattgaaaattagaagtgttattacctcttttttacaattatattttacaaaattcaaaatgaatgtgcaaaggaattgaatacaaaaaccatagcaaaattactaagataaatctctaaaaaggttcactaccgccactttgatttgtttctgacccgcaggtgagacattgctaatcactaatagtctctttaaattttatttgggcaatttctctttgacatcagaaccaacaattacattgtaatcctgggccccagtttgaattcggaatcattcacaaaaaaaaaattaaataatgaattctaaatcaagcaatgttcaaattcacatgaacatatttcttaaagcgaagggcatggattgaataacttattacctacaaatcggtaatgaatgagtccaagagtcattaatgagcagtcaagtgttcgccgaattttcaattaaattcggtttaaaccacaggtgctttttagtgatcaattgacgggttagagcaccagtaaattgccagacttttgctacgttttgggctttatagacaaggagacatcggcagattaggcctaacagcagcagtgagtggcaaagtcattccaataagcattaatgaaattgcattaaggaggcgactttcgaacgcacatttggccgttcccagtttgctgttttaagacggtttgcttttgtttccggcccacaggcttgggatttttttgacagttcttcaccaacttgacacttttttacttccgtttcgggtttaatgtgtgtaagtgcattcattgctccggatctcggctcttcgtctttgtaattgcgacgctcctgaattttaagatctagcaaagcctgagccaagttttgaaaaaattcagctgaagcattcgaggaacttggggcatccatcatgttaacggaactctgcctattttgccattgtccttgcgattggtgtggctgttggttggaccatcttccttgactgaaattggcacggcgttgatagcagttgtaagccacatgtccaacgcggtcacaataatcgcatctgggatttcttgaccaatttctttgactaaattgttcttgatggctttctccccagttgcgagatcgattttgtccttctcctcccccttgttgctgggtttgttcatccgatcctgaaaaagaactgaatcctctgacattgttacctgatgcccactgtccagcaaagtcattgttcaggttcgcttctgtaaaccaacgggactgtgatgactgattgtttagcgcgttgactacgtcagagaggcgcactgcctcgtcactcttgctcatcatcagtaaagcctccaactcctcagcttgtgctcttaccaagtccaaatctttagctcgtgacaatcccaccagacgaatgagaaagcttatatttggtttcaatctatccaaaaattcttcgcaaattttttcttttcgcgaattaccggtcaatgacgaatttgtcgcatccaccaacggagttaaacgcctcagaaattgtgccactgtctcatcttccctttgcttgcacaatgataatgttcgctttgtaatttcccgacgttgaggggagtccaatttccgtcgaagttcactcagtgctgtgtcgagagtgtccgtttgtgctggtaataattctttaaacaatgccagtggcgtgtccttcagagccaatttgagtctggtgactttttcgcgctcagtgtaagccttgcctgacacagaaaggtagtccttaaaacgttcagcccaatcgtcaaatgcaaaaactgactcttctctgaacatttccaaacctgaccctactgccggtccactcattagcatgttcaggccaaaaagagtcggcccgtcatcttcgtcttcgcttgacagttgctggattggcacttgattcggcatgagttggttgggctgtgcattgcccattggcatcacaaacggcgcgagcgatgctctgttttgattaataagactaaaagttccacctgaattcgccccatcattgtcacgttccaaaatatcgactctttcggttagggtctcgaattgtaccttcagcgtttcaaaattggcatttgtattagccacaacatcattcacccaagtgactttttggtttaaggaacggttcaagtggcgaaaagctctattcactccatcttccaatttccccatgtcattttgaactttttctaagtcagaaatttttacagtgacctttccttgccaaagttttctatcaatagccgtgattgaggacgcatcgtcctttccactcaaaaacatttttgtttcctgcccgcaggcttgggatgtaccagaggcgggctcacttgaacagccccctgatgtagacattcgtagtcgttcggttcgtaataagattttgattttattttgctaaaaaattggtaatcccattacgcattaattgagagaaaaagaattaatgaatgacagcggataatcgaatggatgcgaatgccttccaagaatgggcttatctgctcccatctccgcttaaactccgcctaacaagagcaattaacaattctcaggcgtcgcaaaaatgtgtaaagtgaatgatctcgcccaatgaaaaatgcggcggcacgtgattacttgaatattcttatggcgtgaaaaacgagagaaaacaaagagataaaatgaactttggaacttgtaaaaactgtaactcatactgtaagcaaaatgatagggcctaattttcattttttttttaattggttgccttatttttttaggcagttaaactagcgcccctttgattgtttatcagtccgggcctttttgcttctccgaaatttgtttctcttttctttgcctcactttttctctctctctttttttggcttctttctcttttttttggccgttcaaacagtttttaaattagttaattttcggctactgccaggccccttttttggttatttttggcttatttcactctcttcttattctctgtctctctcgtcaaatttgtcaattttctgagcaatcagcccctttagcatttagactagcccgggcaaattttgtcctctttttttgcatttttgaagtccctttagctttaactagccctgacgaatttttggcctccttttctcttcgtttttaatgtccctttagtttccaactagcccggacaaattttctcttttttaaagtccctttagtcttcgactagcccggacaactttagaatctcagacttctttacttgcgtgtacacgtctttttttctagccctcaggccagggagatctcccacaaacttctgccggcttatccaattctctgcttcgtcgtcaatgatgggtcgtttcccaaaatgggaaccatccggtgctaccagtgagggatgcgcactgtgccccccagaccaaccgcaccgtctatcccggatggaacatgggagggaatggggaaagccatggccagtgactaagccccaaaatcccaacgactcattgactgtcgatatatttattcactcgttgttggatttacacgaagcgagaaaaggagataataattgaagtctgttccatcacaaataacaaagggagggatcactgggggaaggagaaatgcgaagagaatggg

SEQ ID NO: 2574 - DNA, 5038 bp, Heterodera glycines
  misc_feature (17)..(17): n is a, c, g, or t
  misc_feature (35)..(36): n is a, c, g, or t
  misc_feature (53)..(55): n is a, c, g, or t
  misc_feature (58)..(58): n is a, c, g, or t
  misc_feature (64)..(64): n is a, c, g, or t
  misc_feature (101)..(101): n is a, c, g, or t
tgtaaatcagtgatttntagtcgttccttatattnnttgtacacaatccacannnttntcgaanagcttttcttgtgaaaaatttttgtacccgctcaatnttgtctatatctttttttaaattagggttccaaacttcggtagcctattctaattgaggtcgtacaaaagttttataagctgctgttagagtctttatttccctgcttttcaacactctcaaaatctgaaagcttctaagatatgcgtttcgtataattttgcttatatgttctgaaaaattaagtttcgagtcaattataatgcctaggtcacgaacattatccgattctgaaatcttttttgagttaattaaataatcttttttcttgttatttttccctaaatacagaacaaaacatttttcagttgaaatttctaacccatttatttttgaccatttttccaaagcctcaattagcctcaattgctttatccaactgatttgaatggccatcattttcatgggcataatataatttaacatcgtcggcatacatttttatgccaactgatgccttttcatttgcaataaaggacggcagatcatttataaaaattaaaaagagtaatggccctaagacacttccctggggcactcccgaaaatattttgaaattttctgacaattcttctccgattttaactttaaaacttcgattttttaaaaaattatttaaaaaattataaatttttccttcaattcctatctttttgatttttttaagtaataaatcaacgggaacagaatcaaacgccttgacaaaatcaatataaataatgtcaatttgttgattcttttgtagataattatatatatcgtccatcgtttttaatatttgggttgtagtcgatctattttttaaaaagccaaattgttctttatcaaaaaattctatactgttcaaaattccaaaattttgctactcaaaattctttcgaaaactgcaaatagtgcttgttaatgaaatcggtctataattcatcggattttttcgccttttttgaaaattggtacaactaatgatgttcgccatatttccggaatttgaccggaatccaaaattaatctaaataaatccgctaatattttggtaattggctctgcacaattttttaacaaaatgtaaggaacattatctggtgaagttgaattacgccggggaagtcttcttaatatattccaaattgttccattattcaattcaatatccaaaagtttagtcttattctgtgctgattgagtcagtgaaccattaacaattgaattttctaaaaaagatttttgaaatatttctgctaatatttcgcatttttgctcattactggaaaacatatttccagcactatcaattaacgtaggaatttcattaacttttgataatttatttcgaataaatttgttaactgaattttgcccctgggaaataatttttgactcttgttcatttcttaatttgtgcaattgttttttcatttccctagaaataattttgtaatttaaaatgatttcacttttttcaggaaattttcttacaagcttatgcaaacgtaatttctctgaaaataaatctcttattttttgaggatacgattgttttattatcgattttagaggtctatttggtataaaagtatcatataatttcagtactttatttaagaattctttatatttttgatcaacggtgtacactgagtttattgataaatcaatacgattttcaagaatcgcccgacttaatttcgaaaaattaatatttttaaaatctcttctataaacactgggattattacgccggaatttttcttttatttgaaatccgaccattttatgatcggaagttgaaaaatgttccaatacaattaattcattaattaattctgattcactagtcattactaagtctaaaatcgtattttctctggtcggttctttaacatgctgtttcaattgtttttggttcataaactcaatcagcatatttgacataggatcatttatatgttttaccttattttcatcccataaaatgtttgggatgttaaaatccccacattatatgatattttcggaatcgctttgatccgaaataaatttgaatagctttttagtattctgaacggtacaattcggtggacgatatatatttataatttgaattggttttttaaaaagtaatttaatgtgtataatttcgcattggaattttgtcccagagaaaagtgtctgataagggatcaatgtttttaatagaattgccgatcctccgccctttttttctgttcggtttgcataaacaatttggtattgacaatttattgtaagttccgcttctaccgtatttctggagtttaaccaggtctcattgattaggattatagacggattgtattttttagctaaatgttctaaatcagctattttatttgctattgatcgggcatttattaaaaggcaagaaatccagggattgttttttaccgttttttttatttttttcggttggtttgctcgcgtgtccctagcgagttctgagcgggtgggggtttttcagggacctgatttccaaatcaaccacaaaatatttatattcaccagcagcaatattggcctgataggcttgttgccgaagggaatataaaattttgagttcgttttgggtcatgtccctgcggactttgatatgttggggcaaattagtcaattttttcagagcattgcggaaattatagataaatttgtctcgcgaaaatttgtccaaaaatggaacttcagaattctgtccttttttacccctccatcaggccgcgttcttgggtggcgatgaatgtctggcgaaagtttgtccttgacaccgcattcttcggcaatttgatccaccagtgcccgttcatcgattgcctccggcaatttctcaatgaccgcacgatttgccttctccttcagctgctctgagttgatgatggcgtcggttatcatccgcgacactgcgccggtgccagcaaaaggcggcggttgaccccattgaaaattgccgtttgtgggggtgggagccgaagtggaggaggtgtgctgggggtcaccaaatcgatgtccatatcgattctcgccctccacgagccgctccaccaacctttccaacttttcgagccgttcgatgattgggttcagtgtgggattccctgaaccttctaacaacttttcaagccggtcaagacgggcgagaatgtctacgatcacttcagtgaattggaaaaaattacaattgctatgaaaaaatgaaatagataaaatatgttgctgaataaaataattctaattctgttcaaataatggcaataatgtgttattattatatttgcggaatgcgcaggcttttttcttgaaattattaattttacaatcaatcaattagtaactgttttgattttattattaaaagcatcaaaataaaaattgataaaatatcacaaaagaaagttttctgttcaaatcaaaaatttttaattttaggagtaattttctttcatgcaataaatgaataaatatgtgtacaaaattaatttttatatggaaacaaaaagaccgagacccaaaaaacccgagacttttttcaaaaaattttccattcgcttaaaaattgtttaaaaaattcttttaactctattcttaactattttttgctttttttattttgattcaatttggtacaatattaatcatttcaaaaacgcacaaaacaaaaattcgttattttttcgcggtttttgagtcaatttaaaaaataaagggtattttggagctcttaatagattttaaaataaaaaatgcttaaatctgtagtaaaatattgatttaggattttaatttttccaggaacctataataaaatgtgaattaatggaaaaaataaataaaaattaatcattattttacttattcttgccaataatttgttcagtagaatgaattttaataaaatctttaattattttttattttcaattaaatagcacttcttatttgtaagaaatcagtgggatttagatttttattatttataaaaaataaaattgtataaattaaaatttgagaaaaataatatcaaattatttttgagaaaatgaagaaaatgaaactccacttattattcattttaattatttttttgatcacccaaattaatcaaattgaaacagaaaagaaaaaattggaacaaaaatcatttgatgaaatatttggagaaaaatgggaagaaaaagaagaagaaaaacgaaatgaactcaaaaaaagagaaataattggaaaattttataaaataaaagaaaaaataaagcaaaaagggagaaaatattcacaaaaaatactggagtaaaatagaagtaaaaatagcgaaaaaattgggggaaaatcgaatgaaaatttataaatgaattaagcaattagtacttaatcaaaaatttaatctgtctaaattggtgctgtaacatttcgacagtggctgatttcgacagagaattaaattattattttattattattatgtattcacatgaacaagccggaatccacggtttgcccgaagcaaactgcctcagggtcaaactgacccaaaaagtcatttttatttaaaaaatcactatgcttaatgaaaattgatatatgtgtgtgtcgaaatttcctggcacgcttccaattataaatattctgttgagaagtgtttaaaatttttgcaatttcattattactcattttgtattttcttttttaatttcccaatacttttttattttttgcattttttctttctccgtcattcttttactggcaattccaaattgtttcatccattttttaattatgaaatggcttactccaattttcttacaaatttcggcataattttggtaccattctttggttgaatattttcctttttgtttatattcatttgacatttcaatgaacttttgtacaatttcaaatttttgttca

SEQ ID NO: 2575 - DNA, 6959 bp, Heterodera glycines
  misc_feature (704)..(704): n is a, c, g, or t
  misc_feature (6796)..(6796): n is a, c, g, or t
caacgaaattcgtgattttttgaaaagtcagtcgaagagtatgttgattgacgaattttcatcatttgaggaattgatctgtaatttcggagaaattttcgcaatttctgaaaacgaattgacacaaacaaatttggtcgaacacaaaattgatacggttgatacaaaaccgatcaaagcaaaacataggcctgttccatacgcctaccgagaaaaggtggctgaaatgatcaatgattatcttaggagaggtctgatcagaccatctttttcaccgtgggcatcgccaatagtgattgttccaaagcgcgacggaaccctccgtttctgtgttgattacagaggcctaaattcagttacagtaaaagacgcatttcctttaccaaacattgacaatactcttttggcacttgggggacgaaaatttttctctgttattgattttatgtcaggttactggcaaataaaaatggaacccgaatcagtcgaaaagacagcttttgttacggaatttggattgtatgaatttacagttttacctttcggtctttgtaatgcagtagcgactttccaacgcttcatgacgcgacttttcgatggaatggtaaacgattcagtgttcattacattgatgatattctgattgcttccgagacctggagcgatcatttaagagaccttggaacagtttttgaacgcattanagcagcgggactgaaactcaaaatcacaaaatgccactttgccgcaaaggaaatccctttccttggccatattctgacccgtaagggcataaagatggacattgacaaagtcaagccaattatcaaccttccaactcctaaaacgaaaaaagaattacattcactcctcggatttttcacttattacagaaaatacattttcggttttggagcattggccaaaccactttttcgcctacttaaaaaggacgtgaaattcgaaatgggagaaattgaatttggagcgattaaaacactgaaaaagagtattttggatcaagtagttctgtatttgggtcagcttaggccaatttatttcgcgtcaagacaatgtaataatcacgagtcacgctattgtccaacagagcttgaagcgttggcaattcgtttcggaacaaagaaatacgctcaagaatttaggcctctgtaatcaacacagaaattatgttttgttaattggtttttctcaattcattttgggttttttctgagttcttcggattgatattttttttttgctgtgaatgacttttttgcttctcaatttctctctcctccgatctttgaatattttttggaaataaatctctctcatctggtgaagtcgtttggattgtcgtgttcgtcttttgtttaattttgtttggacagggttttaattgttggaatttgccgtggtgtaattgttggtcaacgagcgaaaatttgtgcctgtttcagtcgaaaattggagagtatttgactggccgtataattaaaataaaataaaaatataaaaaattaatatttgtgctgttaaccagggcggttgctttaaagctccgtttatcctggcagcaatttgccttttagggcctgaggtcgttttaattacacacacaaatttcccgagccgtttaggtgccctgtcgtcttgtgcttcatgggtggcggtgtgctgctcctcaggccatagttggttttctaatacatgtcaaaattggggggccgtataattaaataaataataaattaatattttttttttgctgttaaccagggcggttgctttaaagatccgtttatcttggcagcaatttgccttttagggcctgaggtcgttctatcgttctaatttctgtcaccaatttcccgagccgtttaggtgcactgtcgtcttgtgcttcatgggtggcggtgtgctgctcctcaggccatagttggttttatggccaaatgatttactttgaactcttttcaatgcttattccctatcatccccttcacccctcccttccatttatttaccgccatataaattcattcatttcatgcaattcgccattttgaaaattaaaaaattcatctattctcaccttcctatgctgggcattgtccaacagggaaaaggagctgagacaacatcgaccaaaaaactaccggctgaatacgtggaaaagatggactgcatcatggagcacgttgccaaatttcatttcaccaaagtgaagtcgagatttgtcataaaagatgtgcctgcagaccccgaaggactgctagcggccattttccaacactgcattgatgaagcaaagaaggacagtcgcgaaaagggaagcgaaccgacacaccttggctgtgtcatcagcagcccactgctggatggtggcgacataccaattccgctacgtcaaattaccgacaacacaatcaacaccatcctaaatcagttcatcaaggtggcacaaagcaaaaagcagcaaaacatgactttgtggggcgagccgttcatcatcgccataacatcggttgatcgcagtggacttccgatgaagcggcacatcaaagggggcgccagacgtcgcttggcacaagttcagcaccaagtgcatgagaagtgcttgattaaggtgaagcgccatctttgtttattgtatgacacctactcatatatttaagatcaacaaccaaaacggggacaacactgacaattattgcttgttttacgccctacaagcaacaatggtggccaagacgcgcagatggccaaagtggaagttttacgattatgtgcatagtcgccgtggtcagcgaggacagttccagcaagacacattgaaagtgatgcggcaaatcagagcaccactcgatttggacgcatacgacgccgacacttatgctccattggtcatcaatcactggaacaacgcgcagcagcagcaccggtttgctgttttcatctttggaacgaccggccactacaagccgctttacaaatacggcaacgacgactacgatacgccattggcgctttatttcaacaacagtcattttgatggcgtgcagtttctgagtggtctctttgacggcaaaaagtactgcctggcgtgtgaaggaccatactcgagaccatcaatgcataatcaatcatgcaaagcgcactgcctcatgtgttcccgtgttggccctgagtttccgtgtccctcggaagctgacttcttccgacaatgcaaagcgtgccacaaaaacttccacaacgcgggctgttacaatcaccacattcagtccaactattgtgcgcgttcaaagaagtgcaaagactgcggtgtcattttggacgtcaataacaattctcaaaaagggcggaaggtaccaaactcaaaaaaaaatttttttaaccataaacactttaagggacacgtgtgcggagaaaaattctgtcagctctgcaacaacttccacagcaccgagcgtggctgtttcattgcaccacttgagcctaaggaggagatggagtcctatcggttcgtggcctttgatctggagacaatgcagcatctccctgttgaccctcgtctacctgagagcgcaaccacgagccaaacttcattgcagcgaaagtgatttgtccaatgtgcattgaaaatgggagctggaaacaaggaactgccgggtgttgggtgtgcggcccacaccgaaccgttgccttctgccaacgaccatttaacggcacttctgttgacaaacaagtggtcaccgacaatccaatgcaagcgtttgtgggatggctgatcaatgacctaccgaagaaaaccaacacgtacgcatactcccattttggcggacgctttgatatggtcatcacattcagtgaactatttcgtcgcggatttaacccggaaatgattagacgagtgagaggctctctttacttttatttttacttagtgaatgtttagggcaacaaaatgtacgagatgaagctaaaggcacagaagaacaaaaatccgaacatcattttccgcgactccttcaatctgatgccctgtgcgctcggacaactggtgccagcatacggcttggacgtcgaggagaagccctttttcccgcacatggccaatcgtcctgacaactatgggcgcgaaatttttccaacacccgaagactacctggcccaaggaatgatgccggagaaacgacgtcagttcgaccactggtatgaacaacatcgacgagagccgtttttattggatgaggcgttggccagctactgcaccaacgacgtggagatcttgatggcagcgttggtggcatttcgacgtgaattcctggaaatcactaagcgacaagaatatgtggatggtgtcgataaccgcgaaaatcacgatggcattgacgttctgaagcagtgcatgaccatcgccagcgcctgcatgaagcacttccggatcaatcatctcccggctaaccatctggccatcgtaccggaaagaggctacgacaacgcccaaaaccaatcattactggccctccgcttcttcaaatggtatgcggagaagcacggagtccaactgcagacggcccacaccgctgaaggtgagaagcgcgtcgccaactactcactggacggttggatcgaatccgagaagagaggcattgaagtgaacggtaattttagaaaataaaacatgtgctagaaaaatttgtgtaggctgcgtttggcacgggtgccgcaaatgtttcccagaggacaacatgctactgcctaatggaaagtcggccggtgaagtgcgggagcgggacgcaaagcgccttgaatttttgcggaaccaagtgggccgtgtggacgtctactgggagtgtgaaatcgagcgcatgctgacgacagaccctgagatgcggcaggccttcgcaggatatgttgatgatggaccattggagatccgcgccgcgttcatgggcgggcgcactggtcctctgaagctctaccacaaggcgcgagaaggggagaaaatttcgtacttcgacttcacttccctctaccccttcattaagtgagttttagcattaaaaatgacacttaaaaatttatgtatttagttttacgatacgctatcctgttggccacccaaaagtgcacgttttgaacgaggacgtggaatggaagtgcgcagcggacaacccctacgatttgtcgctgctcaaagtgtgggtcgtgccacctcgtcgatgcgatgtgccggtcaaggtggatgagcggctgtgcttcccgctgtgcttcaaatgcgccaaagactacccgaccggcggagttgacaacgaatacaactgtcgtcacaccgatgaacaacgcggctgggtcagcacctgcacttcgcttgaattgaatgccgcattggatgaaggctaccgagtcaacaaactgttccgtgtgctgcaatatgagcagagcgacgaccaactattccgctcctacatatccgagttcatggcgctcaaaatccaggccagcggcttcgacgccaacatcaaaggaaacagcgagctggaagaagaatttgtcagcgaatgctatgaaaagttcggcatcaccattgaacaggcaaagatggagccgaataagggcaggcgcttgatcgcgaagctttgcctgaacaatttatgtgagttgacttttatttgccttctataaaaaatttttgaagggagccgattctcgctgcgtaactttgggttgtcgcagacgctggtcaccgacgaccctgctgttctcgctgagtacttggacaaccgctcgctcgaagttacggcgctcgacgagcttgatgctgagcacatcctgatcagctatgagacaaagaaggagtgcgtggaggagaatgcatgctcaaatattggtaaaaaatattttaaatttttaaaattaatgtttttatagtgatttcgctatggaccacttccgcagcacggctcctcttgttgaaagcaatgcagaaggtggtgagaacaccttcctgccaactcctttacaccggttaaaaaaagcacatattttatgtacataaaaacaattgttcagacactgacagcattattttgacttatccggatgccaattgcccattgaagacgggccctcacctcagggagttcactgatgaatacccgaagcacgagattttggagttttgcagtggcggtgcaaaacaagtaaattttgtttttttacaataaataaatttatgataaaaactatatttagtatggactcaagctgcgtcgcaaggatgcacctgccgacgctgacctcgaatacgtgctcaagatgcgtggaatgacgctgaactacgacgtcatccagaaccaggggttgcgctacgacacgttcaaggacaaggtgttaaaatatgctgagactggtgaaccacaaccgataaatgttatataccccaatttccttcgccccagtataaaggatggaagggtcacttcatgccccctccaaaagatttacaaaccctttgtcggcaaaggtattgtcggagccgaccttagagttcaagactttggccacacattgtaactgttttgttcgccattcattgtgtcttatatacatacacatgcacacacatgcatacacccacatacacacatgtactctttattttataacaatttctgtaattttatcttttttttgtgtgttattcatgtttttcataaaaatgtatgccccacaaattgcttgctgatacaaattgttttcatctggttgatccctacacaattanattagcggtggtagaatgtcggagaccggtggttgaccatcaatcaggtttgtcagctttggaaaatcgtcaaattttatggttcgtttttgaaggaatggccaaagtggtggaaatgctacgctgagctctgattaatatttcggtgttactatatgttgtt

SEQ ID NO: 2576 - DNA, 3020 bp, Heterodera glycines
  misc_feature (3004)..(3004): n is a, c, g, or t
tcccattcacccataactaccagcattatccctccgccgtgcactgattgtttgaatttgatgctcaccgctgtagttccattttttattaggtcaaacagcgcagcttgatcatccccgctgttagtcaaattgaacacataaatgcaatgggttttcccgaactgttcatagctaattccattgctttccaatgaattggcgaatcccaccgcttcgttcatgtcattgaaagggcgaacatatttcaaattagggtagtccaagtcgtaaggcgcttggggaaaggagcggccattagcaacaattgagatttcgcgcacattaaacggttgaaaattgaacggactgcgcgaaattgttccaatatagtcagagttagccaccaaccccattgttatacggcgaggaatttggtccatgaacaaattggcagtaaactcaaaacgacctggactgatgaacattgacttcatcaacgttttcctcacggcgtatcgtgccggtttcacttcaagttttcgcgcaatgtccaacgccagtccatccatcaatgaaaccttcttcacatacattttcaaaccgacaacctcaaagtggtagcgaggggcagccgcaagagtcgtaattaacaaaaagttgttgtcattgggtaaaacttcaatgtccagctcacagaagttgatcaaatagagtggctggttgaacaaatcggcgtcaattttggcaatgaattgagctgttctgcttcctgcaaacaagttacgtcgagcaatgcagccgtcccctgtctcaagcgtgccgcccgtgtccctataatagcccgctgcattcaaatgagagtcctttgccgtagtggaataggacaactcatgggagaagtatgttttgtaggccatcagagaatttgagttgaaaacttcacgtccatttatgctcattttgatgtttcggatgaaagtctgtccaatcatctggatcggagcaacttcgtcagctgcgaggccaatcagttgaccatgctcattttctttgcgaattcggaattcagttagtaaataacatttggacaaatcaacaaagttttggctggagtgaagcttaaagttgtagggagtgtccgtcagtggattactaggcaacagctcaaaaacttttgatgaagacacgctcacatttgtcgggggtatacggaaaaagtccaatgcattggtgattgagtttgcactgcattgtcaatcttatggaaggccattttttatttaataaagtccaaaagcgtccgaacgaatacgcttatttcctgctttgctgattgcccgtccaattattgtctgatggcttggtgcatgagctctctttctttttatacccattcttcgaccactgccaaactgttttggcaggccgcccttctccaacaccgtgtcaattcctttctttccctcgctcacaaatgcctccttaaacggtactccttcgtttccaactcgctcaagtactcgttgccccgtgctcaacgcctccgatcctactgtagtgccaacacgacgaaggatgggaaggaaaaaacgccaaagtccacgaaaaacatcacccacccctgcgcctcgttgtccataccctcgctggaaggggctggaccctcggaagtaatcctcgctctctatgccacttccgtattgcatgtactcatcatatccgattatgcttggatcaaacacaatatgaaccattttatttacgtaaaaatgctttaaaaacacaaatgagtgagtttaaaaatttatcactttcttaaatattaataccaccatggtcgtgccgtaggcaaatgggaccagtcgacccttgtccatcgtgcgcaactcaatctcaatttcgttgatctcccgctgcaacactcgagcgtatattggcgaatcataaatcttctcattgtagtcaccgggtgtggcaccgctaactgacacaacgcgaagcagcgaactcagcgaattacccacaatcatattctcagtcaatcctttggaatagacagcaaaacttgagaagccaccccgtaagtcacaaccgtattttgccatttcttgatctccaacgtgttgggggttttcaaagccaagcacatagcctagctgaggtgagaatgacaagtggcttatgattggacttttgagcaccaccttgaatcgctcaaagtcatcaagatattgtatttctacatcatcaacaatgtttttgaaaggctcatatggccactcggactctttgtcatcgtcgtcaggaaattcgtctccggcaggtaaaccgccaaaaaacctatcatccacatctaaaattctcttcgattccttttcgtttttgtttggggcttcgactgatcgcttaacgtctttatccgctgctttgttatctttaggttttgcagaagcagtcggtgaagctatttttgtagtctgagtaggagatgaagcagatttagcaaaaggaggtgtgggtttaacagttgtaactggatgttttattgcgtcaattgatgctgatggtttagaaggagcgggaggggttgagacgatgtttggtttgcttaaaaaaggctgtgttgtagaaacaggagcggacggcttaaaagctggagagctcggagtcactttagcgggagtaatcggtgtaatggactttggtttgggaggtatttgggctggcgaaggattgactggggggattgacgtaggcttactaataggttgcgctggagttattgcagggggtggagtaggcttttgcaattttggagttgccggtgttggtgccgtaaatggctgctctttagcaggtggtggtggtggtataggctgcttagcaggttgaggtggtgtaggctgctttgtcggagtagctggtgtagactgtttagttgggtgagaaggatgtgttatagactgcttagcagaaggagttggtatagagtgcttagttgcgggaggaggagatggaatangctgattagcaggagg

SEQ ID NO: 2577 - DNA, 5451 bp, Heterodera glycines
  misc_feature (2825)..(2825): n is a, c, g, or t
cgttggtcggccatgtccttcgtaatattccatgcttggatggcattctctttaaaaggacaccggttcccgagaggacagccacttggattgtaaaaatctcgtctttttctaaggctctttttctttgactgctcctgttcttctattgtgtccgcttcggaaggcgaattcagagaatcttttaaaattaaagcttcacaaaagcataataggtattttgtcagtcttataatacctttgtttcctcgatccactgtcactctgatttgtttgccactgtgtccacttgactctgattgcgaatcagatgattcaagaccaatcattttttagcatgaattcacacttaaaaattgccgctaatgctttattttagtttgaaaattcacagtttaaaaatagccatttaatgcagggcttccatttgttcttatttataagagatgttctgatttggagggtccaaatcttacaaaataaaaatgttctgattttgggctattattcttatttcttaaaattattcataaatttagaaatttatggcataaatgttcttattttccctagaaattaaaaaaaaaatttccccggcggcgcctatcggcaccgccggacccactcgcctcccccgttctccaaaattccttggaaaaatgcgccgcaaaaaatttgttaaaaatttgtttttttagattaaaaatgcactgaatttgctaatttacttcccaaaatcgttaaatatgataattggaggcgaaaaatacaaaagttgatgctatattaattttataaagtgttatacaagcgatttaagcattttttgttaaatgttcttatttttgaccctaaaatcttattttatggcctggatgttcttattttgaaattttttcgatggaagccctggtttaatgtaatgttttattttagtttgaaagtaacattaagacataaatttaaaaaaaaggaaaatgactaaattatattttgatgatgagtgagataagtgaaagtagtggcaacataaacaaaaactagagtgcccgccctatttagcaaatgacacaaaaaccaagggtacccgtttgattttaaattgggttttcgacttttattagagttcgggattagaaatcaattaaaattgttgtcagattcgtgatcactgatcccccgagaactcatgggaaagtttccacgacttatcacaaaaaaatacaaatcaaagggtcccacaatgattttctgttgtggcattcggcaatagcattgtgttgtcaattaaatctttaacccatttcgctgttttatttgagttattgataataaataacctacaacgcctaaatggaattttcttcaactgattatctcaatgagcatcaacgttttgactatcagattttgccaaaagtagaatacactggtgtatgttataaaacgaccttttttttaattcgggagctaaattttagacaactttggtgggcatggaatgctttggcggaattgtcgttgctactgattctcgttcttccagtggaacttatatatcgaatcgcacaaccgacaaaattaccatgcttaacgaccgtattgtgatcctgcgagcgggcactcaagcagacacacaggccttggccgatatcgtcatgtattatgcggaagcgcatgcgtgtgttcttttattaaaaagacgcattcacaatttttctcatttcaaggatcatggacgaagaggatgagattaccgtgcgcaacgttgccaattacgcccgcaaaatgcactacaattatcgcggacaactcaacagcacttttcttgtggctggttacgactccctcaacatgggtcaactgtatgtcatcccaggcggaggatacaccacgcgacacccttattatacgtctggcagtgggtcgtcatacatccgagaatatctccaaaaccaatggaaggaagatttggacggagaagttgttcgtcaggtatttaagttcaattcgttattttatataatacaaatagaattaaacgagtatgtcaggatgtcttaatttttcagattttgaaaaaagctgtttttgaagcgcagagaagggacggtgcttcgggtggtttgattcacacggcaataattaatgcgaaaggaatctcgcgaaaggtttttataatttatttttttgtttctgctaagcttttttaagacttatcgccccgacaaagaagattttccaattgtttcgcccgaaaaattctacccaaatttgcctgagcatattctacagcccggcttggttaccattgaacgcatggaaacttgaatcactctgatgctgatgattgaaaaataaatgattttggacacatgtatcaattgttctatcgattgttaattattctgcaatgtgcttatgttggataaaatcatcagaatattataatgataacaatcttaatgttgatttatttgttgtaatattccggtccactatcttaaactccgttccgtaaaaagagaattgcggcgctctaaacattcgtacggttccgatgatattttgggacaacgtatccccccaaatagcttaataattaaattttcaaaagattttgaccagcatcaaaagtaaattgacaggaattcgaaattatttctccacttaaaattgagtttttcatcgattgaatgtttgggggtcattcctttgcacttgactgtaagaaagaatgagcttatccgctggcatctctcaacacctttgtcggtgtctcagccaagtcggctctgagtcaactgaacagtggaatgcgttcncaatgtcaaacggacgggccaattagggtttcctccgtttcttctgatggtattgccaatgtgacggaacctatggattcacagcgacataagttgctatttttatggacgactgtcgtctatataagtttttttaagacgccgactttacgaacttttcgcactgattgagaaggaaatggatgcgcttttaatggaaaactgcgcacttcgcgcacaattgggagtacaatcggaggaaaagcctgcctttgaccctccggaaacccctaccagcaagaatgttgcctccgttcaaactgtggaatttgaatcggaacagaagccaagcgggactagcagcatcaaaaaaaattgtaacaatcggtacccaattgtactcaacaatcaatcatttcagcatctcaaagcaaacagcagcgttggaagtcagcattcaaaaacccttcaagcaaattgacgcttaaagtcggcgccaatttcccggaatcaaagcacaaagtggtccaatccttcaaaggccattccgacggagtttggcacataagcacagcccaagttggaaattcaactcatgttattgccagtgcaagtgccggtaaagaatagaattgtgcagcagcttttgagcatgttcataactaattcagaccaaacttccaaaatttggtttgccgaccatggctcccacccattggttagctattctggccacaaaggttccataaattcggtggctattcgtcctgaaacaagccgagtgttttcttccatctatggcaagcatttgacgttgctcacttgtggaggggacagatcggcacacatttggaacgttaacttggatgaacttatggagcggcgaaaagagaaggaaaatggtaaaatttaaggagcattactttatttcctccaaagacgagagggcttaattttttcggctaattgggcgaaagtaaaaaagcatttacaattcagaagaaccgacacagcaaatttctcatcccattacgctgttggatggccattctgacgtcataatggctggggaatggctgatcggcggagatcagatcataacggcatcgtgggatcgaactgctaatttatttgacgcagaaagtgggaaaatcatcaaatgtttatcaggtgaatattatatttaaaaaacaagacgtaaagtacttggttttattttaatgtgaaaattaatgttttctttaaggtcatgatcgagaactgacctcatgttctgctcatccatcacaaaaattggttgcaacggccagcaaagactttactttccgtttgtgggacttccgagacccaatccattcagttgcagtttttcagggccacaatgagtgggatttattctcgactcacaatcagtttaataataagtttccctttgcagttttgttacatcggtcgccttctccgccctccaccacattgtgtccggcagcgatgaccgaacagtgaaagtgtgggacctcagaaatatgcgcagcccaatttcagccattcgtttaaacagcgcggtaaaagaaaagggtttgtcaagaaaaaaaaaaacattctaacttgtcaggcaaaccgaatttcaatttgtaacaacaaaaatttgatcgcaattccccaagacaacagaaacatttccgtgttcgatctaaacgggaataaacagacgagaattccacggagtgcgggaaaggtaagcggaaagaattacttatgcccttcttgttccattcactcattttttgcttggtctcagtttcaccaccgattggtcaatgcttgcgcttggatcagcgaccatccgttgaacaatcttatcacttgtggcttcgaaaagcagataatcggttggcgcgttcacttaccatgattattttaacaaaacttaacattcacaaaaacattgtctacgcttgcccaaattcaaaagctaagatctcagtcattcttcaattgtcctaacattaagatagccttttcttgtcactctattcttttgctttcaaacaaacttttgatttcttttgctatatttttgaaacaaaaaatatttacaatttttatttacatacctattggataaattatttgagtatgtgtaaaaatgcaagattcataataaaattgagcgatcaatggttgaataaggttcaattggtattcactccgaaggcattgcaattgtctagtccaataaaatatttcaacgctgaatgcatctcttcgatatccaaacgtgagagaaaggtcgcacgaagcttaagtgaattaaattttggacaattctaacaaaaaaatgatgtacctgcaattcggcggcactgacatccgatggtttggcgagctgcagagaaattgtttctgtcgcgaagagttctgcgagttgccgtagtctttcattcagccgatctttcatctgaaacaactgcgtgattcttcgtttattcgtggtcccctcactttaggttggaaggaacgattcagcagagagtaaatgccatcgaaagtcgaactggccaattcgatgccacactcccggagaaatgtgtggatactgtgtacaaaacggagcaaagaaacagcaacgacattggccgcgact

SEQ ID NO: 2578 - DNA, 997 bp, Heterodera glycines
  misc_feature (26)..(26): n is a, c, g, or t
tttccagttgcaaatgccgtcccaanatcgctgaggacgaggtgtggcacttcagctgaaaagggaaacttttgatggagaaaaatacaagcaagaaagcaccttcactgtcaaaatccaaaaggatgttgtccgatttcatatcctaaatatttttttcaatttccttctaatttatccctctctctctttacccgatgacaaattttgtttttgtgtaaaaagacaacagcttccaacaattgtccgaacaaaagtcggcccaccattgggtctcttttctcgtaatcgttcttcagttccaaatagtcatgcaaagtcattcgatagcttaaaaaagtgtattattattttgttctgaaaatgacgaatttcaccgtttcatcaccaaatgaagcgttttcaactcataagtcaaagggttttcggctgcgtttggcaacgcctcggggtaaagtttctccgcttcgggaagaattggcatacgatcgacaaaggcggtgtacattttgatgatgttggggtggggacgtgggagtgtctttactcttgaaaacttgcattttttttattggaattggtctctgttggcagttaattttaattctctctcactttgccattctcgcccctctcaaaacggcctttggcaatggtacgagtggaattagttcagtgcccatttgtttccataaaacccgttcaggcacttcctcccaattgtaattgaacattattttgagggcgagtggaaattccttaaaattttaaagcgttctttaagctttgacttaaaagtgccgaatttgccttctgagaagtcattggagcgatgcgccgcgaatgtccgtcggcgacgcgcagtttcaactcgtgcaccgccccattgcaccccttggcaatgaaggcacctcaatgtccaaccaaaattgagaaatgagaagggcatcaataacagatttcgtatccgtccaaatgatccggcagttccgtgact

SEQ ID NO: 2579 - DNA, 3865 bp, Heterodera glycines
tctttttcgtccttttttggtcaatttttccaaattttctcccattataatccgttaatttttaagccaattgctttattcagctgaggatttcactgtggtgagtgtttgccgtgctttgccatttcccgtgctcccatttccggacagattcgcggtgctctaatggttgcagccatgaaaatgatttccctggcatttgatgccgaagatgggtcttttcatacgattggtctcggcgattgttggcattcctcgctgtttctcaaaagagtgtgttcgatgttcgcctttgtgttcagtccgtgctccgttctgttcggacctccgattcaattcgagcaattcgacgattggactttccgtcgtgtccattccttcggcttcttcgtatggcttttcctcggctcctttctctgcatttcgtctgctgtcccttttagcctctgctaaaacgtctcctccacttttctctgcttctcctctcttcccttctcttcctttccctctcctcttgtctgattgacccttcgtccgactttttcccctcccatttgtccccttggctcttccttcactttttaaatgctcagtccttccgcttctcccacttcttcatttgttatttggcctccgcttgtgccgttttggctggccatccaactgttgaaatcactcgttggacttccatcgaatggccccgttcgatggctgaagtggccgtccattggaacaagccaatgcatttctttctgcacaaatgtttcccattcagtcgcaattcctctctaaactgtctcttaagatgtctatcggagggccaaagtccgcttgggctccctcttctcccttttgctgacatttgctgtctcttccgctttgcatgttcgcttcgttttgctcactgatttttgaataatttttaatttcttttagggctttgattttcaaatgctcgccgttctcctttcccttggcctttttgtcttctcagaaaccagtgactaattaattagttatttaatctctccgctttgtccgttttgctttgattgttcttttttcatggcttcgcgatgcgctatctcttttgttgtccgcttgtcttcgttcaaaagaatgtcctgccaattgccaccaccgttataaaaaggtgtgccaaacagcaaaagaatccattcgctttctctcccatttttccatttcgtctctttttagggtcatttttcgcttctcattgttcgtctctgtttcactttggtcaacattttccttctaatttatctcggtaataatattttttggcattgttcagttgtgtttaattaattgcttttttcccaaaggttctccgttccatggcgaaggccaatttaccggatacagcgcggaacatttgctgtcaatttggagggatcaattccattattcggggcatctgatcgcttttgtcaccattcttatttctttcgttattccaaggaaatgcaaagataattagccatttaacgcattttattttatttatttttcactttgcctaataaatttcgagacttttgattttgtttgtttatttactattgtttcgggtgagggtgcacgttttgaagttcttttgccgttcaaaagaagcaaaaggcgagcgcacgcactgatcgattttagccacacaaatccccaaatctcactcaaaaccctaattaatgacggtgatcaatcaattaactctcgaccaatttaagaccacaacaatccatccgaattcctttaaacttttctgtgagtcattcccttctttttcaactttcttttgcccccaattgatttctcggcccgcgcattttcactgaaccaaaatgtgaaaagggaggtgacggagagagttttattgggaaaatgcgaaggaatgaatgtccccgaggcatggaaaacgaacgccgccagggcccaaaaataggagagaaaccgccattagttgcgccagcagcgatcggtgcggtgcgtacgccttcggccggggcggctgaattccaattattttgtttgtcattttcactgtttaggcaatttgctgtgctagtgccacgaaaattgctaagtgcacggccaaccactcgctaattaagacataattagctaattgggttaggagtgctcatttgaggcttatcggttgctgatgagcgcaagtgacacaatgccaaagaaagcattgacatttaaatatatttcgtttgtgcgttcagatccccctaatcagctgattgtgagctaattagtgtttttttcctcccattatgccgtcgatcacttcgtccgtcccttttgtctctttgcccttttctctgttttctctgcttctcctcctcttccccattgtcttttgctttcctcctaattttgaaactgtctgtccgacactttcttcgggagtcgagtaagtcgataaattaaccctccctgcccgttgccgtaattttttgccgttttttaggctccgatgcgcaagggcatgctgccgaagccttgagggggaaaatcaggtaattaagaggcattcttgtcattttctgttttattggggtcaatccaccggaaattggctttaccacagggttatttctgctgtgaacctgacaatgtgaatgttgtggaatcgtccggccaaatcaccgactttggccaacacaaaagggaggaacgtttcgctgccgtgtacgcccccggcggcggttttcagttcgtttttcggcatggtaaaagtttcgtccaattcgcccctaaagggtcgactggtccctgttcatcatcggcctcatcctctccatttttttgtccatcctcctctccttcttctgctgcttgctctgcaacgggtgttggctccatcggcgccgcaacccgcatatgtacgaaaatgtgggagaacggggcgaggacggcttttatcacatttgttgcggtttcggcattccaaccggcacaggtgaagcagcagcacatcaatcggaaaagcaaatgcttgtccattcccataatttcagtggtgttcagcacccatcccccgcagttctccgacggcgtttatgccccgccttcgtctctgagttcggcctcgcgaagccgagtccgtttcaacgaaggcgccgcgccgaagggagtgctgaaaaacggagactttcagcagcagcagtacccaacgccaccaatgggcaatgggggcggatattatggacactgatcggagagagaacggaggcaaaagcatttgagggaaatgccaatgccatcgtaaggggcaaaggacggataataaaaaaataaaatgtacaaacaaaaagcataatttgcaacgctaaaacatttgaagccttttgaccaatgccttaagccgatcaatcagtaattatattatgttgttgcgcatatttcttcagtttttttttccattaaaagaataattttcatttggcccttaattgtcaaatttcacaattattaatttgctatcaattaagagtcaattaattgtcgttaattggagagggcaaagaatgggcaaagaattcggctgaactttggtaattgaatggcaattccttcagcatttcacttcttaattaactgtcgttgattgacttccgtcgccgttgcgtcgtcactatttttcgtcaatctttgccctttgtcgttcaaaaaatatcgctgtctttttacagcgaaagtggcggcgaaatgagcgcttttaaagacacccctcggccgggttttgcagcattgaaaaattttaacaaattttcgtcatgagcaaatccatcgtcaatttgtgccttttgagcattgttttgctggcgttttgtgt

SEQ ID NO: 2580 - DNA, 2963 bp, Heterodera glycines
tagaccgcagtatctcggctcagagtgaagattaagggtcgcaaaagagacgatttaacatcgattggaaagttatctcgactgatataataatgatgcagtcgcggcgatgtccactgagatggtaccaaaagttacataatatctttctataaggcaggaaaggcagaatttgaatggccagtctatgtgtacaacgagcgcccgctgaagcgggtgatgtgaatccatagcaaattgtatgattaactttgtgccacagttatatcataaacgtgaatggaccgcaggtagcttggctcagagtgaagattaagggtcgcagatgagtacgacttcgtaagcgattggggaacttatatcataatgatataataacgatgcagtcgcggtgttggtgaggagtaagtggcgcaaacgaatcgcgttaatatactcgaaattactcaattccgaacctcggacccgaattcgaacaaaagaagttggattttttctggtaaaagcttcgaattcatttaacaactatttattttgatccaaaataatgcttcaactattaattgcataaaaatatgcaatttacgccaaaagaacatcgattttaacgcgtattttgaataaaaattgaactttttgttcgaattcgggtccgaggttcggaattgggcaactccgagttcacattcgtaatcagaacccttgaaaacctctaaaaacaggttttgagcccaaaattttaaaaatgaaaaattagggacacccattcttcaggattgcctcattttcactaaaaaataaggtaccttttattttagagcgagtcgcaacttcctattcaaggccaaaatcaaaaaaccggaactgattttgtagctggaaatgcccggggatggcgtccagaatttgctggaagaagcgtcgtcagaagcacacaaagccaacctaaacagtggaataattcatcaatgtcctttaatgtggagaaaagaggacgagtaagcaaaagcaaatccatgtcgacaactttggaaaacgaatcaaacgatgaagaaggaacaatgaaacccgcaaagagagaccaaaaccatcgaaactcaacgagtttgttagtccattgtctttttagtcatttattaccataacagatgacttgcgaacaacttcgactaattcggtttccaacggagaatatgccgattgtgatgagagtaatgcttattgttaatgtttagctttacattaaaaggcatatattgcaaagcggtctaactaaagaccaaaatgggggacacttgttttttcctaccccgaccgcttctctgcataattgcatagtttattacctattagtggaattggacgagccgttctctgaatctgaaggggaagactttccacaagcgaagggcgttgagaagccgtgtttggtcatcccccgtggacgcatccgctcgctttccggtgtttctcctttgctttttgtttacttatttgacttgttcaggtacaattccccccgtgggctttgcgccccattggggcgggccgacgatgtgtttgagttgcttccaatttttccaattgcctgagatgatttgcgagttttccactcatctcctcactgagcatcaaatctttatcgatgggatggatataatcgtggacttgaaacgttacattgagtattggcgccagcaattcaccaagcgaaacattgcagagattttcccaaaaatttgtcctaagcccgaagatgatgtattcggtaaagtgggtttctactttttgatggacgaaagtgtgaaagaaggtggcgagtggggacttcacagttaaatggtcattgcctttcacagattacggattacgccaacgtttggccatgcgtcgtctcgaggaggctttggcatgccaacagcgcgagagagaagactccgtcttctcaattcaatgcattttctgtcgctacatggcgcgaggaaatcgttctaagatcatccaccatctttataccatccatcatctcaaccttggctcaccggacagtacgttttttccctattctttaactaatttcctacaactttttttttttttttgctcttaagagggtaaaaacccaattcatactaggccaactcgtaccatacatggaaacgggggggggggggtcgccggcgaagggaaaaagagggaaatttctgaaaaattcgcctattttcttaacaaaattgtttaaaattctgaaaatttttccccggcggcgcctacaggcaccgccggcccccttttcttgaaaaaacctcgccgaatctttttgaaatatataaaaatctttcttgaattatgcatgtagaaagagtacctaaagggctatcgaatatactaacgatttacattattttttttgtttagctttaccataatatggtaattctagtaaaaacctttccttgtaaaaagccaactttattcgagaatcataatcaattaaaaaatccccttttgtaccttttccgatataaatcgccactagtgatacttattgttacttttatgaggtttcttgttaagacctcgtcttcgtcactgaatacatcgaacatttgagagagaaacttttgcgaaatgagtgtatttactgcgagaaaacttttgccgaccgaaacgtattaatggaacacatgcgaaagaagaatcaccgagaagtgaacccgaagaataattattacgacaaggcaacattcttttcactttatatggaagacaattgggccttttagttctacatcatcaactacttggaattgggcaagcgttggctggacgttttggctgaggactttgaggacacaatgccaacatttgtcgactctgacgatgaggaggaggaagattcgtggcacgagtggcaggcatttttccggcgttggcatcatgtttcgctaatgctcaattca

SEQ ID NO: 2581 - DNA, 2670 bp, Heterodera glycines
atgatgtattcggtaaagtgggtttctactttttgatggacgaaagtgtgaaagaaggtggcgagtggggacttcacagttaaatggtcattgcctttcacagattacggattacgccaacgtttggccatgcgtcgtctcgaggaggctttggcatgccaacagcgcgagagagaagactccgtcttctcaattcaatgcattttctgtcgctacatggcgcgaggaaatcgttctaagatcatccaccatctttataccatccatcatctcaaccttggctcaccggacagtacgttttttcgcctattctttaggtcgtagcgaagggaaaaagagggaaatttctgaaaaatttgcctattttcttaacaaaattcatttaaaattctgaaaatttttccccggcggcgcctatcggcaccgccggcccccacaaaaatattatttttttaaaaattaccccaaaatctcaaaatttggtcattttttagataaaatctgctaacaatagcattaaaattacaaaaaattccccggcggcgcctacaggcaccgccggcccccttttcttgaaaaaacctcgccgcaaaaatctttttgaaatatataaaaatctttcttgaattatgcatgtagaaagagtacctaaagggctatcgaatatactaacgatttacattatttttttttgtttagctttaccataatatggtaattcgagtaaaaacctttccttgtaaaaagccaactttattcgagaatcataatcaattaaaaaatccccttttggaccttttccgatataaatcgccgctagtgatacttattattacttttatgaggtttcttgttaagacctcgtcttcgtcactgaatacatcgaacatttgagagagaaacttttgcgaaatgagtgtatttactgcgagaaaacttttgccgaccgaaacgtattaatggaacacatgcgaaagaagaatcaccgagaagtgaacccgaagaataattattacgacaaggcaacattcttttcactttatatggaagacaattgggccttttagttctacatcatcaactacttggaattgggcaagcgttggctggacgttttggctgaggactttgaggacacaatgccaacatttgtcgactctgacgatgaggaggaggaggattcgtggcacgagtggcaggcattttccgggcgttggcatcatgtttcgcaaatgctcaattcaggaggacaatgcggacgagggggacctttttgcggtgtgtcttttctgccctcacgcacgggagaaactcgaggaaactatcaaacacatgaatgagactcacaaattcgaccttatcggttacatccacgacaattccatggacacatacgaccggatgaaattcgtcaacttcatccgaaaacgagtaactgaatacttaattcagctcgtgttctctcctcgtcacaattttatatgatttagactttcaacactcggactaaagaccaacagacaatggaatccaaatgcgttgaaattcccgacaaagagcaatgggacaatgaggagaatttggtgccgctgtttgggaatgtcggttttggttttctttgggtctctctccttcacatttgttaacttttcataggaccatttgctttggatgttggagagttggcatttggagcaggaaatggagcaaatcggaaaacaaaaggcgactgaatgtgatgaaccgatagagaaggctgtcactgaaagtgttgtcgattcaccaaaaattaacatgggcacattggtcgaggagtcgaagcaaaacgccgtggaaggggtgcaacaaattatactaacaataaaatcctgactttgtttgggtttgattaaccggatttgcgcccttttacatttctttgcttttcaggtgattgccgaagatttgccggatctgacgggcagtgtcttggccaatgccgagctccaacaatcgctccgttgattttgtggctctccaaaaatcgactaaactgttgctagcacaaattattatgagtattttccagttgttgacaaattatgtattaagtcgaaattttatgtaaattggactttaaatgcgttcgttgtctgtgcacttttcactctttcattttcaaatctttcctacgacatgggtctttgttatgatgtaaaaacatagttgatgtgcgtatttgttgccttgccgcaaacgcttcgataaagggttgctgtgaaaagacaaaaatgtttctgttcctataaaaatagaggatgacgagtcatttcgtcgtaggaattggacatgtttcccccccctggcgttaccgtcgctgtccctaaatattccatcattgtcaaaggcgttttttcctttaggagatggacttggtggttttccctgtccgcggcttctgttttctccgtttccccagttacacaaatgccgagccgataatcccgggattaaaattgcgtttggttgattccctttcacggggttcctttagccattcattcattgacttttgccaattcttcgctttttaattgccgattccctcgggcgcaatgcttttgctccgtttcgatggttatttgcttatttgtctcccaatgtttgcccaatttctgttcatccgtccaa

SEQ ID NO: 2582 - DNA, 3162 bp, Heterodera glycines
acatttctttgcttttcaggtgattgccgaagatttgccggatctgacgggcagtgtcttggccaatgccgagctccaacaatcgctccgttgattttgtggctctccaaaaatcgactaaactgttgctagcacaaattattatgagtattttccagttgttgacaaattatgtattaagtcgaaattttatgtaaattggactttaaatgcgttcgttgtctgtgcacttttcgctctttcattttcaaatctttcctacgacatgggtctttgttatgatgtaaaaacatagttgatgtgcgtatttgttgccttgccgcaaacgcttcgataaaaggttgctgtgaaaagacaaaaatgtctctgttcctataaaaatagaggatgacgagtcatttcgtcgtaggaattggacatgtttcccccctggcgttaccgtcactgtccctaaatattccgtcattgtcaaaggcattttttcctttaggagatggacttggtggttttccctgtccgcggcttctgttttctccgtttccccagttacacaaatgccgagccgataatcccgggattaaaattgcgtttggttgattccctttcacggggttcctttagccattcattcattgacttttgccaattcttcgctttttaattgccgattccctcgggcgcaatgcttttgctccgtttcgatggttatttgcttatttgcctccaatgtttgccaatttctgttcatccgtccaatgttcgtctctttggcgttgtcactttattttgtccatttcaaattcttttttttctccccccccctttcgccccccctttttcagtcattggcaaatacaaattggtggtgaaaatgtgctaattaattaatggattagcttactcaatataaatttgttacgcgatgagagcgaaacaaagaaaagaaagggcaaacgattggaaaggcaaaggaattaattaggagcaaagagagagagagaagaagaagcggactaattaatttcgctgcgttgtgccaatgcgaaggaaatgccatcattgagcgaacgattgcccaattccattcattccttctctgtctctctccacaaaacaaaggacaattttcgcctcctcagctcctcctattcttcgccttaattaattctcaaagaaattataaattaaaaaagtgaccgatcgatcgaaaaggactgatcggaaaggccaaaatgacgacgactcgcgagagttcgacagagatcgctgatcggtaccctttcggctactccaccgaactctcttccaaccacgaatcgtccatttgtacggcaaaacggcttcgacaacgtctgcagaggcaacagtcgggccaatcgggtcattcttttcttttttgggatgaccaaataaagcggattttatgtgaaggacggcgttacaccggcgaaagcagcgaaggatcatctcttgtggtgggaaatggggggggaaggccgagcgaatagcaaagcgacgttttgagggcactccgacggagtcgggccgatgtttcactttcaccgccgcccaacgcattcaccgaaacggagccacaaacagcaccaccacaaccaacaacaacaacagcaccagcatggacgaccagcggaagccgtcgatgaatcaaaatttgtcggaaatgttattggacgtgagtgatcggaaggggccgtaggattgacgtcagccttctcacaattagcgatcctttcgtgtcaattggcccatttaaggccattcacatggaagacgccaatttggtcgaccgtttgctgctgtcccattgcagcaacaaagtgaccaaacactgctcccctcctcaatttctctgatgcctttcaaaggtcctttcctcgtccccctccatcggcagcacaaacactttcaccgatttggcccaacgacggcacggcgccaccggcggaatgggttcgatgcagcaccgacgctccaatgcctcgagcacattgtccacacattcggggggacgctcaaactgtgctgcaatgagcacattgtaagaaagtgaattgtaacggatggaacgaaaaaagcaaaaaaagggacggatttgaattttaagaaattcaaaatgaatgcattttcttcaggcatatggcagtggcacacaaacaacgcgaaattgccgagctgttgctgaagagcggctacgacccgaatttggtggcgttgtgccattgccggggcgcgtgcattaccagcggcaacattcctttgtcatccgttttgccaccaaggcatgccattcactaccaaacgaactttcgcatattaatcttttccctctttaacttcagtcgctcccattcggcggccattaccagcgacatttgctcagtctgttcacatcttcgagtcgtttcaattctcgatcagacccctctggcgattgccgtccgaactcagagtgccgaaatgatgtaccatttgcctaagggctatttaatgagtttgatacttaattgcagaaatttgctggtctcatacggtgcggatgtcaactcagtggacgaggacggcaattcccctttgatgttggctgtccgcgactcgcctttgagttggcactgtcttcacatgttaatcctattcggagcaaagtaataaaatgccgaggaaatagaaaaaagggaccaaattaaggatacaacagaaaaactcacgagggatctgtcctttggatttggctccggaactgcgcaaaatccaagagacgtgtgtggaggccctcttccaaatggcctgctcccggccaaacaatgcctcccaaaacgcatcccccgcggcattacacggcacagaaagtacccagggtcatcaccagcagggctcctcggccacaggtggcaatggcactaacggagcagcagagcgtacggaagaacgcgacgcaaatgggacgaaacaaacggcgggggccgcagcgagtacgcaggagagactgatgcgcaccgcggcgatgatctcagccacgaagcaatcacgaaaagcgcatttggacgcaggtgaaagcggagggagagggggcgggagacattttgagaggggggggggggggggaagggggggggggttgcacattgtaggatggggaaggat

SEQ ID NO: 2583 - DNA, 4359 bp, Heterodera glycines
  misc_feature (22)..(22): n is a, c, g, or t
ttttgggggttggtgacaattnagggaagtatcgtcgtccccccaccgttcgcgttgctgtgctttgtttgttcatctgctctttatcagcttacattctcagagtcgctgcttttgccggccagcttttgcgagcgtggcagtctcagcaaatcgccgctgtccccgcgcacttcggccgccccgtcggtgtccaactcgtcgatcattgaaagtctctcggttaacaaagaccgtatcagcgtgggcggtggcaacgccgactcggcctccattccaaatgtgccaataaatgcggcaaaccgccgcaaatcattcgtgtcgatgcaactttaccgcaagtccaagctgaacaaggaatgtgagctcaattaaagcggcggtgtgccgtctttggcctattttgcttctttagcgccactgtttgtgaacgtaagccgagaacaatcttgggaaacgctgcagaaaatgagcagcaacccagaatgcattgagataatcatggcaagtggtgacaaaaccaaaacgaggacagaaagggcacagagagaaagagactcaattgccaatgggcaatttaaaggaacaaacaaaaccaaatttagggaccatttggtccattaattgctaattacactaatgccttcttttagcgttctctgcacaaatactgcgcccaacaattggacgattattcgaatcccttttgtggcaatgagcgcgacgtgatggactcctttttggggggactgctccatcagatcattttgacagcgatcggtgattattacctaatgaacacgcccagtcaaaagaagtggaacaagcggagattggttggttttattgggggatagccaaggaaatgcccattcagtcgaatgccaaaacacactatctatatttatttgatacttcaggtcggggttctcgtctcgctggtcaacttttgctatttgtgcttacaaaagagtgggacatgtcgtcaatttgccgccctaagcactttaaataaggtttaaataaataaagcaatttcaatacttttgatcacttcctaatcacttcgtttgatctttccatttgacttttttctgatcagtcagttttagtctccattctgatcagttagttttgattccttttctgatcagttagttttgattccttttctgatcaatcccttttctgatcagttagttttgattccttttctgatcaatcccttttctggttagttttagtaatgattccttttctgatcagtctgttgttgattcccgctttgaaccttttgctgaattggttttcctttttaagatcattgacgcgggtctggtcaattcgctcttcacccatcctgaggttgtcttccattcttctcggcttctcaaccgttcctacgactttcatcattcgtactgtagcggggacgacgattacgatgacgaacttccgccgcatgggtcggacccttcgcaggttttgcggggttaacacggacagaaagacccttctgtcccttcactctgatcattcgttgatttacacagcgtccgggaaatgagctcctgtgccagaaaagatttgcatgtgtggctcagtggtttttgtaagatagtaaagggacaaagggtggtggttcgagtccgttgtgcaacatgaatattttcatttatttttgtccaaaatattaaaaaatcacgatatttgggaattatttttgaaggtttttgccaaccaaattggataatcttggtacctttcgaaagctcttgataatgagaagctttttctaagcaaatgctaagcgatttggtgtaccagagaaaagttatgaggctttaaaattttgtttttcttataacttttgaaatagagcattaacaaaaataaattcagcattaatcgatgcagaatttttttctctaacgatatgcaaaatttcctgtggatctaacatatagaaaagaagctaaacatagcgaagtaaatgttgtttttcctaataataaaaatattagatagtacgccaaaaggagacaaaaaattagagaaaaaaagataatgtttttctctggcactctctatttattggtgcacatcctcggctggtccgtgacatcgctttgaaagtcattttcactattatgtaattgacgctctgcaattttccataaaataaaaaaattttatttcttgaaaaatgttcgaatccgggttcgggtccggcgcggctattgcaattgtggcaatagtaacttttttgagtcaatgtacatgacatttttaagagctcactaaagatacaaaatgttaccaatgaggcagcagcggatgcatggagcgaatcatgaggaatctacgtttaagtcacaccttcaagacgaagtgagacaaattctgctcacttgggaaaacgaacaccggaacaatgattgggaaattgagccatctttgaaacggtcagtttccaaaattagttcacagctcttattcgcgcatacatccgccggcaccatccctaccttattctcctgtcatgctttaatgtatttagaatggccgaaatactcgaggaagcgataaacgattatctacagaacaacccagacccaatggttgatacaattacattaactgtgaaaaaaagatgtttaggatgaacggcacccattcaaatcgcaaccctcgcgcccgctaggctatttgctgaaaatgataacaaaggaagagaactttctcaacaaggtttctattttttcgctttgctctttctcattccattgttttcagttgatcatttcgtatcttctcgccagggacaacccccgactgaatatgttcgctgcccgacttcttttggatttgttgcctggaattgacaccaatgtgatccttgcggtaattaataattattcaattacaattggatttaatcgttcttaggatgccgaatcattattaacacaactctttcgctgggcagaaaatggcgattctcgcgaactcagagcgtatagtatggctttacttggatcggcaatggacgctgaacaagcgcatcaatataggcagcagaacgcgactttgatcccaatcgccttgcaacgccttcagtcgctttatgtaacattaaaagttacgcaccgaaatactagtagagcattgttttcttttagtcacaaatgttgtcagaatatgatcatcaagacgagcaactcagaaaggaaagcaaagtagtcgggccaaccgatttttcacttttacgtcaagaagaacaacatgaagaagcatttattggtacgacttctacaccagattctaatgaggaaatgcgttgccggccatcaatatccaatgtgaatttattcttaaattatttaccaatatttaactgattaacttctgcgaaataaatggatcaaactgtccattatcttacaagtcttcttcaggaagaactcataaaggtcgccagaaaacggcataatgaacgacagagtggattgtcaccaacttcaaagcggtcatttcccgaccaaattacggacaatgatttctatgctgattaattcgatacggggcgtttctaccattgacggcggtaacagcaacagcagttggcgtcaaataatgcagccgattttggttggcacccattcattgtacccgctttcgattgaaatggagcaacgacttattcttaactatttgggaccgaccagtgaatatcaagatgtattttcgggttttatctaactttatttccgtaccttctttagaatcttagtattgttctcgagaaccatgcacttgatgttgttttaaactttttggaaatcgatggtccgaatcacaaatgcagagacattcggcttcttttcgacggcgttcgctatatctcctcgctgctcattcaccgcaaatttgcctgggaatttattgcggcgcagggaatccaacgcctcctgcgaatcaatcgtaaatcaattgcctcaactgcagtgaccacgtgcctttattatttggcctattcagcggatataatggaaaaagttttactgtgttttgttattgattccatccaattcaaaataggtgtgtcatttgcctgaacaagttttgaatgacatcatcgattacgctttgtatgcgcttgaccataaccatgaaagtggtcgtgcttcaattgccatgtttcttgcccatgccctccaatttcgtcccatcctcgaccgttttgaccagcgtgatggtcttcgccgtctctacaattacatttcaacattgaccgtactgcagagaattgaggaagacgggtcagatctgctcaacgacgatcacatcgcgcaaagc

SEQ ID NO: 2584 - DNA, 3232 bp, Heterodera glycines
ataaattttgtatatgcaaattgtatattaaatattcattcatatgtacattaaattatacacaaaataatttaaaaagtactgtcgaaatcaattactgtcgaaatcacctggcacttttttggacggtgtccttaacatctgtcgcattataaaaatgtccttgaagaaagcagcatacagatttttcggagaaaaggatcaattttttagcacccggaagaaccagtcgacactccagtaaaatgtccgcagcttcccgccgaattccacgtccacgtcaacaaggtccaattctcgagtttttttttgtacttggggctgagtttgacttttttccatttttggatgaagtgctgatttttgccaattcagtttgttttaatattaattaatgaacattttttaaaatttattcttctttattcttagggtgataaatttttgcgttcattttttgttaacattaagtgtccactaaattctgtcatagtggtcaacaaatttatttaagaattttaacaatccaattacaataatacagcaattttaagaaaactttgccagatcattctcttatattagctccaattggttttttattttgttgaatctcggaattaaattcattgaaaaaactcgaaattgcatttttgaagttgatttagcgatttttaaaaaatctatccgtaaacaaatcaaatttctctcaactatgacagaatttagtggacaccctaataaattttgggattttttttttggagactttcattcccaatttttgtagcgggtattttatttttgtaaaattaatataggatagacactttgcttaaaattttgataaaattgtagttgcctatattaaataaatctgatgttcactatcactttccacattttgcattttaagtctcaccgacctttgccgccaaatgatatgccaataaatgacccgaccatttacttcgataatatgggaaaacccaattttgtatcaaaaattgccaaaaaagctttatcattaccaccatcatcatcatcatcttcatcaccatcattatcatcatcatcttcttcatcaccatcatcattagacggaccaaaaaacaaaaaacaatcaaatcggcaaaattccgctaaaacaatagaaaaaacggattcatcgccgtcgttcagccgattttcaagaacgaaaagcccaaatgatagagctaaaactagcaaaaacaacaacaaagacaatgataacaacagcgtcaatatagatgacatcatgaaagaaatcacagaaaaatataaaactgtccaattatcgggcaatgaaactgataataatgatgtttggctaaacgaagacgagttggccaaatattcagaagtatggtaatgagaaaggaggaaacattgagcaaaaagaaaaagaacggaattgaaaatggaaagaaaaagaaagttgcaaaaaaaaaaccgtatttactgaattcgaacccccgggggttcatttttcaacccccctaaaaggggggttataattcagggggaagagggtttcaaattcagtaaatacggtatttaaaattgcattcccatttattataaacagagcaaataatgcctaatcaatcagaggtggagcgcgactaagacccgcgaccgcggcatttttcccaaaccagcgatttgcaatcgcgacaatttaaagtcgcgatccgtgaccgcggtattttgaatccgcgagcgcggcacttttgtccgcgctccaccccggtgtctgcaattcatcacggcggggctgggcggaaatccactgttttacctacatattcactgaaacggacagaaggaaaaaatggcaaaatttaacagaaaacggcggagttccgcgcagccatctgatcagtgatcacattgttattctgtacctcttttctcaaacattttgtgataagtgattgtgtgggattgtgagattttttgaaaattttgaaaaattcgcacttaaataaaaattctccaaaaaatataaccaattttatcggacatttttgctaaaaataagataaaaaggagaaaagtaagaatagaattccaaaaatttatttctgagataaattttttaattttttacccaattaatttttcgtcgcgtgtctctttttgaaatcgtttgagtggagggcggaggaccgccgaaaaatatttaaaattgtctaaatcagcaaaagaaagttaacaaatttttgaaattttagatgggaatagcgatgaacacttatgactatcgaatgatatcaaggattaatttttttgttttgatggttttttaaataaacccattatgattagggatgcaatttatagtttttcactatttttttcctgagctccccgaggcctgaaatgcacgaaaaacgtgtttttttcgactgttgttaagctacttttcgagttattagcaactattttctagttttttttatttttagcaactaaaaaactataaaatttttgaaaaaaactattttcaactatttttgcttgtgaataaaatttgctatgaaaaatgcaataaaaacgaaaaataaacctctaagaatcgacttaaaattttttcaaaaaatacaccgcctaagaatcgacccgaaaattttcaaaaatgcacccctaagaaatgaaaaatttattccttttaacataattttttattaaattatgattgagtccggcgggcaacagaacgcatcattgtccaacttttttccgtagaaactaaaaaataaattttggagatgaatttgaggaatttttcatttcttaagggtgtttttgaaaaaattttaggtcgatctcaggggagtatttttgtcaattttgggcaaaactccaaaatagattttttcaaaattttttaggtttttattttaaaaacctagaaaataggcactaataactcgaaatgtggcccgggttcgattaaattcatgtgaaaattgatttgtttccgtcctaaaattgttttgttttgaaaataaacaaatttttattgcgcaaatactaaaaattttggtatcttattattttttgtggtgttgtttttgttattatttttagtttacgatttccggtgaattgttgcataatttatatattatttttttaataattttttttttatatttgcataagaaagatttttccctcctttaaacgtggcaaaaaagaaata

SEQ ID NO: 2585 - DNA, 6352 bp, Heterodera glycines
ataaatatttcaataagaataggagcaatcttgttttatgcacattcattcattatcattttatacaaactgtatacatattgacgtgcatattcatattcatattctcactaaattttacgccttttattttgtaataaaattttattaaaaaaatatatataatacatatatatattaatgtttatacaaaaggaaattattaattttactttaaaatttaaaagccaatttttatgagttccaacaacgtctagcaaaatttttttaaaagactcaaaaagcttcagaaaaaattccaaaaagtcaacgcctcttacatattatgattttatttccgaaaaatataaatttattaaaataatttttatttaaaagtaaatttaaataaatattcattaagtaagtgtgtgttaaaatccatgttttgcttgctccatttcactcttttcactgcgctttatgtcggtgcattaggaggaatgtgttcatcaaaaaaggaaaaggtgcatgaccccttaccaagatacatgcaaccaacgtactcgtttagccaaagtaattaggggaacatttgataaataaatttaaaataaataccaataaattacctgaaatccgcatgtgaactgggattgcaagtgttttcattagaattgtcatgaatttttaattttttttaattttgagggtttggtaatttagggtatttttttttttgaaaatttgaacgtattaattgggattaagggataataggtgtcgataattgtgtgaaaatccccaaaaaaggcaaattaagcaattttcaaattttctgagagctttatcattattcagaatccaatgccgccaaaagttatcagagtacgcctgagcatgggtacaaaacgcctaatcaccccagggaaaatttggcaaaattacgacggacggttgcgcgaaataacacaattccaatgagtggtgcaaaacgcggcccattagcggcatcatcaagcgctgggagctatgcaaattcaccgctaattacccatcaatcgcaacaaaaaaacaaatatttacaacagcgagcatctgatgcatcaccggctgatcgaatttatttgtaggcaaaaaaccaagggcatagcttagccagacacttggcttcgggaggggaggctaatccccgcccgagattgttctttggccttatattttttagactcgattttttaaaaattttttttgtatggtaggatacagtagatctagatccgaaatgcgcctgcctggaaaattttggaattttgccgattttttaactgattttcaccaaaattgcgttttttatgttaagttttaaattataatgaaaactcgcaacaaaactttgtatttttcaaaaattatttattttcattaaaaattttcattttttagtttccggaggggggggggaagggaattcgcaaaaatttaattggattcattcatgggaaaaaggccgcttcaacaacgccggcagcacgaaatgaaccggtccaaaagcaccagaggcatgttacagttggaaccgacatcaccgcggtaccaacagctgctaacaccccaacagacaccacaacaccgtgccatgattaaggtcggttggatgggtgtggagaaggaatggaaaattatagtgatgctcgaaagtctcatttctcgagaaaagtctcgggttttttagtctctgactcgagtctcggcttttcgtctcggtcttcgagactatacgagacttgagaatgagaattttttattcccctaatgattggctttcttgatgctgacagggattgattttaataaatgaagcttgatcaccagggatgggagttatatatgctaaattaaaaaatcctcaaaatgtgtgctaaaaccccaaaaagagccaaaataaatgggacgaaacaaaaatgctttaattggctttaatatttttatgcttataattcgtcaaaattttttttaattagaaaaaatatttaaaggtataaattaatttatatttaaaaccatacaaataccaatccttactgatcattaaatatggtggcgggtgttttaagctaaaacagtcggtttaattttcaggttttcgattgagtaagtttctttggttcctggcttttcgttgaatatattaatggaaaattattttgtcctgtaaattgagcattattaataatgcttcctagacgcatttcgatgaattaaaaaataataatttataataattaattacccttttaatttggtctatctaattaatgtcatagaaacgatttgaaactccgccaccccaattgccatcgccggaagttgtgttcaaacaacggaacaatcagctgaggattgaaggaggacaacaccagcagcagccgcagtcgaaaaggacgctcacacgagtgaattccatgggcagaacgcaatcgtatgccaacgaagtaagggaaaagccgccgaaaaactaagccttcaaggcagaaggaatctcgacgaaccattaaatggtcgagagtcagtctgagcctgtggtataatgtaaataggcttgaattagttctaaattttctatgtaagcttgcaaaatttaaaaaatttgcatctacttaaatcaatttttagagatttgactggtcacaggttgtttgatctgctagatgaaatttgaaattttataggcgaataaagaaaacagagctaaaaaaacttattttttgctcaaaattttgttgggttaagttttgaattgaaaatgcacaaccactaaagacgaaagaattttttaaaaagacttggtttgaatctttcatgttggtcagatagctaaaattatttttatattaattttcttatctaataaatcattttaagatttccaaaaatatgcggagtattgaaaaattcttgtaaatttaaaaacttttataaacaaaatttagctgattacctatttttacttatggaaagtgcctggattttatttgctaaaaacccaaatatatactacatatatatatatatgtgccaaaaacaccaaaaatatttgctaaaatcctaaaaaggccaaatatttgccaaaaattgaaataaaactgctcaagaaataaatgaaattatttaaaaaatatcattgttatccatttcactagcacaatgctaatcaaaatcatttcaatgcttttaggcgataattcatgaaattttaaatccaatgacgatcaaagcagaattaaattgggtctttaggcatctctcatctctgtaagaataaaaattaaaaaccaaatttgactcaattgtacatttatttttttaactgggccctgtttatggaataacctgaaattaaaactaaatgaaccataaaaaagtagcccgagggttgcttgtagtaataatttttaaaattttcctgataaaaattttcattatggaatttctatttttatgggacgaatgccgcaaagaactgggacggaactggcgtgatggaactgaccctttttcatttatcagatgaaggtgaaacatcgccaacgtgctttgcccttgccttcgtcactgtcggttgttggtgcccaaattggggaccgaatgaaacagcaacaacaaaagcttcaacaaaatcgccaaattgcgcaactccaaattgactcaccgcgcggaatgtttgatgacaaacgcattttggacgagaaaacgaccgaagaaaaggaggaactaatggactcactttgggaggagtttaatgacgaaaaactcattagccaaatggacaaccgcccaaaagctggcaacatgaagaagtcgggctcatggtgaagcagtcgaaaaaatttttttttgccaaaatgactgctaaaattggcattttgaaagaaagaaaaatttatatatttgttgactttattgaaatattttttgtaagctttaaaaacatgctctgattttattaaatttcgccttcttggctatttattgagttaattgttttcaatctaatcaaacattgttgggcgtcaatcggccgctctaagttttcttaattagaaatttcaaaaaaaaatttgtaaaatttaaataagaatgtacaaaaagtaagtaattaatttgctgaattaattttttaaaatttgcaaactaacttttgttatgcttttattatgttctgctgattgttaccttgataaaaactttattttgcaaatttttaaaaattttctgttaataaattttatttcaaaactattttcaagaattttttaaaaatttattataaataaataaagttgattataattaataattattcttttaactgtggcgattaaaggaaatttaattttagtacatgttttttgtgtttttaaaatttttcgttagataaaattttttaaatttatatgatctaaagttttaaagagagtttctggggatgaggaaaagtgtgtattttagccaatttttaaaagaaaaaatcttttaaatgttttatgtttttaagctagaattttaatcagaaatgtaatttagtttaagaaatattttacaaaaagaggaattaatggaaaaaatctttctgttcaagtaagaaacgagtgaacaaacccacaaaaaagcagatgattgagactacaagtttaccaattggaataatttatttaaagcattataaattatataaatattttctatcattctcaatttacataaatattttatactcagattcccattacaatgctcaaaattgtggattaatttcggaaaatcgcaaaaatttagcaacccgcaaaacgtaaaattgtcgacccccaaaacccgcaatttcagcaatccgcaattcctgatgtacaaacatattttctttattttctttaaaagtaattcaactgccgtatttattcatttccgagattttcgcttaataacttgaattaattaaaaaaattctatgcataatttataagtttttgtgctgcgcattttacgtttttatgtgttggtattttgcagttctagtcacttaatagtgcctattttctaggtttttaaaactttaaattttgaaaaaacctattttgacctattttattttgtccaaaatttattaacaaaatgcattaaaaacgaaaaatacacccataagattaattataaaatttcagaaaatatacctctaaaaaatgaaaaatattctcaaaaattcatctccaaattaatttatttatttttgttgatagaattttgaaaatattatgtatctcaatactgttttggcttaattttgttgctttatggataaaatttactacacccctaaatttgaaactttttggcacctattttctttccaattttagcatctgttgtgcgttttttagaacgtaaaaactaactattttggcaatttttagcacctaaaaatataatccctagtcattaccagttaattacttttttccgttaatttccgccttttctgctgttattggtgttggcttatgtcttcatatatatgtcatttatacattataattttgtataatttgatgtaaatctaattttatgtgtaaattacataataataacaataataatattgattaaaaaagaaattgagaggattttttatagattttcatttaataaaaaaaatattttttcaatatatgtataatattattattcattcattttaaaattaaattttttctcacatctttatttaagtcaaattaaatgaaaaaaaaacaacaattagtgctcccatttttttccaataagaaactatgctttttaatatatatttttgaactattttttttgaagcgatctatttttgtgcctcgaatttgatcagaaacaactgttagtgcccgcctaaatgttgatttatcaacaatttttgctaattttctcgttgtttttgtgggacggtgtgtttggcggcgtttgcttctccacaccaaggacaagctccagctcctccgcgccggcacagctgatgcgcggcggtggtggaagcagccgaggaggacaaatgccgtcgccgcaaagggaacgaaaaaaattgaaacgggcaaaaagtgcaacgccacggacatcggtggcaacggttaatccgcattcatcactctcgagaacccattcagaagaagcgattgagggtaaaattgactttttgatttacaagcttatataaaattacgtatttaggttctagaaatttttgtggctatattcgaaatttaaggaattttaatttttttttatccattaggtataaaacgaggccctgctgaaaattgcatggcaa

SEQ ID NO: 2586 - DNA, 7669 bp, Heterodera glycines
tttcagccggaatttctataaaaatgttcgtgtgtaacctttttttgtctattcggataagtaagaaattgaaatattcgtattacttttcctcccttaaagctttataatgaaagcgtcgttgtctattttggatttgccgttgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccttattgtttaattcggcctttcctataagcacaatgtgtttgatgggctctacaaaatattgcttctgcaaagcaattattttcttggaggctttaattttctgtagtcatttgatatgcatctgctatttttctagtcacaaacaccaatatttttcggcccgaattttataggcgtgaaaagtactgatttccaacttctttctattcggatacacccaaaatttgaaaagcatctttaatttagcctcttttaaatcttaattttctgaaacccgaatttagaaaatatgaatgtatttctgcgacgccttctatacttaattcatccataatgggccaaaaatcataagttaagaccaaaagagggatgttagtttcagccggaatttctataaaaatgttcgtgtgtaacctatctttgtctattcggataagtaagaaattgaaatattcgtccgagtagccagtccactatttttggccataattgccttccttgccctatttggaagcaacggagcatccgaaatgaaggcaaagcccatgatatgtctcccggatgctcccaccagtatttggtcattgcctgtcgaccctatctgccctaattgggttccaacgcaggtccccgttccttttgcattaaatatatatcgaccaaacactgtacaatacaaaaccgaagctacagcctgcagctgcattttaacgcgcatttcaaggaggagaggattttttggtggaacatatgaagaaataagtgcctttcattcggtagtgcctacggcaatttgcaggaaaatggcagttgataaggactctccagcaggcgaattatacgttaatgacgaaacgttaatggcaacaaataattccctagaaattgggtggggaaaatggccatcaaatttgttttggagaacggaagaaatcgataattgttatgtgtataagacaattgtttttacacgtcatggaatggaggggttgaatacaccaatcggagagtgctctaattgcttttataaatcaggcgaatgtcaatgcataaaaattagtctgatttggacccccgacaagacccaactttgcccttttgtttggttgtcaaaatggtctggtgaatatgcaagtctaatatggacgacggaaagtggtgattttgcattgagttttgaaaatacctcgtctcatagtcagcccgggtgctatgccgagtcgggcgaactaattgtgtcggaccaagcgtttgccgtacctgtttcggacttccaagaaatggtcgagaaagccaaaggaagcggcaccaggaaaacgagagaaacaaccgaaattggtcctgtttatagttctcagcttgctgcacagcttacagccttaagcacaaaaatggccataacgactcagcggctatttacggagacaattcgtaaaatttgcacgagcatgcaaataatggcagaccaagctttaaccttgtctataacaaacccatcgttattagcgaggtttttcctgggaaatccttttttatcggctcgattgatcacggaaaaactaatggaggtaaaaacgtgttttcctatttatgagggcgaagtacattttgactggcaaaatggtcactgttttgagtttcttccggtaacattttatttataccgtcagcaaaagcacggttttatcgacccaaacacgttaattatccatacaaaatctaaagaggtggattgcggtaatggaagattcatttttatggagatttttggcatgataatacgatacgatcaaaaaacaggaaatgtcagccaaatttcaacagaaggaataagggaaatcagccgatatggaaaaatagacatcccagaaataaacctcccttttttcaaaaataaagttttggccaattttacggaactttactcgcgtgaaaatttcaaagaaacagtggaaggagccaaaataattcaggagatttcccgcttatcgcgagttgattcgtggaatagtccctcggaacacaaaaaccgtatttcgggtggaatagtgagcagcggactgttttcatttttacgtggcggtattctgagtctaaaccaactttgggtttttggatgctgctgttatgttacgctaacaattataatccaaattttgttaccgtcgacaatcgctcaggccttacagtacctcaatcttggaggaattttcttcagattctttcgatttgcatggcatattttctttagggggaagagaagaggtaaaaaaccccgagatgaaattgaggagggagcctatcccgtggaaaagaaaaccatacaaaagaaagactcaaaaaatcggaaaaggctaactcgtacgcactcagttccgctaacggaaagatggccatctccggaacaaaaaccgaccataccagtaaaaaagggcttaaaagtgagcgtgttggcaatcattgaatggaacacaaggtgcgatgaaacttttaaaattgaaggattcgtttacgggaaaataactcggtttcaattggacactggcgcacatgtgtcaatctgcagcctacgcactgcagaaaaacttggaataaaattgcttagtcctgaggtggctggtgttatcggaattagtggtgaatttgcaccagttattggcagtggaaaaattgaattggaactggccggagtgaaaatcataacagaagtggcggtgattgataaggaaattggtaaaggaggtgcatatgacatgctaattgggcgcaacacatttaaaaagacacccttctacctcgatttacaaaatggttacctgatcaaaaaaggcagcaacgaaataatggagtgtggcacctcacagagaaaaattgaaaatttggagcagcatgtcggaaaatcggggaaccgagaagcagaacggaacgaaacggaagacaggcaattgaaaagttgcttagaacaaaataaaaatgccttctctaagcacgaatatgacttaggaacttgtaaaattatggcaccaaagattttaactacaacagaattgccagaaagggttaaaccgtaccccgtgccggaaaaatacgaaagcgaattgaaaaagcaaatcgataaaatgttgagagctggcgtaataaaggaaagccatacgccttgggtgcataatatggtgcttgtaaaaaaggcaaatgggcagttaagaccatgtgtggattttaggccattgaacaaagtcactattcccgacccttaccctttaccgagaatggaaaaggtcatttttcgggtcgcagggaaaaagttttattcgagtcttgatctcgcctcgggcttttggcagatcccattggatcccgagagttcatataaatgcggaataattaccccatggggtgtttatcaaatgctaaaattgccttttggcctgtgcaacgcaccaagcatttttcaaagaacgatggacaaagttttggatgacataaaaaatgtaaatgtttacattgatgacatattgatacattcgaacacattagaagagcatttggaaagtttggatttagtttttaatcgcctacaaaagtacggtctaaaattaaagggagataaatgcaattttcttcaaaataaatgccattacctggggcatattttgtcggaagcaggctatcaaccgtcgttgggcaataaagaagttattgataagttcccggaacctacaaatgtgaaagaggttaaacgatttttgggaatggcatcgttttttcgaaaatttattccgggttttgcctcaatcgctcaccccctcaataaattgacaagaggaaatggcacggaattcgtatggggaggagcagaaaaagccgcgatggatgaattaaaacagcatttgttgaaagcaccttgcctacgcccgccaaactacgacttggccttttacttattcaccgacgcatcagcaatcgcttatggcggggctttaatgcagactaaggataataatgagatgcatgctgttagcttttggtcccgtacactcactccaacagagagtaaattaccacccactcatggggaattagcggcaattgttcatgcgatacagaattttcgagcaattctgtatggggcagaattaatcgtactcactgatcatcgaccattaacattcctcttccaaaaagccagtacaaatccaaaattaaaccggtggctcatggctctgcaggaatttgagccgaaagtaatatacattgagggtaaagcaaataaagtggcggatgctttatcacgagtccctatcccatgggaaaatgtggaaacaaaattaaaagaggatgtcccttatgtgttggcaatagaaagtagtttgaatagacaaacatttgtaaaagaaacaaaagatgatcaaattatgtcaaaagtaattgccaaaataaatgaaaactgggcagagccaatagagaaggaactggaaatatattttaaaaaccgagataaattgtatgtcgaaggcggaataattcgaaaacatccccagggccaatttgtggtaccaaagaaactaaaagttgccattttggaacaaattcacaaggctcattttggaatcgtacggggaaagtcaaaggccagaaggtatgtatggtggccaggaatgtcggaggacatcgaaaattttgtgaaagaatgtgaggtgtgtcaaagaaatggcccaagcccgccccgattggatccggaacaccgttggcccgcagcaaaataccccttcgagaggctccatgccgatttggcaggcccggtttggggaacgaattttttaataatggttgactcgtattcacgctatccatttgtctttcagacaaattcaaccagtagcgcaactttgatcgcatttttccgggacatttttgccttatttgggtccccaaaaaccttaattaccgataacggcccacagtttatttcggtagaattcgaaaattttttgtgtgaggaaggggttacccatttaacctcgccaacatatcatcccgccagcaacggagaggcggagcggttcgtgcgaacctttaaagaaggaattaaaaaattgttggatgaggggagaaatctccgtattgcacaattcatccttttacaggaataccgatcctcaccatgcccaattttgaaaggaaatagtccggcacaaatgtttttgaaaagagaaatgcgcacgagtttggataaaataagaatttcccaagtggaaagagacaaaggcactcctacgggcgaccccgtgagagataaaggggctcaaaatcagcaaaggcagttgccgaaatatgagccaggagattcggtatggatgcgcgaccaacaggacaaaaagtggacgccggccatactgcttgagccaataggagagaggatgtggcgtttggagatggaagggggcggagaaagaactgcgcatgtggagcaaataaaagcgcgtcgaatggtcgccggacgagcctagcccacatcattctccggcaaaactgttttttataaataattttctttttttttttttgcttttgtaagtctaaaatttttggtttccattccaaatttcgtatttttttttgtaattcatttttgtttctgcaagattttcttttgtcgctttgtccctcttctcgaacctttccgacccaaatcatgtcaaccaccgaaagagaagtcggcacttcggtcgagaatcttgaaaatgtgccaccacagcagagcaacgtcgccgagctcgaccaggacgggatgaccaagcaacgcaaaaagcgcccggccattgcaccagtgactgttgagatcggacagttgctggaggccttcaaatcatcattgtcggccgagatccgttcatcagtcgaacaacttcacaaggagttgacgggagaagtgcaccacgcactgaacgcactttggaccaaaatggagccggtgctcagcgatcagtcgcgctgcattgcggcgctgactgatgcgattgacgagttgtcactcaagggaaccgagcaatcggtaaacccatccacggatggaggtccagctgagttggccaaagaagcaccgatgaacccgcagggcggaggtccagcccctgagctggctaatgaggccccgttaaacccgcagggcggaggtccagcttctgagctggctaaagggcgtaccagcccagctcgttcgaccggaagagcatggcacggaaagcaacatcgacaacccgcacgcaaagccggccgtctaaactacctgatgcgccaattggagcgcgaggtcggcggcagccaaatggtccgatccccgcatccgtactgggaaaaccgccgagggaatggttttggaggaccgcgcggtgggggacgcggaggctacaatgcgtatcgcggagaccgttctgagcgcgtcggcccgtcaaacaatggacgttgaatctgtggtgtggtttggactccggaaggggggagagatgttgaatccccttttgacaaaatcatttatttaatttaatgatcaattttcacttatttattttgtacaacttttcttctctctccaccgatttcctctcccatcctaaccaatcgttacactttactgtaaacccaagccaagccaatttgtgtccatcccagctcactctcgactccaccccttttctcttttgctatttaaactgaattcattccttgcattattaccctttttttttactcactttgactcattcccattttacttgcctttctcacttttgctaaataaactttcattaacaaacctaaagtcttacttttgattgggaaataagtcgggaacacaacactatgctatcaagcgaagaggtttaatcaaattttatttgatttttgctaatttttcaaaaaagcaaataacaatgaataaaacagtaacaataacaacaaacggctcaagcttgattggttttccgctctcttcttttctgaaagggtgctgctgcctttcttggattttttcgaccagcgccgccgccattagccaccgaatgttcccgcggcggttgctctttgcctttgcccaatagcaaatccaacaaagacttggcgccggacaaatgcgaattcttaaaataaaaataataatttaaatgtcgaaattcgatgagaggtgtatgagccatggagtggaatgacatttgtgggatccgaaaattgaggatttttcaggcagaaaaaggtttatttgtttcgtgtgagcaagaggcattcgaagtccaccgtcttttcaagttgcggaaattagaaaataaatctttttttgtttgtttgtgctgaaaattgcaaactttta

SEQ ID NO: 2587 - DNA, 1902 bp, Heterodera glycines
aaattttggcctcaaaacggaactttaagacttttgctctgatcactcattcatcccttccctccccccccccctctgatcagttcgtcttttgctctgatcactcatccatcccttcccccctgatcagtccctcttttctctgatcactcatccatcccttcccccctgatcagtccctcttttctctgatcactcatccatcccttcccccctgatcagtccctcttttctctgatcactcatccatccctttctctcccttttcccactctttcgcttgccttcttctgctttttctttgcgcttctcccaccgttcgcatttgtcccataattcgttcagcagttcattcagtgtctcaattgcgtctgttctttttggcattgtttttatgccgacttttccgccccatttgtcaatgcttgcgtggatttgcttttcatgcttacaattaaaattgtcatcccccgcttcttcatgccaatttcggctttgtcccattcggctcaaacgttcataagtcaattgggacattcgctgttcggacagctaacaataagtaaatgatcattaattatttgttaattggacgtttagtaaactagccacgattaatatttgttaattaatccgctgtttagtatgttaaccattagttgtattaattatattgattcacttttaatgttttactcactcttctttcttcagttgcttgtgcttctaactctttcctcttcaaattttcttcagttttaatacgcaattctctttctctgttgtaagctgaaagacaatatcaaatggaagcccatttttaatcacccctaatttttttatgaattcccctagcctaattagttttaattacccctaattatcttccactgatttcccttacccttttccactttgatcaattccgcctccaatttggcgtttcgccccttctgctctccgttggtccgtctcagcagtgcgatttcgtcgtttgcctcgttcagttccgtcttcaggtgttccgtcgagctgttttgcgcgacacttcgctcgcttaactttttaattggcatttactctttaattatttttaaatgccccaaattggctttttcgccagtccattcacctcagatcgtctaattcggcgattagcttttggtacatttccttgcccattttgatttggaattccgcgatgctcagctgatgcttcaattgcgcctcgttttcgcggagttcggccagttcggcacttctgttacttatttcggcctttgcgcggtccaattccgctttatagcgtctttcgcggtcgtccatcagatcctccgtctgacgacgcgattccgcggcttccgcttccgtgtgcgttagcgattgttgtagccgttccgcacgctgacgccacgcttccgtttgcgggtgttctccgagtgcatgctgaaccttctcttccgctttgaccagcctttgctggaggcactcctcaattaattaattgatcaattagtgttcgttatgcctttcgttgtgcttaactaagcaccttttctgcctccaatttgccaatgattctctcctgctcctcccattccttgtcgcacctttccgcgtctgtcaaacgcgtctctctctccgtgcgcaatcgctgttccgcgtggtgcaaccgacctccacaagaagttgcagccaaatcggtgatgggaacaagcagacaaatcgcctaccttttagcgtctccaactccgcgtccgcctcggccatgcgttgatgcacttccgcgtcattttcaacacgcgttcggtccgtttcttccgcttgcgttatcacagccgcaagacgcacttgcaactcggacagttggacagtctttgctcgttggtctcttcaaaatgc

SEQ ID NO: 2588 - DNA, 1135 bp, Heterodera glycines
  misc_feature (1062)..(1062): n is a, c, g, or t
tccatcgatcgcgacttttccgcgaagggaatttcaaccaaatgaaagccgtcgtagaaatattcgcgcgcgagtgtctaaaaaatgcatctgatgagagtgaccatccattcggatggaactgctcacacaaccactcggaattcggtcggccgattgggggacgagcgcacaaagctttggaggctaaacgaagcgaataattaagggttttatcgactaatggacatgaaaaacaaacagtgttcgttttatgcgtataacggacgaggacaaacaattgtttgtccatacagcgcttcagaagggcacggtaaagggcggaactgccggagattacctaaaccaaccgacgacgaaggggaaatgttgagtgaaaacaaaagcgaaaagcacaccgaccgattcgatgggatagacaaaaacggcggcgcccatccgatgcgaatccttcagcaaatgcaacggtttgaagccgatcacaacaatgccttagggagtcgttgttacggtagaatcgttacggtaaggaaatgcgaatgctttttcccttaggccgttttatcgtattccttccgttttctctgcccacccggcttttccaatcggcgcagcttctccaactcggcccgactcagcacaacttcgaccccgcccacttgccgactgaagcccaactcgccctcgaacacttcgtccgccggcgtctctttttctttgccctcctccgccggcatttcttcgggcgcctctccctcccgtggagcaacgaggtaatggacgcgttgttcaatcctgcccagataaagtgacaaaaatggagttcatcacaaccaacagctgtggcacagtgtacctttcacccgtttccgtgtccatcataaccgcgggcggtttgccctgcggtttgatcaaatagtaaaggccaactgcgaattcgaagttgtcgcccattttgaagggaagcgaagtggtggaacgcagcgcgtaattcttcaggcggagactgaattcagtcgacaaattgtcattcattcccgtacattctcaccccgactgaangtcggccggactcgaaaagcgggacaacgatgggtcaacttctgcctgatgccattagaaagtttcaaaatga

SEQ ID NO: 2589 - DNA, 6403 bp, Heterodera glycines
  misc_feature (72)..(72): n is a, c, g, or t
  misc_feature (154)..(154): n is a, c, g, or t
actgaattcgacggggtaacgccgttatattaagccataaatgagagagagactgactatcggagcagcttntggcacagatagagcagctcagcccaattgcaaacgcccgaaccgccgagaaaagtgtccaaagattggcgaaggtcagccncactcaaaaggtcgtccaatcccttcacaaactccgcgtccatcgtgcccatttcgcggaaaacgaacactgtgagaaaagtcaacaggaaatgagagacattttgccaaaaggaaaagcggatattgcaaatcccccgtggtgagagagacgcactgttgtcaatgttctccgccttgtcatttgtgcgctcagtgttcgcaaataccacagcacacatttcgccccaattgcccatgcagcaaatgtcgctgatctgattgcggacggcctcaaaacccaaaatgaaatggagcaattacaatcccgacgattggcatgagaagggatcaactaatggaagacatgtaaaaaggccatttccgaatgcattggcagaaaagcccacttgtaaagccattctgaagcgaaatccgttgccaacaaacatttcggcgccgtaattgatcacgaaaatgcgtccctttttgccgccctcataaacgatgctctgctgctccccctcccattgctgctgaccgtttgaatcgtccattcttaatacaacatttttgtgttcaaaaacccacaaaactctacaaaagtaatcgcgctcaaattaaatggataaatcaaacaattaataaaacccattttttgaagaaaagataaaagttttcacatataaaggaaatgagggaaacactacagtaaactgtgcacaatttaaaagagaaaagaattcgaattgtaaaaaaaaacaatttgttcaaaatggaaacatctgacgaaaagtggccaacacaaagcacacagaacaaatgagcaggaggaacaaggctacggtatccaccaaaaaacactgtgtgatcagtgtcggcacaattcagacagatcataaggcaatgagcggaggaagtcacccactgatcagaaggaacccagagaagtgagaggaaagaaagacttgaaacacaatcggacgacgatggtaattacagtaaaaattacagtatgaaggcataagcactgtttcatttaatgccatccatcgtcagattgcctatggaatacaacaaagaggaggaggaggatttgatagcgaatgctaatagaattggaaataggtacaacacaaattgccgaacacaatcaaccgatcgctctccgaccactttctgactctgtctgtccgtctgctctcattgtatctctccaccgtcttcccgcagttcgacgtccctcccattttctctctcgtcctcctcctcctcctcggtttgcagtcggtcttcgtctccctgaccgccccattcgtatccgcccggtctttggtcggggtccacccgcggcaacggggcggggtcaaacagccatttgagcacacgcggcgtttccaacacgcgaaagcctccgggctgattggggaacacgtcctcgagaaagtagtacaaatggccacaggcaatcccttgagggggggggggggaattaacaaacattccatgaaaatgggaaataaacacacggataactcaccgaaaatgtccacaataacagtttgtccgagcaaaagtgagaagaacatcagcacccaaggctaaatgggggagagagcgaaaaatgagggaaaatggaggaaaggggggacaaaccaaataaggggcagaaaaggagaaaatgccgaaaaaattcatccctttaaataaataaatgcaaaaaaggaaatggcgaaaacggaccaatgaaagggtttcttctcgaccaaacgtaaaccaactgaaaactgaacaatgtaaaaaaaaataaaaatatattaccataatggtaaatgcatggccaaggaaaatgagatggacaaaacaggcacaaataatctgaaaatggcacggatgatgaacaaatggaagaaaggaccatgaaaactgcgccaaaaatgaacataaagacaaagtcagccgttcgaccacggaaagagccctcttccaacatggaacaatgcctaaaagagggggggggagaaggaataaaaggacgaaaaacaaataatggaagacggagcagcaccacctgtaggtgaacacgatgttgaagaggaaggaaaagccgacggagccgaggtaacagaaggaagtgagcaaacgccaaaactgaacggagggacgaatttggcgagaagtacaaaacgaatggaccacctgccattcgcgaatgatcaaatgccaattgaagtagagatgaaacggggtgaccagctccaaatggaccgccaaagtggtcacctgaaaaagcaaattggcaattaattggctactgccctttttcgattggctttcaccacacaggcggtcacataggcacgagtcacctgaaaaaatggactaattatggtaatgaaaccaacgaatgagccaaaaaaacaaaacacggaaattaaagggaccgggaataaaaccaatcaaagactaaagcaattaacaagaaataagacgaaaagctaccggcggcatctcagcatatgcttggatcactgattgcattttgttggcttaaccattcaattatttttgtaaaaatggtgcaaacgaacaacgaaatgagaggacaaagtgccaatatatacgtcaaattgtcgtttaaacagccgagttttctttatcaagaaataacaaaataaaattaaaaaacaaaaattttccattttatcgctttgtctttttctcatggagtcaaaatttgtgatttctccgcgttcaactgcagcaattccgcaaaaattttgttgagccggcccaccattttgctggtgtccttcaacagtccggcagtgcacaacgcattctcatacaccttgaattgtgtgttcattaaggaatgtgccctcccatcacatgcgccgtgccacacctgtatagcaatttcagttgccaattcggcattttgacgcttcagacgcatcagtccagcgacgacggggtgcgaaaggttcacatgcaaaacgggacggagcatgacgaggtgttccatctgagaacattgggaaaaaaccttatgggagaaagaacgcaacctctttgatttccgtaattcgaagcatatgacgagcagcgcccatatcagcagaaatggtgatctgtcaagtcaattaaaatttattacaataatttttacgtcagcaacatccaaattttcactattttatgcataggtaaattgccctggttttctcccggtttaatcccccataaatttgtctttctgtctcattccattccaagccatccttttcttctcattcccaatgttattgtgccatttctatctcatttaatctctgttatatatccaatcaaatcttcattattccccctggttttgccaattattgttagtattttatttattccctaaaccttataacacaagaacaatttgttcccattttacctaccataaacggatgttccgattgtcttccgctgggcttaatgtcactgacgcgtacagtgcccaaactgtcgcgcaaccagccaagaaattctgaatgccgagaaaaggatgatacagtaaatgtagaaagtgagagccaatccgagtggcaatagccaacgaacaaacgaagcaattaccctttttggagctgtccctcatcaattcagccgatgattctttgtcagagtcaatgctcagtccctcctccttcgtccatttctccagcgactgcaaagatttcatgcgaaattggggcattgacaaaaagacgagttcatccgctgggtctgaaaaaatggaaaaaataaatggaaaaagggtggggggggggagtgacaaacccgacaaaaacaacacttcgtatttgtctttgaacagttcaaagtaaggcgacgtttcggcgagttgacggctaaataaaagtgacaaaaatgtatatgtcttcgtgtcataccttggtgcgtaaatgtaataaatgttcttttggtccgattgcattcgttcgacatattccgacagagtggtcaaagtgccagaccgaaaactggacgattcgaacaacagaagctgagcaatttcttcctgaacaaagttttgatgaagaaaaatgggataaatggcaatggaaaacaccttggtggtgttggactgttccgtgacaacgccttccttgaagaacattgaatagcccatgtaaaagtcgttgtatttgactcggtctttggacaattgtgagagaaagaagcgcacacatcgttcggtaagggtttttctgatttttctgaaaaataatgtaataaagcatataaagaggggggtaatatactcgagaattaggtcagtctgtagcatttctcggcttaaattcaacggcacatctgaaaagatacgagataatgttaaagcgagcgacacttatggcgttaaatcgcaaaacaaaaacattggccaattaataccttcagaatcgacgacctaaaaggggaatgaatgattaattttgctatggcaaagtgcaaaggaccccaattaggaagcgtaaatagtgcggcaccaactctttggcatttggcttaatcaaaacgcgttgattgtacagcgaaatggcgatgtcccgctgtgaatctgctgcaaattccaagtgggagacgcgctttgtgggcactaaaatgaaggaaaatgttcaacaaaaaagatgggatgacgaacggaccataaaacagtgcacggatgttgatcggagaatcggtctgatattggatggtgtactggggacggtcgtctgccaagtgggggtggtgcgtcttggccaattgtctgtaacagttttgaattaaaagcgtaaatgggtgggttgtagccacttgaaaaatgtctcgtgcatttcgggcgtcgtttcgctcggtgccattgtccacaacgcgcgggtcacatttattcgctcgccattcacaaatattggagcggtcacaaaataggaatacctttaaacgcaatcaatcagtcttaagcatttgctgatgttggcattgcccactcacttgttaatgacatcgaccactttctgcggcacagcgaatttctccgcttctcccgccttcaagtgcaattcgaccttcgtcccaatgtcggcatctgctttttcttcaaccgtaaaatgtgtcccgccattccaactccaaatgtgccccatttcttcgccaagttttcgggtggtaacggaaactttctcactaaaacgcgtttaccaaaacgaataaattgcaaaaatatacaagaaaagacctgacaacgaaagccgaataaaagccgaccccgaattgacctaaaaatgttttaaaaaatgaaggaaaatggcaatgatcagaccaaccgatgattgcctcggcagccgcggcgtttttctcgtccgctcgaaacgccttggacccagacttggcaattgtgccgagcaaattgacgagctcgtccctgctcatgccaatgcctaaaatggaaaagacgcaattcagaaaacgcaattctgattttattttatgcctgtgtcgacgaatgtgagttttttgcccttttcatccacttcaattctcagctcgagagttgccgttgcttcggctgcgtcgccttgcaattccgaacaccgccgtttttccagtgcgtccgacgcattcgaaatgagttcacggatgaacacctcaaaataaatgaacacgtaatcaaatgaaatgctcaattcttcgtccgttccacccacttcttggtccgaataaagcgacttcgcaacgatgcccaaaagactgtcaatttcggcttgaaattcataattttcgggtgctacagcagccgcctgtgacgaataacggcatgttctgaagctgttcgtgctggtggtggcggtcagcgattggggacagtgccaaggaactgaagcggaggaagacagaagccgaccaaaatgaagacgaggccaacaatgtctacaaagcacacgacgacagagagaaggggcgatggaaaaacgcattgggaaaatgccaaaaaaagaagtaaaggaagagaaataaaagtacaaatattaaacgaaaaataaactgaaaaattgaaaacagcaaagaaattgcaagaaatattagacgaatttatagaaggaaataatgcgacaattggtaagagtgagttcgttattctaccgcctgatttcttcaagatgttttaatcggagagccgtcattgtgcagggtggccaattgttcaaattgtcgacagtaatcgacggaa

SEQ ID NO: 2590 - DNA, 1963 bp, Heterodera glycines
cagacttggcaattgtgcccagcaaattgacgagctcgtccctgttcatgccaatgcctaaaatggaaattaaggaattaagaaaacgcaattctgattttattttatgcctgtgtcgacgaatgtgagttttttgcccttttcatccacttcaattctcagctcgagagttgccgttgcttcggctgcgtcgccttgcaattccgaacaccgccgtttttccagtgcgtccgacgcattcgaaatgagttcacggatgaacacctcaaaataaatgaacacgtaatcaaatgaaatgctcaattcttcgtccgtttcactcacttcttggtccgaataaagcgacttcgcaacgatgcccaaaagactgttaatttcggcctgaaattcataattttcgggtgctacagcagccgcctgtgacgaataacggcatgttctgaagctgttcgtgctggtggtggcgttcaccgattggggacaatgccaaggaactgaagcggaggaagacagaagccgaccaaaacgaacacgaggccaacaatgtctacaaagcacacgacgacagagagaaggggcgatggaaaaacgcattgggaaaatgccaaaaaaagaaggaaagaaagaaaaataaaagtacaaatattaaacgaaaaataaactgaaaaattgaaaacagcaaagaaattgcaagaaatattagacgaatttatagaaggaaataatgcgacaattggtaagagtgagttcgttattctaccgcctgatttcttcaaatgttttaatcggagagccgtcattgtgcaggttggccaattgttcaaattgtcgacagtaatcgacggaattctctttgagcatctgctcataagcatttcgcacatcttcggggagtgttttggtgggcgaattgtccaagacaattggatgaaactgagaaatggtagcggatgagtccatcgacaattcgccgttcatcaatgtcagctcaatggcagtgtttggcgccgacgacgaggaaggcgacgaaaacgattctgttgttggcacaaattgttgcatgttgttattgttcaaattgacggcattgcgaggctgaaagctatgttttctgttaattatggaaatgaatcgcttcacttcggccgccgggaaattctgaaggaccgaaaagtctgtcgcagtgcccgaagaaagaatttgtgggtggtcaattcgataaagacaatgatgatgcaccggcaacacttcactgtcggacaactgctgccgttggggtatggccatgtccaccgtcgtcgtcctcccaccaattgccgtgttcggcacgtgcaaatgttgattgtgagacattactacgccactggtcagatgttgttgcctctgcggaggaggagcggtaactctgatgagcttctgaagaaaactttgtccttccaacgctttgctctatttttgttgcatttgcttactcggtgattgtcctggaccaattttatctgtctttttggccttttcggctgcaatatgttgcagtgggtcttcagctgttctatgaactgtgcattttcctgctccacaatgccattttctgcgtcatttcttatgtctggcggatggcgtcgattttgctgtggacgaaccgtctcaacggacaacggagaagaggaacagctgttgttgttgttgatcaaaacattgggcgttgctgttgaagttgttgatgctgtcttagtcatctccaaaatgctactgctgctgctcggctggtcgtgaaattccgtcgtggcggtgcctttggccattaattcgtcgtaatccctcgcgaccaacgacttgaacacggtccacgaatggtagcgtggttcatggccagaaatttgataagtaaagctcaattccttcttcatccccaactgaaacgattgaaaaaaattgcaaatgcgaatgatttacaaattta

SEQ ID NO: 2591 - DNA, 5633 bp, Heterodera glycines
aagcactcactttgatctcattttgctgtctcattactgacactgagttttgaatgtcaggaattatttacagaaaataattggttacctgatccgatggattgttttcccatttcggtgctttctatcggacaaaagtctttcttcaatttgctaagcgacaagagaggggaattgccctcatttccaaccaaaacatcgtggataatttggttactttcgccaacaaataaccgaatttcgcccaccacagttcggctagcattattattgtacacatgagcagcgtttttctgtaaccgtcatttaagaaaaagtaaagaaaatgctgtaaaattaccttttgagtgccattttgtaaccatttacatttgagcagttcgaacaaagatgtaattttgtcatttacattaatttggaccatcaaaaggggattttgctcactggcaacaacaaattctctgtcctggttcctcaatggcttaagtctgacaaccaaatgttgtgggatttcacagtttcttctgtcatctgaaccaaaagtaaaaaatccgtaatggcataggcaaatgccattgaattacgaaaactcacatggaaagtatttgagcaaagctggacagtaaggcgtcttcaaattgacaataaactttttccttttcggtcgaaaagatgcgtactgaaatgaaaaattggtgaaggaaagtcaattaataatcaaacagaaaacgtaccccttccattacgagttgcttgaactttttctcgtcaaatgacaaccctttgagccgtttacgccactcgaaaccattgagaagcacaaacaattcccgggcatcgcgtggaatgttctcccaatcgacgtcctcaatttgcgctttgcacttccacactttgaaggtgttcaaatagtagttgcgcacttggtctttgtccttgttgaacttctttttgagcatgaactttgaaattgcgtcaaaatctttcccatgctgaaatttttggtttaggcttatcaattggaccgaaaatcttaccaatttcaaagcctcgtagaacaccgcttgttcgtcaaaggtccaatacattcgccgagttttgtcaaccgtttcaacggaatttgcatttgttgtacactttgaggacgaagcagtaaaatcagaagccgtagtttttatgctcaaagaaaggcccgcagaagtggagagaggaacattatgctcatttttgtcagccgaaacgcaagttgaagaaacaggagttattgcttttttattgctggacagatttggaggcctaaagggaggaaaaaataaatttaagtataaatttatctgaatttgagttagcacaaaatatttgaatttttagctaaatcccgtgttcaagcatttttttatcttttacttaaatgccagcctccttctcgacactataagtgctgttgaggagtcatcgggcatcataccatggacatgtgacggcgaattcatcggcaccaagtgcaacaacaattgtaaaaggttcatgggaatctaacaataaaccataaaggatgttcgagcaaacaaaattcattgaaagcaactcgattaaaattgtttatgaaaacaacaaaaacataaaacaattgacagatttgatttgatcaatctttgaacacctttctgttcccagttggaactttggatttgttagaggcgcgggaaatgttcttcagccgttgcaactcctgcttgttattcttttcccgcttttcctccgccttctcagcaaaataatctttgtatgggtctgaagggagagaatgagcaaaaaaaaacggaagaaataaaaaaaagactcgcctttttggtcgggaatttcaatgagccattccttcgattggttctcggctcgtctgtatccgtatttcggcttccattccttaacatattaacgattgaacaattcgccaatgtctcagattaacctgagtcgttttgtcccagactttcctgtctttcttctttgttatccctttagccctcgcgaacttctcccatttcgttggttctttcggttttggaatcttagaatttggaattatttaattaaaaatttaaaaaatttacgggtttttcacgaggaaggccataagtgtattcgggaagctgaattttataatttaaacggacaaattattttgtacacctgagaacaagtcgcatcttgcacaatttttctgggtaatttccatatttcattgaacaaaagctgggcatttttgcttgtaagttcgttaatccgttctgagttgctactggccaaaccttcggcgtccgtctcaacatcaatgagtaaaagattgccaacatcaatgcaaggagcagtcattggtaaccaacaaatcaaatatgtgaatttcccaaagcaaatacctaattgtttatctcttgaattggcattatatttcttaaaaagcacaacatcctaaaaataatatcgaaattaaataagcgtataaattttggcttagaaattagagaaacacaaagaatctttaataagtttatttaacacaatattattctttaaaaatatgaaaagctttgaaaattggaagtaatttggaggtaatttgggatgtcagtgggtttaagtcaaaaaagattttcaataaatcgaattcgtcatttttcgttcattttctcagagaagttcgatgccacgctgggtccgcacggcgcagtataattcgtccattttggagaccttagggcataaactgctgggcctgcaaactttgtccagcgggtaacaacgtcgcgcttccttacacatgtacattggatgcgaagaaaaacgcgtgcattctatgaaaaaatattatttttttaaataattaattttatcagttttttaataaaaaactttttcaaaagattcaggtgaaaataattaaagggaaatggaggaaaggttcgcatttattaaagtttaataacgcatatatagtaacaaaagagcttatgactatcgtatgcaggagacccaagggataagtcattgatttatccccctccgttccgcaccttcgcatgtgcattccttctcatctgatgcgtcctcacaatctttgtgtccgtcacatcgtcccatactcgaaacgcaacgacgctcactttgacaaagaaatgcttcatttttgcacgtctcgcagtcgcgctcgtcttccccaccaatgcaatccgtgtatcctgaaaaagaaaaattcaatttttagtaccactattaatcagctaattagcactcaccgtcacatttctgagactctgaataacagcgtccagtcggcagtcctttcccgtggtcttggcactgaaacgcgtcgtcgcagtcacaattcgactcgtcagaaccatcgaggcaatccattttgtcatcacaaaccttaatacgtttttacacggcatctagtaggatgtgcgagaaattatttttaccgagaatcgagaccggaaaatgaccccgggaaacgatacgagaaccgagaccccaaaaaacacgagaaatttctcgactcgggaatcgaaaatctaaaattttttagccatttttcaccaaaattactattttttgccattttggtctcaatttttcaaaaatatgataaaatggggggtccgatggtgccgttaggagccccagggaaaaattttgaaaattttaatgccatttgttacgaaaattgcataaaatttcaaaaaaatttgctgaaaatttttactttttgggtttcgaggggggggggggggctttagccgcctcacccaggatttcggcttgggagtggtacatcccccgggcgacgcgacgaattctgtccaaaaaatgaccaattttgcgattttgagtcatttttagcagattttcttcaagtaatagttcacccttaccgcaataggcgccgcgttagaaaaaaatggaatttttgaatatgtatctttcttcagatttcactgaaaaatgggtaattttagattccaattttttccgagactaaaaacccgagaccgggaagcgaaaaacccgggaaatttcacgagtcgggaaccgagactctcacacatccctagcatctagtacaattgagatggatgtcattcactcataggtttttaaaatggattacaaccccaattgtttatgaataattcaaattaccagcgaacgatgaatgcattcattgccgttgctgtcattggaagtctttgtgctgcccacacattggaatgcgctttgcgggttgcaccgatcacagaatttgttgcattcggggaaaagccctccgcaggcgacagcccataagcgagtgactccatcggagcatttgaccattccatccgtattcttgtcctccgttctgctcgctcctttgggcaatgatggacaaatgccatggcaatcgttttcgtcctcccctcccggacagtccgctcgtccgtcacacaatcgtcgcctgtccacgcaaaacttctgctcgccgtcacacaacgcgctgttcattccggaacaagaaggacaatcgcagtccttgaaaagacaattaaatgtattttattttttccaaaagcataatgtaaccaaattaatgtttaattattatgtaatgtaaaaaaccttttcgtcactccctccgtccacttgacagtccacttctccgtcgcataacttccgttttggcagacaatggtcaccgcatcgctttgcttcgcctatatttttaattttttcctataattcataaataaacagttgtgttattccacctcgacattccgtgcagttcagttcgtcgtctccaaaaggacaatgttttattccgtcacagaccacttccttcggaagacaaatttccgacacgcgacacgagaattcttttttgtcgtcacatttcgcacctttaaatacatttcaatccaacattatttgcaaaattgtagatgaaatgacttacggcaataggtcttagaatcttcgtcttctccgtttgcacaatgcgtgacgccatcgcaaagatgctccggagtgagacagaaaagatgttcaggacgagactttgatgggcatgacagcgaagtttgacagcctataaaagattgtagaaacttgctcgagaaatgtgtgttgtactttcacagcccatttcatcactcgagtccaaacaatcggtgtaaccgtcacagcgataattctttggtatgacgatgtgctttaattcaatttttaataccctattgtttaaattaagcttggacatttactaccggttggtccagagcaggcaaagccgaattcgctacaaatgctgacgtttggaggaacaaacagttcagcctggacgatgagatcatcagcatcctcccagtcggtgaacttatgaattggaacctttgaggcatcaggccaagcgtgatgagtccggtggacggagagaatattcttaaaataaatgcaattgttttcagaaaatgtaaatgttatttgtgaaaggttttttaaaccaaataaggatttcattgtgtatttaaacgagatccaaatcattagataaaatagcgattttaaagcttgcttttccttcttgaaga

SEQ ID NO: 2592 - DNA, 10852 bp, Heterodera glycines
cagataaggcaaaatcatttcagggcattgctaaaagctatggtatgagttctaagggatttcattgacatttgtattgacattatttattattttatttattttatactttttcatattgttgtactatttgacattttttatttcgatttttttatgcaccacataagagcactaatgtgcctgtggtttgctcaataaatataaattggagtgcaacaaatgagatttcttattccccccattgggtcggggaggaaccttttgatttttttgcagtgcaaaaattaccacaagagagtgatctggtcaagaagaaaaaaaatcgctaaaatccgttaaaattaagaaaatgtttgccatcgtaattttctggctttcaaactcaatttccttaatttaccatggtaatttgaaaaaattcctttaaatttttaacatctttcaactaattcgggaatttttctattttttttcttcgaatttttaaaaagcatgaatataaattttccaaaaagactttgtttttggtttagtatatttttcaaataattacatgaaaaattgcaaaaatattttctataatatttctaatttatcatcacaaataaatatttaaattaaaataaaaattatagatttattcagaaaatcgaaggattatctaaaaaggaaattaccttttagtcagttatttctttgtgcaaataaattgtgttattatccgactttaaaggagctactgaccaagtgaaatgtttcggacttcatttgatttaacgaaaatattcattaatataaaaaaaaatatttgggtattttaaaaaaaataattaattatttattttgttcttttgaagttttcattaacaaataataaaattaccctagaaaagtgctttcctttgttggaagtcaactaaattccaatatttcactctgaatattggcatcgctgttgcgcctctaatatccgttgatgattttgattttaagactgaaaaatgtaactaaaagacatagaatttatcgtcaacaacaacaacaagccaagaataggcatgtattaaggatcataatcactttggcgcgggacattttgatgttaaatttacagggtaataattcttgaatattgaaaaatgcattaacgtttggcgccaaagtgtcccgtcctgatcgaacaaatcaacaatactatccgaacaaattttcatctgctcaacttactatacagtatctctttcggtttttcgctctacgggagtacaaaaagtgcaccattgccatcatcaaggaaacataattgaccaaattcattacgaaaataatgacgcactccttccgaaaagtccaattcagcgccatttccagcaacttcacgcaacagctgtactgttgcagaaccaaaataaaccttaaaaatttgtctattcatttacctttttatgattttgaatataatttcaatttttattaagaaatactaaaagctagccttttttataccaacagttattgagtctttaaaccattattcggagacatcaattttattggcaagagacttttttatcaatttcactgttggtgaaaatacatgggaatttaaatttttatccaaatggaaactggttccgagccgggaaatttgagaatccgatttgaacagcatcggagagactcggaaccgattgcttttgaagggatcagcccgtctcgacccgcccaatttcaaaattgcagtttctagaaatttcatattgaaaaatttttaatttttcatttatttttcttacttgtactcctctgcattttttgaaagtaatcacagcatgatcgctcaaatattcccagattgaaggatcaaatttcaaaccatatttgccctctcttctgtattcttgtactcttgcgtctcttcgttgattaggccataagcatacccactcttggtccccataaaatggacaaacatttctaattggtctattcaatgggaaaaacactttctttttcaccatcattattaattcatgatttgtttgatgcaatagtcctgctgtggttttaccaaaagtctgaaatggatatgatttcattaatgaaggccgagtgacttggatttctcgccgttttccttttgagctcgatctcgagttttgtgacaattacaaactcaacttttgtttttttatgatattttgttctactcgggggtttatgtttaaagatctttttatgcatctaaaattgcataaaacaaacgactttgactaaaaagtgtcggaatttttattcctatcgccgatcaatgatcggcggaattaagagggaggaggcccttcaccaatcccccgtccgccgcgcgacatgttttcgccgttccatccctctatcccccatttcccttcaaattgtcaattgtttttgtgtgttcctcccccgccccgcgcacaaattaatgaccaatttgtcaaaccgcaacttttcgccgccgtccccaattcggcgaatgagactccaaagaacgatgaacccccaatttcccgttttcctcccaatttgttcattcgttcatttttgtgccctctttttcaattcatgcccaattttcggcccattttcgttctgctcaatttcaccactttttgttcaattttgctcgtatttaatgcgacaaatccccaccaattcctacaatcagaagcaccagcaaaggcaagcaatgcctcttccgtccctctctctcagtccccctcatttcattatccttttcccccggcccaattgtccgttccatttctgtcattcacccggtccctatcattgaattttgtgattttttccatttgccccatttctgaaatttctgtcccatcccggtgcccaattccatttgtgataattccccggtgatggcatttctgtgatcaatttgtgataattcgttcaccatttcaaaatttttgtttaattacccaagtttgaggtcatttcccggaataaattttttattaattctgtgtctcgtccctgcctgcccctgaaccccgcaccgtggaattcatttggcccgaccccagagcaagtcgggacaaattggcgctcctgggtggatttgctgtgaaccacggactgaaatcgacggatcccggtgacaaagggggaagggaaaagcaaattagagagcctagacaagaccctctgaggcttgtctagtgttcatagtttcgtgtagttattgtcctccgaggcataacttcacgagggacgtagcggacttagtgtttaccctctgaggaagcacttcgtccgaacagagggttggaaggtgttgtgtagtggacaaagtacttgccctccgaggaagtacttcgtacaaaagggtgttcaagcgcgcacaaggccattgacaaataaggaaaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacaaaaggtccaggaccaaggccagactgatcccggaaaaagacacaaaacaacaagtgcaccacaacacacacacacgcacaaccaaactgcacgcaatgtctgggccaatacaaaaagggatcatcaatgcactcaaagctctggacaatgccaaaagcgccacctcactccttctacaccccgacccggacctgtcaaactgggaaaatgccatcaacttggaggctcaatttgatcgcgtcgtcaaggaaatccgtacaacggaaatgcagatggacagtctacgagacttatccaacgcttggattgaacttctcgcccgcctgaccggagacgacaaagacaacggcgaaaaagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagagaagcaaaggcggatcaattggccaatccacagcaacaaccgcccatgccaccagcaatggcagcaccaatgacaatgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttactctgcaatctactgggcggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgagggaccgcaggtgttcctcatgctggagaagaagctgactccaccattcctacgaagcatcctcacaaagaaaggagaggatccggcaaactggacgacaaccaaattccgggatgtgctaaccgaagcagtccggaaagaagtccaaatccaagaagtgatgggagaatatgggcatcactacgtccaaccaaaagcagaagtcgtctcagcagcacctgtacaagcaccgagaacaccaaaccaaaggtcacgaaggcctaaccaaccaatggcactgcgtgatatgacatttatagcctcatcactggacgagggtcacagacatcaagggtatgtaagccaacagcacacacaacaagcaaagaaacactgccaacaaatgcgaaaccaagtacaaagcgtcaaaaagggtccgccatacccctgcattttctgcaacagcaatcattggcatgacgaatgccaaaacgtcgacacactcaaccaacggatcagcatcgtcagagaaaagaagctgtgcttcaaatgcatgaagccaaaccaccgcgcatcaaattgcgctcgaccatctaagtgctatcactgcaaacgtcggcatcccacggcactctgccgagatcagtacaaagccgagaatggcatcaactcgcctagcacctcttgcagtgaagagaagccaaatgccaacgatggcaagcgatcaacagtgatcgaacaacaacaaatgtgtaatgccatccaaagcaaggaaaccagagcgttgctaatgacgacaaaggcaacgatcttcaatccgtcacggccatccctcagcatgatgggaaccatcttcattgacccgggaagccaccgatcattcatctcgagcagtgcagctgaacaattggatctgaacgtcctcagcacggaagaatgctacttgtccagcttcggtgaacgagaaccgaagcgatacataagcgaccgcgtcgaaatcggcattttatgccccgaccaggacaggttcattttcaacctgaacgctttgaagttcctgctgaatgatttgccggtactacaactaaacgcattggataatgacgaacttcaacaaaagaagctttccctgccgaatgagtcacggcaaccggacattctcctcggaatggacgtttggcaccagctgaatgttcaaccaattgaacaactgccaagcggatttacgatttgccaatcgaaaatcggcaatatcatcagtggaacagggcgaatcaagctcaagcaaccgtccaacatctctttcgtgctaatggtcaacaacgatgaatcgccacaaagcagtaaagcggctcagaggcagaaaaacattcaacaaaaagaaaaggacgaactgagacggcatcaacgcaacaaactcttgtccagcattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaatgcctatggcagtgcaacggctaacaccaacaaggaagagttcatcagttgccatgcgaccagcattttcttccagcaaacaaccaaaaggaaaagcagcgaatcccgcacaaacaagccaaacaaatgaactcaacagaaaaatgaaagccttgtcgccaaccgcaagtggatcaggcgccaaccatcattgcgtcgctacattggccagaagctcggactcaacaacagtaattgataagggcagtcaacagaattgcctaaacatgagctcggcaacaatcagtaagacaccatgccaacagcactcgtccgagaagacgttaaactaagctaatcaccaacaatcgtccgcaatgacgttaaactagcctaagccatcaacaactgtccgaaacgctaatcacccggctgccacgagtccggaatgacgttaaactagcaaagcatcggccaacccacacaacaatcgtccgcaatgacattaaactaaagaaccaaccaaacaacaaatgtccgcaaaaacgttaaactagcaaagcatcaattgtccgcaatgacgttaaactagcaaagcaccggccaccaaacaaccattgtccgaaaagacgctaaactagcaagcaatctatccgacggtcagggtccgaaatgacgtcaaacaagcaacgacaattggtcataaggacgttaaactacgtcaccaattcaagcaaaagcactcgagcatgcagctgacagcacgtttccggaagcaaattcacatgtcctcaacgattgaggaggttcagcagcgaatgaaccacaacagaccgcaaccgcggaggtcacaacagaggggactaaggccaactcaagcgcctaaaatatgccaatccgggatggcacagtacaagcagggtcgagggatccgccttcaccctgcgtcttctgcaatggcactcactggaccacgacgacgactcagcgaacaacccttgcaacgagagcaaggacacgaatccagtacgtcaccaggacgagaacgcagaccacgaaagagccaacgacacgccccagatcgcgtaagcacgatttggaaactcaagagcacggaaaattcacctttttgccgtcccccgccatcactcactgctcaatggctcaacctggcaattgagctcttcgcaaaaaatcatcaagcccgagcagagaatgcccattcgccaagtctgaaatgacgaatcacgaagcacaattgtggtcaacgaatgacgaattggaagtcaacttccctggaccaatcgccggacttttcaaaggcgaacaaatcagcacggcgacaaactgctttgctcaaccagcaacacttttcaactgtcaatatgcaaccgaattctgccaactgcccgacaactcaactctgatttggaaatcaacctgaaatggcaacgaatgccaaacatgcgactacgagaaggcggaagccatcaacggaaaattcactgcggcctacggagaatcaatggccacttggatctccgaagatcaccaaaaggcattaactttcgccaaaaatgcgccagaactcatcgcctgcgatggcacgcacacgcatcgtcatgtccgaacagaacttcggaattgccaaggagcaatacgacgacattgtcagcaccacgacacgatggaaaagaggcatccgaccagaacagctcgcatcacagctctcggcatcccaagtggcaacaagcgttgcgttaaatcagctctacacgagggaatgtcagcgaaacacgagggcagccaacccgactctccaggccagacgcttactacggcaaccaaacatccaagctcgttggatcggcgaaacgacaatggaagtgtttccatgtgtcaacatttcgctacaggacatctcatacaggccaatgaatgaatgtcgcctctacattcccgtgactgcgcactttcccgaccgagctatcgcagctttcctggatccggaacttcgcatcatctcgctgacagcacaacaggcaagctgtaatagctaccggttccatcatcttcaactgcgaagcaatcccaacatctggttacggatcgactctcgaaccggcacagcacgacgaatgccaaaagattacgtgcacgaattgtacgaaacaacgatcaaccaaacaaacagcaacttggaacttcatccattgatcttccacgcatggcaactcgacaatgagtctgacgcgacacgcttcccgcacatcaacgaattcatcaactcggagcagttcaaggacaagctggaacagcacattacagcaaggactgaagctttgggcgcgttgaagggcggaatagaaggattcaccatgcgctggctaaaaggcctgatcgacgaagcaatcacgtggtggattcgagtcgcctgcgtttattcaaccttcctcatgctgcgcgacattgttctcccatgcactctggcgtatttgctcaatcccatccgagtgactcttcacagcctcgttggagtacgcccgcacccgacattccgacccaccgtttctaaaccactcgggatcgaagagggaatgccgctgcgtgaaatgccacgaacccccaaaccaccagcgcgcagggcagagcatcgatccatgtcaccaatcaaattggacatgattgccagaacggctcggtaccaacaaccactaacacagagccatctcgacctcacagaagactcgccctttgggaggccgagacgaaaagaattctgacgggccccatcctttttcgcgccggaatgtcggaatttttattcctatcgccgatcaatgatcggcggaattaagagggaggaggcccttcaccaatcccccgcccgccgcgcgacatgttttcgccgttccatccctctgtccccttttccttcaaattgtcaattgtttttgtgtgttcctcccccactccgcgcacaaattaatgaccaatttgtcaaaccgcaactttctgcccccgtccccaaatttggcgaatcgactccaaagaacgatgaacccccaaatttcccgttttccgcccattttgttcatctgttcattttgtcccccgtttttcatttcgtgcccaaattttcggcccattttgttctgctcacatttgccactttttatttaaatttattgttatttaagcggccaaaaatgcccccaatttcacaaccaaaattcattaggcatttttgccgtttctctcccctcccttccatttgcctttaactgtgataaccccattcgtgatcattctttgacccccggttattgatttttgttctgtggccccagtgccctccatttcctgtcccatcccggtgcccaattccatttgtgataattccccggtgatggcatttctgtgatcaatttgtgataattcgttcaccatttcaaaatttttgtttaattacccaagtttgaggtcatttcccggaataaattttttattaattccgtgtctcgtccctgcctgcccctgaaccccgcaccgtggaattcatttggcccgaccccagagcaagtcgggacaaattggcgctcctgggtggatttgctgtgaaccacggactgaaatcgacggatcccggtgacaaagggggaagggaaaagcaaattagagagcctagacaagaccctctgaggcttgtctagtgttcatagtttcgtgtagttattgtcctccgaggcataacttcacgagggacgtagcggacttagtgtttaccctctgaggaagcacttcgtctgaacagagggttggaaggtgttgtgtagtggacgaagtacttgccctccgaggaagtacttcgtacaaaagggtgttcaagcgcgcacaaggccattgacaaataaggaaaaaaggcaaactaacagtcctccgaggctttagtttagccataaggcaaaaggcaaactaacagtcctccgaggctttagtttagccataaggcaaaaggcaaactaacagtcctctgaggctttagtttagccataaggcaaaaggcaaacaccttgtcctccgaggcaggtgtttagtcacagaggtccatcaaaggccccagggccgagaccagactgatcccggcaaaagacacaaaacaacacacacacatacgcacaatcaaacagcacaatgtctgggccaatacaaaaagggatcatcaatgcactcaaagctctcgacaatgccaaaagcgccacttcactccttctacaccccgatccggacctgtcaaactgggaaaatgccgtcaacttggaggctcaatttgatcgcgtcgtcaaggaaatccgtacaatggaaatgcagatggacagtctacgagacttatccaacgcttggattgaacttctcgcccgcctgaccggagacgacaaagacaacggcgaaaaagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagagaagcaaaggcggatcaattggccaatccacagcaacaaccgcccatgccaccagcaatggcagcaccaatgacaatgccaacattcaca

SEQ ID NO: 2593 - DNA, 2960 bp, Heterodera glycines
tcagagggagcggcttctaatggaattaaatatttttgacgctcttctcacattacattcattcattctttttgatttccctcaaccgccgcccccacacggccgcgcaattcatttgtcatttggtggcggtcgtcgtcgtcataatgcccttttgtgtttgtgtgggtgtgttggcgttgtgatcggagggacaacccacgcaaaacaatgatcagaggggggagagttaagggttgattgatcaatgtgatcaatgaataagtgcattaaaagagattttatgaaattaaaataggcgattttatattaaattttaaatcataatttttattggcgttgtgatcggaggacagccaactcaaaacgatgatcagacggggagggattaggggttgattgatcaatgaataagtacattaaaagtgaattttatgaaattaaaaatgggcaataattaattaaaattataaattatctctctatgccgaaattactcatcgttgtacttagggtggaacataatttttgatacccaaattttttttattaaaatttttttttttaatttcaacaaaacacaatcatgattcaaaatacccgccattattatcaataatatgttgccattattttggcaagagatcaattaccaatggaaaagtatttagagagttagagttaagtaagtaaaaatggtcattttagaggtaggtatttttgatggctgatttaaagaaaaataaaagagatacagagccagataaatagtgattcaatagagcaaagttaggaatataagaacacaaaaatataaaattttaattacaaaaattgaattattggagagccgagactgaaagtggtctccaaaaacggcatttttcaagaccacaagtaacataatgttttaaaagtggttttggaaattctgaatttaattaaacaaggtaaatcgggtatgttgagttcgaatatggtcttagatttggtctctgggatcgcaacaaacctgtacagctcgaacttcatgcatggagttggagcagtacaagctcaggttgaaaagataggtcccatttaaggccatattcggattctactggtctaaattgtatagaaaaactaagattttgttatatcagctttggtttttgaccataaaaaattcgagaaaaattagtgggccaattttcaattttggcatggtcgggaaaaaaggcagaaaaatctatcaatcaaataaaaagtgaaacgatagtaagatataaaagaggacaccatgaagaacaaaataaaaaaagaatcatttaaataggcgcagaaataacggcgttatgaatttttaaaaaattggaaaaaatttgggtatcaaaaattatgttccaccctaagtaaataatgatgattgatgtaaaaaacagcagcaactgttttttttcctataattttctgatcagtttcaaaactaagtgtcaaaaatttgattgagaaaaaacgtacttaattatgaatgttttgataaaaagaaattagtgcattgttttaaaaaaacaaaattaatacataaattgtccattgcatactgttgtataaaacattggaaatgctaaaatgaggtcaaaccaaaataacgaaaaaaataatttctcgaatttatcgtaatcagcgatctgaaaccaatagaaaacatgcattttaattatgagttactttcttcgaataatgagggaatcaaaatcgctaatgccgaatagggcaaaaaaaatctttgaaattaaaaaaatcaaataattaaaaagaccctttcgtacattaaaaaaaaattaatctttaccttgatttcgcgttttctcgcgaatatgcttaaataagctttattaaaatactgataaatatgaagcaaaaattaatactttcagccatttttcgctaaaaattaataaatgcccaaaactattctcctctattagcatacaaaattttgaaagctgtccagattcaaatacgctgtgactaacaaatccaaaaaattctattttacttacattccatgaactttgaaatatctgattttcttagttagttagttcatagttgtcagaaaatattttcgcaacaataagcgtgtttttaaaacccgaaaattttcatgtaaatttcattttacaaaaagagatcagttttttttaattttaggtgaacgaaacacttgaattttgcagaattttagcccttatattaaggtgttttctataggcgtaggcaggagggctgagggggctaaagtccccccgaaaccgaaaaaaaatttgagtaaatttttcgtaattttaagcaattttcttagcaaatgtattaaaattctcaaaaattttcccggcggcgcctaacggcaccgccggacccccattttatctattgttgaaaaatggcgaccaaaatggcaaaaataataattttctggtgaaaaacggctaaaatttttggaaaatacacccccccccctaatctgtatttcaaaaaacgaaaaatacacctctataaattgaaagaaaaaacaacctaacacccctaataagcacattatggcctacagcccccctaaatacgtttcgaatcacatttgagtattttaaaaatcaatttttgatacctattttaaaaaaagggtttttagggatatatttacaaacaaaaatcttttatttttcacaagaaatttttgacaaattctcaacaatatctccaaaaatatgcaaagaaaatgaaatatgtacgaaaaaattgcgaaattgcgaaattttgggcttctgggacatttaataaaaatttcataaaatatccattaaaaaagggatgaaaaagtgctaaaaaatataaaatatttacgagactctctgaaagaaatatatgtatttacataaaattgacaaccctaattatagaccatccaaaaa

SEQ ID NO: 2594 - DNA, 5474 bp, Heterodera glycines
cccccccccccccccccccccgaagccaagggtctggctacgcccttggcattttcctaaaacatttcaagccgttctgacaaactatgaaatgaacagcagtaaatcagaattaaaatcgaacttcgtttgttgtttttctttaaaaatcattctcattactaatcattagactccgtttctttttccaacgattaattgactttaaactaacgccaaatttcttcgcaatttgttcatcaatttttttggtgcttttcctttggaatttgcgcgaaaatttctcttttagcatttcaaaattctcaattatttctttcttttggcttattgaaagtcgtttttttggctctaaaataattattaaatatgttttttttgctatactccttttttcattatttcttcgatttttgattatttgttgaagaatttttctattattttgtgattatttcatttttttaaattataaagaatgctattttaataatagagcaaaatttccaaattcttccaaaaatttttttgttatatggctttgttatagtttctccaaaacgcttaaattaaggggtaggttgttaaaaattgatgacaaatatttttgtaaacacttattttttgttttttcagtttatgcaaatttttgctttttggttttataatcgcgttttaattatgtccttatttttgacaccataattttgctttaaccttcgatgtccttattttgaaaattttctatcacaaccctttttatttttatttctgttcacctaattttcccaattcattttcaccactttcacccgtttctttttggcgcatttcccttttccattcgtaaattttcctccgatttgtccccaatttcatggcaatttcattctcagtttggtttttgctttttttcattttgtcaaatgctttcacaattcgcattttttcactttggcttacttcatccatcttcagattttcttcccttttccattcgtaaatctgttcacgggtggtgccaaatttgttggcaatttcgcattccattttaatgcgattttcattgtcattgtcattttcatttttatttgtaattttttcaaattttttcactatgctcatttttatttcattttcattctgctgttgtcgttttcttgtgttgtttttgttgctgaattcctttttccattcgtaaatattattacaggttgtgcccaacgcgttggcaattcttcctagaaatgattaaaaagaattcaaatcaattaggattattttttacacttttgagccggatataattagctaattagattggttatttttttttaccaaggatgagagacatctcttgtgcgagtgaaatttatgaaaatacatatcaaaagttggcgcattttggaatgcgtccctcaaatccctgcgtgtccccctctgtcccgaccagcagggctgggcgtaataacggattacgggaaattgcggccttttttgacccctgtcatgacggattacagaatctgtaattgatcaattcgccgtaattacggatgacgagtttccttaattgaaaatccagttacgcccagcgctggtcccgacccctcccattgtcgctgatttcaccttcgattttgtgccgcttttcgctccaatatccgattctcaattggcattccttttttgtttggtcaaatttgttgatcagctctcgtcttctctcattttccttctgctcttccgcttttgttggtctttcatcgccctcgtcttttttcatcatccgattaatttctcttttccattggtaaatttttcgtcgatttgagcccaattcaatggcaattttttgttcgattttataacggtcttttccatctttgatcccctttttctttttgtattcatttttcattcggtcatattcattgatcaccatcagtttgattttatctacaccttctgctgctttccgcttgtcatcttcttgatcaaagtcggcttcatcttcttccagtgtttctggcggactttccgtaattttttcagttattttgtccgctttttcttccgttttgatcacttttggcacgtttccaggatcttcggcaattttatcggcttcttcttttttgatcatcttttgataaatttttcttatcttcgcctgttttgtcctcttcctcctcaaactttggttctttttttatttttaaaaatttgtgtgccaattttcctgccattttttgttcatcatattcaatttgttcacgttttacaacatttccagcattttgttcatcacttttatgtgaagttgattcattagaatttacaacaattttttcaaataaatcatttaatccttcgtccacagcgaaaatttgaagacaatttaaacaaaaaatgtaaaataaaattagtataaaaggcatctaaaggaagcaaaaatttattactaatgaaataatttatgtaataaatactttaattatcaaaaatttttcaataaaatataaacaatttaaatttcatttaataagaaattttatgaattatcctttcaacaatatcttatcacatagaaaagctataataaaattacaattttattattcttcaagtattcaacaacaaaaaaaaatcgacatatcgatgatttgttccattagcaaatacatttttcaataaacaaaaaattatattcatttttcaatgacaaaaaatattttttctaaaataccttctttttttaagcattaaatggcccaaattttattgaaaataataataataataacaatgaaacattttgaataaaaaaattataatatgaattcggttgcacttagcatttataaatttgactatacttttgaatgttagggaagggattttcactttataaaatattattttgtatcaaaatatttttacaagttaagctacaaaatactaaaatttgaaaatttacatcagaatttaactgtttataaaaaataattaaaattatttgacaattaaataaataaaaaattactttgttgctctttgacatggtttaacttaaaaacacaaagttcttaatattacatataattttcaatgaatatttttttggttttagcttactttttattttgtttattttttgccaacctaataaaaaaaaaagtcaaagtatctgctggcagtgccatctttttcttgccgttgttggaagcggaagtgcggcgaatattttgcacagcgcagcaattgagtgaagcagcggtggtgccatcgccaaaaagtgaaaaattttttttataattttttaggttcgcctcatttcgatttatttagggtttccatagttatcagtacttttaataaacatttgaatagtcaaatttatgcattaattagtattaatgtgacattatgctaatggctgaagctgcttttcaaccacttgttctcttctctaataggtcatcaacatctctcattttcatgcagcgcttttgcggaatacaactgatttccggcttaattaactgctgagggtcatttgtaagtaaaacctgaaataaaaaaaacatagatgacatataaaaaaaaaaattagttatgccgaaagaatatcaaaaaataataaaaatattatttattacgaacattttaaatttaaagaacattttaaaaattcaagcgaattaatcacaagtttcatttccataactttaatcttggcttaattaattattttaattttttaattttacaacttcataatttagagaactttactaaatgatggtaattaacgctgaaaattcaacactcaccgtgatatattggacagtccatgttggcatttccggactttcgtactggcaatctgtcacttcgccatccgtgtcaaatttcactttatatttgccggtgttgtccgtgacgtgaatgccaatgttgaactgctttatctttgtcatgtccaacttctcttcgattttacaactttcaaaatttcccagcgaaaagttggaagtctaacgggaaaatttgggaaaaattttgaaaatccggcaaaatttccgcatcacaatttggctccatcaaacaaacgaaccttactatgcctctgactatcatagctgctaaaatagagtgcatttgtgccgctaaatatcattttcatggccgtttttccaacttaaaaaaattcatttaaattttcgatcattgcgaaatttagcatttcgtaaaaagtgccaagaaaagcgactttggtgccattttatatgcttgcatttttggtggctattgctagcattttatagggtaagattggctaacacgacaacatttttatgccaatttgcgcttttaaaggaatgatgattttttaattaaattataggatattaatttttttttttttgggtatatacatttttatttttttaaaattattctctcaaaaatttgtgaccgaagagcaaaaaaaaaaataaaaaaattcacttgggttttgcctacataattttcttgttagggcctgccccaggggtaatggggagggataactgtccctaccccgtgccctccgattttttataatattttatttctactgtaattttagcgctgaactgaacgtgccgtgagatttttttagacaaaaaaatatataacatacaaggatgttacaaaagaaataaataccgtagggtggaagaattctcccagaatttttttagagaaattaagtgtaatgaaattcacgattccggcacatttaactcactgatcggatgaaatcgaaggccttcgtacagcaaataaatttcaaatttaagcgacccattcagcttgttcggtattttcacattgatctgttcatctttgcttaacagtcggccattctccaagtcaatcactcgggcaaagtgccgaacatagatgctttccgttattttggcatttgtatgattgattttaaatgctttgagttccattcccccaactgactcaatctgaacaaaaaaaatatggtgagtttccagcacacgactcgcggctgtccttatttctgtccttaattttcctaatattttattttaggtttcaacctcttaaatatgattattttgtcatacttttgaataataaaagttgcaaagcatttttctgtattgtggcccatgaaataatgaaaatgaattactgaataatttaatgtacaatttggggccgggttgcgttactcaaaaaccatcaaaatgaaaatttttgacagaaaattattcataactttgcccaaaatgaaccaaattttaatttggtatctttcgatagtaagtgttttctaatatgctgcaaacaaaaaaattcattaagatgaaaaaaagttatgacctgagaaactcaaaaaaccaagggtggttttttgaacatttttggtcataactttcttcaaattt

SEQ ID NO: 2595 - DNA, 3792 bp, Heterodera glycines
  misc_feature (70)..(70): n is a, c, g, or t
  misc_feature (2938)..(2938): n is a, c, g, or t
  misc_feature (3133)..(3133): n is a, c, g, or t
ttacctaattaaattatttaaaacttaaaatgaattttaaattatttattatacatatagaaaactaatntgggtttataataacatcaaatttaattcatttttaatgacattgatacttttttgtataagttttttaatttaaaatttaaaattttattttttaatttttaattattttcatacatttcttgaatttctcattttcgcgcagttcttctgcaatatgctcgggcactgattctttgccggacaatgcatgtacagcgcacattaccgtagaatactcaataaaatcagccaccaattcttgcgaataaatattttccgatggttgccaactttcctcgcccgggtaacctatgccagaattaatttatgaaacaatcgatggtgccgggtcgttactcaaaaaactagagtagagcggtaattgtaaaaaaaaaccggtaccgggacttttcgggttgaaaaaccgggcctttttggctcgcaaaaccggaaaaaacccgggactagtcccggtcccagtcaaaaccgggacttgggtactcatgtgtacctttttttcagtaccagtcttggtcccgtgcaacgctacaaaaaaccatcaaaatgaaaatttttgacagaaaattattcataacttcccccaaaatgaaccaaattcttaaaccttggtatctttcgatagtaagtgttttcaaatatgctgcaaacaaaaaaattcattaagtttaaaaaaagttatgacctgagaaacccaaaaaaccaagttttttttttgaacatttttggtcataactttcttcaaatttaacaaattttttgaaattttgcatgataatagaaacacttagggccattgaatgatattaagaattaaaaattgagttgctttttgcactacgttgttagcaatatatatattttttgatggtttttgcgtaacgtcatagcacctccaattttacttgaattttatccactgcccatggtgggtatatgaagcgttcatcttttgagaaatctttcggaattccatatttgcaatccagttgaaaaccgacttgatcaattctgatttcaaaatgcttggccgtcgcattgatcagtaaatcaaaatgttggccatattggttcagcttgtgcgtgccattattaccaattgaaaagttttggttctgtaatacatgatacagtactcagcatttgattgttgctatatgtctgatacggttttgtttctctgttcagttattaataagctgacatttggcacgagctggttactgtattcatttgtaagtgaatgttacaagttggttactgtatttatttaacaagtcggcatttcgtatacgaaattgccattgtattaaattaataaactgacattgtttgcatataattcggttttttgtaggtaaaagtgggaaattcatttgtgacaacaaattggatgacaagcttttcgcttacaatttcctatattactgtaaaatttcaaaaaaggacaacaaacaactgtaaattttacagatgtttctacaaaatttttcaactctatattacagaatttgtaaaaaaaaaattatttaaatattatctcacagcgtgcagataattcctgcagctaatatcaggctttgaaagatcgaattccaataacagcaaaatgtcaccaactgaaaatgacaaattaaatggattaaccaatgcccatttaaagcttccaaaatttttgccagccgaaagaggataaataaatatggactaaacggtttacctcagtttggccccagccaattttttgactataacttttttctttgccaaccaaaacaaacgaattttgtatcattcgaaagcttaatatgtttagaagctttttctaaaatattgcttcgcgattagacaatttcaaaaaaagttatacatgaaaatttcgaaaagtcgaatttttgaagttttttcttaataaatttttttaattttttccaggcttggaaatctttttgctttttgtaaggttaatagagttatgtaaagagctttcgaatgataccaagattgttgattgggttaacaaaaaaaaaagttatagatcgaagacttggctggacccgaaccatgcggggccgaattgagcgagtccgggactaaattgtttaaaaaattattaagttaattgtgtatcgactcaagtccaaaggaaataccgattttataatattctttattttctggctaacagaatcaaccctgaattgaactgactttttgtgctgggtttcactgattcgtgcatcaatcgaatgtagaattttttggttgtttcactgatgatcatttccatccaaatttcgtcaccgtagttaagtaccgtatccaatgatgcgacaatgttcaaatttgcttttttcttaatgcaatgtgaaaaagtagtacagtctgttaagaaaaaaaataaggccactaaattttttttttttgtttcatttatcatacttcccatgtcccaaccgagctgaaattttttaccaattttaccctccccctataaatattaagaatcacacactaaaaaattaaaaatgtaaaagaaattttatttttatgaatttaattccaaaattttgcccaaatttgctgtaaagaaattatcaggctacttcataaaacacaaaaaacttttttcaaagacatcataaaaatctggaaaaattcatgtaagcataactttttgtgctgatcaaaaagtccactatgataaatgaagaaaaaaaaattgaggctttataattcctttacagactgcaataatgaatatgaaaaaaaaacttgtggattttattaaacatatgtaatggaattggctttaaaatttgaaaaaagtgaattttcatttgggtttttcaaattttcgccggggganaattttgaaatttttagtgcactttgtgaacaaatttagtccaaaaataacaatattttctcattttaattgttaaaattgtgattgaattcccaccgaaaagggaataattttgaaaattagaagaaaaaagaactacttttggggaacaaggggggagatggtccggtggcgccgataggcgccgccgggganaaattttgtaatttttaatgcgattgcttttttgtcaaaaaataactaaattttgagcaaaccctatattttcttgataaaatagtgacattctgccataaaatttcaaaattttgaatatatttaagaaataagaacaaaataagaacaatagcccgaaataaggacaaatcttacaaataaggacatttttattttgtaagatttggaccctccaaataaggacaaatcttataaataaggacagatccgaaccctgatttatatacatatttttaccaatttttgtacatatttttgacatccctacacataacactcacagacataccagcgacggggtgaacgcattacaccttcaggatctatacataaagagatgcatttcggaaaatttttttggtgcctgtggaaaatagcccgcccgatacacacattggcataaacccttaaatccaattcgcatttccccacttttttttgggtcgcatacttttaagttttttgttttccttttgctttatttttacactatcaaatgaagcaatcgctcctttcaaatgtgcacattaaattattatcttcagttcatttatcttttgtttgtttgttttcacattatataaggcgaaagaaaacttacacaaatggaatttacg

SEQ ID NO: 2596 - DNA, 1392 bp, Heterodera glycines
  misc_feature (86)..(86): n is a, c, g, or t
catccaaattttgtcaccgtagttaagtaccgtatccaatgatgcgacaatgttcaaatttgcttttttcttaatgcaatgtgaanaagtagtacagtctgttaagaaaaaaaataaggccactaaattttttttttttgtttcatttatcatacttcccatgtcccaaccgagctgaaattttttaccaattttaccctccccctataaatattaagaatcacacactaaaaaattaaaaatgtaaaagaaattttatttttatgaatttaattccaaaattttgcccaaatttgctgtaaagaaattatcaggctacttcataaaacacaaaaaacttttttcaaagacatcataaaaatctggaaaaattcatgtaagcataactttttgtgctgatcaaaaagtccactatgataaatgaagaaaaaaaaattgaggctttataattcctttacagactgcaataatgaatatgaaaaaaaaacttgtggattttattaaacatatgtaatggaattggctttaaaatttgaaaaaagtgaattttcatttgggtttttcaaattttttctggcaaaaatttgaaaaattacctgcttttctgttttcggtggtaaatatggccggtccagcaacctgatgtgctcaccctttacctgtaaaaaattggcatatttttcaattttttcatttatttattttttgcatttacccgaataaaattgacggcccaaattggcacaattgtaggcaatgaatatgtttttttgttctcattaaaagtaacactaaattggtagccttcctgcgcaatgattttaatgtccgtcagtcgagttaaatataaattgaaagtttcaggtggttctgccttctaaaaataaaataaactattttaaaaaataaataaaataaatatcacataaacttgtaataaaaaatagttttcacaattttgtttcatttagttgtagcacacgacttggttattttcactttaaccggtactgattctgtactgtaaaaaccggtaccgtttctgataaaatttttgcaattcaataattttcgcgaaattgtctattattttggaaattacaaaagattcgctgccgaaatttttttttttttgagaaattttatttattttttcttcaaattaattattaaattgaatgatttgttttaaaaattggtgagcaaaaaagaaagagtattaatttttttgaaaatttttacattgaaaatatggacgacctgccgcctggttattataatagcctgtttacttacctcaacagaataggatgtaaatttcatgtggccaagaataaaatttaattccaacacagtcgcaccgactaaaataaattacatttaaaatgacat

SEQ ID NO: 2597 - DNA, 3093 bp, Heterodera glycines
tgaagaaattcatagacattgtgtaaggaaattctaggatctctcttcttggcctcctcccaaacttttagcataccagcatagctggccggtgagcgtaaatcgtaataaatttgttccaataatttatccacagtcggctgctttggtgctatagtcttgcccataattcaggtttaaatttgcgttttggttccgttcggtgtaatcctgcggtttttatagacgatgaattcatcatattgacaagcactaattttttctttcccattttcttcactgtgctacgccgccggccttcccccgtttgtggtattttttgaagcagtttcatcatttccgggtcttttgagatgcgttgaatgaagaagcgatgtcctctgggcacatcttcgcgctgacctgtcaaatgctttaacgattcggtgaaatgagagcctgaaacgggtttattgaaattagtcaaaatttctccgctgcttgcgttgacaccgaattttttgtgatccttcccgataatgcccatcatttttgggaaatttttcgggctggtccttaaagaaaccgttggcgtcttttgatgcggcgttttctttgacgaagtagtagcagcatcagcagcaggctcaaactgatcagaagcagttgaaaagtccgtgtcctcttctacatcagtgttgctcttacttactgcaccaattgattgaattgaagccgagttgcggtgtggtgtgctcacatgcgacggtgtttgttgtttctgaatgcccatatacggcgcaacgtttggtgctgtaactgagccactctcaacaattactttttgaggtttgttctcaataatatcttttagttggtgtctacgtttgtacaaccatgagtgacgcttcatttttatttctgcgttcgtttttggatcaaccaaattcttttgaatctgtacatcaagcagcgttttctcgccctgtaacgggtcgcctagaggaggagatacggcgctgtttcctttcagtagattaatgagggccaaatactcactctctggcaccataaccatcttttttgtatatttcattggtagctcccgcctgttaggtcgtaattttctcgaccaggtgttgagctagtgcgccaagaataggcactaatattgcccctaatgctacaccacttccctgttgtagcctttttctcgcagtcttttcgctacgcgagcgtgcaattgcacgataatagtccgcgtattcggccaaccgtttcctttggcttctgcttaggctgaaattgaattttaatatgtttgcacaaatttcaacaagtcctaatatttgttcggctgttgcgtctcgcagaaggatgtttttctttttttccgatttcgtggaggcgatttttttaaaaaattctgcgttttcacttatatatggactgaattcatacatttgtagtgaaaattacagattttctcaaccttttataccctttctttattcaattggtaggtacacctcacgctgttcatccgggaagattttagttgttaaacgttcagactcgggcgcattaggatgcatatttataaccaaatagctgaatggttcgctggttgcatcgttgtatgcctccataaaatagtttagcctcttcggaaacaattgagagcccaccgttctgacctgaagttgaccagaaggattccgggttaaaaccaaataatggctgttggctcttgcggtacgaatattgcgtccgtagagactttgtgttacaaaaataacacttacatcccagttatgggagcctcgggtgaacaataaatccaaaaaatcgttatttacactcaacatcaggtcgtccaggattaaaagtaagggtttgggcatactttgaaccaacgtttgggtcggtaccccattatatgtctcaattccttgtttcattaacccgatcacagaatcgttcatctcggaataacaatagagtatttttacaggaggcggtgcgattagcatactgtaatgttttaaaagtttcaatagccattgagtttttccacttcccgtagcgccagataaaattaatgtaaacggtgcgttgaacattttttataaaatttctttgtgcttttttgcttacaaatatccctttatataggcaaaagggagaatgtcgcctgcatcccctctcccgtccatttttgactcttgcgacactttttttttactacataactgacaaatatcctttttcggatgactatgttcctcggtcaattggttgtgcgttggatttggccttttgggttcgaatccccctcccattggtgaattatttaatcgattttaaattatatatatataattgctaattatcctttttcggatagctgtatcgctgacccagtggtagtgctttggattaagacctcttgggttcgagtccctctgcctctgaattaatttaatttaattaatcctctcctggatttggaccccggcacctgggacaaaatcatgaagaacaaaaaatgggtgtttttttaagcggggcaggggtctggacccccgcccccggggccttatactactgttgacaagtgatttataccggatcaatggaagtggaacggcacaccgacgtaactgaaaagaatcaaaggcatttgttttatatcaatcaagaattcaaaatcaaagtcaccagcagaaaagatggacggatgtccacgtgaaagaacccttcgcaaacaaagcatgaaaggaagtcgaaagcgcaatttaccaaggaattaaacaaattcaaacaatcaaaaacaaaaaatgacggttgtaaagtggatataaaccgtaaaattacaaattcacattataattaatggtactagtgcaggtgttttcaatggttttcgagggtgcagattatgaatccgatctccatttcaaaaccaattccgagtcttgaactcaaatttgaacatttttcgaagtcaaaattcgcaaaatctgattgacgtaaaggttcttttcggatttgtgacccccccactgaaaattttcaaataaaaagtcatttcagggttaccctttgtcctta

SEQ ID NO: 2598 - DNA, 1045 bp, Heterodera glycines
cccccaccctccgccaaatgcgccggtaatcttgagtctcactttcggttgctttttcaaaatcccgagtgtattgtttccgaaaattgtagtgagcaggaattttaatgtgaattggacaacacccgacgacataccctatgatggatggacttttgaaagtaaaagtgatcccaccgaaaattcttttgtaccccctcctccccctgcacatcgatgacatgctcctcttccccaattgttgggcttgtgcaaaaagggccaagaatgagtttgtgatgacaaaagatgtaaagaaatgtaaccatcgtccagcgcagagagcatttttggggacattcacctcaattgagttgcggaaggctttagagctaggatatagaattgtgggattctatcgagcgtatcactttgaacaatttgacagtcaactgtttaaaggatatgtgcgtatgtttttgaagataaaggttgaggcatcggggtggccggcggaggtgaagagtgaggaggaaaagagagcattcctcaagatgtataaggcaaaatatgacattaatttggattacgataaaattggactcaatcccgggttaagaatgattgcgaaattggtgagaaattattttaaaaaatcgaaaaattgtttaatttaagggattaaacagtttgtggggcaaattttcaatgcgcaataccctttcaaatacggaaattgtgggcagcatggaacgctggatggaattgggaagagataatacaattgaatttgggcgcccagtaaaaataagcgaagaaatatcacgggtggtgtaccggaaaaaggaggagttcatcagggagcataaagtttcaaatattgttttgtcattgtggaccactagcgcagcaaggataaaactgtacgagtacatggagcaggtctacagggaggaagggtctaagctgctgtattgcgatacaggtgggcaggaataaaaagaaaataaaaaccaaaaatttagattctctagcttttgctcatcggaaggggcggtgtccgttg

SEQ ID NO: 2599 - DNA, 2435 bp, Heterodera glycines
caaggataaaactgtacgagtacatggagcaggtcttccccgaggaagggtctaagctgctgtattgtgatacaggtgctcaggaataaaaagaaaataaaaaccaaaaatttagattctctagcttttgctcatcggaaggggcggtgtccgttggtggaggggaaatttttggggtaaaacattatttttgaaacgcatctaaattgtggttttaagggagatgactcgagagtatgcggacagcgaaattttggagtttgtgtccgcgggcccgaaacagtacgccttgaaacttagaagaaagaaggatggtgtgatttggcacaaaaccaaaatcagagggatgacattggatagacgaaacgaatttaaatatgaattgttcaaagagatggtgctggactacaaagaaggggtaaagaaagtttttcactacccggagaagatcgggccaacaaacgacttccgggttctctcaaaaaatgtgcaaaaagaatatacgccggtgcagaaaaaaggaattattgacgatcactttaatgttttaccctttggatattattgataattttttggataattttgtccatgtttataacatttaatattttaaattaatcaaatttgtttccttttttagaatgtcaaagaaaaatttccaagaaacttcaaaagaaatccgccgctcgaaaaatacaaaaaattatttcaaaaacagttttaatttagaaaaaagtttcgaagaagtggagagtcacataaaggaaaataaaaaatttgggataaaagagcaagtgacaactttctattttaagtgccccgaaaatgaagatcccgaacaaatgtttaaaaaaatcctgaaaaaattaatgacggatgcaatgaaccgtgaagctgagcctggctggaaaattgagaaaatttcagtggacctttattgcagcgccctgtcggaccccgtgatcatccctgcccgccccttccaacattcgaacccagacattgttttcaatgagttcatgcacaggcatcaatcatttggggaagtgaatttgttagaccagagaatttcaataattattgccacttattctttccctgttaaataaattttttaattttttgatttctttattttttgtttattacaataattatttattcgaccttttttctttaataatttttcagttatgtactcctttaaaaaatattttgaggagactctcgaaaaagaggactttttctggccgaaaaacagagaagacgttgaggcgttgttatttgagtcatcagattataaaattgcaatacatagagactacgaaagcccttattccgattatataaccatatataatcgtacctcgattttttgtttcaccatggttgagagaaatttaagattttttcatgacttaggaagagggacgcctatcggaaggtttacaactgtgctaaatgttacggtacaggcgaattatacgggagaagggtacatggcaccagcgttttacttttggttcttttgggagggcagaagtcaaacaaccaacgcatccttcaggagccgttttttttgtattgcgtttcagcgttgagagtgatgggcagggcatggggcagagaactacttatgaaccctatcgaaattttacttgacatcttcttccaacgcatggataggttagaaaaaaagcaaacataagcttaaaaattttttagagatttggttggaacatgggcactactctatagactcccgccctcactttttgacgcttcacgccgagtcgttgcaaagaaggcaatggaagaatttttaaaattaccatcattttttcgcatgattttttataataaatattaattggaaatgtctttttaaaattcggtttctggccaaactattcattcgatcctaatttgctattttttcgtagaaatttagaaaaaatgcaaacaatcgctggaattaaaaatttcgagattgttgatggtgtaagagtttttgttgtgagagcgagaattgagaatgtgacggaggcggagtacagggtttgtaataaaaatgaaagaaaatttcagtttgtttaggcatgcactttatgcgtaaaggggcttgttcttgcggggctgagaaaaagatgacatcttatttgaaggtgtctgtggcagatgatacagggcttttggaaaatgtgggatttttcggtgtgcgtgggaaacagaatgggatggtaacgcaacgcttttttaaaaatccatatacattaaatttaggatgaggtcaaaagtttggcaggcgccgtgtgcactatgaaagtcggggcgagggtgaaagaattcggagggaagaagggaatttattactctttgattgatattgttagcctttaaatctataaataaacttgttaattttttctaat

SEQ ID NO: 2600 - DNA, 2416 bp, Heterodera glycines
  misc_feature (2395)..(2395): n is a, c, g, or t
gataggttagaaaaaaagcaaacataagcttaaaaattttttagagatttggttggaacatgggcactactctatagactcccgccctcactttttgacacttcacgccgagtcgttgcaaagaagacaatggaggaatttttaaaattaccatctttttttcgcatgattttttataataaatattaatttgaaatgcctttttaaaaattggtttatgctggccaaactattcattcgatcctaatttgctattttttcgtagaaattcagaaaaaaatgcaaacaatcgctggaattaaaaatttcgagattgttgatggtggaagagtttttgttgtgagagcgagaattgagaatgtgatgcaggcggagtacagggtttgtaataaaaatgaaagaaaatttcagtttgtttaggcatgcactttatgccgtaaaggggcttgttcttgcggggctgagaaaaagatgacaccttatttgaaggtgtctgtggcagatgatactgggattctggaaaatgtggcattttttggtgtgcgtgggaagcagaacgggatggtaccccaatgttttttaaaaaattcgtatacaatataatttaggatgaggtgaaaagtttgtcgggggctgtgtgcactatgaaaatcggggcgagggtgaaagaattcggagggaagaaggggatttattactctttgattgatattgtcagcctttaaatctataaataaacttgttaattttttcaaataaaaatgttttacttaaaattatttctagtttggttcttgttggtcggaacggaaagttgttgcctttcaaaagaagaaaaagagcaatttaccagtgcccgaagaactgtagaaggcgtatttagagatataattagattagataacgaagcaaaagaattttctttttctgcacataataccatgggtgaagcccaaaatattaaaaataaaaaccctgataaacctgtgtgaatttttggcatagcaaaatattagatggagttttaaaattcatgccctatttgacaaaataaaatgaagaaaaaaatatgaaaaatattaaaaaaggtatggaaaaatgtctagacagaaaagatttaactatgtgtcaagaattagcagaagaggccaaacaatcaatcgaaatagctaaaaattatcggcaagaaattgggcaaatttatcggaccgcttactcgcagccagatttaggtattggagatttggcaaataaactaaaagaaacaatgcgcgaaaaccaaatacggtttgaaaggcaaagacctcaggaagaatttagggatgaatttattgcttataaaatttaagaaaaaaataaaaattcgagaaaatgaaactgcatgagaatcaaaggttgtgggacataaaccaaaaacaggtgaaaagggaaacaggtgaaaataggtgaaaaggaaacaggtgaaaacaggtgaaaataggtgaaatttcacctaaaaatatataggggcgtgcatttaatggggcatattagagaatgtctcaactagtatcaataaaaagtgccaaaagaaaattttgtgatggttatcgctattacaaacataaaacgaccaagttcaaactttggtggaaatgtgaacttaattcacatgggtgccagggctggggttttgaaaaggaagggttttttacaatgacgcgccgacacaatcatcatcctgaccctatattaattgaaatcgaagaggacataaaatatcataatttttctgcgggggcaaaatgctttttgggtgacaacaagaaatagttgatgatgctaagaaaaatccgagactccaaactgaatttagagatgaatttattgtttgtaaactataaataggatcaagaaaaaaaataccaattaaataaaaatgaattttcataaatcggaaaaagctaatgccattttattggaggcagctaaaagagagacggagagagcatggaaggatgttgttgcactagaggaagaggttagcgattttgccaaatcttctcgggaaactcttaatcgtgcgataaaatcccgagagaaagccccatacgctaatggtgttcgggagttttacataaaaatatccgactcaatctgggaaattttcacaatcttggacaaaattaatgtagagtcagaaaaggcagaagctgtatggagggaattggaaaaatgcaaagacttcgaactggcaactaaatttgaggaaaaatcaataaacgcattaaccgaagcccataggttgcatttcgaatcccgaagagtgcataataaaataagagcgtatgaaagtagacttcaaaatattgtctgggaatttattggactaaggggggagatataaaaagaaatntttttttattaaaattaatgg

SEQ ID NO: 2601 - DNA, 5741 bp, Heterodera glycines
tgatgctcgaggaggccatcagagtgccttggatctgttaacagttaaattgtttacaaagttgttttgtttcaattagagagtccctctctttccccgagccttcggtggaaaaaaagtcagggatttcgggaattaaattaaacattttaaattattattttttcaaataaacatttggtaatcggacgcacaatggccattttgtcctcgtacactttcggcggcacaaagtcgtcaatcgtggcattacagcggaattggtccatgctcatgaacgctttgatcttcagcagaatgggtgggggtggtgacaaatttaattttcaataattgaaaattagggcttaacgccaaccgatggaatgtaagcgaaagcgacgccttggagaagagccaacctcaaaaaaagcatttttattggaagttaaagaagataatttaatttcaaaattaaattaatatttaaaaaaaaatattttcgaaatttttttgacctcatcccaaacgccgtctgcaaaattgtgccaatgccacaggtgacaaaagtggcggcgatcagacgcactcggagctgatcacggtcccttcctgggcacacctcgtccgagatcagaaacgggatggatacgagcacggacagggacaccatcacttgctaaagccggaattaacagctttcattggttagggtacggtacggtatgaaattattacggtatgatgagcattgattgattggactgatcactgattgcaatttgttttacctgaaagccaaacaaaaaggtcagcagaaatggtgggttttcgtccgctttgtacagttttctttgctgctggtgtcttttgtcggcttttccctccgtttcggcattgcccgagggcacaaatccgtggccattcattgccgctgaatttttgtgctgctcgccattggcagtgtccggctccgattcgttgggacaaatcatttggaggacaaaaaattggcgaaaattagggacaagggattaattgtcaagttaattgatctgtgaagaagcgatcagcagatctaaaaggaaggaactgtaatacagtaagaaaccaatgagtttcgatccaagcggcgattgtgccaagccaaatacggcattttaactgtccagcatgaggtttcttcctatcaatacatatgccaaaaaaatcggtggaatttcgtgccttcaaaactgttggggcttcaagggtcgggggcatcggacgggtcgacttcctctcccaaatagtcctcggctgatcacctgactgatcagtgagtgtgtgctgtccatggactgatctctgctgcccaccccaaatttcattattttatttatttataaatttatttttcctgggatttttctttaatatatataaaaagttttttataaaaacttcggccattcttttttcttttttttttgctcattttttggtgagtcagccaaacttcgctcggcactctttggccttcgtggcaaatgaaaatgagaaagaaaatgacacatttattccctcctcccccctttttttttgttaatattttttgctttttagattagaatttcttcacgtttctgagcattgttaaattaaattgtgtgtaaataaaaaattattggaagaattttaaaaataaatcctggcaaaatttcggatttgtaaataaatgcaaaaatggaaaatgatacaatttttggtatgttttatgttttaaaagtttaaaccaaattggcattttctgaaatatttatgcgaatgttttggcactttttgtctatcatttcacaaaaattggcccaataaaataaagtggcaaaaatttcaatgttttttaacatttttgttttgttgcgaaaattaaattaacaaaaatttgtgcgatgatttttcatcattttggaattatctttggaatttgagaaaaatgaaaaaattgcctatatcaaagcaaatttttagaatggaatttgataaggcattttagaaataaaaaattaaaataaaacgaaataaaaatggaaaattgaaaaaatggcaaaaaaggaataaataaaaaataatggcatttagcattttatattaagtaaaatttaatgagagcaataaaaatgtgagaaaaaagaatatttctgataaaaacccaaaagaaaaattttgagtgataaaagacaaaaggaaaaaccataaaaagaaatgttttattttatggaaagaatttgcaagcaaaaagagagggtttaataaagtgattaaaagttttagagagtgagtaaataagtgaatggcttctcctttttgaaaggaaacaattggccaaggacagaaaagaagtggaaaagcactgatcagtcagaagaagtgaagttggcttaaattctaaaaagcgagagttaaattcggattaaatgaatgattgagtttttaaaattgggaaaatttaaaaggaactgactgatcagtgatcactgatcagtttgatccaaggaaaaatattttaacaatgaattgggttttcaatcatttttggcaactgtaaaattgattgattggtcagggtgatgtgacacttgcgccgcgacagttgccccccccctattttgacacaagcgaaaccaaaattaatattttcaacagtattctaatcccatccttcgaatcccttcatccccacacggtattgcaatgcatgaatatgtcggatcaaatcatcgtcatttttttcttctttcgcgtcataagcaataaaattgtgtttaaaagccggaaaaattgaaattgagttcattaaaaaataatcaaaaatgaaaatatttcttttttatttcttgctactctcggcagtgaagaagaaaaaaacttgtcattgctcttactgtatgcgttgaccaaagacaaaaaattaagtatttaccattgtgattagtgatttattgttgtgtttttttaattagttgtcattttgcgtttaatttatagttttagtaaaatttgttgataattacctaatgttgaattttatttaaaatataattggaatggaagttttaattctgaatactacattaactttaaacattaaaattgattgagaaaattatgctttaaataatcaaaattgggggtgggcggcgcaactgtcgcggcacaaatgtcggccaatcattggtcagtacgctttgcatttgatagaattatttgtttaatattcaataaacaaaaatttatcggaaaattttttgactgatcgatggacagacaaaaaatggacaaattaaaacaaaaaataaataaataacggaagatgtaaatatgcacacaataacataataataataataatttaaggacggaagtgaagtgcgacggaaaaaacggaacgaaaacatttcaaaaattaaattaaatttcttcggtcttccgattttattcttacattttttttgtttgctcaatttatttatttatttttcaatttttgtccactaaattttgctcaaaacaacgcactttttaaaagattccctcacaaaaaatcctttaaaattctttcaaaagaccacacaaagtgcaaaaaatgggggggggggggaaggtttaaaattagaagagaatggaaacaaataatttgaggttaccttattaaatccatccttttagtttaattaaatttgtttaaaatataattcaaatttataattaatctttaaatataaaataaaaaagaattttggaaaatatccagaaaattgtgatgtaattaatgggttagcaacatctcagaatgattatgaccttttgaactgaaagaaagcgaaggtgaaactgaaacggcaaaatgatcgatggacaaattgggaaaattaatcaccaaaacaccactaattactaaaaataatttgcattaattaatccgagcgatttgcgtgtgaagatgatgatgtgatgcgacgtaaatgtggtgaagtggaagaaatgtggaagaaagctgcttgcaaatggaaggtcacataaataattgggggagagggcgggtaattagcaaaagcaattaatattaattatgaatgcccgagggcatggaaaaatggagaagcaaagacaaatgataaatgcataaaattaatcattgaaaaacggtacctaaagagaaaagaatgaattggagacgggcaaaattattgcaaattaataataataaattaaacattaattattttttaattgccccaattagttgcattattttcaaaaataatgggttttacaaaatataaatttgaaggaaaataaggacacgattctttatgacatttttgtaattccatcaagaaggcgcttttcaaggacaaatcattcgtaatttaatttatcaataatttagcgatcaattaaatatattatttttcctttactaacacaattttgtaaattgacaaataaacatgactgctaatcagtaattaactaattatttaaccatcaaactaagacaacactttcgagtcgtaaattgcaattaacgaaacatcaaaaatcggcgaaaattactgaattaattgctttccaatttaaatccattaaaaatataataagagtaatataataataatttgatttgttttccaattgtccaaatgccatttattattccgtcaaagagaagaagcgtaaaaataattctttcttttcacgaaggcataaaaaggcaaaaagaatgcttttgcctcgggcaaaagcatttgttcgcttttcagcagacgaccattagtggacaaagcagcaaaagcaggtggacaaagtgaaaaatgagagcacaacagcaggaggagaaacagaagaagagaagcatagggaacggagggaaaagcatggccaaaagggaggaggaaaagcatcgatcagtggcggaagacgaataatggtgataaagctgacgatgatcagcatagtgcatgtggcgagcgatcaggaaaacaatgggaccaaaagaagtgatcagatcccgttttcatgtgatccaaatcccacttttcctattttttttttttacgaaaactgtaaggtcgtaaagcaggaatccagtagcatcgggattgatcagtgatcaaattggtcaggcaaaaaagcggtggacaattcacattgattgatcagcagaaaagtgtttgggggggggtgatcgaatcaaaattagcagagaactgagaaaactgtggttggtttagatcgatgaaatgcacatctttttgttcatttgtgctgtgctgatcactcctcagcagagagcagtgatcgatcaatttgatcaaaaccctccaaactctccaatcacttttcgttttttccatttaaaattttccatcatatccccttaatgtgttttaatgcttaatcccccgcttttccctcccatggatttgttttggctctgtttgttgcttcagctgcacaaatccgtcaaatccatgctgggcagggcgggggagtgtgaatgagtcggtgagtgagtgctttggccacctccgcgtcagctgtccgtccgcccgtccgctcattaaattttttcgccgcttacaaacgatcaatttgccgcgggtgggggggggagacgaatggattccgcccaccccctctgctcggggtttgcggatggactccttccccgatcactcgccgatcagacccattccgccactgatcggatcagaggc

SEQ ID NO: 2602 - DNA, 2161 bp, Heterodera glycines
  misc_feature (43)..(43): n is a, c, g, or t
aagcagcaaaagcaggtggacaagtgaaaaatgagagcacacnagcaggaggagaaacagaagaagaagaagcatagggaacggagggaaaagcatggccaaaagggaggaggaaaagcatcgatcagtggcggaagacgaataatggtgataaagctgacgatgatcagcatagtgcatgtggcgagcgatcaggaaaacaatgggaccaaaagaagtgatcagatcccgtttccatgggatccaaaccccacttttcctatgttttttttacaaaaactgtaaggtcgtaaagcaggaatccagtagcatcgggattgatcagtgatcaaattagtcaggcaaaaaagcggtggacaattcacattgattgatcagcagaaaagtgtttgggggggggtgatcgaatcaaaattagcagagaactgagaaaactgtggttggtttagatcgatgaaatgcacatctttttgttcatttgtgctgtgctgatcactcctcagcagagagcagtgatcgatcaatttgatcaaaaccctccaaactctccgatcacttttcgttttttccatttaaattttccatcatatccccttaatgtgttttaatgcttaatcccccgcttttccctcccatggatttgttttggctctgtttgttgcttcagctgcacaaatccgtcaaatccatgctgggcagggcgggggagtgtgaatgagtcggtgagtgagtgctttggccaccgccgcgtcagctgtccgtccgcccgtccgctcattaaattttttcgccgcttacaaacgatcaatttgccgcgggtgggggggggacgaatggattccgcccaccccctctgctcgggttttgcggatggactccttcaccgatcactcgccgatcagacccattccgccactgatcggatcagaggcggaagcagcaggtgggcactgacgacgggccagcattgggcggtcgcaaaaagaccgatcaatttgccccgggccaaaagtgtgtaatccattgcggcggattttgttatgccgaccaccacagctttatcagcatatttttattcttttgctgatcagtttccgtcttgtggaaatgccttttagctgagcattaaaagtccgactgatcagcggactgatcaagccaaactaattttggctatgattattggcatttggaaaaacattttttacacgaatccgaaattgatattcagtttaaaaatcagagaatttctggtgctgattgtcaattatccatattatctgatcaatcatttatctcagaatgcccactgatttccgtgccgtccgtcggttccatgcccaatttccccccttaacaaattgccccgttcccaacaaaatatgaattgatttccaatcaaatcctgacgattaatttaatcactctcatttaaatttgtctgataactaattagtcatttggtccctcccttaacgcagaggaaaagccgaggccgacgaatccatccgccacatttccccgtcgacgtcccaacgcaaaagcagtcgttagttgctgaagtgatcaaagccattaaaagtgaacgaaccgcagcaagcataacacatttttggtcagtttaattgctaatttggcaacaatttattcaaaaataaaaataaattggcaatgaatttttagagcgaatttaaatgctcttttaaagtgaacaaattttcattggcttaaaacctccttttgaagcggatcaaatttatgccaagcaattgcttaaacttcacaaattaccacccccaaaaaatgttttttactctttttttattacatttttcaatgtttgattgacttttttatttgattttctccgtttgttttatccgatttttcgataattacccgccccaatttccgcttccattattattttgtatgttcgtcgttgtccccattttcaagtgtccccctaagtccccgccccccattttcttgcgcaaagatctccagatcactcaagcagcagttgtgtccccacaaatcagccctttggccattagctgcttcattcccctccattagcttctcctccctcgcgcatttctctctttctctgcccatctctcaggagtgcgcactttctcccttcccctcccattgcgct

SEQ ID NO: 2603 - DNA, 2654 bp, Heterodera glycines
  misc_feature (2532)..(2532): n is a, c, g, or t
taaaataatgattcattgggccaagcaaaatgaaataataattaattggaagagcagcacaaatggaaaatggaaaatgcaaatttaagacactttttcgctgggctttccttcggcaaaatgcgacggggcatcagacaaatgcttaacgggggagcagcgaacacaaagtaacaggacaagggagcttattttgttaaggggtggcagccgacccctcagggggggggggaggagacggaggacaaatgccggggtcggacccaattaaaaatgattaaatttggtattgcagcggccagcaggaagtgaacggagacggtacggccaggcaacagatccctcaggaaatgcctctgcaaaaaccggccggatttttacacgtaatgaatgtgtttttttgttactcaattaaatttttgcacatttttttgcagaaaattctgcgcgggggaggcataaccatggatttaaaccaaaacggacaacaacagcaacaacagaaacagaagcaacaaggggcatacccacgccaaccccaacaacaacaacagccccaggcacaaaaaataattgaaattttaaacaaattattttaaatttttgaagtaccaccgaattgcgcaaccgcaaccgccgcccgcttccgtcacggcggcactaccgcaagcgcaaagagtccgcgagttcgactccgtcgacggtgacggatacgcagagattgggggacagcaacatgcgcaatggaagagacgagaaagtgccgaaaacaataagaatttataaacaattaaaatttgcaaagtgagtacgccttcggcctcaccgcgcaacgtgaagttcagcgaagatcaggaacagcagcagctgtacagccccgcgccgcaccgcagtggcagcgaaggacagcagcggatggccgaggcaggcgcagcgtcggcacagcaacagcccatgacgcagtcgatgtacgtgcagtcgtcgatgccgcgtcagcaagcgcagtacggacgcgtgggcaccgacacgtttgcggttggtccgcaccatttcgatgaataaatctccattattttaaggtgtatacgcctccagcacagcagcaccgctcactgagacaggtgggtaaaggaaaaggaaaattcggaaaatttcttcggaactaaatttcactttcggcacagcaatttgcctccggtcgtcttgtgcccgtagggcacgacccgctgcgtggcggaccgggacggcactttccgtccgcaggcggaaccgccatgggaggcggaggcatggacggctccctcagtacgccaccggcacgcaaatattaccagcgacagccaagcgtggatgaggcgggcgccggtgccgcgctggatgaagcaacgcgcgacatgctgcgactgtccgccgagccggtcggcaccaaattcgcgcggatggacggcgcgggtgggcgcgtgccgcacgttcagaaagccgcttcgacgagtgccgtgcagcgcaatttggtcagaaggggagggggcagtatttcggacagcaaattttctcgtttaagatttccgcacaaagcccattggcacgctttggagtgggtcaaccgccgctgggcactgccgcggggtcgccgctgacaacaggcggtaccgtcggtgcggccggcctgcgcgactactcaccggacacgctgagcgccacagcggccgcggcagcgcgcggtcgccgctcaaccgcgccgtttgccggactgacccgctcaacggggcctccgttggcacaactgacgccaccgccgcaaattggcggtgggacgggtgggggcaatttaaaaataaattaggtaatttaaaaaataattcagcagagggcgaacccatcgctggaggggaggcggaagaagaagcgggcggcaccggccgcgtgctttaccatcaccacgcgcggcgtgagcacgagatggaaggacgacagaaaaaagtgcagttttaaaatgggaacggaatgccaaacaaatggtataaatgaaaatgccaaaaaatgaaggtgggcactccaatggtgaaaacgacggtggagggcaaactaaaaatggagaaatcagtgggcgcaaatttgatgcgctgtgatcacgaagtggccaaagtgaggaaattggaattgaagctgcacataaatatgaaaattaaattggatttgtacaatttgttactgatcgaacattgttcagttttcggatcactctctattggcttttgatctgctcgctgatcatttgcttatcttcgatcagtcttaacatgtcaaaccaacccataataaatgggttttcccccggctaacttagctgattgaactgttgaataatacgaccccttagttttttcttgtaattaacgatttctattttactgagttcggtcaatttattgagtttgatcggcccgatttttgtctgatcagcattgaaaagttaaactttattttaatctgcttctctttcgcttcctctctctctctccttcttttcgntcattgcccattcttctcaggcgtacactttgcgcgacactgtaacccactaccgtatccgggacacttttggcaaacgccagctttttggtgaagaagtgcagcgcgcggccagcggaatg

SEQ ID NO: 2604 - DNA, 1218 bp, Heterodera glycines
  misc_feature (53)..(53): n is a, c, g, or t
tgccaaaaaatgaaggtggggcactccaatggtgaaaacgacggtggagggcnaactgaaaatggagaaatcagtgggcgcaaatttgatgcgctgtgatcacgaagtgcccaaagtgaggaaattggaattgaagctgcacataaatatgaaaattaaattggatttgtacaatttgttactgatcgaacattgttcagttttcggatcactctctattggcttttgatctgctcgctgatcatttgcttatcttcgatcagtcttaacatgtcaaaccaacccataattattatttcttagtgatcaatcgatttcaatttttgatcggtcaatttattggggttgatcggcccaatttcagtctgatcattaacttatttccgataagtcgtaatatgatcaataatggggtttcccccggctaacttagctgattgaactgttgaataatacgaccccttagtttttttcttgtaattaaacgatttctattttactgagttcggtcaatttattgagtttgatcggcccgatttttgtctgatcagcattgaaaagttaaacttattttcaatctgcttctctttcgcttcctctctctctctctccttcttttcgttcattgcccattcttctcaggcgtacactttgcgcgacactgtaacccactaccgtatccggaccacttttggcaaacgccagcttttggtggaagagttgcagcgcgcggccagcggaatgagcggcgaggaggacggtgagccgaaggtgcgcagttcgggcacttatcggctgtccgtgtacgaagacggcaaagaagtgggcacgcatgaggccaacatccaattgccggaaggaattgtgagccaattaggggcaatcaattagcgctaattaatcgcccaaacaaattgaagaacaaacccgactatttggcgaaagtcagcgagaaactattggctgatttggcatcgctggacgacacggccgaccaaatgaccgccgttacgcgtgtcgaaattgaacgcgttgaagacgtgacggacattataaaaacgtaccgtatcggcgaggcggcacccaaagaggagaagccggctgaggtactgtagatttatcatgagaaatggtaaaaaattgagctgacaaacgagggagatgatttgaaaaagcaatagaagccatttgtaattcaaaggcaacaagacatataaa

SEQ ID NO: 2605 - DNA, 1342 bp, Heterodera glycines
ttatataggttttgagtttcgttgctaaaaccattttctcccggccgaaggccgggagcgccctgaaagtggtggaagggtcttacaactttttgaggagaatccgggaaaactatagagaaaaattcagcgcggacgactgagtcccggggaccgatttctcactttttcttgcagtttagggcccgtaactttttttctaaaactcggatcaaaaaattcccgctgtgagggcactccgcagaagtgtcctctataatccagtattttttattttttgatcagaccaaatcccggacctgtacagacacggagactcagttaatttttttttcccacttcagtaccaggcgaataactcattagggtttgatctgagcgaggtggctccagcggacttattgtagagctttgaaagctcgatttttccagattttaaaatttcgaaaattttcaaaatttttcgagttaggcctaaaaaacggttttcgggttttttaattttatgattttttaacgaattttcccagaaaaacggagaccacttccaaaacatagtttttcgagctctatcgactggtatttttttcggaaaaatttcgattttttcccggaaatagaaaaaaattttggcctgagcgggacatttgagtcccgggctcataactcgttaggggttggttttagccaaaaatggcctaagagcaaaattgtagagctttttaagctctatcgaacggtgtactacatgatgtaaaattttgaaaaattttcgagctaggccccctagaaattttcggaaattttttttcggacgaaaatgggggtgaaaaatattttcctggggtaaaataaggtgctgagtacgaatatgatgtctattttaagtttcagaatttttggaattttttaaaaattcgaaaatatttggcaattttttggccctcgggattttggcctaatatttgaaaattcataactcagttcagatcaggtctattttggcgaattaaagctttaaaaatagcaaaaaatcgggaaaattttatgagatttatttgaaatttatagcacaaaaacaaaaaaagttattccagaaattctggaaattttcgatttttcagaaaaaaattcagaactcggttctgtaaaggtgtttttgaaattttaaatacttaaaaaatccgcaattttttgctctattaaataaattttatttggcatttttatcacttttttgcgaattgttataaaaataaaagtgattttgagattcgggaccaaaggggggtgaccaggatttttgagtggaaaattatctttcacaaaattcttccaaaaa

SEQ ID NO: 2606 - DNA, 2401 bp, Heterodera glycines
gcgaattgttataaaaataaaagtgattttgcgtccgggaccaaaggggggagcacatgatttttgagtgaaaaaattttttcgacaaaaatcttccaaaaacatcgtcactagggctatttgaggctgctgatcatgaatacgtaaacagtttttacttttgacatagtcaagacctcagaatccctgtgtgattggggattctgaggcatcatttttggggggtggggtgcaaagttcgagtccggacggtgtaacattatttttctatttattttttgctattttcaatttttattcatttaaaatatttttattttattaataataaataaaaaattttcatttgaattaaattattttttggtgaaaattttatttaaaaataataattttttaaattaaagaatttaatgtttttttaaattagaaattgtcaaaaaaattattttcaatacaataatacgcaatcattgtaaattcaaagtttatttttaattaataaaagaaagcattttttaataattttttaaaaaatattaatacattttttaattctatttttcataaaccatttactaattttttaatcacagttgtacctcttctaatctctgtaaggtcaacaaataattaatttgaagatttcttttaaattatttaaatttattttttttaaattaaaggatttcattatttatttttgaatttgtaaaaaaattaattaatttcaaattaaataaatattcaattaataatttccaacgttgtttttaattaataaaaagagtttttattataaaaattttttaaaattaaaatgcattgtatttttaattttaataaaacttttaccttatttatttaatttcaaaccatgttgtacctcttccccaatggtagtacctctcctaaccatggtgtacctctcctaatcactgttgtacctcttttaattacttttatacctcttttaatcactgttgtacctctcctaatcactgttgtacctcttttaattacttttatacctcttttaatcacttttgtacctcctttaatcactgatatacctctttgaatcacttttgtacctcttttaattatttttgtacctcttttaatcacttttgtacctcctttaatcacttttgtacgttttttaatcactgatgtacctctttgaatcacttttgtacgtttttgaatcacttttgtacctcttctaatcacttttgcacctcttctaatcacttttgtacgttttttaatcactgatatacctctttgaatcacttttgtacctcttttaatcatttttgtacctcttttaatcacttttgtacctcctttaatcacttttgtacgttttttaatcactgatgtacctctttgaatcacttttgtacgtttttgaatcacttttgtacctcttctaagcacttttgcacctcttctaatcacttttgtacgtcttttaatcactgatatacctctttgaatcacttttgtaccacttttaatcacagttataccttttttaatcaaatttgtacctcttctaatcaaatttgtacctcttctaatcaaatttgtacctccttctaatcatttttgtacctcttttaatcacttttgtacctcctttaatcacagttgtacctcttctaatcatttttgtacctcttttaatcactttttgtacctcttttaatcacttttgtacctcttctaatcactgttgcacctcttctaatcactgttgcacctcttataatcactgttgtacctcctttaatcacagttgtacctcttctaatcacttttgcacctcttctaatcacttttgtacgcacttccggtttccattgcattatgcgatgtgtcaactccaattattggaggaaaccaagtgcatgtcggctgacgcaaagaccctaacagactaaaacgcgcctaggtagcgaagctcacaaagcgcgaagcgctttttcccagcccagatccgacggttcacgcacccgctagtttttataataaattgatagagagcaaaaagcacgattgtataatattcaaaaaatttatctatgcatttgttgaacgattctaaacccgatcgaattttttaaacctttatatgaaaacatttattgcaggaaatgacaaattccaacgtgggtgagcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttatttattttctgttgactaaatagtcagttcttatagcaaatattaatttatatttgcg

SEQ ID NO: 2607 - DNA, 946 bp, Heterodera glycines
tttgtacctcttctaatcaaatttgtacctcttctaatcatttttgtacctcttttaatcacttttgtacctcctttaatcacttttgtacctcctttaatcacagttgtacctcttctaatcacttttgcacctcttctaatcacttttgtacgcacttccggtttccattgcattatgcgatgtgtcaactccaattattggaggaaaccaagtgcatgtcggctgacgcaaagaccctaacagactaaaacgcgcctaggtagcgaagctcacaaagcgcgaagcgctttttcccagcccagatccgacggttcacgcacccgctagtttatatatacctaaagaaacaaggcaactcatttccaaaaacaaaatctccttacggtttgccgggagggattcgaaatttcgaccttgggggtaacttttgacggcgcattcaggaaaactatagatttttcgatccgagggccaactgagcgccaggcgccgaaaagtcacttttttcgaagcagtttttgcagtttttgggattcaaaaattttttaaaggcttaaatgaaaaatcggcctcgataggattttaagttggacttttttggattttttttgtttcttgaccgaaccccaaggtcttgtcagtttttccgaaaaactggctaaaaattgcatacttttttgggccatttcagcgccggctgaataactcgccggggtttgaccggaggaggtcggtgtaagcggcttttttgtagagctcgacgagctctatccaaccatgtttttggatttctgaaattttcagaaattttcgagctaggccccctcgaaaattttccgtttttgaattttatgattttttacagatttttccggacaaaacggagaccactttcaagcaaccgtttttcatgctctatcgattggtgtcattttcagaaaaa

SEQ ID NO: 2608 - DNA, 1624 bp, Heterodera glycines
  misc_feature (43)..(43): n is a, c, g, or t
tcattttttgttctaatttttatgattattttattttctgtgnactaaatagtcagttcttatagcaaatattaatttatatttgcgtagcttcaaataagcattctggcttcaatttcgaagggaattgaatttttttataataaattgatagagagcaaaaagcacgattgtataatattcaaaaaatttatctatgcatttgttgaacgtttctaaacccgatcgaattttttaaacctttatatgaaaacatttattgcaggaaatgacaaattccaacctgggtgagcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttatttgttttctgttgactaaatagtcagttcttatagcaaatattaatttatatttgcgtagcttcaaatgagcattctgccttcaatttcgaagggaagtgaatttttttataataaattgatagagagcaaaaagcacgattgtataatattcaaaaaatttatctatgcatttgttgaatgttcctaaacccgatcaaattttttaaacctttatatgaaaacatttattgcaggaaatgacaaattccaacctgggtgagcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttatttgttttctgttgactaaatagtcggttcttatagcaaatattaatttatatttgcgtagcttcaaatgagcattctgccttcaatttcgaagggaagtgaatttttttataataaattgatagagagcaaaaagcacgattgtataatattcaaaaaatttatctatgcatttgttgaacgtttctaaacccgatcaaattttttaaacctttatatgaaaacatttattgcaggaaatgacaaattccaacctgggtgagcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttattttattttctgttgactaaatagtcggttcttatagcaaatattaatttatatttgcgtagcttcaaatgagcattctgccttcaatttcgaagggaagtgaatttttttataataaattgatagagagcaaaaagcacaattgtataatattcaaaaaatttatctatgcatttgttgaatgttcctaaacccgatcaaattttttaaacctttatatgaaaacatttattgcaggaactgacaaattccaacctgggtgagcacacatttcagataagcttcctatcattaatagtagaaacaactaataatctgatgaacagttatttcaa

SEQ ID NO: 2609 - DNA, 6895 bp, Heterodera glycines
  misc_feature (18)..(18): n is a, c, g, or t
  misc_feature (47)..(47): n is a, c, g, or t
tcattttcggcactttanttggaaaactcccaatttttggcactttntgggaaaccatggttgtgtcaacattttttgtaaatttccaatagtaagtgggattttgccgcttttttcctattccaatttggcattttccaattttggcactacgatttttagccttttgtcagttaaattttcttaagcagtttatcagttatcttcttacggcactttctctgaattattttttggcattctgttcatcgtaatagatttttgacaacactctcacatgtttcaagttcggacaagtcgaattcgtttgttgcggtgccatttttggcattttcttcctccgccgcggcgtccaaaatgccggccgaatcgccgtgtaaaaattcttcatacgttcgtacaaaatacaggctgctttctgccggataggcatatttccttgaaatggtattaatattattttgaaaacttcacaaaaatttaaattttatgggaaatacaaaaattatttaaaatggaaaatgggattttacaattttgcataaaataaattgcaaaatattttaaataaatttcagaaaaagtaaaataaattttcaaatttttattaaattaaatattcaataaattcgaaggtttaataaattataagtttaaaaataaggtttaattaattattccttatttgtaaaaaattaattaattaaaaaattaattaaaaagtttgaagaaaagatttaattattccttatttcatgaagattttaaaaaaataataaataaattcaattatagaaaataatattcaatgtaccgtatccatattgtttcctaattacagtatgactcacaggtgttccatttcatcaattagcccattcaaatgggcgcgccgcgttgcgttggacagatcgccagggttgttgacaaacagttgcgcagttgtgtaaaatggcaacactttttcctcgcggtatttctcaatttcgagcagcggcgagtcgggcgggaacagctttttcagcgtcaaattgatctcgaatttgagcagggcctggcgaaatgatttttttttttaatttaaatttttttaaataaattgataaataaaattgaaaaaaaggagaataatcgaaccaaattaaatcagcagcaagaggctacatgaaacatcaaaaataaaattttgggaaaacgaaaaacgaaacgaattaaaattttcgcgaaaacaaaacgaaaatttttttttggtgaatgaaaatgaaaaaaaaatgaaaatttataccaaataatatttatagtgatgttagaccaggggtgcgtatcgaaaatttttcaaaatcagatcatcgagcccaaaaaatcaaattttggtgtcaaaaatcagaacattttgtaagattgcattaaaacagttatttttacaatttattcgatcaaaaatgtattaaatattatattattcgccaacaattaaatctttaaaaattttggtgaggaaattagcaaatcgtaaatttcaatgcactcagtagcaaaaaatcagatttttaacaattttttgcggcgcattttttcaaaaaactttaggtgaacgggcgggggaagtgggagtccgacggtgccgataggttaattcgattcgctaacagatttgtccaaaaaattgtttaaattttgctaaaaatcttcttttcatgataaaatagtgacattatgccataaatttcaaaaattttgagtttatttaaggaatcagaacaattctgataaaacagaacagatacgcaccctgatgtagacagttttttctgatccagatcaaaatttttaatcattgccttacaataggggctcccattttaacaatttttattttataaaaacaaacagcaatttttcggattttctgcttgagaatttgtgtaaaattggacacattcggatgtgatgatttgggtcaagtattaacagagcaaaacatatgatcagttttatcaatcaattgattgatcacttacattgagacagacaaccaaaaatgcggcccacacaatgcacaccaacagggagctgatcgcattggaaaccgaaaagaaaaattggcacaattaattaatgaaggtaaaaaaattccgattaattaaggataaaaaatgttggatattaaaaaaaaatttttttatatgaaattttcaaggaaagaataattgaaattttttggcaatttttcaaatttttttttttaaattagcttaatatttttaatttttctcttgaaattttcttgtgatcacgatgtttaagcattaatgaccatgatcatggattgatttttgatcggattaatcccgtgaatggaatgtccatttgtttttgttttgaatttggcacactgaccaggcaaatgtaaatgtctttaaatgcgttgaatttgcgttctaatgagtgccgaaatccaccgcttttcgtcggcttaacatcatcctctgacaaattgttgctatttgtggcatggattttgttgttgtcccgcttccgggcactgatcagttcccgacgtgcacaaatgacgagcactgaaaaacaattgaaaaatgctttagtgggagggtaaaattttgattttctagaggccggcaaaagtgggaatttttagtttaccaagaaaatttgaaaaaaaaatagaaaatttttaggttttcaaggaaaaagctttagggggagggttaaatttcgatttttaagaggcaataaattttagattttcatgagaaatagtaaaaatcaaatttttggagtgcaaatattttaaaattgcatttaaaattaaaaatggggacgggattaaatttcattttaaatttttaggttaggaaaaaattttaaagtttgtttttggtggtcaattttttactcatctctctcctaaaaaataagaaaattttttgattttcaatatttctggggaaaatatttaaaatattaaagtttaatgtataaataaataattttgaaaagataaaaaaaagttttcatttaaataaattttgtgatgataaaaaatgccaaaaatgacctgcagtgaacaaagtgatttggtagaagaaatccacgataatctgaaaaaataaacataaattagtgaacaaaaatttttaaaaatatccatttttgtttaaaacaaattattttgttgatattatttaattttaatcagagtgaattttagggaccatatttttggaagattccaaaaaatcaacccctaacgggatatacttatatttcggttttaatggatttttttacaaaatttcatcaaaatttgcccaaacattcctgaaaacccaaaaaatgatgaaaaatggttttaaaacattgatcagcactagagaatggcaaatcaacctttttattagtttttgcggggtatcaatttaaatgttgatatttaattaaatcaactaacattatgccatcaacgcaaatatcaacgtaatttttaaaatttgcgaaaatttgttaaaatttatatgagcggtttataattttagtgcgagagataacgcaaaaatgagagagtgctggatctcagtcccagtcatacaaaacatttttgatgaaggagggtagagaaaacaatttcaatagagagcgcaatgggaagggagttcatgtctcttcttcgctgattcttttggtaagagacgcagattcctcactatgttctctattctctctctgtcttaaatctcttcccataacactctctttttaattaatttttctttattcttctttaccaaaaatgcttttgtatgactggggctgaatataacaccctctcacttttgcgttatctctctccccatcttattttccgccaaaagtcatttttgaaaaattgctttaaattttaaaaaattttcgcaaattttaaaaatagcgttgatattacgttgatggcataatgttatgttgatattaaataaatatcaacgtcaatgttgatatttattaaaacaattttcgctaagagaaaaatgttgatttgcctttctctagttccataacagtgcaaccaaattcaaattcagtaaccatttatacaatacgccagaatttttttattatttttatttgtttacctttttctttcaatttgtgaccacacaaaaagggccacacatctacataccgtatttgctctaattatcccccattctccagttatcctccagtctaggaggggtttgaagaataatccctctatcttaatcccccagtctccaagtatcccccagtctacgaggaggttgaaaaataatcccccatgggggataattagagcaaatacggtatacaaacaaaaaacgaatcaatacaaaaaatgcatttacatttgcacattttctatattctttggtagttggattcactcaaaattatgttgttttaatgattcatcatacacaaactttgctttcagaagaaatttgtgttcatttacaaacttgcagcaaaaaacaaaccagcaaaaagatgaaacgcaacggaaattccatttgctcagaaaccaagccaccgcttttggaattgacgccaaagaatgcattaactttccgtggtattgtgtgggctgggccatttgtgttccgggatgtaacccaccgaaagcaataagtctgaattccgaggtacaaaaaaaaactcggaaatctgtgaactcccaggtctaaaatttctcggaaaacgcaatttggttacgttccctggcatgttcgttaaagaaattgacacatacaaaatttgccaaaaacaggcaaactcggccacgtcggttccgtctctttggacatcaaaaattgtgagatctgctccgtttacttcaaagtcaaatcaaatgccaaccacttctattcggttcgtccaaacaccggtgtgattggggcgtacgggcgcgtgaaggtggtcatccaattgcacgacgacagtctggcaaagttggacgagattgaggaaaacaagcacaaattcctgatcatggtttgcaattttcaattgctaattggtcgggtgattaattgcaaaacattggttggtagtactgccgattgggcccccccccctttttgtaaaaaaatttctgctaaaaagtcctgaaaacactttttatggagtttttagtgtcgctgatcacgaatctgacattcattttgaccaattatgaatcccggacccgaattcgaacaaaaagtagataattcaaaattttcggaattcacttttatgttcatgtctgtacataatgaccgttttttgatgttgtagtgatttgactaaatttagagatcgtgatcagctactctaaaaaccccccaaaaaaacgtgttttcacgacttttagaactgcagttgggttacgacttcaaatttcaaaaagattgccaaaatagccccccccccttataaaaaaaacccactaaatctcaacttatggttgccgcccaaagcaaaacccggctttttgttccgagaagaattccaatccaaacttctttcaatcgacccaaccacttttttatgcaaccgcgaaaactcctctgatcctgactgtttgtgttcaaagaaactaaaaaaaattatccgcgctttaaaatctcaaaaaaaaatttgggatttttttagtaattttccatgacagcattctctatttacacactaataacatgattaatgaattccatttgctctttaaggcagcgattgtttcggatgcgtccattggaacggagaaattttggaaaggcaaaaaagaggggatggatggcatttactcgagcaaaatgaagacggaggtgaaaggggcaatgattttggcatatttgctatcgggggctcaaaaagttcatttaatattgtttaaatatgcatcacccaccacccgacagcaaaagtgccataaatatacgcttttccccgggcacaggtgcacaaagtttgtcggtgggaaggagggaagggtgtgctgagccaacagaactcggaagaaaatgtgccgaacggaaagaactcagtgtctgtggagaaagtgccgaaccaaattttggagttgtgttcggagaaggaagcgccgaaccaattctcgaacttggaggaaaatgtgccgaacggaaaaaactcagtgtctgtggagaaagtgccgaaccaaattttggagttgtgttcggagaaggaagcgccgaaccaattctcgaacttggaggaaaatgtgccgaaccagcttttgttggagaagcaagtggtgccgaaccagcaggactcggaggaaaatgtgccgaaccagcaggactcggaggaaaatgtgccgaatccgcttttgttggagaaggaagtggtgccgaaccagcaggactcggaggaaaatgtgccgaatccgcttttgttggagaaggaagtggtgccgaaccaacagaactcggacttgaactcttgtgccatggaatccactcacgtttcgtctgccaatcacttttttggtgcgaatggaaatgagtgtcaatgtgccaattgtttttcaaaacattgcttttacagcacagtactgcgccgaaatggttgaaacacttctcgggaaaatgtcggacaaggacgcgttccatttgcgcaaggagatgaatgatgttttgacgaaatacgaggccgccaccatcgacgacaaatgagttgagagggattgattgattgtctgccagtgatttttatgggtttctgcgcttgaattttttcatttgaacgtcatttcgtcagtaaagcaaatatattttgagtttttttgaaaaattaaatattttggaaattgtcaatatttgtctatttaagcatttttggg

SEQ ID NO: 2610 - DNA, 2473 bp, Heterodera glycines
  misc_feature (2379)..(2379): n is a, c, g, or t
  misc_feature (2404)..(2404): n is a, c, g, or t
aaaaaaagcgttcccaatctcgagtggaccacattatctcaaccgctcttctcatttattttattgtggtctttttcatttttgttcgttaagcttttacatattgctgtcgttgaatggacccatccttgtgtgaattctttgccgaaaacgaattgatcagggtgagggggattcatttgttttaaatctctcgttttaatttgtttttaatccctttttaattaaactcagtcagatagtgcccaatttcaatgaccgaaccgtccatttgttctgtggcgattttggcccatttgaggccggcgcgccggtgaccatcccattttggttggccatattgttgaagagacgccgtaaatgcacaattattgtaccattttttactgttttcatttatagcaacttaaaatgggagacaattggggcccggaccacccaaattgatgcagtttgatatcatttgatagccctaattcactccacgaaatttggccaaaaattcaaaaagccatgctttcctaatacatttggcattaacttttctttgagcctaaccgtgggaattatcaatttttaatgtttcatactaataggctactaatttcatgatttttaaatatttcaaaaatgcttccgaattaatgattttcgggtctctaattgtaagttgtaaaattattaaaatttgtttaacgtgtgctcccaatttttcataatttttgccatttcagccccccgattggctgagtggacgagctgaaacgtatgattgttgccgaggcggaacagagagcatttgcgcccattccagagtgctttttcgagctgtccaacctgttgatgctcaaagcgtgggaggatgtcgagcagtatgagcaggtttcaacattacttacagggaggggtccacttgtgtaactgtaccgattgagcggtaccccaaaagagtaatggtaaaattggaatttccaatttgtaaaatccattttagaatcgaccggaaaattttaaaaaaaaatttccccgaaagttttcatggagacataaaattaaatacttttccattttagttgaaaatacgtcagaaatgcgcacgtcgaccatcaaatttggccaggcgagtttttaaattctcagtttttttaaaccctgccgatatcctagaaaaaaacatgaatgatgttttgacgaaatacgaggccgccaccatcgacgacaaatgagttgagagggattgattgattgtctgccagtgatttttatgggtttctgcgcttgaattttccatttgatcgcaaattgtcactgcttttccgtttccgaccatttgttgcgttgtttattagagcccgggcgcccgccgggcttttgccgggccgcccggtaaaacggtctttttttgaccgggcccggcattttcaaaattccgggctctattatttattacccagaatgttgaaaattaagattgcattttggagaccacatttattgtcagattaagtgattgtgaaaacaaaggcaattttgaaagagatctctttaagctcattaaaagtggtattcgacgtcaactgacttccacgctccaacatgcagcaccttaataccaatgattaattattagaggctttaccagagttggtggttactttgagctggataattccatggatggaatttcgcgttttttccaccaaattgtagaaaacatcttccgcccttaattggagagtgattacatgaacatacagttcaaaagcaacaattgcttacaaatggtccccatatccgaaaaaacggtcatcattttggttgtttgggttcggaggccgaacaggcattttgtacaagcgacgacgacgccagacagcttgcatctaacataagacatttagcaaactaagaacatgataaaaaaatgaaaaattataccaattcaacggtttcggcatgctccacctctaaaaattccaccaactgggcaagggtcagcgagccttgattgatcttaaatgggtcgggtggtgagtcactgtcactgctgttttcggggggactgtgctgttgttgttgtttcattttaatttttgaacccgaaaaggtcctggttttgcccaaaattcccggtcccgtggcactctattctaaacattaaaaattggcactttgcacttgggtgttcccgaaaatagtggcattctgaaaaataaaatttcatttcccaaagctttaggttcgatttttgctaatttttattgggtttatgactatttttttagcttagtcgggattatgacgcgtcgggattatgacgcgtcgggatttagacacgtcgggattatgactcattttggcttagtcgggatttcgacngcatcgggattttgacagcgcgccntttaagtagtggcccgttttttcattaattcccaatctgcccctaatttcgggcccccccccccccccc

SEQ ID NO: 2611 - DNA, 3042 bp, Heterodera glycines
  misc_feature (2273)..(2273): n is a, c, g, or t
attttaaatttaaaaatatatttatacaatttgcccccaggttaaattgttggaaattgtcggagcaatcttttagaaaaaatggtcagttttattaaactaaattctgcaattaccatagatggtgcttgaacagtattgttaggagatgaagcaatgttgggctggaaattaaagaacattttgaaaaaaaattcgataatattattctctgttaatttaattatttcaatatcattataaatatatattttttaaatggtcatttaccaaaattggtcttcgaatcgcattattggcattagatgaataaggctaaatcataaaaattaattacatttctaagcgtatttgtaatttaattattttttaattaacataaataatttcttaattcactgcaattaccacaaatgttcctcgaagtgttgcattgttggggttaattaaattaggctttaaataaattttgatttttttttatcagtttcattatgtaccataatttgccgccaatttcctctgtttacgcctgttgaagaaggctaaaatattgtcagtaattattattttaatttacaatggcaaaatttattaaaatattttcaattaaattattaattaccatattaggccattgaattgtgttgttggcaattttaggagcgggctaaaattaaaaaaaaataattaaaataaatactaaatctttttttttgacaatttgtaactaaatttaattttttttcgctatttaccagaattgttcctcgatttgcgttgttggcatttgaaaaagatggcttaaatttgaaaacaacataaatgggaatatatttagtggaaaaaaaactccttacagatggcacttcaaattgagccaagctgcttactgtaattgaaatttttgtattaaatttttaatttacaaaacattcacttgatttgtactcaatgtcgaacccagtgtgattgcgttgattagcatcatcaacactcaaaatgatcaccacttccgctccgatatccgcataaatagcggctggaactcctgcacaacaaagtcgcgcgcctaattatttaaatcatttttaattaataaaaaataataatttttaattattttaattttttaccggttgcaactttgtcctgttttgctttcacttccacatagctggagcatgtttcgcgattgcatggaaagtccaagcgtctaattgtgaccatgacacgcctatccgcggactcgggcttaattaatcatttgcgtaattacatttaatttaaataaattttttatggtaattaaaaacatgccaatattttccagtagcaattcgtgcttggcgtcaatgacactgtggaaatgtttcccgcaaattcgcctgccatcagagcgccagtgctcaagcagttcgggtttgctaaaattaagaatttaattaaaaaaccttttttaaataattaataacaataataataccattgccaggaatttcgtcacaaaaagcgccagagtagccctaaatgcgattttcaataaatgagtgattttttttaattttgacaaaaaaaaaataatttttaatattttgtggtattattttcgaaaaaatttaaattgtcgccaaagataaaatttgaaatttcatcaaatatattaggcatcataaaactactaattacccatttttcttaaaaattattttttccattaaaataaatcaccgcaggacaaaggcactgattgcaattgttgggattagtgtaaccgccatttgtgcaggccaaatcatttgggcaaacttctttaatttaattaattaattaattttatttttatatatttttttactcgaacaataatgcaggttaatcattttcgcgtccttgaaagaaaggcctccgcggtagcccattgtgtactggtaggacggatcgcgtgtagtgatggagaatctttcgatttttaggggtgatttttcttttttcagtcgatttttatgggtgtatttttcgttttttgaaatcccgaactaggggggtattttacaaaattttttcgccaaaaaattactattttttgccattttggcctccatttttcaaaaatatagtaaaatgggggtccggcggtgccgataggcgcagccgggaaaatttttgagtattttaacgcaattttgttaagaaaatcgcttaaaatttcaaaaaaatgtactgaaaatttttacttttttgggtttcgggggggggggctttagcccccntcaagcctcatgaacaaggggtgcgccaggaccaatttttcgtacgaaggctctggggcccagtcgacccccaccgtaatcaacgtagaaacattttttatacgattttaaaagaattttttttgtggcgtaccaactgcactagtaccacattttttgttgttgcaatggtttttaactaaatttagattattttgataaatttaggcacaaaagtaagaattttgaaaatttggaattttcaacttcttgttcgaattcgggtccgggattcgaaaatggtcaaaatgaatgtcagattcgtgatcagcgaccctaaaaaccccataaaacttgttttcacgactttttagaatcgaaaaaaatttttccaaaaacgggggggggggggaccatcggcagtattacagtgaaatgttttggcatttggcatccattcgacagtccccttcggcactgttgtctctctcatttttgcatttccctccccattttggcatttgtctctctcatttttggcatttccctccccattttggcatttgtctctctcatttttgcatttccctccccattttggcatttgtctctctcatttttgcatttccctccccattttggcatttgcacatctatggctttgtctcttttaagccgttgttgtctgagtttattttatttacagcatttattaaaattcaaatgtgctttagtgactaaaccttatgcgctttcctttttttcgcttgggttcaattcccccactggg

SEQ ID NO: 2612 - DNA, 6377 bp, Heterodera glycines
ccccccccccccccccctgcgtacgcccttggaatgaattgattagtaccaattattaagaaatgtaaaaaattggctgcaataaataattaatgaaattttttgtgtttttaaattataaaatttttgaaatttgtgtatattttttttttgtgttttattagatcaatactcttttaattttatttatgaacaattgcagacaaattattttgcttttttaaaatattaccaaaatttaattaaatcatattttagtaataataataataataataataataataataataataataataataatattttactggttgaaatcccttgcaaatgctttgtttgagtaatgcatcacagaaccgaggtccttaaataaatcaaaaaattattttttgtataattattttatttacataaggctggccaagattgtctgaagtgtccggcgatcgtttgtaaaagtttgattcggttcccttaaataaataattttaaatatttaaaattatatttattttaaaaaattttaccgacaaaatgttgttgtaattgattgtcacataattttcttggtcagttctggactgttcatgccaaactcccaatgcgtgcattgtttcatgcacagtaatgcccaactaaattttatttatttttagcattaaaaattcatttaaattttggcattatgccaattgggcttaccgtttcgcaaccaaaaccaattgagacaatttgtgaaccgccctgtcgtccgaccattgaccaacagcccgacaaacgagaatattccatgtagtctcttctgccaaccaaatcattggcatctcggtaataagcgaagcggatgcaagttaggcttctgaaaattaataaaagcgaatttgtccatatgtccgatttcaaattttttaaaattcgtaaatgttcaaaaaaaactctaattaataaatgcaattattttcctccattttcaccacaatttgttcatttttttaatttttaaatcaaaaatttgtcagttgaattgaaaagttaaattaaagttctttgattaagtatattcctaagatttgatttgtggtaaaaaaaaataatttaaataaatttattgtaaatttcaatgataaaaaaaattattacgaaatatgtcgatgtgcagcaaaaactgattgagccaacacttaagttaaaaaaaaaattaagattcataataataattaattgaactaattaattaccgtcattttgcccaccggcaattgtaaatggaattgttgtttctgtccaaaatgtgtttgggtccgggttcaattggcgtgggcgcatgcgtctcatcagtgtttgtgacgcttctaaattcaaaatttcgtaattttaaaatttctttggcacaccgttttccatttcgcgcaaaatttgttgggcttgtggccggttcaacagaatgtcgccctcaaacagttgatgcgcaatgtctctgttcacgctcaactccgtgccatcatttgcgccaattttgttttgaattctcagccgttggagcaattttgttggattctcaaaaaaaaaaaaaattaaattaacacataatttaataattaatatttaagattaaaattcacctctgaagcactcgtaacgtgccctttgtggttgagcccagtaatttgaatccgatcaagcaaccgtcgcagattgtttgatatgtctcagcgcagcgatgtccatcggggactaaattatggttaattaggcgtaattaataatttaaatggtcaattaaatattaaaaataaaaagcatagctctttacaacttcacctcatcatccagcaaaattgagtttttaagcgttattggagccgaatgcaaattgtaaaaaagcagagaaaatagtaaacaaattaaattttgcatcatttctttaaaatctatttaaaaatatattaattaatttaaaataacagtttttatcactgaaaatggttcagtttcgctcaatttatgtgatttcaaatatactttttaggtcataatgtctcgtcaatgtataaaaaaacgaactccacaaactccattcccgcagtgaccttggtggtaatgtgattttacacgtttttgcggtgcttttgaaatgaaaaattcaattctaccgaatgaaaacgataaataattttaattaatcttttcggattaatacttatcaattttttgtcaataaaaaaattttcgtttaatgattaataaaaatttttgaagaaaaatggttagatattaaaatttatctatttaatttattgccgtgtcaattcggtccccgttttccttaaaatttattatagctgtgaattcttaaatcgctaattggtcatgcttaatttaacaaaagaaaattaaatgaagaaataatgaccttgacgtaaattgttttttttttaaagtttaaaatcgttggttattaagaaaaacattttttattggtagaaaagaatcaaatataaacaattgtttaaattaatttaaacaaaaataattaaatattatgttatagaatatggcgtgtaactaactatttatatgcaattgttttaattaaaaaaaattcatttttttcataaaataatccaattagacatttttataattcctcagaattaattttccgtgaaatcttctgacttttatttaattacacatggtcatgcttagtaataattttttatgctaattaaatattttccatttcatctgttcaaattgttttttttacagaaattcatctgacttttgtgttggacaaatttagaaacaaaaccaaaaacaacagaaaaattaattttgatcagatttttaattggatcacaaatttagattttgtaatacgcacaataaaatgcatcacatgtacgaaaacaaaggtgcttgcagaagaaattggaagcgcttaaattgtttgagtagctttttaagcggaaatacgatttttacttactccattttttctaggcttaaatctaatgccgattttcgacactcagataattttagcgctcataatgggttgtataaaggtgcttgtagaaggaattggaagcgcttaaattgtttaagtagctttttaagcggaaatacgatttttacttactccattttttctttggcgccagtcatcttgcgcctgacgctaaaattatttatcatccaattaataagctcggtatgatttaaagcaattggcattctcttatggcaaaaaaattatatggctgctaaaaacctcaaaaaaagccaagttttctagccatttcggcgctgcaaacgccatatcttataatataattttttgaaattgtgcagacttataataaaaattcttattcttctttttatttaaatttaattcctttttccatttgtatatttttgggcgatttgcgcccaataattttccagtttttgctcaattctctttctgttttccaatgatgttttcctttttccttaagcttttctttaattgcatcaaatttttgaatgatttctgttttttgttgatcatttgggtcatttcccatttctccacccatttgatcaactgctgctgatctttcattatgttcatttgggtcattttgttccattttataactttatcttctctttcatttttgttccatcctttgccaaatatttcttcaaaatttttgagaatttttttgaatggattgctcaataaagaagaatttttaattaatatattttttaaatttgttcataaaaccagattgattttattacatattagctaaaattgaagtaaataaatgtccaattaattataaaaaaaaagtaaatgcaaaaattatgacatttcgcatttttcatgctaaaatctatgtaaaacttataaatatgtattagaaaatgcaaaaaagataatgggatttcataaataattgtcgaaactgatttggaaacatcggcttgaatttagttttgctttaatacaacttcatattaaaattttagcaaaaaataaaaggtatcaattacatttatatttaattaaacaattcaaaccacaaaaataaatattgtttgtttaatttgacacttattttgtgatttttgactaccatttaggtatgatttattttatctagaaataaatgtaaataaacagattataattcaaaaaatttacattttttaaattatatgcgtctttctaccaatttatatttctaaatttttctttttatggattaaaaaataaaatttatttttattcaaaaaatattcttttcaatttttaaaatgttttttattttttaaatttcttattcaaattttcattttattatttttttttttttgccctttccaatccatttatcaatttttatttctccttttttcatttaaaaattttgtttaacaacaaacaaaaacacagcattatcattattagggttcgaagttgtatgcactaaaaaatgccaaatatgcgcataaaatatgcactaaacccccccccccccccccaaatatgccctaaaaacacgaaaaaagccaaatatgcactaaaatattccttaaaaattgcctaaaatagtttttaactctcaaaaaatgccaaataattgtgtaaacatttagaattgactttaaaaacaccaaaacaatggcgaagtagtgttttagacaatttaaaaaaaaattaatttcaaaaaatttatgtatgcaattttgaacgattttgaatttaaaatttttagtatatgctaaaataaaattacattttttacaaaaacaaattttttcattgttacaaaaggttcaaaatttttcgatttttaaagatgtattttttaatttgccaaaaagtcgtatccttagaaaaaatatgcaaaatcatacaacttcgaactctaattatcactaaatatttttcctttttatcatattatcatatatttttttatatttctttttgaatgacccacttccccgaacccaacggggtaggggaagtgggatattcgcctccatctttgtgccgttggcttccaaaatcctcttcaattctttcaatgccggatcctcttcttcttccgctccacaactcgaactcggctcttccaactgttgctccagttcaacgtcattctgttcgtctacagtttccgtcttcacgctgaccttctcttcccatttccgcttggcattttcttccggctcattctgcttcggttcgtctacagtttccgtcttcacgctgaccttctcttcccatttccgcttggcattttcttccggctcattctgcttcggttcgtctacagtttccgtcttcactttgaccgtctcttcccgtttccgcttggcattttcttccggctcattctgcttcggttcgtctacagtttccgtcttcactctgaccgtctcttcccgtttccgcttggcattttcttccggctcattctgcttcggttcgtctacagtttccgtcttcactctgaccgtctcttccgtttccgcttggcattcttcttccgttcttctgccgtggctgcagccagagggagatgggcatcggcgtggttgacgggcagttcacaagacatgattttattatttatgcgatgcgatgggaagtcgcaatttatacgcgaattttaggagttttttttgatcgcaattactctcacccccgggggctcttcgctcattttttcatgcgctaaaagaccagttgcttttgcacacagaccgaggttttttgtcagaaaaagccccggccgtcgtccatccatctcgttttatgaacacataagtttttctccataataagctgaaccagtcacactttactttttgctaaaaataaattcgaggaaattaaaacatctaaattaaaacatcttcaaacacatttgccacccgacagatgtcattgcaatgttaatatacgcgcctatttagtcatgcgaagtcgaattttcgttttcggcattcaaaaactttttggcatattcgagtgtgtgattttcaactgactgattggttgatttgcataattttattcaaagcttaatgcaaaattttaatggcatgccaaaggttcaatttgtcatggattccgattttagtctttttgatcgagtaaaaaagtaatttaatcataattggtaaagaattgttttttgtatgcaatttggaagaataaaaattgctttatcataattcttaatggacttttagttttatttcgattagacaaataaataaaatgacacttaaattgttgtcatgaacatttcttgtttcccgcttttatattacataattttgatcaatgctaatga

SEQ ID NO: 2613 - DNA, 5771 bp, Heterodera glycines
gatcagttcgactctttcaagctctgcccgaatgtcggaaagctattcaaaaataaatgaaaaaaaataattattattttatatgaggggcgacgccatgactttttggaggataattaattggttgtttggatttgtttgaaaagatttaaattatcataaaatgagagaatcgatctttaaaaaaatgaaaaaggctcaaaaaagttttttaacgaaaaatatttattttcaattttttatatctaatcaaattaattaactaattaatctattatttattaattaccatcttttgccactcattttgttgttgttgttgttgttgttgttgttgttgttgttgttgttgttgttgttgttgttgctgttcttcaattatttgtgttttcgcaatatttatccaaaacaaaagcgtttctctgtccgttctctgcgcattgttttcctttgaaataaaaataaatttaaatttaactaattatataaatgcttaaaaaatttttgttatttgcagagaccggatttatatatttttattttattttttctatagcatttctagcaaataaaaaaagattttggacttttggctgataaatattttggtgtttttggagtttttagcaaatattttgggggattttttttacaaaaatagctttctggcatctaaatttttggcaaaaagtccaagaatgttcgaaattttttttttttgcttttttaaggcaaagtttggattttatcgaagaaaatttcgaaaaataaatcaatcttagagaattaaaaaaagaatgacgctaaaaagcattgaaatgattttgattagcattgtactaatgcaatggataaaaaataccactttctgatcaaattggtcgtggaaaggcgcctccaaagcactgatcagtttcccggacaaacgcaaatagaaaaactgcaaaatcccgacacgcttttctaattttgtaagagtttcaaatgcagaaattcgttgtccaaatgtatgcttcatcaaatccaaataaaccttgaaatgagtcgcggtggaagcatttttattgtcacttcaaaaaaaagaattatgaatatacggcattattgtgtgccatttatagtgtgagtttttaagaatttctaaacactttaatctattaaatttagaaagaaaaaaaattgacgcttaatttaaccaaaatttcagaaaaaaacgcaatgttttagcaatttttggctaatttctgctaattttttcgtatattttggccattgtttcgagcttttagtacccattttacaattgaaaaataattgtgaaaatacagccttattgtgtgccattttagtgggttttaagaatttctaaacattttaatttataaaatttcaaaaccagaaaatttgacgcttaatttaactaatttaagaagaaaaaaaactcaatgttttagcaattttaggtaatttatgcttatttgggcattgctttagcgcccattttgaaaaatgaatgtaattaatttaattaattagcgtttttaattctcgctaattgcctgctgaagattgttttgccaaacaaaaactcggtctgcgcctgaatttcactgatttttgtggcaaaattttcattttgttttgcttttgccaacagcaattgcaaacgttcaaatgccgtttccgcgtccgttacgttcaaacttttccatagctttttaaaatgtttttttgctatttgatcgctcattttggcaccctttttgatctgagccattggtttattgaaagcttgtggcgataagcacaatgcaaataaactctgatcaaaaacatagcgcacaaaatcgactaaaaattcaaattcgaaaagaaaagggtaaagtaagcctgatccccccattttccgaaaaattttttttaattttcaaaagccatgaaaaatagagcaggacaaaacgtcgccggccgaaacgtcgccgggacataatcgccgctaaaaaaattttaattttaggaatgaaagatcaaaaattttagttacgtagctgaatttgtgaaaaaaaattctagaaaatttcaaaaaaaaaatttattaacaaaattctaggaaaattttttttacaagtttcttttttcggaaattcagcaaatttagtttttataaatgtaggctttcaaaaaagctaaaataattttaaattttcttgaaattttgaaaaattttaatattttttttgcggcgatgttatgttcggcgacgttttgtccagcgatgtttctgcggcaaggatacggtaacgtttttgggtgtagcccatgaaaacatatccctgggcttttcgggatcgctgattatgtacccagcatccatttcgaccaattcggaaccccagacccaaactcgaacaaatggtcgaaaattcaaatttttaaattactaatttttggttcaaacaatggggggggggcagccttaccataaccgaaaaagtcacaaaaagtgcactttgtctttgctcctccgtcccaattgtgcctttctccgctgctttttctgctgtcgatgcttttccgatcggctcaatgcggtaccgctcccgttgattagttgtattgaattgtttctctgttggcgccgccaaaaatgaatgcacaacggcattggctggccgaattccaatggcattgccaatgggtggcacattctgcgaaacaatgacactttgaagcgaaattccaatggcattgccaatgggtggcatattctgcggaacaattgcactttgaatggcattttgctggccaactgctggcatgtttcgcttgccattttccaatgcgttccgcttgttttggtcctctttggacgatttttgccgttttaatggcttaagtttttgtgcctttatttgctttgtttgtttttgccttttcttatatttcggcggttcagtcgcttcaattaccgtaacttcttccccttccgccgttactgtatgatcatttttcacattcatttgttcaccgcttgcgctgggctgattaaagaatgtcggcaccaaagtcaggtcgtccattattgtggtcagtgatgacgacttcggctccgtgttgtcgtcattttcatcatttttccaatcgctcactgacaaattggcatatattgtttagctgctaatgttatgctcgacgattgggctctattgcagttcacacgaccatgaaaaaagacacgaccataaaataatttggcaaatttaatggaataactattcgatagctctaagagtcctctattagtgtacaaaatttaaaaaatttctgtgttgtttcaaaaaaattatgcctgtaaacttcaaaaacgggtttgaaacttttttgaccataacttttttgaaacgcaacaaaatttttgaaatttggtagtagtctaatagaggacttttagagctgtcgaatgatttaccaagtattttaattatgacacttctagaaaaagttaaggtcaattaaaattaccaaatcattttatggtcgtggtgaactgcaatagagtctgacaagtgaccctcaccgatgggtgggttttgcggcagtggtggcacattttcgggcattggtaaagttgggtttggtaccatcacaaattgttgctgcaaaccgttgaacattaaattatagtcaatttggcctctgttcgctctcatggcattcatttggtcaaaattggcccgattttctcttccatttccctccgtcgacatttcatctacacatttctcgccgccgaccattgaggccaccattctatcgatggaaaactgatcattttcctctgatcgactgaatagtaggctttcatccaatatccaaatgtcatcccaaactgcttcttcccctgtttggaagttaaacggactgtcgctcataattggcattgcttcacaatttgtcggcattttgtctgtttcttcaagagacattttgtcattgcgcttcattccaaatgccattataagaaatggaaacaaaaagaaaaccactgacattgccaatcagtaataaataattcaaaaaaataatttaattgaatattacaaaaaataatatatattattttattaaaaacgtcgtaaaaaaattattgttagcactgacaaaatcattttagctttgtgcaatataaattagttacatacgtcaaatgctcatcacatacataaattgattttattccaaattatccgaaaattattaataaattaaaaaaaaaagatcaacccctccgactcgtccttctgcagctgatgcttccgaaatttttaattagcataaaaggcaaaaataaaaaaaggaaaataaatttacataagaggggacacgaacttgtgaaagcaaaaatgaacatcgagaacacaagctccgcgccgcctaagcacaaagcaatgcaaatgattatttaattattgggataaaaaaagtttgatacgtcataactcggcactcacgttcatttggcaagaaaataaaaatcatttttcttatgaacccatggctgttctcttgccacccaccaagtttaattcggaaaccagcacggacttcatcattattattttcttaatactagggttcgagccccgtccccggtgatgggacagttttagccgaggaaatttgtttgaaattttcaagaaattctgtctaaaaataacgaattattagattggataaaaaaacccaaatgaatggataaatttttcatagtttgttcccccattgtttttgtcgattttttaataaagaaaaatttaaacaaaaaaggataaaaaattgtaaataaagcagtgtgcggatctgtccttcagaaatagaagggtccaaatctgataaaatgaaaatttcctgatttgtcagatttgccttgatttggagatatcgagcaaaatttgttctgatttcttaaataaatttataattttttaaactttattgcagaatgtcactacatattttatcaagaaaatataaggtttgcgcaaaagttggtcatttgttgacaaaaaaactgttaacaaatcgcgataaatgtcgaaattctgatttagaaaaattttcgatccgcaccctggaataaaataaagtaaaacggttaataaaaaataattattaaaatagaaatttgttaataaaaaatttttacagtcgatagcaatctcatagattttttttagttctctactcgcgaagaatataaatcataaaaaatttaaagaataataaattgtcattcaaatatttattaaacagccaatttcataatttgttaaataatcgagcacaaagaaatttaatcatcttcaaaattgggaaaatgttgtttctcatctcgttctcatcaattcggcttttgcgactttggtggaggctaatacgctggttggagtggcggttgggcgccatagcttggcggctctggtggctcgtacgctggcggcggtggagggggaggcggcggtggtggcggcggcggggctccgtagcttggtggctctggtggctcatacgctggaggcggtggtggaggcgggggcggagggggaggcggcggtggtggcggcggtggggctccgtagcttggtggctctggtggctcatacgctggaggcggtggtggaggcggtggtggaggcgggggcggagggggaggcggcggtggtggcggcgatgaggctccgtagcttggtggttctggtggctcatacgct

SEQ ID NO: 2614 - DNA, 2114 bp, Heterodera glycines
aggtggacggaggcggtggcggaggcggtggcggtggcggaggcggtggcggaggcggtggtggcggaggcggcggcgcaacttttccggcactttgcacaacaggtgccccaacaaaaagtagggaacagaggaccaatggagtcaatgaaaacaaattcattttgactaaaaccaggaaaaaatttttaaattcaattaaaataaaatgtaatttaattatttttatggaattcatattttattgaattgataaaaaattttttatttaattgactaattaaattaaataaattaattgaattaatattttaaagaatgaattatttgaattgatgcctttcttcgttgttaatccgccttaaatagtcgtttcattaagccaatctttgacacattatacaaaattaaaagtcataaagctgtagaccgtcggtttgtccccgcaaatgcgatgattaagccattttttaagcaatcaaattacaaattgctgctgacatgagagcataaaaactccattttaattagtcattttttatttcattaaattgtcatttccttcattttaaataaaaaggttaaatttaaaatgttagcaataaatgactaatctctgactccgaacagttaattgaatcagcaggtgggtgtgtgaatgaatgcaaaatgttacaccattaatattatgaacatttacaaaatgtataatttattttatcattttattaaaaaaggattagtattatgaataaatttttcaaaaaaaaaaattatttcttttatcttttattcccacgaaatgtgccaattttggattaattttcaaagaatttgagtgttttcaggtttgacaattttaaaattttgaaagaaattttaaaaaagaataagccaatttacagaaatctccctttcgcctgagtgtttttttaattggaataatttgtttttttacccaattaatttttcactttaaaaatttttacattcgacaattttgagcaaattagacttgtcgccatttcccatcacaattattttatttccctaattaaaaaaataagccaaaaaacaattaaaactaatgcgaattatcaatggattaataagtataataaaaagagagaattattgtagcgtacggtaatgaaataatcaatccaagatgctgctgctgaaattattttgattgtccattcataatcattgccccgctggcggcacgcatcagcgcggatgacgaagcggcacgcattgtgccgaacgcgttcggtgccgcgttgacacggattttggagcggacacgcatcagggagttttccggctcgtccgcgcgctcctccgactcgcccagatgggattggatttggcgaaacttttgtgtgttcatcgccgacacttcctcctgcaaatgaagggggtaattaaatttaaaaaaaaatgccaaattattagcagaaattcaatggttcatttgtgcaaaaggctataaccctctaatacatgtgaaaatgtaaattttcttgttgacaaattcttgaaaaatatggttaattagggttgtggtaggtttttcttaaaaattcacacaaaaaaaatttaacaaaattttgtgtacgtatatcaaaaatcccaccgctaccgtgctctaaaaattcggatgatgccatttcccatccgtcgtgccttccccccgaaaattacaaattaagaaattttaaaaaaaaagtcttagggaattttgccaaagaaaatttcaaaaaaaaaaatgaaaaatttttcagccatttttcaaaattatgatgaattattaagtattttttaataaatttccaaaaaatagttgaaaatttgtcaattttttacttgatgctttcttaaaaaaactttctaagatttaaaaaaaactcaaggggcggctgacagggtggatgcacttaattagcatatttcaatttaaaacaattacaattttgtaaaaatcgaattaaatttaaataaattttaattttatttcagctttaccgcctcctcaatttgcttcttgtgcactttgatctttgactgcaatttttcgatcaacgattgtattttggccgtgccctttttct

SEQ ID NO: 2615 - DNA, 2839 bp, Heterodera glycines
  misc_feature (2761)..(2761): n is a, c, g, or t
cctcttcccccctttttggccaaatcctctccctcttccctctaaggttggccaagttctctttccccccccctttttgccctaatccctcctccttttttggccaaatcctctccctcttcccccctttttggccaagttctctttctctcccctccctttttggccaaatccctcccccttttttggccaaatccctcccccttttttggccaaatcctctccctcttcccccctttttggccaagttctctttccccacaggcgaaaacaaaaaatgtttaaaattatttaattttttgcaatttcagagtttttgtggcgaaatccccgcgggggagggcatggagtacaagcaggatgagaagatggcgccacaggtgtgccaattgaaaaaagaaattattaattttataaatatttatttttaagtgcttgcaaatgttgtcggaacaagccggactaatgggtactgtaacacagtttaacagaaaatcttttttgttacggtagcaagttactaatttctttcctttctttacaggacgtgactacaaagatcacagatgtcagcatgagatgatgacacatcgtcaaatgatggtccaagaattcctcatgtcgccagaaattgtgatgggctgtgcccaacaaattgacaagtactgctcgccacagggcgacatcgaatcgaacggcaaatcggcgcattgtttgatggcacattcgcaggagaaggacgaagaaaaggtggggaccatttatccgatcagatcagcattgattcagattcaattaagaatattgtacattttttcaaaaatgtttttaaattttgctatcactgatttaggatttccattgtttttggtacatctcacaataataattaaactttaacacgaacggtcatgggaagtgttgaattcttaggcacatgatttacaaaataaaaaactacattttggcaaaaatatattactattttaatatgcgcagttgaaattcttcactgcctttgtggaccagcagctgaatgacgcgtgcggccaagaagtagtgaccgtcgacaattggcacaaaagtgccaacaaattgcggggacaggacgacaaagtggcggccgacccaggaccacaggtaaagccgtccatacggcctcaaagctctgactttgccattaaatttacaaattttatagggcgacattgagccggagggcaaaacggtgcacagtttgatggctcatgaacaggaggaggacgtgaaaaaggtggggccgattggctgatcaggacagatttatccataagtctgagcattgttttgacattttgtcggctttcaacttttttgttatcattaccggagtttaacaccccataattttggccaaccatatgaattctgattataaataatataaaattaattatttttgaaaaacctggaatagaagcatgctttcaactggattaaggacaaccttataaatggaaactttttttttggataaatggttaaatttcactaaaaatcctcaaaaaatgtgatataaacgtatttctaaaaaagaattaattcatacctttttataaaattatatcaatagcctgtaaaataaattaggtagaaaaatattgaaattaaaagaaaaaaacgtaaaaataatcggtggaaagtgggttgacaaattatggcgcgcagggaatcgaacacagaccaaaggctgtgacaaaacaaacaaccaacaaaatgcgccatcccaccgctgcactgatcgtcatagaaataaaagaaaagaaataaatttcctcattgatagccgtgttgggacatttcctaaatccgtcatcataaagaagataaataattatagcctaataattaagttctttgtccatgaaacgaattcttcaaaattaatgccgtaaataactttaaacaaagaataatattaaaataaatgaaaaaaagacaaattttttctgttcatttgtcaaatttagtattgcaaagaagaatttcacagaaattttatttttaattaattactttcagggaataaaaattcaatgattgggattttccaaatatccctgtaaacaattattttcatgaaatgaagaggccatttaaaatttataaaaattctgttatgagccattaaataattttccaaaaaattaactatttttgatttaatgaagatggagagaatttggcactttcaacttttttaaaacaacagtaacattgactaaattatcagatgtatgtttaaattttgcttactattttttgggatgatttaaatactgaattaaataatattcaagcccagtaataaatgtttacagcttccagatttcaaattccttgctatcaccaggaaacggatttatatgtttttgaccttttgtccactacaatacttaatgctacaaaattttaataatttatcaaattgacacatttcccggaagccattattatcattaaaagggctgggattttttacacatattttagattgagcacatattttggcattttttggttcttaaaacctgttttgaaagttttttgcacgattttaaccctaattattaataggggaaaaaatgtttaaatgtgtaattttattatttttattttgttagaaaataataaaaaaatttccattttattttttcagtggtgggacaatgagcagaacaaatatgtgcagccgaacctgaagtaccagccgtttgacttncagtgtctgaatgaatccattggcatgcttatgtaaaaacaatttacttacgaattttcaaaagggcacatttttgga

SEQ ID NO: 2616 - DNA, 2676 bp, Heterodera glycines
  misc_feature (79)..(79): n is a, c, g, or t
  misc_feature (128)..(128): n is a, c, g, or t
aaatgcgtcagtagaaatgcgtcagtgatgtttatgtcataaacaagtccttgcgtttcggggcacagaccatgaatcngtatccattcgcccaaatcagaaccccagacccgaattcgaacaaaacntcgaaagtccaaatttgcgaatttagcatttttggttcaaaacggcatacatgatctattattgaaagactgatggcttttagtttgcttccgtgtatttaaaccaattttgaagaaaaactctaatttcgaaattttgacttttcgattttttgttcgagttcgggtccggcgttcggaatgcagaacgatgttcttatagaagtttatttctatattacaatacaaatgccatacaactttattttaaagtatttttatcactgacgcattttccactgaccgattttccggtcacgctcaaaaatagcatttctacgttaaaattttttgatttggtgaaggtttttagtgcatataaaagcatatttcgggggttttcgagaatgaatgcatatttttccgtttttgctttttaagagcatattcagcattttttggaaattatcgcaagaaaaatacaaaaaaaaagtgaaaacacatcactaaggatcgatttttgggaatttaaaaaacattccttaaaagcaaaaaatcttgagctttttgaaaaacttttggaaatgagttttgtttatataaaaaaatataattttgttttgtcatataacaaaaatttaataaatttcaaattgcatatataaatttagaaaatcaaaattttttcaattatctaaaaacgctacttagccattgttttgatatttttaaagtaaatttttatttttacacaattttggcattttttagggtcagaagccatcttgggtaatttttaaggcatattttagtgcatatttgggcatttttcgggttttagggcatatttgggggattttagtgcattttatgcgcatatttggctttttttagtgcatacaacttataaccctagtcgaaaagtagaattgtggtcataacgaattgcaaaaatatggtttccaaattgagggtataatttcttaaaatttcataaaattcgctaaatgtaaaataacaatttcaaaaatggtgaaatgtggtattaaatagagaccggaaatttcaaatttgcggatcccgctgcgggactggaactcaaaattttttgcgggacgggatcccgcgggattaatcccgcaaatcttctaatagagatttttggaaaaatgcaaaaatatgtacataatgccaaaacatggacataaatcacgaattatagaaaacctggaaaatatacactttgccctatgaggcttgatcgcctccaaaagtgatcgatgggtaattagcgatttatcgtaaaaataaaatttagaaatgctcatttaagccagaaaattcgaatttaaatttgtttattttattatttttttaataatcgctttccctccgtctcccaatttctcggatcttccaagaagcacttcagaatccgtcgtcctccgtctccaccatgttaaaccattgaatgccctccaaattctcggccaaatcgatgtatttgaactccacgtagctgtactgtctggtgtccatcgggttcatcaggttgatgtacaggccacgcagttccgcccaattatcctttaatgatgctatgattattgccaaattggcacttcttcgtcatgtctctggctcatattttttcggcattaaaaactgccaatggttgtggccttactccccaaaataggcagtaaaattagaaaataggctaaaaagttttaagtttttattgcgcatttaaggaattttatgcaaaaggtcaaaatcttaaagtttttaggctcgaaaaacctggaaaacactaaaaactcggaaagtagcttaacaacagcgtacaaaaaatattttttcatacattcagaccaaagagtattctaaaaaaatgaaaaatttttaatgatatgaggagccctttatggcattttgcaaattggcattttgtttggtgcccagaaaacgcactttgaattgcttgtggctaaggtcgcgcaattggatctgaatttccttggtagctttggcgcctttgcaactgaaaaatgaaaaaattaaaaagttacccaatttcttttgaaaacatatgattacagtagactaaacaattactgtaaaactgcgctaccatacacaaactcttaactcccccccccctccctccctctccggtgtcatgacaactcgtacaaaaggcaactcatacaatgttgtacaaaggcaattcgtacaatggcatagacgcttgcttgggcctatgcttattgttagctttattttgtaaaaaatttttattgtacgaattgcgtttgtacgaattcccaagtgaccccctttccacgtatggttctcatttacagcagcaacatgtgacaccaccaacttgtgctccacgatcagggtcaagttctggtacatttcgggcaccgggtcgtggctgaacagtccgctgcactggcgctggaacagcacggcggccaacgagaacgaggcgtagtggtaccggcccgactccatcagtgacggacgccctcctcgctggtggacgagtcgatgttcatct

SEQ ID NO: 2617 - DNA, 4371 bp, Heterodera glycines
  misc_feature (68)..(68): n is a, c, g, or t
aaatgcaaatatttaataatgtgaaattaattaaattaaaatttttgaaaaattcaaaatcgaacccncgccgttgtgattgcctcattgcacgaagtgaagaatgaaccggctggccatatgtgctgcagtcttatagtggcctatagagtttaaattaattattaccgttaatttttgtattatttcaaaaaagtgtccatattttccataagattttggtccttaaatatattttatccaattaattttatatgacttttaaataaaatatttatttattttaacactattaattagtttttaaaattcgaaggggctgaaaaagaagaaaatatgtcatcaaatggaaacccccaagaccgtaaaaaaataaacataaaataaatcaaatttacaaataaaaattctttttgtttataaattttaaattaaaaaaacaaaaagacttttttgaagccaaataaatgattgaaaaattttgacttgttaaaatattgttatgaatactataccctgggaatttcatttaaatcggaaagcgaattcagaggcctaaagaagttggaaatagaattaaacaaaaaggtaaaaaacggaattccgaggccaaaaaattcaaaaagtcacaaatccgcggcgtaaaaaattccggaagtccaattttaagccccaaaaaatttcgggaaatcgaattctttcagaaactctaatttgagacaaagaaaaattcagaaatcttccccatcccgaagccccgatattatcatttttgcaatccctcgcccccctcccccccccccgtttttatgcctcaatttgctgatccttcggatttgctagcgttccactcgacccttcctcatcacacaccacgcagccgtcgatcagcaccagcaatgagtctttaaacaggttggtgaagaattttgaaatttttttttttacccggattattctcagcgatccatttcttcgggctcttattttcataaaatttgaccatggcacagtgtttcgcgaattcgtaaaacgggtcaccgcaagcggggccctaaaatttacaaaaatatatttttaaacgatttttatctttattgtttaaataataattattattttaaacattcttaatgggaccgagaatctgaaggaaaacgcgggaccgagaaaaagtgaatgaaaatttcttttattgtttttgcaatgtggaaagtttgtggtatttggtatcagattttggcaattttatcaaaaacaatttataagaatacccaaatacttatttaaaaaatggatttgcattccaaaaatgtgccctttttgaaaaattcgtaagtaaattactatatacgttatattgacaaggagtttcgtttcaaaaactaatttgagcttaacggctaatgggacgggtctgaaagtagtggaagggtcttacaactttttgaggagaatccgggaaaactatagaaaaaaattctcgacgcccaactgagtcccggggaccgatttctcactttttcttgcagtttagggcccgtaactttttttctaaaactcggatcaaaaaattcccgctgtgagggccctaagttgaaatgttggctaaaaattaaaaaaaattccaggcctctatctctaaccccctgggctgggtgcttctagaacttttcagtaccaaatttgtccagttcagtccccgttgaataactcattaggctttgacctgagcgcaggggtgccagcggcactattgtagagcttcgaaagctcgatttttccaaattttaaaatttcgaaaattttcaaaatttttcgagctaggcctaaaaaacggttttcgggtttttgaattttaggattttttaacgaattttcccagaaaaacgaagaccacttccaaaacatagtttttcgagctctatcgactggtatttttttcggaaaaatttcgattttttcccggaaatagaaaaaatttttggcctcagcgggacatttgagtcccgggcccataactcgtcaggggttggttttatcgaaaaaactccttagggcaaaattgtagagctttttaaatgctatcgaatggtgtactacatgttcgaaaattttcaaaatttttcgagctaggccccctagaaattttcaaaaattttttttgggttgaaaaaggggctcaaaaatatttttctgggctattttgaggtgctgagcacgaatatgatgtttgttttacgtttcagaatttttggaattttttaaaaattctttattttttggcaattttttggcccttgggattttgggctaattttggaaaactcataactaacctcaggtttggtatgtttaagtgagtttaagctctaaaaatagagaaaaataaggagaattttatgtgatttatttgggatttctatcttcaaaagaaaaaaagttattccagaatttctggaaattttcgaattttcagaaaaaatttcataactcggttctgaaaagtcattttggaaaaataaaatattccaaaaatccgcattttttttctctattttataaattttatttcacatttttatcgcatttttaaaaaaagatacaaaaataaaagtgatttttggattcgggaccaaaggggggtgaccaggatttttgagtggaaaaatttttccatcaaaaaccatccaaaaacatgtctttaggggttatttgggccgctgatcacgaatacgtgatcagattttagtttggacatcgttaagacctcagaatccctgtgtgattggggattctgagtcatcttctggggggggggagttcggatccggtcggtgtacattatttttctgttcattttttgggtatttaatattgttttattaatgattttaattaatttaaaatattttgttaagttaataaataaaaaattaaatttaaattaatttttttttgatgaataaattttataagtttaaattaatttttttttaaattaaatttgttaaaaaatttttcatttttatttaatgaatttactaatcactgttgtacctcttctaataagtcaaaaagattggggattctgaggggtggggcggcaggttcggatccgggccgtgtttattattttttgatttattttttagttttttcgatgttattaattaatttaattttatttttgttttttaattaatttaaaatattttgttgagttaataaataaaaaattatatttaaattattttttttttgatgaggttcggacccggacggtgtacattatttttctatgcatttttgggttattttcactgtttttaattaatttgaagattcgttttaatttatttaaatttatttttttttaaattaaaaaaattattttttgtttttattaataacaaaataattttaattaaatttaatttttcttttgatgaatagatttatttttaagcaaaattagatttaaaaatttggatgcataataattcctttcaaaataaagtaaaataaattattccgtttattaattaaaaaataaacttttacattttttattatttagttttttttaaatttttaaataaacctaattctataaaattatatttaaaattttgaaattatttttgtacatctcataaaaagttagacttttgtacctcttttaatcactgttgtacctcttttaatcaccgttgtaccttttttaatcacttttgtacctcttcatcaaatttgtacctcttttaatcaccgttgtagctttttaatcacttttgtacctcttcatcaaatttgtacctcttttaatcacagttgtacctcttctgatcactgttgtacctcttttaatcacttttgtacctctcttaatcacttttgtacctcttttagtcacttttgtacctcttttaagcacttttttacctcttcatcaaatttgtacctcttttaatcaccgttgtacctattctgatcactgttgtacctcttttaatcaccgttgtaccttttttaatcacttttgtacctcttcatcaaatttgtacctcttttaatcacagttgtacctcttctgatcactgttgtacctcttctaatcacttttctatcactttttcactgtcgtacctcttctaatcactgttgtacctcttttaatcaccgttgtaccttttttaatcacttttgtacctcttcatcaaatttgtacctcttttaatcaccgttgtagcttttttaatcacttttgtacctcttttaatcacagttgtacctcttctgatcactgttgtacctcttttaatcaccgttgtacctcttctaatcacttttgtacctcttttaatcact

SEQ ID NO: 2618 - DNA, 2695 bp, Heterodera glycines
ctcttctaatcactgttgcacctcttctaatcattgttgtacctctgctaatcactgttgcacctcttaaatcactgttgcacctcttctaatcgctgttgtacctcttctatttactgttgtacctcttttgatcactgttgtacctctcctaatcacagttgtacctctgctaatcactgttgcacctcttaaatcactgttttacctcttaaatcactgttttacctcttctaatcactgttgcacctcttctaatcactgttgtacctctgctaatcactgttgcacctcttaaatcactgttttacctcttctaatcactgttgcacctcttctaatcactgttgcacctcttctaatcgctgttgtacctcttctatttactgttgtacctcttttgatcactgttgtacctctcctaatcacagttgtacctctgctaatcactgttgcacctcttaaatcactgttttacctcttctaatcactgttgcacctcttctaatcactgttgtacctcttctgatcactgttgtacctctcctaatcacagttgtacctctgctaatcactgttgcacctcttaaatcactgttttacctcttctaatcactgttgcacctcttctaatcactgttgtacctcttctaatcactgttgtacctcttctaatcactgttgtacctcttctaatcactgttgcacctcttctaatcactgttgtacctattctaatctctgtaaggccaacaaaatttgaaaaacgggcgcgaagcgccgactgaggccgcgagcggcttaacaagctaaaaacgggcgcgaagcgcccgtttgagttcaatggatttaaaaaacgggcgcgatgcgcccgtctgaaccaacaaaatttaaataacgggcgcgaagcgcccgtatgagttcaacaaatttaaaaaacgggcgcgaagcgcccgtcttgagccaagatgtggactaaaaacccctaataattttttaaaaattcaaaaaaatctctccaaccaattcgatcaatttgaatcgcttcacagcctaggtagcgaagctcaagaagcgcgaagcgctttcccaagcgccaccctcgcatgcacgcacccgctagttactatatatgttatattgacaaggagtttcgttgctaaaaccattttctcccggccgaaggccgggagcgccctgaaagtggtggaagggtcttacaactttttgaggagcatccgggaaaaatataggttttccggtccaagggccaactgagtaccagggactgatttctcattttttcgtgcgtttgacggcccctaactttttctgtaaaactcgaatcaaaaactttccgctggtaggaacctaagttgaagtgttgtctaaaagtcaaaaaaaattccaggcctctacctatagtaggaagggctgcagaaaataggagaaattcagtatcaactttgtccacttcagtcccaggtgaataccgcgtcagcgtttgatctgagcgagggggctccagcggacttattgtagagctttgaaagctcgattttttaaattttaaaatttcgaaaattttcaaaatttttcgagttaggcctaaaaaacggttttcgggtttttgaattttaggattttttaacgatttttcccagagaaacggagaccacttccaaaacatagtttttcgagctctatcgactggtatttttttcggaaaaattttgattttttcctggaaatagaaaaaaattttggcctgagcgggacatttgagtcctgggcccataactcgtcaggagttgatcttatccaaaaattgccttagagcaaaattgtagagctttttaagctctatcgaacggtgtactacatgatgtaaaattttcaaaaattttcgagctaggcccccttgaaattttcggaaatgttttttcggacgaaaatgggggtgaaaaatatttttctggggtaaaataaggtgctgagtacgaatataatgtctattttaagtttcagaatttttggaattttttaaaaattttttattttttggcaattttttggcccttgggattttgggttaaattttgaaaattcattgctcagtgaaggtttggtcaatttaagggaattaaagctctaaaaatagagaaaaatcaggagaattttatgggatttaattgaaatttatatcttcaaatgaaaaaaagttattcaagaatttctggaaaaatccgaattttcagaaaaaaattcctaactaccttctgaaaagtcattttgtaaaaataatatacaacaaaaatccgcaatttatcaatattacacataaatattattttatctttttaacgctatattgaaaaaagttatagaaataaaattgatttagggaatcgaggacaaaggggtgagtataggaattgtgagagaacaattttattaatcaataataatacaataacaattatttagggatcattcggaccagagatctagtatgagagatcacatttttaaggtgtcaaaattagatcgtcaagaaaagaagcgtgattgtagtttttgagacatattatcggggggggggtcgacaggttagattctcgcacaggaataaaagatcatatgatacaattatatgactataaagatcaacacgattataaagaaaatatgacat

SEQ ID NO: 2619 - DNA, 2614 bp, Heterodera glycines
  misc_feature (2601)..(2601): n is a, c, g, or t
atacgaaaaaaattctagaaaaattcaaaaaaaaatttctatcaaggaaattttaaaaaattttcaagttttttgggttttttccggaaattcagcaaatttagtttttattaacacttagattttccaaaagctaaaatacttttgttttcttgaaatttaaaaaaatttttaattttttttttgcggcgacgttttggggtgtacccggaagcaggtccataactaatcgtaagactatattttagataagaatttggtctcgctaagaattgacttaaaatttttcaaaaatataccctaaacttgactttttcaataatttgtcaaaaattattgttttacataattttttaaggcctaaaccacctatttttttgcagtttttagtcctaaagagagcgctacccaaagctaatttgtaagtagcaattgaaagaaaaccatttcaacaataatattcccccttttttacaatttcaacaaaagacaatcttttattacaagtaacacattttattttcaaaaagttgaatttcaaaaatatttaagaaattaggaaacttttcgagaaatggtttttgtatttgcgtcccctttttaggagcttttatgtgcagaaaatttggacgaacttttgagcagtgagaagcaaaagccgaccaacgaggacgacgacgagtcggccccgccgtggcgcttcgggccggcccaaatgtggtacgaccgttttggggtgccggcgaacccgtcgaatttcgactacggactgaagaggcggggcacggtttgccccccccacgccccattcattggtttgccgttttcattgttaaggcgctgtcgaaacgttcaacggacgacggcactatgccattgccaagcgaaggtaaccgaaccattgccagctcgctgctcaaattccatggcctttttcagatgaccgcaactttttgccagtgcatttcttacattgggaggacgacataatcattgaccctgaacaggcgcgggaaaaggtacagaaaatggggggggggaaggaaatcccacgaacatccgctcaatttgttcagctggtgaaggaactctcttcggttaaactgccgcgttgcggatggattccgacgccgtacacgcgcagttacaaagcatttatcgcggcatgtacgatttgacacagaaattcactggcaactaatagtcatataagaaaaataataattactaggtcgttgcataaaaaagggcgctttttcaaaatgactttttttaagacttgattaacgtttgttatgtcttttttgtgtgtaattcttttatctgaatgttctcgtcatgtttttgccaaaaattttgattttgtccttttatatctaaagttacagtccaaaaaattgggtaaggtcaacaaaatttggctaccattttacaccaacgtccataacttgagttaaaattgtcaaaacgacttaaaacttggtcagattatgaaatttgatgagcttaacaagaaaaagcctgaaagaaatttttctgaaaaagaaaaaacaaaattttttggccatgtttattttggccaagtttccaaatctattggccaaaccgaaagtcaaaaacaaaatccaaaataattccatcggggttttgaggctttttatgcccttaaataatataaaaaattacagaatcgcacaagtttccaaaattgtgttatgggcgattattcgaatttctgaaaacgaaggccaaggagaaaacacttgtctttggacaaaggatttttcttatattttttgaacacatgcaaaattattccagcatagtttatccgtaggaaatccttgttttaaatccttttttaaaattttaaacaacttccctaaagccttttttggccatttttcaaaaagtgggaaaatttgggattttttggccataacttttttaaaaattgtttgagtgcattaaaattgacgccattcaattcatctcgttattctgcatcagatgatattaaatttattagaatttgttacacttttaataaagttacactcaattttctggttatggccaagtccctaattttggcaccaaatttcattggcccatggctgacaggagaacaacttataggacatgctacgtcacccgtcttattccctggaccctatagacttaatttatggctaaattatttctctcaaaaattccttatagggtaggctctttaaagaatatggcaaggtcgtggatccagtgaaaattacctaggttcaaagaatggcacagaattttacaaaaagggcattgttaaactcccatctcggcggcaaaaggttgtagacagtcagggcaattactttgttaagtagctttttgatcggctttgttatgattgttatttttcattttttgttcataaatttttttccttcaaaaagcgcccttttttatgcaacgacctagtaattagacataaatgttttaaaaataccggaaaatgtcagacaattgcacccaatgggcaccgaccatttggacggccaagaagacgatgcacaacagcaaatcgatgcctaggtaaagcatggcggnctggaaaatgaaa

SEQ ID NO: 2620 - DNA, 1685 bp, Heterodera glycines
aaaagcgcccttttttatgcaacgacctagtaatttaggtttaactaaaaacggaaaagtccaatttgactttctattttttagatttgacttgtaacgaaacaatgccccctttggacgacggggacaccaaaacggtacgacccaaacattaaaatatttccgcttttacagaatgcattttttcttaacgaaaactcaaaattattgtcctgtgtcgagactatttgaatacgattaaacttaaaattagcaggacagtgttatgcaaatatttaaaacgcaaaagtgctatataaaagtggtcgcttttcaaaatcttccgagccccaacccgaattcgaaccaaatttatagaatgtttttattctcatttgaatggacgacgtccaactcctttttggtccttcgttttttgtctttaaatttatgtaggaatgcagacagtgagaagtcaaacagttcctatacttaacacaaaaaaacgaatcggggtaaaaacgaattggccaaaaaaaaataaaatcatttttaccctttatattatccctttttttattcaggatttgaataggacgcgtaatggcaaagcaatgaccggcaggtcatcttcggggactattgtgccaaagccttcgcctgaatttggtacgaccggctcattaaatcacatgacgaccgtccgcgacgtggtcacccgacattttaggaacagcaaagtttgcccattttccatttttaaattggttttggcttgtttttagctgaatgcttcggccgatttatctttcgtggactgttcgaaattgggcggaattttgtcttcaattggtggccgtttcgatgtcatttcgcacggcttacaaaaccaacagcagcgccacgtactgatcaccaaccaaggcaatgcattttaaaacacgcactaaaaacatgacgtcattttaaatattgtacttaattttcatgtaataaaaaaccggaatcagatggcaaacattttcagattgtaatggtttagcgcattcttccgccgatttccaccaccgttcaatggcaccgcccgcccattcgtcggctgaggaggcgtggcgtcacccgcacctttcgccctcctcgacgtcgtcgtccacatcgactccaccttcctccaccgcaccttctggcaatttcgtcgtcaccaaacacaaccatttggacatcagcaccaaaagtggccattatcctccctccgcttccaattcactgctgtccaatttaactccgtcctcctcctcttcgtctcttctccactccatcaacaagtcaaacaacaccaccgctaattactttgtgaagaccgtgccgattgacggaggaacaacatctgcggcgttcattccaccgccgctttctaccggcgcaacaattgaacaacaacagcagcagcaaatcgtacaacccgggtcacaaaatgcatttttccaacagcaacagtcacaatgggccatttatccgccagttgaacattccgtccaacaacagcgacaacacttggtaatacttgccaatgccatttggcttcttagttaatattaaacaaaccaatgaaaattatacaattagcacttttattgcttaaatttcagtaactaacaataagagcagacttcgttgtgatttaattttataattaattccgttgt

SEQ ID NO: 2621 - DNA, 1338 bp, Heterodera glycines
aaaagcagcataataatgacgagcacagaatccccgcaccaacaacagttccttcggttgccattgttttgcaacaacaaccgccttcggcaccaatcagcccacaaaagcagcaacaacaacagcacacgagcccaaggccgggaatattgcgtaagtaagacaacgcaatttgtgcaaatgtaatttcaaaaggtggcaatgcgtcggcagtgcgtcgtctcactgtcgatcgcgaccgtcccgcgtcagtttcgggttcgttcataaacaattcggaggaatcccctcggaaacgtcggaagcagcactttgacaacagtcagcttcttggtgacaaagtgacggtaattgcaaattgaaacaatttatggggctcactgaaaatttaatgatttttctaattaaaacatttctcttatgttacattaattgtaagtcgtatataattttaggtcgagatgagacccaatgaccgtcttggacagtcggcttctgctgggcctttgctggcgggctgttggaggaattcgagcagttcagtgacaaccgaaggcggtgttgcaacgcaacagtcagaatatataatttttcaatgcttttccgtgccaactttctgtctttacttaggggaacctttacggccgacccattggcacgtgttggcgcggcaatcagtgggaaaaaagccgtcagcggtgttccaattgagggaaaacagcagccgaagaagcgcggccgaccgaaaacgaattgtcaaacgcaacaattgccgttggtgtcggcaaatgcgacgacaaaaagtgtgcaacagaagcagaaaaacaaccaacgaactgaacaacgagcggtggacatcgccaaaaatcaaccaaaacatcacaaattggcattagggaaccatttgacgttgacaacactcaacgaaagtgcaaaaacgtcaaagtcaaaacagatcatcactgtccaagtcgagcacatcacagaggtatttgaagtgagattggaaaggcacaccaaagcaaaaaaaaaacatttaagacggagcaaaagaagcgcaaataccaaaagaggacaccgaacattgacccattgaccggagcgaggaaagtgcgaaaaaagggcagtggacgaaagtcaaagaaagaattggctgcgaaagcggcaaatggcgggggagtttttggcactgacgggcgatgggtgctgacggaggcacaaccagccaaaagcgatgccaattccatcccaaatcataagatggaggaatttgataacagccatcagccgagccaaaatgaagcacccgaactgatgtctgaaacggctgcggaaagg

SEQ ID NO: 2622 - DNA, 1292 bp, Heterodera glycines
cgttttgcgcccgcttttacggcgttgcgagcgcggactgaatagtacggacaattgccatttgggcgagtcatacgaagaggttttagtgaattggcacttgcgaatgcatttaattttacattctctacttttcagatatgcaattttttgcgctcatccaatcggcaaccagtgatggacagtagtgaaagtgcggttcgtgcacccagaaatcggtcttacaatccgcaacatttgacggtaccgaaacatttggacgaacggtgcgtcgaccgattgagtgccgacattttctgctcgcttttcaacagttacgacgaggtatgctgtcaaaacactattaatgaatttgccatttttccattcgtcgcccattttcagtttaaaaagaccacaaattcgatgcgtttgctgcccgtcgcctgcgcttatttcgacgcctcccaacgccttctctcctctcttcgcacttcacttcgaggcttttcactttatcacgctctgcaaaagtcagatcagccaactatcaaagagaaaaatatggtaaaacacaaacaaatgacaattttatcaaaattatttgcattattatacaatatataattataatatttataaaatcgataaaaatgaccaattacaggatgaaattttggtggaggagagcgaccgttggttctttggagacggtttggtgggcattgaggaggccgaaacggaatgggacgacgacgccgagggcgagagggaagagcggctgagccgtgccttttttgccaaattggacaaagaataccaaaacatcgtcagacgacagtgttgggacgacgatgaacaaaacgaggcgaagggggacaattttcaaccaaaaatggcgcaccaattactcctccaacttgacgttgcccaaacattggatttagtgttgcacaatgttgagaatgacaggtccggctgcagaaacccttaccacgcattggttattctcacattttgtttaagcagtccaatttcgatgcatcgatttcattccgaccattcccagcggagttacgcattgccatccgaaccctctgatacgacggactcattcagaggtcacaacgaaactctatcactcggtgactaccaaattgacaagaggaacttgccagacgatttgagtgaaattttgtggacaaaacggaagattgacagaacattaaacggaggaaaaaaacgaaaaagaagcgagacggaagtggacgaagataagaaagaagaggaagaagaaaaggagcaaaaaaaga

SEQ ID NO: 2623 - DNA, 2878 bp, Heterodera glycines
cgtccgagtatgtgcaatttggtggatacaacatttatcgggggttgccctatcagcgtggagcgggagttggcgcagtgttcagaagtcttatgagatacttgctgccgattggaaagcaaattggctccgcaattggacgtcagggaatggaaagcggaaatcgagtactcaccaatgtgctagagggaaaagacctcaaagagtctctcgttagtgagagtaaggcaggactaaagaatcttctcgaaaaagcagccaacaacataaacactcagaagggtcaaggttttgattttaagcgatacaaaaaagactcggctcccaaaattggaaaaataaggcgaaaaaatataaataaacttcaatcgtcagtcgggccaccaatggttgtaaagaccaaaaataaacgtctgcgtgttgactcactaggaacttactaaaaatgacttgcccacaaaaaatcagcgacagcagtcctctagcaattaacagtggcctaaacattttctcagttccaccgaccaatgtgtccgctgttcgctcattctttcgtcaggtgcttccactcgcaacaataacgcaagaatcgccttatctatttcgtctttacagtgacaatttgtggactgatttgtctcgggtttatctttatctcgaagtgtccattgaaaaaccaggagcaaacgataaatgggttgcgatagaggacggggatactcatgtctctgccattcaagggattggtcaaacatttgtccagcaactaaaagttacggttggcaacacggaagtatacgatagcggaaacctatacccattcaaggcctatatcaccaatgagttaagctttccaataaatgtcaagaaaaattttcttggttcaacagggtattatcacaccgtaaatcaagatgattcatcagacgatgggtataaagagcgttgtaaaatttttaagggtggtaaaaatgcgcaattcctctcccgtctcgactttgatttgggaaaccaagagctttatctcttaaataatttggacttgctcttcacaatttacaaggccaaagatgtctttcttttgcaaacattaaaagcaaatgattccaccaaatatcgtttgacagttcacgatgtcaagatttatgccaaaatggttgaggttcaaccctcactaaacatgagcctttacaaaacccttgaaaaacaacccgccacatacgcagtacgcaagaccgaaatcaagtcgtcattcatcagtgttggtcgatacgaatttgagtacaatgtattcagtgcaaccattcctcgacgtgtgacaatagcgttggttggaaattcagcatttcatggtgactacaaactgagtcccttcatgtttgagccgtttgatttgcgtgagatttcggtacatgctggtggcgtagtttacccagctgttccttataaactaaatttttcaaatgatcactttgtcagcgcctttgttgacatgtatgaggcactcggaatggctaactcggaacgttcatttgacatttcaatgacccagttcaaaaaagggtggaccttttttgtcattccattgacttccacgcttgacgacagctgtggatttgagctgttgagaaacggtacgacaaacgtacgagcaacattcaattcaccaattccgcttggtggtgtagagatgattgtcttgggtgaattcgaccaaatgattatggttgattataaccggcacattgtgaccgactcaaagcttggataaaatataaataaataaaaatattattatgtaatgttaaaatgaataacaccaacacaacaaaacctgacatacaaattttgaattccccagaagagcctaatgaaactcttttgcatgtactgcttttttctcattatcttcttgcatttcctgtgtttttgcttttttggttcgttttaattcggtggcttaaaagtcacggtcacctctcgcccagcgaggccgagacagtaatggaagagatgaaaaatatccctcgacaaccaccaatatttttcgcaacaaaatgatgcaaaattagagaaaactgacaatgaaatctctcttcagtatgacaaaatcgaaaaagactcaagaggatttgctcttgaattggtggcgtgaagacccgacaattgtaagcttgtttttttttcaatttagcattttttaaatttcatcacattttttcagattcgtttctttttggacaccgtcgaatcgaagccgcgcttcttcagcgcgccgaacgcgaggccgaaattttgcgccaatacgcagagaatcagcaatgaaaagggaggaccaatcagttatcattttcgtatgtttttttttcatttatgcaatttaaattatgattaaaaaaaatttaacgtttagcaaagtacagaactgggggggggggggaactcgcatagcccttgtccgattgacttcaaatttcacagtctgtcaatccacccatccctaagctgaacggcgaaagaatttcgcctcaggcaccatttcaagcagtactgtcccgacgccccgccccctcgcgcacaccgagactcgcgcaccaaaactcgctcaccccttgtacgattgacttcaaatttaacaggcaatcattccaccactccttaagccgaacggcggggtgagggggtccgcgccgtcggagagagggggtccgcggctatggtgagagggggaccgcgccgacgaatggtggggaggggtccgcggcagtggagagagggggtccttggaagagagggggtccgcgccgactgacgacggaatggtggggaggggtccgtggcagtagagagaggggtccgcgccgacggacggcggaat

SEQ ID NO: 2624 - DNA, 3831 bp, Heterodera glycines
  misc_feature (74)..(74): n is a, c, g, or t
  misc_feature (91)..(91): n is a, c, g, or t
  misc_feature (97)..(97): n is a, c, g, or t
  misc_feature (104)..(106): n is a, c, g, or t
cctcccgttccttcggtcgccgtctggcttccgcgccttccatccgccttctcgggttccgtcccgcgcgccgncgctcccgcgcctttcncccccncggcccnnnatctcgcgcaacccccttcccacacccccaaatcccgaccccacaccatcccgcgcacctaccaccatcccgaacccacatctcccgacgcatccccccaccccattcccgtcagagacgcagacacaaccacctaataggcacggacccgcccgctcatcctctctgcgctcagcggagaaaatcaatcgataattcaagtggtcttaccatgtagtcccatttcttatagtgattagaagaagaaaacgtcataacaaacttctggctcgggaaaactcgcatgggaggcatttatccttgatcagaaggcaggaaatttattaaaaaacaagtacaaataattaaattaaggcttcagatatgtgactgagaaaaaaagaatcgatggaagttctctaagagggactgtcgtgcacgcgtgattagattacttcgattccttaaactctgattattttccaatataattagctcaaacatttatcagctcgaattgttgaatatttaaaatattagcattaaattcagttgtggaaagtaatgattttttttcgattggcttattattttaattcatctttcatattcaggaaaagaatcccgactactttccatataaaaggcgtaagatgaatgttatcgaaaaacctaaatcccggactattaaaaaaactaccacataggaaaaaatggaattctaattttttgattcctcttttttaatgatcacttcgacggagagaaaccccgattctttaactttatagtgcaaatctctattaatatgaataatggtatattttttaaatgctagcaaaaataattaatttaaaaagtcgctgaatactgtttcatttggatgtttttgtatgacgcctttacccaaagaatcccgacaattttccattataatacatataacagtatatagtgatggaaaaaagaaggctctagtacagtttatgcgtccaatggttttttatgcgtccaataaaactaattgaatttcttgagaattttaaccactaaatttcaccttaactcctaaattgtcagctgacatttttctctccattcgtcggcattgagaggtgttagctgagaaacttgagcaaagcgatagcaaatactcttcccccattgaattatcgcgtttattttgtagatcctcaagaccggcaagtccatacgcaaggcattgaggccacttggggtgctctcaaaacgtctcttcggcatttacgtggctccaatgaggaaatgttgccgacatatttgtttcaatatatgttcagacgatatcatggaaacacaaaaatatttcaaaatattttggaggaaatgagacgcaattatcccgtgtaattcaaaaagaaggatttgacgaaatttgattgtgaaataattcaattagttttattggacgcataaaaaaccattggacgcataaactgtactagagcccaattccgaagccaagttgtgaaggcgcaagtgaatcgaacaccgaaagccaacaatcggcggagatgaagctgaaaaaaagggaaaaaagcattgagtgagtcattggcttagggacagatttaagaattgaacgaaaacattccaacgggggacggattctcttttttgggagtttgaatttggaaaacgaaacagggtgacatgacttaattaatccgtttgacagtgcctcttggcacagtgtgcaatttgggatatatttttattttggcaaatgctgggccgaccggtgacgcctaagagataaattgtaccgtacccgacccgatgatttttcggccgacacgaaatttttttggacccgcggcaaccctgcaatatacctatcggtattcctgaaaaggggtttggtactgagatgggatcttacagtatgtatatgaaggaaaacgtcggcgttcaacggcatcccaaaaacaatccttttattttccaaaaacaaatttgttatgaatttggcattttttaaagctctaaagattaaaaaacaaaaaaaaaagaagttttacgagtccaataaaaaggagcaatttttatgagcacgtcaataattccataattcaaattgatcgatcactttctccacaattcattcattctttcacttcttctgctgatcacttgggccgggagttgtgtcgagaagtctttaaaaaacggactttgtactaaaaatcagacactcaaaaatctttgaaatgtcctcgattttcgcatttcgaaccaaaaaatgaattagggtaacaaaagcgagtttgtccaaaaagagttgggtgttgtcccactttgactacaaaagggatgtgtacagtatgcaaaaaggaaaagcattgagtgagtcattggcttagggacagatttaagaaatgaaggaaaatatttcaacgggaagattctcttttttggggaatttgatttggaaaatgaaacaggatgacgtgacttatttgcttaattcgtttgacacgagatattaaactttttggtaggcaatgttgctatcaaataataccaaaaatctgaatagcgccgaaaaacagcgtaagacaacgtttttcataagtaaaagtgccatttgttgcgaataggaactgtcggaaacactaaattacccttattagggggcttaacaaagattattatgttgatcattccaacaaaaaaaagagaacaatttttatgatcataggtcaaaatagcatcaaaataattcaattagatcaaattgatcaccgcaacaaaaagaacaattttctgactcaaattcattatccaacggcgcaatttcaaattgatcgatcccttctcaacaattcattcattcacttttgctgctgatcacttgggccgggaatttcgtcgagaagcctaaaaatcgaacaaataaatttaatttttgaaaaagcattcgctgaccctttgcagatgtaatcatccttattaatttcaatgtgaaggttacactgattataaattcgcaaatcaatcgcttccttctcccattttgtccatttgctttcgtctcgcacaattggacaacggacgaacagaaaacgatggctattgttaatctttttcagcgtcaattgttctcgagttaattcgttggtcagcacaaatggcacaatagaagcagcaaaagacgaaggaaaccaaacggaaatgatgaaattggcaggagatgaagccgaggcaaaagcctgaaatattgaaaaattgagaaagaaaatgatcaatgaaatattaaatcaattagtaagcaccgctttgaatgcttcaatattcggcgccaaatgccagctaccgaagttcaaccagcatttgaacacctttggcacatcgtcaggacgaggagtgaaaagccatttggccaccgcttgtccttccgatgccgcggcactgtcatcgcatgggaattcggtgaagaactcattagaataggaattgacaacgcgaagcgacggacaatcattgagaattgaggggacgaattgacgcaaacggtggaaaaatctggcggacaatcgcaagccatgaatgttttttccgaacattggccaaatgttgtgaaaaatgaaatccgaaatgcgatcattcgccgttcggatggccaaattaatggggcatttggcgaaaagttggcgaaaacggttgataaaagtgatggcattttggtcgatgaaactgaaaagaaa

SEQ ID NO: 2625 - DNA, 1359 bp, Heterodera glycines
  misc_feature (9)..(9): n is a, c, g, or t
  misc_feature (53)..(53): n is a, c, g, or t
aaagtatanttgtcaaaaaatttaaatcccaaatttatgaaaaaaccacgttnttggcaaaaaaatgtgactctcatttttttagtcctttttatataatcactgaacttagacatctccgttcatttttcaatataattaagccaatgacttatttgctctgatgctaatgaatcccgaaatattttccactataaaagcataagaaataattaggtcgaaaacccaaaattccgactttcttaaaaaatcaacatataagcaaaaaatgggattctcgttttttaaactcctcttttatgattacttcgatttcgtaaactccgattatttaaaaaatattcttacctgaaatattgatcagctcgaattgccgaatatttataaaatgttagtaataaactcaattgacaaaattggtgcttttctttttcaaaacctaagaatgaccctaaataattttaaaaaatatacaatcctaagaaatgaaaaattttctcaaaaagtctacaaaatctagttctttgtttgactggttttaagaatagtagtatatctcaatactactttggctttattttgttacttttttgaatagattttgtcatagtgcctattttccatttcttttcacttatttgttaggctcaccacggacgaaaatggcatatattattatgatttgagcatccgaggatgaaaattcagaattggcatgcaatgcatgataattatagagattcgtcgcaattatgaaaattccgacgaattgcggaggttcgaatccgttgggctacataaatatttttatttattttgtacaaaaattagaaaaagacgtttttgaaaattattttgaaggtttttccaaccaaattagacaaacttggtttcattcgaaagctcttggaatgaagaagctttttctaagcaaatgctaattgtaagcagttcgatgagtttgaaaaaattgtttgaaattttgttttttgtttaatttttcgctaaccactttttttgctcataaaaacccttagattttgttcgtaattttcttcttgaagcggttttacaagcagaaaaaagttaaacaagatgaagtaaattcgtttttctctattagcagagataaagaaatagtaagcccaaatgagagatgtttttttctctgcactctctatttattagtaactcatttttcggacggtgtgtctatctctttcccttttctccatctatgtcattttctttctcttcccccttttctcaatctctttctgtcagtctaattgctaaaaataagaaaagatgaaaaaaagaagatgtctctttctgcaaaatgtgacacttcggtatgct

SEQ ID NO: 2626 - DNA, 5299 bp, Heterodera glycines
  misc_feature (47)..(47): n is a, c, g, or t
  misc_feature (2702)..(2702): n is a, c, g, or t
tgacataatggaaaaattgcgaaatcgaaggcatttcaaaagattantggaatccatcaaaaatgggtgaagcagcgacctttttgcttttcacaccttttttttttgctgtgcaaaacttctggggaacggaggagtccggtggtgttgaagagttcaccgggaaaatttttgtggaaaatcaaaactataaaaaattatttcgacagaaccacgcaaaaaaaaaaattttttttttatatttttgatgaaaattttatatataagctcatcttttttacttttactggcaaaaagccgacttcaaagggcgcctttgaaaaaaggacccttaaaattttcaaaggaacggaaagcgaaaaaaggacaggacgtgttcagtaaaaaaaataaagttggattgaacccttctgtattaaatgattaattgctcgagaccgagattcaattaaagtctaatggctgtgatatcatatcccttttatagaaacttaataggctcccaaaaaaaagctaaattttttacattaaaatacagcaattgcttgtgcactgcccacactttaatacggtatgtgttactgtcggtgcactggcgcgcttcactgttgaacacaaccatagttgaccgtttggtgtacgttttgaaattatatttgtcattttcatcattcattggccagtttttgtccgaatttgtcggtcctgttttgccatcaaccatctgttggtgttgctgattttcaactgttttttcctcacagtacacttggatactgtaaaagtgctcactgttactgtccatttctggactgatggtcagatagaaatggttcccgaacaaaactcgatgattcaacaggttgttttcaatttcactgttatatgatgttggctgaaaataaaaataatttaagaattcataatttttaaataatattatttctttttcttttgctattattttctatgaaaaatctgttaagaaattgttaaaggaaaattgttttttttttatgaaaaatttcatttccttctaggcacccatttcaaggctttcttcactcaaatttcccaaagattttgttaatttttccgatgagaaaaattgttaaaaagtggtcaaattccatacaaaatttttctgaaaattatagatttttacgggtatctgtaccgtttttccagtacggtcagtatcagtaccggttaaagtgaaagttgccggtaccgctttactctaatatagactatttcaatgttctattttattttgttcattacatttaaaaatataactattaatgctaacccatgaaacccaatgttggtcttctttcagttttaaccaaatgtgaatgttgtacgcaacacattgctgtgtgtcattaaactctaatttggcaacttcatcaaagacatgccgccaattattcttggccgttggaagttgaattccttttgagcaaccattttctgtgtaaattagtccccttttgccagtacagtaggccagcatatggtaggtgtgtgcatcgtcttcaaccaggcttgggataattttcaccgttaattcattttttcttatttttgagttggccatttgtgtacaattcttggcaattagcagcataataattttaataatcaaaaattttgcttccattccttttaaaataaattaaatttctttttttttaataataaaattagaaagattattgtataataaaaattgaaagaatcatttttaattgaaaaattcttttaggctgacaaatcttccctggataaatcaatgaagctgattacataagccatcatcattaattggatttatttgtttacattaggttgtaataatcttgaattttatatttttttataagcatgtaaaaacgagccttaaaaaatcttttaggctgaaaaatcttcattggataaattaatgaaactgatcacacaatccatcattaattggaattatttgtttacaattatgttgtataatgtttggtttattttataaaaaattttcttataaaaaccagccggctcgcccgttggtggctgcgcaggtgaacagccggggctagacgttcgggaacaggcgcatcgctacggcatagacagttgcttgcggttaaaatatgcaaataaaaagacatcctagaagcatcaaaccaagctaaaaatactatttaaaggtttggtttttatctatatcccatatttacatatatattttttgcatttttatacacccttaacgatggaaaaaaagttgggacttttatttacatatttcggtgttttatacatattttacatatttggtacatattttggacttttttcttacatatgtacattttttaaaaataatttgggtattttttatggtaattttggaaattctcaaaaaaatgcaaaatttcggcaatttttcatttttttattacataatttgacaatttttaaaaatttatagaaatttcttatgaaaaaaattttttttttgaaaatgtacctctaaaaataccaaaaattaattaaaaataaataaaattttatttacatattttggacttttttgtacatatttttgaatccctagtaatttgtaaaaaaaatttcctaagaaatacaaattgccaacatagcacagaaatggaaactaggaaacgtaaaacaaacactanaaatattccactgacactttttttcacggttcaaaatgtagaaaaaatcgaatggcacctgtcccatttcgctacattgaaatttttcccgcgcgtagaagttgtgaaatttttacgctgacttattttaattgaattcttttatgttctcaaaacttttattgctacttgaaaaatctactttagcaaataattgaattatttgaaaaaaaatttctataattagccggggtatgcactcgttgattttgatatatttgctcattagcttaatcgaccccactctaaaggaagccgacgacgagcgtgacccttgagccatcaaattaagacttgtgggcaccgcgtaatgaaagggtcaattacataatcgaattaacagccgatggacggacgaatggacgacgacacgcagttaatttttgagataaattttgatgcaatccgattttgtcatctaaatttaaagcgaaaaatttattctcaaatttttactttaaaatttttaaaatttcaattaaatatttaaatgttcgctataaagtgaatgaaaatttaattttagtcaaactatttaactaaaaatgatttggtataaaatgcaaaatggaataattttcatttaaataatatttttaatttttcatctaaaataagcaattataaaaatgtttctattgccgtttctgttttgtttctgctcattgtcagcccattttgtgtttactcatgcgcaaaaacgaggggaatggtcattaaaagaacaaaaggtaattaattaatttattcatctcattaattatttcattacgccaaatcagaaattttggcaccattttcaactgaaaaaagagaagcatttgttgccgacaaaatcgctaattaatgacggcgaccaacaattaacagcacaaaatgggagcaatgtggagaagaaggctgcaccaatattttcgcctgaagatgcttattggtgggaaaatatataagctattgtgtctagaaatcataaaattctatcaacatttcttctttatgtcgtattttataatatatttcgcaattttaaatgctaaattaatttaaacatttttgattattttaattaaaattttttattcaaaaaataataattaagtgaatcatttaacattgatattcatccggacgattatccatctgcgcggagaaatgagtcagttgttgagcgtatttgtggacaaaaggtgtgcaataaattttaatagcaaattcacaaaaatagtatatattcacaaattcaaaaacaaaatttaatatttcaaatattctaagtgaaaaattattgataataatgcgatttattgaaaacagaaattaaaccagaagaaactgataaattttaaatttctccaatgcaatttccagtaattgtttatctttgtgtcaaatatatactaattagaaaaagtacagtaaattttactatatctaccgtaggttatggacccataccgttggatggaggacccggaccggccagaaacaaaacaatttgtcgcggagatgaatgatttgtcacgtccatttctggaaaaggcattcttccgtgcacaattccgcaacaagttggtgatggtgcaaattgccaaagcgatgaaattttgatcaaaaattggccaaaaaaaattgtgggggtggttaggcttttccattatgacaggatgaagcagctgttcgaccaaaaggcgtacggatgcatcaccaaacatggcgactattattattatgcgtacagtgagggcactcaaaaacaaaggcaatttttattaaaaagaaatcattaatcggttcttaatatttgagaaaatttttaacatatattaaattaatcatttattggggttttcttggccccaaatacattaaaggagaaatgaatgttttctaataatcatggattgtgatggtcagatattgagatgagagttaaacaaattatataccaaaaaattcagtgccatttatcgccagcggacattgtcgggtgaaaaggaattgtttttggaccccaaccaattctcgccggacggaacagcggcaattgtgcaaagcgcgttcacccgggatggccaaattatggcgtacaccgtggccgaaaagggcagcgatttgagcacaatacgggcaagaaaattaaaaaaaattatgcaattttagtattaaaatcgaacggtagttatttttgatgagagaacacaaatcgaaaatttataaaatccttgtctgatttggtacatctcttttaattggagaaagctttttgtctttaaaaacattgacttatgataaataaaaaattctaatagaaaagttaataatttcgaatttaaatttgttttacaaaaataatataaaatatcaaaaataatatttaaatttataaatattttcttcataatttagttccgtggtgtaaaaggcaatgacttgccggacaaaattcgaaatgtgaagcaaagttcgctggcatggatgcccaataacaaaggcattttctactcggtaaatacaaattataataataaaaattaaattttcgtattattatattattt

SEQ ID NO: 2627 - DNA, 2727 bp, Heterodera glycines
aaaaaaggaaataaaatacaaattttggaattaattactgtaatgtcccatttttcaatttattaatttatgtcggcaattaaaacaaaaaaagagatcgcacatacaaaatgttaattaattaattttaaattagcttaataagaaataaaacaaataggggaaaatgcctttcacgaattaaaattggtagaaatacgattcgtttatggccaattcatttttacaccgattattttttatgtgttatatgtataggaactgtctgactacgcgctgtatgcactccaacataaatataaaaacaaaaaaaaagaaatggccaagaacgaatagggttcattaaaacagaataaattgatattttttcatcaaaaaaaagttctggttctgtgtcgcgtgatggtcgctttttgttcgtgtacgtctacgacaaggacagtgccaataccgtgtactatttggatttgaaagcaattgacaacaaaattcaacgaaagccggcactgtcgttgcttatccatgatacgcgggcatttttcattgtaagcatattaaaaaaattaattcttgtacaatatcggttgaaacaatttttagtctcacctaaatctttatattgaaatatttttggcaaattgcccaattttatcatttaaattttctttcgcctattttgataaattaaaaattttaattaatttcaaagtaattaatcgttatttttaatatttgtttattggtcttttcgaaaattattatttttttttttgcaggactttaatctttgatttatgtccgtatattattggtttttctttttctgctattttaaatttatttttttttttggcgggggacaaaatctttgtagaacacaaaattataatttaaaatttttatgttgcaaagatttatgcataataaatattttatttatttttttaaccttaatttttggaaattaaattttttgtctacaaaaccatttgtacagtcctttaattatttttttacctcgcaaaaattctatgtacattaattatttttgattaagattcttgactacgaccatgaatcagaatcggcattgggtaaacaaaaaaataaatgaataaaattcttttttcgaaaaatttatttttattcgatgtagtattgactgatcacaccgcgcccaatcgaaaactgatcagaattggtatgtcaaccgcaattttgggctgtgcccactgggacacagtgatcgcggaagatcccgagaggacattggactcggtggtgccggttgctggcgacaaattgcttgttgtgtacattgaggatgtgaaggtggcaaaattttggccaatttgagccctttaaagggggggggggataaatttaaaatatatatcccttttttaaatttaaatatattcatttaaatttgtacaaaattccactaaatatatcacattaatatgcactattattattatttttttcttcgattaatagataattaattatagaacaatttagacatatctttatgttcatcattatgcgactggaaaactaatttacaggtactgaaaacaaaaaagccgtacatttcaaattggttagtcatcgttaggatttcgggattaaaattattattattttttttacttggatactgatcatgaattaaaaaggtcttcttttattatcacgagggtgcggattttttgtaaatgaattaaatttaatattaaaaaaaagatttttcataatttttgatgaatttaaatttaattttaagaattccattgggcattggcactgtcagccaatgctatggcgatcgagatgatgtggaggcatttttcagcttcaactcatttttggagccacccacttttttccgtgctgatttttcactcgtcgagaaaacatcaatgcttcaattggaacaggcaaaaccaaaaaaaacagctatttaaattaatttaaatattttatttttggttcaaattcggttacatgttactctgtgcaaaaacagaatgaaatggcttttatataaaatttcaaaatggcggatggtgccacaatagtcaaatttgttaaaaagatacgacacagtgacgaatggcgtggcgtcaatttgaccggcgttacagtaagccaggagtttttccacagtcgcgacggtacaaaggtattaaattgtcatttaaataattcgtctgattttgagtttaccatgatttcgaacatctaaataggtaaaaaatccaaaataaaaagtgacctagaaatttcgtcataatagccaaaaacaggcaaaaatagtcattataaaaagtcatcttaggcgaatcatgcttttttcgtgccaaactaaaaacggcgcgctaattattttaatttttggttcaaattcacacatttttaaaggtgccggttttcattataagtcggaatgatacaaaacgcgatggttcaaacccggcacttctttacggttatggtggcttcaagtcagtttatcttgggatttcaatttcccatcatggaaataaattattaaattaagcattccgttgttacccagttattcttcacaccgcaatattttcgtaaaagtaataaaagaaattatttattatttcaaaaatagtcgttcgagtagcgttttatttttggaatcttaatgtgaaaatatttcatcatttaattggtttataattatttttt

SEQ ID NO: 2628 - DNA, 7654 bp, Heterodera glycines
attgacaaacaaaaaagttattggccaaaaaacctcaaaacactgactttttctggccattttggcgccgcacgctatatcttttgtcaaacagaatttatttttttaatattttcaggctaataaagaacacttaggcctatttaatggtatcaaaattattttatttggttggacaagaaaaaagttataacactttaaagttcgcggcgccaaaatggcccgcgccaaagtgaccccgacccaaatataactgcttagagccgctatcttcctaaaaaaaaattcatagaaatttttattaattaaagtttttaagaaaattcagtttctaaaagagtctatctcggttagactacgttttttggtcgattattcaaaatgcaagaacattcttggtttctatagcaatacatgaaatgtaagttgaaaaaaggaaattgcagcctttaaaaagagaagcattttcccttaattttccttgacttttgtcgccgctgtaaaccctataattagcaacaacaaaaaaaatatcggccataaattttaaggttagccatccaaggtggctccaacggtgggcttttagttgccgcatgctcacaacagaggccagaactttttggtgccgtgatcaaccaagttgggtaatatattcaaaaatacaattaatttcccatttaaaataaataacaataattttaaattcattttattgctaattttaattttattcaaacataaaaatgattatttgttaatgatagttaatatgattcatttgttagggtgatggacatgctccgattccacaagtttactgtgggcagttattggatgaacgaatacggtgacccggagaagccggaggaatttgaatacatttacaagtaattgttatttatgaaaaataataaaaaataatttacatttttaaagatattcaccattgcacaacatacgattgtctcgtggcactcaatggcccgcaacactgcttatgtgttttattaaaaaacttaaatttttctttaaaaaatataaatgattaattagggcatgtaattttataggcacgaaaaaattaaaaaaaggcattgaaaaagtaaaaaacatgcacataagttttataaaattggggtaaaatttcacaaaatttcgtcaatttcgttaaacttaagctagagatcccgtgaatcgctaaataaggtgtcacaaatcctttttgaagaaaaaaaaataccaaataaagctaaattcattaattttgaagaaaataataaaaaaaatcaaatttttttgaacttatttttggcataaattgaaaacatgcaaaaataatttttttgaaaaattttcttgtcaaaatggtcgcctctttaaaatttttctggtcaaatggcttagatgttgttctatatacattcatgcatttagaaaaaaaaaattattaaataaatttacattaactaattggaaatttactatttaattttttgctttttaatgcatttgctattaaaaatataattttattattaattattttaatttctaaaggactgccgaccatgatgaccgggtggtgccaagtcatacgctaaaatatgccgcacaactctatcattacttgaagaagccggaggtgaaattaacccaacgaaagccggtgattgtccgcgttgaaaccgacgcgggccatggggcgggcaaacccagggacaaagtggtgagaaaaattggaaaattaattaaaaaataaattagttaattaattggaataatagattgatgaactgaccgatattatgagttttctgcagagagttattcagctaaaatggtacgacgattaatttcaaatgcggtactttaattgtttttaatttattttgtgcgaataaaaattgattttaaaatcgtcgaattgtatttttgacccaattcattctaaaaaatgataaataattaaattagtttaaaaaatattacttaattggaaacataacaattaataatcgttgggtagagataaaaaaatgccaaaaatgaggcatacgatgccaaagttgacatcataagagtgccagcacagatacggtaatcaactgtggtgtactgtaaaatctgggccaaaaaattgacaaggaaaggagcgcgaaaaccaattggcaaaacgaatcgaaggctaacagccaattacacactttgtgatcctttctttaatatagaaatgaattaaatttaaaattttaaagactcacattttggtaaaagtatccaaaattaacgaaaaattgaacaaaacggagaccagtgccaatattcctggcaaaatacttttaagcaataaatcaacaaattcttcctggtatttagcagtagagagagctaatcaatgagatgccaattaaaataaaaaattcatgtttttattcattgtaaaaaaattgatgaaataaaaatttgaaataaaaaggttttgcattaatgtcacacaactttttactttccttttctccgaatgagaattgcaatttcccacaattttaaggcgcgatatttgttatacttaaaaaattttatgaaagaaaaagctttacattagatttcagatagtttatttgttcaaatattcctaaattttacgatgtcacagaaatacggggggaaatggagaaagaaagaatcacagcgaaaaattaatcagatttttgctgaaggcctgacaaaacatctttgtgttggttggccaaaacgacaagaatgtacccaaagtctcggccttcctgcacattgagacgcaaagagttgacgaatttctgatcatattcagtcagtactgcatcaccttggtttctgtaaaaaaaatgatttgataatgctttaaaactgctcgagagacggtaccaagaccgagacttggcctcaaaacacactcgagaccatgactcaacaagacgagaaccagaaacccgagactgttctcgaggcgagaataaagatcataattgcatttttttatattgttaattatttcccaactaaactttaaaattaaaaaattttgtgtgtttcgataaaacttttcttagcaagtaattttaaattataaatttatatttttcagggaacggaaatgacttttttccaattccgatttctgtcaattaatcatcaaatagttcttaagaagtttgcttatattattactttttaaataagaagcaaaaacaaatattaagctaattaccgttgcgtatttcgctccaactctgtgcggtcttcatgataaatgctaattaacttaaacgaataaatatcaattatttggaaaaacattaaaaatataacaaagataataattcaaatattataagaaaattggtataacattttttccttgattgaacgtgttgattaagggtaaagacaaattctttaacataatctgaaaagttgataaaaggttgctatatattaaattatttcaattttttattattattttaaccaattttgttatttttattgcgtccttctttatcgtgctatcattggtcaacaaacgtaattttgcaagtaaaagcataaaatcactacaagcattaactaaaaatattattatatttttttatataaatttatactattactattattataccgtatattggccgtatttggtctatcaatccatgaataaaagttttttccatttgattttcggtgttggtaatttttttgacaattttgtccagctcaacaacaagcgacggaagtgtttcaataaaaaatttattaaaccctttgtcaataattgctttttgattttcaatcttaaaattaatttttataaaatttatttaaataaatttaaaaaatatattttttattatttatttttttaaacatatttgtacttctttcttcatttgctgttctttattttcgttctccacaccactgctttcttccatcacctttgatggcaattcgtcgcccttttcatttgtcttttctggcgaatcatttcctttggcaccagcggcggactcggaaaaatttgttgcaaaaaataaaatcaaaattaaattggtaaacattttttccttttagccttaattaaacaattttttgaataaaaaaatgacttaattgattgaaattgacctttttatatgcagatttcacatgcaaccgaatgattggaaatgacgcgttgctgccatcaagacggaaattgtcatattttccatttttcctgcgaattttgttaataaatgttatattaattatgataattacaaaaaataagccaaattgccggttactggcattcggaggatggggagatcacaacggcggaggatgtggggatcacaacggcggagcagaacataacgacggcggaggatgtggggatcacaacactaaaatcacccaactccataccgaagaaaaaaatattttttcgatgccataatcgaaatattaaaaatgaatatttttctgggcttctcgaattaaggagggaggtgttgaatagggattaaatttgacttatgccagatattcgttttttatttcttattttgtgtcaactcgctccttccttcgcgcataaagtggatcattaattatttttgtatttccaatttacatcctccgacctaattgataaacgtatcttttctttgtgaatttgtcctttttcaaatttgtgcttgcctttcttttaaatacttatttaaattacatcggaggaaaagtcaagtcgaacattaaattattatccctactgcgcagctttgcaattttggcctcccagttaaaaagatttacatgtgcgactcataaacagatgctaagcctataaagctgaagtgaaacctttctttttctatgaacagagacaaagaaatagtacgtcaaaatgaaaagtctattttcatcaacattttctatttgttagttcaactttaaattttttaaaactactacttttacaaattcactcaatgtccctcatcaatatccgaggtccgtgtcttggtgtgttgcggtaaagaaattgccagcaaaaggttgtccaagttgttctttatcggcaaagtcggtgacattgaatccaaaacgaacgactaaaatggaaaacaatttaattaaattatttttagcattaaattttgaaataattttttaccagcggtggcgtttaagtattttcctgccttttgttcataagccaagaaagtgtagcggtgtgtttctataaaaatcgggtaatgattagggcatcgtcttcattaaaacaagccagttgggggtgggtatatctgaaaatatctgtatatgacttttactcatatccaccaaaatgaccgcgttacttaaaaaaataatcaaaataaaaaattttgcttatagctttgctcatctacaaccaaattcgtaatccttgatatcagggatgttgatccttttgtgtttagagttcgtatttttcgtattttcattttttactgagtttcgcgttcgggtttcgtattttggcacgaaacacgaaatttttaagcactgataagaatgggggtcttgtctggtgagagaaaagattttttgaaaaaattttcaaaaaatctacttaagtttaaaaaatttagggatatcgaataaaattaatgtttaaaatctttattattcttgagcaatattataaaaaaattttttgtcaaaaatctccatttggttgttttttaaataacgccctttttgatcatttttgagtaacaaccaaccgcaaaatatccgccagtcgcctgatctccccacaacatatcgtttcccggcacattggccacaagccaaaatgcaccattgtgcttaaatttaaaaaaagattaaataattgtgttaaataaatattatcactcacgattccgcgtcgaccattagaagcgtgtaatttatttccttttgagctggccatatcacttttggcggcttcatcgtttggttttggaacaataaatttcccaattcaaccttcacatcctttgggtattcaacgtataaaaatttcggtggtggcaatggcaaaatgtccggcacgagttttgaagttttaaatttctccgccactgttttatttttgccacctccgttcgttgggccattttgctgtcctccatcgtgttgatgctcttcactgccgtggtgatgccctccaccgccgtgatgaaattgtgagaaaatgaactttatgtgttcaccccatccttcgccgtgaatgaaaccaatttgtatattgtacgcaaaaaagagcagagtgaaaaccgcaagggcatttgttggaaaaattgccatttttatataaattgacaaaatttattcaaaattattattctaaacaggcccaagcaaagccataattaatttaattaatattagataaactgcactattaagagatgttgaataatttatgtttttttttctgaaaagacctttttatatggaaaatttgatttaaagagtttgaccaaatatttatttagcattcaaattgttagattgtttgaattttttgtctgctttgcgccatatttcataataattttaaaacatttggttcataaaaattgccagcttcaaaccttaacattcaacacaccagttaaacaaacagtagcatttttcgaaatttaaatgaaaagagaaattatgggaatgcgaattttgtcttttgtagtgtcaaaatatcattaaaaattaataaacagaactttggttcataaattttggaaaattcgaaaaaaatttaattaaatttcaaatccaaaaatcaaaaaatacctgaagttttgaaaaataaatttttaggggctggcgggatgcattaaaaggggctgatggactcaaaattctttgcggaacgggatcccgcctgattagtcaccgaagcgccatcacgtagagcgatccctccgaatcccgtacgccaaccatcccctggccgtccaccctccgctatcataattgagattgatcgagtgcgactaattgatcgatgccacaagggctgccgttgagcctgaccatgaatttgggtgccgatttttagtagacgagagtagagattgaaacgtccgcagattgtcagataggctcatacataatctgctgaaaatctcgaaagcccttcatgtatgataagaaaacgaacacaaagtcactctacgccccccatttccattggaatggtctaagagaaattgagcaaaacaaaatcgacacaatgccatggaacattctttttatttgcaaaattattaacaactatcgcaccaaatttcatgaaaataccaaactgatatttgatattaatgaaaaaagtaaggataacataattattcactgacaaatcctttctaaaaataacattttccgatgctctaatgacccttttccatcctaccagcacaaacaattacttaattaattacatcaattaataaattaggcaattacttataataggacatttgctcgattttctgtgcttttctttccttcgcgcactaatcaaatggtccatcatttttgtcggctaaatgaaagcgaacaaaattcccaaaagccaatgccttcc

SEQ ID NO: 2629 - DNA, 1428 bp, Heterodera glycines
accctcgggaatggcagcaaccgcgagacttaaaagggagcattaaagggaaaagggaagagcatgacaacctgaccccgattgtgaacatttcgagcatgtccctgcgaaagaaaaatcaaattaattaaataaatagataccatttaatttgtttggaattgggtcattccaattttcacctgccctgaatcagtccgagaaggaaaatcagtccgatgacgccgaatgagtacagtgacaactgttttcccaattggtccatgcctaaacgggaaaatcacagtgcaaattgttcacaattgctcctcaactgttctgcagcggcgtcttgggcgactcttccgattgcatcatcataaatacttcgccaaattttgaatttggcccagtcccaatcacaattccctgtcaaaatgccatttagattctctcttccaaccaaaccgactgacttttccccagccggcacagaccaaagtgcccataaatgcgatgttgtccatgtgttcaatgctgccgcctccgtttccatttactgtcccattatttgtcgaaaatttggccgcattttcgggcaaagctgcggccaccttttgtctcgcctcattttcacccgtaaacgacgactcgtccaattgtaattggacggacttaaaaaaattttttttttttttaaatttagaaaatagtctaaaaagtgcctcgatgacacgaacatcggccgggactcgatctcccgcgttcaaaagtaccaagtccccaggcacaagttctcgggcataaaaagtgacgcttcgaccatcgcgaatgcttaaaaaagaaaattgctaaaatttatttttagaatcggaccaatgcgccgtcggtggcaccaatcggttgagcttttccaaagtcttttctgaccgatattcttgaacaaagccaacggtgaccaccgaaaaaggaaaattggagcaaattggaaaagaaaatgggaacaatgagaacggcgacagcaatggacaaagcatcatcgaattgtttcaccagaacagaaacaatggcagaggcgagcagcagacaaatgagcggatttttgaactgtaaaacgacgacagataaattggaaaagggcgaggaaaaacaacggaatgccaaaagtggcacctgctcaaggtacttgccgaacagggacaccttctcgttcagctcgaactcgttgaacccgctgaagcccagccgacgggacgcctcggcggacgaaagaccatttgtgggatcagtacgaagtcgagaaacgcattcctaaagggcaactcaaaagccaaattattaaaataatgcatttcaaatacatttaatttaatgaattatgagtataagtagatggttgcccacatttattggagaaatttttttgttttcataaggcatgaaaccatg

SEQ ID NO: 2630 - DNA, 2291 bp, Heterodera glycines
agggtatggaatttttaaaaaatttcctgtataataataatccaaaatatttagccttttgacacacctcagcaccgcgcgagggatgcctcttggatgtccatcgcggggatcatcgtcgtgccgttgcttcccgctgcaccgcgcgccttcgagttctgcccaaccaacaaatgtgcaccctcaccaagaccagtccgaaaaagcgaacgcaaaaacccagtcccaccggtgaacccaaaaaatgcacagcaacgattgttgattttggtgttgttgacagtactatctttttgatgctaaacaaaatttaataattaaagaaaaataaaacaaaattttggaataaaggataaaggtgatgaataatattgtcgatttgactgtatctccaattaccgaaattgattggcaaggaatcggttttgacgcttcgttcactttttttccgtctttctcgctgtcgccgtttttcgacttaatgtttaaatctttaaatggaattttatattatctatgtatatatcttctagaatttggtgccaagaattatgcttaaactacattcccgtattacttaattaatgtgcacaaatgtttaattttgcgacatacataccaatacaataatcaaaggaatgataaaatttagccaccgctaaaggccgaaggccgccaacgcaccgccaccacatcaaaatcaaacataatgccaatcagacgcaattttaatttatggttcgttcggtcgctccctccgagaatggctaaccccgccttccctcctcaccttttccttttccgcctcttctgtctccgattgtttgttgtgcggttcagtcacttcagcaacaacgctttgttgcttctgtttctgcttccttttctttgcaccgctctttctgttattattattttccgttgttccttcgtccattttctgttcttttcttttcggcttttcgttttgtctgtaatttatgccacttttaatatccattttcattatatatttttgttatttttctcatttggaatttaaaggaatgaattaatatgtaaaagcagaaatgattgtcattcattcgtttgctaccaattaatcttttctctctccagccgttgtcacattttttctctccacatcccaggaatttattcaatgtcgttttttatcattcaaatggaaagagaggaaattaaatgtaaaaaatgcacggttttatgaaagcccaatgaattttgctgttcgcttcttattcgtcgtttctttgcgcttgcatttttcatcaattacctaccgaaaaaggactgaaattcataaattttaaatgtatttgccatttcttcaaaaaataaacagaaaccgactgaaaatattattaaaagcattcaaaaggaaatgaataataatgttttgttttgcagaaactacacaaatataaacgaataataattcctcttggggggaggtgcaaaatcaaaattatctgctgatgatgatcaaaatgagctgataagagccgtttgtgtgcgaaactttagcagtacttgtgttcttataatggaggggaaagtccgttgaacagtgaaaataacgtcaaaacaggccacccaaagaacgaataatttattcgggacgacaatttcgttgtcgctaatttcgaggcgagcatttacatcccattaagccatgaggcaattaaatgctaaggcacaagaacgaaacacacaaaggatttaatgggacaaaccgacaaatttaatttcaagggatttttgtggaataattggtttaaaatggaaatacattcctttttcaactgctttgggttctttgaaatgataattttgttgaggaacctaattaattaaaagtgtatttaaccaaaagaattttttaatctcggagtttaaatgcaaagtcgctggtgagtcggcaaatccatttaaaattctccaacgaatcggcaaatccaatcattgctcatctgtcggtatttttgtcgacctttttaaaactgaaattgcatttttccaaatttattttaattattatcacaaatgtttatttggaaattgtttaaatgttgcgtgaaagacattggaaaggatgggcaaaacagagaatggcgaaaaaataaatggcaatgaaacaaatcaaatgaacgatgaaaacaattgaatccatgcgttgtcagcaaaaatgagccacgaatcattggcacaaaacccgacaaaaaaaaataattgatcgtttttggatataaaatgccattgatccgcaaatt

SEQ ID NO: 2631 - DNA, 4660 bp, Heterodera glycines
  misc_feature (8)..(9): n is a, c, g, or t
  misc_feature (18)..(19): n is a, c, g, or t
  misc_feature (34)..(34): n is a, c, g, or t
  misc_feature (40)..(41): n is a, c, g, or t
tgcaggtnnctgatcgtnnttttggatataaaantgccannttgatccgcaaactcttgcaataaatcattcgaatacaaagcgaaaagggggagaaattatttgtggaatattgcatcttttcaatagaaatctggggacaatgatttggccaatttcaagaataaatgtgaaagttgcaattggaaaatttgccggtttaattttatggaaatgaatggtaaattaatgaatgaatggatctacttatttgatgtaagagaattgagcattttttttaagattttgtgggtttattgtcgatttattttcccattaaaagaatttgaaagacttagggattttttgtgtgagaaaatcaccgtaaaatgttttcccatttcactgacaaaaaatgagatgaatgaatgaaaatgtctttttggtcattaattttaatttagaataaaaagacattttaaataataaatttaattaaataactaaatacgtgtaacaaacaactgggacagtgtgcaaaagttgggattaattgaatttgaggggggggggggggggaaatgccaaacgacgaacgaacgaatggccaatggaacgggcggaggggaagagaccacacgattgaagaggatgaacttctctgtcgagtggaagagaatgaatgaaaggaaagtggcaaagagttgggcaaactgaaaaaaacaaacgggcgattaattaattaggtaattaaattataaaataaaataaattttgtaatttgatctgtttactgatttttggcagtgaatgaatggcggggagagaaaagttgacgagaaaaggcaggccaaaagcaacgaaagaacggagggacagcctaagaattatttttgcattttttcatttcccaatttgtgtgcttgctttttctcaccattcttccgatggtcctgcaaatgccgtcgccctcacttcttgaaaaggccgtaatcggatgaagaacatccgcagttgttaaagagaccgccgccggagttgccgctggaggaaggaaagccgccgaaagggccctaagggagtaattaaaagaattacctaataaagcgaaggagggtaattaattaaatgagggtaaataattaattaaattcaattcgcacaacgcaaacattggcattaataaaattaaaaaatattaaatgaatcaattgtttagtttttgttttaatcaaaaaaacacctgtcctaatgacgaaggtccgcccgagtgcaatccgtccaatcctccgcccattttcacgccaacgctgccgccgaaaaggccgccaccgcccaccgatgagcaggagagaccggcaccgatgccaccgacgccgcgcgtggacctgcagggaaaaaggcattcaaatggggccaaactttgtttggcatttcacttttggaaaatattttttctagtacatgaaattatgccgttgaaaataaccaaatggaaattgtacgcaccaatttgatgatccgccatgaccagcaattgccagcccactgatcactccaccgccgatggaaccgctgcaagagccgccgttggaggaaccgttgccggaattggacgaatcagaggaggaggacgaagcggactgagtggagaaagaggaaatgaaacagagaattggggggggggggataaatggaagtttagagtctcattttaatgtgccaagtcaatggaagaaaaaaagtaaaacggaaaaactggcactttcgtgccctattcgggtaaataaaaaatacccagcagagagagcagtggagagaaagggccattcatttggctttattccaagttctgcccacctgctgtaaatcggtgagggcaaggccagtccggggtgactgtggtgggccagagacaaccattgctttgttgttgttggtgtttggcgatatgtccgctttttgtgtttcaaattttgtccaatcggtgccgattggaatggttaagtgaagctgtgatgattagttagctttcttcacgcaataattcgtcgtaatttcgctcctttttgtcgtcacttttgggcgaacgacgaaacgaatggctgaggagggcgaaaaatgggaaaatgtcctgaaattggcgaacatttgctgatggttttgtgaacgaatgaatgattattggaggcgagtgagtgattattgttgttacgagaaaaaaaaaattataagacgaaaaggggcgaaaaacaataaataaaataaacggcggcggcgtctgatgggcgagaacaatgcgcgaacaaacggtgggaaagcgagcgaagggattgtcgcttttgctcactggaaggcgggcgcttgctcgcctgatggagggcgtttgctagcctgatggtgggtgctttgccaacctgatggcgggcgtttgctcgcctgatggcgggcgtttgctcgagtgatggcgcgtgccaactcgcttgaaggtggttggcaacggaaggatggtttctgtctgtatccttaattaggagagttattttcccgtataatagttttgttgacaataaacggatagcttcaagatttttttgcgggagtgtgttttcggaatgagttgaaatgaaaacaggtaaatttggatattgggtcccagatcatgagaggctcattcaattgaaatcacctgcttggtagagctttggtttttggcggccgattgccaagctttgttctgttttggcactgtgactaaatgccgagcctgaaaaggttttggcgtttggttatcagaagccgagcatagttaagttttggcgcggcggtgaatgtcgagcctggctaagttttatattgtacaattgacaaccgtacttgtctgggttttggtttttgacggccgagtgccaagcgttgttctattttggcactgtgacccaatgccgagcctgaaacggttttgaatttggctatcagaagccgtgcaaaaccgagttttggcgcggctgttcaattccaagcctggctggtattagcttttaattattcataactgacagtgactttacgatgctgtgacaataaccgtcttttgatcttaaaaaaataattgggtcgtgatagtataaatcaataaactatcttaaaaataagaaatgaattaaatgggcaaaacactatcaaaggtttatttcaatcttaaatcccagcaagttatgtgggaatcttgaaggttttactagaaaaattaacccaaaaataaaacttaaagatgttcatgagtttcatgataattttacaaatgctagtataattttgaacaaaaggtacgacaataaaaaatgaaaataataataccaaaatttaaaaatggggatattgtacggatcacataagaaaagggaaagtttcagcccccagcctcatgggcatttgcccatcaccagacccccagccccatcagcccccaacccaatggcatttcccatcacgagtcccccagccccatgggatctgcccatcaccagaccaccagcaccatcatcccccaacccaatggcatttcccatcaccagtcccccaaccccatgggatttgcccatcaccagtcccccagccccatgggatctgcccatcaccagaccaccagcaccatcatcccccaacccaatgggcacttgcccatcaccagacccatagccccatcagcccccagccccatgggcacatgcccatcaccagacccctagccccatcagctcccagcccaatgggcacatgcccatcaccagacccctagcccccagcccaatgtgcacatgcccatcaccagacccccagccccatgggatctgcccatcaccagaccaccagcaccatcatcccccaacccaatgggcacttgcccatcaccagacccatagccccatcagcccccagccccatgggcacttacccatcaccaggcccctagccccatcagcccccagcaattggcacttacccatcaccagacacctagcaccatcggctcccaacctcatgggcattttaataaatgttcagtggaaggttttattctgttttaaagtctgacatcataaggcaaattaataatacgataattgggttcaaaattatgtttggttaaaggactttttttaatttgttatgtgcattaagcaatattttcattttttcccgctacattttttatttttctattcatttttcttggaaatgaataagtactaataattatagtaattaatccaatatcgtcaagtattattccatcaccaggaagcatcataaatacattaaaaagagtgttggctgtgatttgttgagcggacttaacggaatacttattggtccattgagacaattacaataaaagtcgacagaaattttttccattttccaccctcgttttggcttgctaattcgtgcatcatttaacattttatttaagataagctcaaaatttgcataattgtcctcatcttctacaactctaaaatgaaagcttgtcgcatgttcttttatcccaaagttttcgttttctcttacaccgcttccaatcggatcataaaaactacctaaatagtgacattattttattgtaattagcgaaaaaatgtatttataaagttattttgcacataagatcacttga

SEQ ID NO: 2632 - DNA, 2646 bp, Heterodera glycines
  misc_feature (2570)..(2570): n is a, c, g, or t
  misc_feature (2621)..(2621): n is a, c, g, or t
  misc_feature (2629)..(2629): n is a, c, g, or t
cccatcaccaggcccctagcccgcagcccccatgggcacatttcccatcaccagaccccccagccccatgggatctgcccatcaccagaccaccagcaccatcatcccccaacccaatgggcacttgcccatcaccagacccatagccccatcagcccccagccccatgggcacttacccatcaccagacccctagccccatcagcccccagcaatgggcacttacccatcaccagacccctagcaccatcggctcccaacctcatgggcattttaataaatgttcggtggaaggttttattctgttttaaagtctgacatcataaggcaaattaataatacgataattgggttcaaaattatgtttggttaaaggacttttttttcatttgttatgtgcattaagcaatattttcattttttcccgctacattttttatttttctattcatttttcttggaaatgaataagtactaataattatagtaattaatccaatatcgtcaagtattattccatcaccaggaagcatcataaatacattaaaaagagtgttggctgtgattttgttgagcggacttaacgggatacttattggtccattgagacaattacaataaaagtcgacagaaattttttccattttccaccctcgttttggcttgctaattcgtgcatcatttaacattttatttaagataagctcaaaatttgcataattgtcctcatcttctacaactctaaaatgaaagcttgtcgcatgttcttttatcccaaatttttcgttttctcttacacagcttccaatcggatcataaaaactaccaaatagtgacattattttattgtaattagcgaaaaaaaatatatttataagtttatttgcacataagatcacttgagaggatatgcaaaagtggtcacgatcacagaaattctttcgtccataaggtttacgtcgccaaatgattgctgacgatgcataaattcgtttagcacaacatccgaagttacttggtgtagtggtctcactggtatcataacaggatcagacaaagcagcacaatataaattcagcgaaattctttccgtcttccatccttgtgcaggttctttttcctttgcctcgtgtattagtttatcgataattattctaaaattattttccgcatcttcatttggtgggcatttgaaataaaaactagttacgtgctcccttataccaaacttggctcgctcgttgacatggctctcaatcttttcgagacactttcccttgtcaggggttgccttgaaaaagtggcgggtgtttctcgcacgccgaacttcttttggcgtattttggaacgacattcttaaagtatttttaattgataaattctagccttaaatagatgatgattgatacaattcatgccttaaataaaggatgatttactttttacaaggcggaggaataaaagcaaaagtttattcaataatatccaaaaggcaacacattaaagttttcatcaacaatccctttcctctgcacgggcccatattctttctttacatcccttgagagtatcctgctatcccttgtcggcccaatcttttccggataacgaaacacttttttcactccttcctgatagcccaacaccatctccttgaattcttcataccgcatcttgttggacctattcaacgtgaatccccgaattttggtcttttcccaaatctccccatctttcttccttctgagcttcagggcgtactgcttcggaccagctgacacatattccaaaatctcgctatcggaatattctcgagtcatctcccttaaaaccaatttaaagagtttcaaaaatttttattttaccccaaaaatttcccctccttcaacggacaccgccccttccgatgagcaaaggccagagaatctaaatataaaattttacggaaattttttataatataacacctgtatcacaatacagtggtttacatccctcctccctgtagacctgctccatatactcgtacaactttatccttgcagcgctcgtagtccacaaagataaaactatattcgacaccttatgctcctttatgaactcctcctttttacgatatacaacacgctctactccttcacatatttgtattggcgtcgaaacatcaagcgtattgtcttgtgacaatgcgacccaccgttccatgctgttaaaaatctcactcgtcgaaagcgtgttgcgcatcgaaaacttcccccacaagctgttcaaccccttaattttcattgctgataaattaatatttgcgtatttagtaccaattttgctatcatacgaaggcctgggttaaagacaattttgtcatgatcaaggcagatatcgtatttcgccttgtacatatcggtgaatgctctcttttcctcttcacttttcacctccgccggccaccccgacgcctccacctttatttttaagaacatccgcacatatcctttgaacaattgattgtcaaattgctcaaagtgatacgctcgatagaatcccacaattctatatcctagctctaaagncttccgcagttcaatcgaagtgaaacgtccccaaaatgctctctgctctgngcgatggntacattttttcacatcc

SEQ ID NO: 2633 - DNA, 1248 bp, Heterodera glycines
aatatgatgaatggttaaatgatatttgcggtcgaataattatggcctgctggaatctgacctttgcggctaacgaatacgaaatgttcaccctaaaaagctcccaaaatatttccaaaatgctaatcaaaatatatcccaaaaactgctcaaatacgcgaatttccaaagtcttattctgtacatttttaatttcaaaaacaccgtaggaagcgacagaaaattttttgaaattaaagtctgtttgctgaaaattttttccataagtttttttgtcaaaaaatatatttttttttaaaatctcctacataagtgttaaaactaccaaaacccagtcttatagccaaagtcaaaaatttgtttttatattttaaaacgtcgcattgatttgaataagtaaaaagcttttgagcttttcataagataaatattagcaaaaaaaagagagaacataagaatccttcactaatactaattaaaaatattttgtttctatctgttcttagctcttttttaagtccaccagatacgtaggaaacttctcatcaccaggataccgcactgtttttaaatcgtctgttattccatgtatttctggtttgaggaagccaagcgcactgcctacccacgtttcgttccaagcctaaaatttcatttttaggtccacattgatatggaactccaccatagaagctttaaaccaagctagaggaatctcgcacttgtttagcgttttaaaaaaagtaataatataaaaataaattgaatttcttactgaatttattcctcttatgttcgcttttaagagttcaaaatgttctatcacgacaaatgctgtatgctttcttggttattatgaagaccaaatgtaatgcatgtgatctgatcgtgaggttggtacagaaggtaagcaaaaacacatgctaaattccggatcaggattagtgaatttaaccggtaaatgtttttttattcctgattctgattctaaaattttacaggactctgacctggaacattctcaaaaatgaaaaaaatattatgctaacataacaaaaatgaccccgtcgaaaaactattaaaatgacacaaagattttagataaaattattttacgcaatcaaacttttcattcccataaatcacaacggtcaatagcccttctcatgaccataaaaaatttctaacaacacttaataacacatttaatgattcttatatttaaaaatgttttttatgtccaatgat

SEQ ID NO: 2634 - DNA, 1504 bp, Heterodera glycines
  misc_feature (1462)..(1462): n is a, c, g, or t
ataaaaaccctatcttttattgattatttaaataaaaaatatagttttacgtttaaacggatgcgcaaattatattaatattttctcatattcaaaaaattttatgtggtataacttttgaaatttaattcttttggtttttgttcatgaaatttggttgaaaatatgacaaaatatttttaaaactgttcaacaaaagtatttatttggtcgagaaagtgcattttatgggacaaacattggatttccatttccatttttcaaaaaattgtttttaattatttttgcacttcacttcgccatttgtcgctttctcaatccaagcacaatcaattggagcaaattgacctggaaatttattttttatagacaaaaatgaagataaatgctgagtgagtggaatgtcataatctgtccattttctcaattttcgttaaaactttaattttcctcaaaaacgaaaaaattttacccctaataattataaagttttaatcagctttgagccattagctatatttagtagagaatccttgaaaaattttgcttaacttattccaacaaaaattaaaatttccctggcgattggactatcaattcctttttgcatgtttcataaattttgacaaaaaaaaaatctcaaattttcataaatcatgaacgagcatacgaaatatgcaaaggaatccccaaaagtaccaaaataattaaataaaattttttattatgatttttgggggaataaaaaagttctaaagcgtgaatacgtccttaaatgcaaaaaaacaacacataattcggcatagaatgttttgaaaaattgatttttaattcctcttgaaatggaccttgttctaaaaaaataaaagaaggtttgaaaatgttggcaattttaattgcaaaaaatataattaatttttaaaaaataatactataattatcacctgtgaggccttctgttcgtgtaggatctgtaggataacaagtcgtttggcttgagacgcccacttgaacccaaatattgttgttgtttttcattaatccactcccactgtcaccctaaaagtaaaaattattttaattttttaaaaatttattacagtttcgattatgctcggcccaggctgaacacaaatgatttggtcatgctcattatcattagaagaattatcatcatcatcagcaattgaaagtctttttgctaaatcaaggatttcaattttaattttttgttttttcaatttgaaattaattacatttgattgatgcactttgacaattctctgatgcactgattttcatttgaccgtacatcaattgtttgcttgggcctggcttactgtcgttcgaacaatatggtgaagtacggccccaaccagcaacaacaaaggttgactgatcattggtgcctgaaaatataagcaaaatatttttaatttttaaaaagtatttaaaatttatntggcaaccatattccattaaacaaatgggacgagcatttgct

SEQ ID NO: 2635 - DNA, 1974 bp, Heterodera glycines
  misc_feature (1907)..(1907): n is a, c, g, or t
  misc_feature (1937)..(1937): n is a, c, g, or t
  misc_feature (1965)..(1965): n is a, c, g, or t
gaaaatataagcaaaattttttttattttttaaaaaagttatttaaaatttatttggcaaccatatttccataaaccaaatgggacgagcatttgctgtgaatgcaagtgggttcttcaactaaaattttattgtattaaattacattttatattgtgtatataaagaattcataaagaaaatgaaaaatctattaaaaaactaaaaaaccaacttttgcggactgaactatcaaaaaattaaaaaatgttttttaaattataaaagtttttcccattagattttcctgagttaagccgaatagaaaccagaaaaattcatataaatattttccttaaaattaatcgtgtcctaaaacactttataatgtttatctgctttctcatgattaatttgaaaaaatgcttaaaaaccccaaaataataattgacaaacgaatttttttattcccataattacaattttctggtttttacagaacttaaaattcctaaacatccaggaaattgtcttgtttctttaaggaattaaattagaagacgaattaataaagcaagcataaaaaacgaattcaaaattcgtctttttttatcattttaatccgcttttcctcactattagcgatttatttgaatttttacttcaattatagccatgtcatatggattcggttgcactctctgcgcttttataatgacgtttttatctgctttagcatcattaatttgattgcgttgcgcgtcggtgccctttgggtgcaatttaacggccgcaacgcccgtgagttgttgctgttgtttcaaatttgcggaaccatacgcaatgacaatttgatctaaaaaaatcagcaaaaaacagcaaccacttttatatatattaatgatatcattacatattcacgaaatatttattattcattctttagtctacaaatttttcaataatttgtactaacaaaggcaagtaaataaccgaccataatgagttatttgttttttaatttttggaagagaaactttgcacactttaagtggtacaaaaaatgtaaagaaagaaagcatattttaattaaaattaagcccttaataattcactcactttctgcaacattgtgctcggtacaatgcaatgcggtcaaaatatgtcggggaccgataattgttccgctgcaatacgactcttaaaaaatatgaaaatgttataaataaaaaaaagattaattataattggcctgtttagaacacctttaattatcaaattaatttatttaaataattttcaattaattaaatgattacttccaaaaatcagtcggacgatccatggaagtgccttgtcatcaccaacttcttgccctttatacacctttttaaaattttaattattttttaatttggaactttccttctcttttatacatgatttgtgccgattgccatttttgacacattggccaattgaggttcgaagtcggaaatgccgcattccgaaaagttcgaactttgttggcatgacacaatcaaaagtttgctgttgatggaataaaaagcaagcaaaaccattggcaaagaaagatttgccaacatttttcagctttttattagacttatttctatttgctaaattatttatttttatttttccataaatttttaaaatataaattaaataaaattcttaataattttaaaaacataaacgtatatttataatgaaatttcaattgaagaagaaacaattttgacacctcaaaattcttttgtatgaaatgattaattaatttttctaatcattcataccattcattaatgcaacaacaacgaaaacaaataggcaattagcatttaattaatgcattttattgctcatgcctttttttctttctttatttttagtattgtaattantggatttttgtgtgcaatttataaatttanaaaacccaaaaactttattaattacttntaaaaaaat

SEQ ID NO: 2636 - DNA, 3666 bp, Heterodera glycines
  misc_feature (3534)..(3534): n is a, c, g, or t
gaaatgtgaagaatggcggaggagattataaaaataaaataaattttaaatcaaaaatatttcggctcgacccagagactcgagacatgaccaaaaaacagagattttctcgattcggatgcaaagaaacccgactttatcgattcgagaccgagacttttctcacaaattcgtattgtgtaattaaaaccaaaaaaaaaaattgtggttatggtcaaggtaattttttgcttagggttattgaacagattttaattcctaaaattctcacaaaatttttgacactgcgaaaaatcgattttgaatgaggcatttgttaagaaaattaggaaacttttaccactccctcgctgatgttactaaaaaaccctcaaaacaggcactaaaatggaaaaatattctcaaattttttttatattgcgtataagcaaattatctgcacttagctagaatatccatcatataataaaataatttgtaagtaatatgttttgtgtctttccacggtcagttcattccattgctcttgtgcttttgcttcgtcgccgttcactcctttttgtctcaatacatattttttaataagctccagggtgtcgatgacagggtaaaagaaatcggagcatcctggcttggagtctaacccgtagggcgcccagcttagcggccctacgttccacgcgatggcggtgttaacaccctaaaaatacgtaaaagatcccaaacaacctgacaatttacggttgaaaatccaaaaggtgccgctcccggcaaagttattatgccttctccttgtctttgaacctaaaacagatttttttggattagattaccataaaatcttaccgttcgagtgcaacaatattattttgacgtaaaatttccgggctgatcattatggctttttctcgcagatattaaactcctgcacaaatactgatgctgccaggttcttgaagcgggtaaaatctgcagccggaatcgaatacctaggttacccattctatctcgttgattctttacaaagtcagacaaaccaaatagttaaagcgttacagtccgattttggtagcagcagactaatgctgaacagctccgcgttttcggtgtgtggtggaaagaaagcgccggcacgtcttagatatatgtaaaaagaagtcacaccttcaatcggtgcgtccattcctcctgaggcagcatccattggttgaaaggtcaacagagctcccattgctggtttcaattcggaatctgccggttttggggctaattcttgtgcgtactcgaagacccatccaggctgagcaattccctgccaaaaaacgctaaacccgaatttgatttttcctttaatctcttaaacctctcgtattcgtcgattgttcggttattgggccagcagtttacttcctttacatacttagaaaccgtcttaacggagtccgtcataggtaccagtttataaaaaccatttaacggcattttttccaatgaaacggaactagagaaattttttttgaatgtaccattattcatggtaccgaataggaagctgctcccgcggcgataatttacattccggaagttgataattttgaggaatacgaaacttaaataggcctacatatctcccaaaaatattcagggagataatgttgttcaagaagtcgtcaatttttgacgaaaggtcgtcagccgtgggtaccaaagtttttgatccctcgattgcttcgtaggtagtcattatttttttagcgaggatttattagcaataaatatttattattttaattttaatatgtgaaaaaacctatgaaaatttttttaaataccacaaaaatctacatttaccatttccaataaacaagttatatcctgcataaacgataaaaagcagtgtttaaacccgttctccataatcattctctcatcatctgcctacttaattacgctaaaggttaatgtctctttgtcgtcgacaacgaattagttgacagtttaagtgaaatcctcttttttacattttcccgatccatcatgtatctttctttacccgtttgtgaattaggctaatgatgatgttaatcgtttttagcttcatacaaagattagggaaatccgctttttaaacctccatatttcgggcttttttaatccatattttatgtttatgctttttcgaactttttttttggcctatgatttgattttgtaatgctttttcactagaaattattgggcataaaaaggtgtcattcgactctatcgtagagaggagccatatggttatattttgaaaagcaaaggtgcagtttacctaaatgtaacaaattctaaaagaaaaagtattttctctgataattttcgatgttttttaccaccgtttggatttaattaattaaataattattttggcctttcccatttttgcagttatttgcctcagtgtcacaagtattggcctgcctgcatccctttgattctttcatcttttcaccgattttgagatggtttgaacagtgcgttgttggacagttttttggccaaattcactctgaccttttaaaaatgttgataaatttcttagaaatgatccaattcagggtgaggtacttttcggttttgtgacccccccccctgagttttctaataaaaagccttaacaaaaaaattttcgaaaaagggggatatcatacgtactattaccaaaaaccatttttgttcgagttcgggtttttcgggttcggcgttcataatttcgccaaacaaaagcaatattcgtggtcagcgccacaaataacccaagaaaagactttttattaaaaatttcaggggggtcacaaaaccggaaagttgatggcagatggtcttttttgccatgttcactctgaacttgaatctattaaaaatgatacacattttgcgaattcttcaaattattttcttagatttaaatctctaaaccagaaatttctgctaaaaaagtttaaatatgttaaaaagctaaactgtaaaaataaatggtaaaaactgggcataaaatgtcaaaaattttgaaaaagctattttcccaaaatgattaaattgagctttaaattttcatgatttttgatcacagcaaaaatatgtgctagaaaaccccaaaaaatgttttttatgagttaaaattcactataattcgaaaattgggcgaagaaaatgtgttttatagcaaactttgagcaaccaataatagaaaaaagtagggcaaataatttcaacttttagatcctggtaacgggcgttgccgattcttaccaatggtaattactgattatttactatcacactgggatctgtctactgtgatcggtcatccctcacccattgttctgttccccacttaggcgctgcttcctccctcctgatcagcgcatttagtgatcacagtcaaacaaatagcattcatcgcaccgtttggtcggcacaaggcatttccagggcaacaattttgtaggtccggcatttaattcctctgtgtgcacttaattttgngaatttgaacatcggaaatgagatgcatttcatcatgttgagtgctagtgcttattacaccataaaataaaatttaaaattttatatttaattcagaaaatcaaatttggaaataatatatttataattaac

SEQ ID NO: 2637 - DNA, 2480 bp, Heterodera glycines
gaattattctgatttttttaattattcccgctcacaatgtgtcgtaatgggtgagtatttcttccggtgacaatttgccacaatgtgaatcaaatgcttggcttctgcgtcggcatggccaaagtccaacggcatcacccagtcgcgcatttcctcctaaaaacaaaatgccaattacgccatcagaaataatacttttaattagagaaacttcggtaatattctgcaggcatttcgccccggacaattgcggccgagaaattgctcctatgcttaaaaatggtttaaaatattcttttcaattttaaatatgatacataaatagatgagaggtgctggtgattaatcaaaacttttatttttttttaatgagataaagctcttttagggattttgagatggaaaatctaattttgacacattcgaaaccaaacccatattcgaacaaaaagtctaaaactcattttcccaaatttcacctctatcaacaaaatggatttaatatgtgcgaattaaacaaacgccagagattattggcacaaaaaattggcaaaaatgtgaccaaaaacaagcctaaaaaatcactttaattttgtaccttttttcgtccttttcacttccgtcacttgttgacacgctggagaagtgttgtttttgctgttcttcttggtggtgctggtgattgtcatggttatgaatgtactgtttgtttgttacggtggtgatactgtcgatctctttggcaatttcaatgctcgtggactgagatacctaaaaatgctggcaaaattttcatgtcatattacgaattcaaaattggtgacaccggtggaaagtatactgtagctgagttggtgaaataaaaaaattaaagttggtatacagtagtagtaattttatttataaattgaagaaatcacattttaattggtgtagttgaaaattttacggcatttttttctttgatgaaataaatttagcatgaaaatttcatgaaattttgttgcggttcaaaaaaatatagcccaaactatgagaacggacgggctatgagatacggaagatagggctgtgcgagaagtgatttttactgggaaccgagaaacgagaccgagaaatgaccccgggaaacgatacgagaaccgagacccaaaaaacccgagaaatttctcgactcgggaatcgagaaccgagaaatctaaatgaaattgattcaaatgtatttttttaaaatcaaaaacacattaaaaagggggctaggtcaaacggaatttttgcgtaggagtctcaacattaaagttaccgcattttttgcttttaaaaacgctttttcgcgcatttttccaaaaatttttggggaacatgagggtccggtggtgccggtaggcgctgccggaaaatttttttgtaattttttagtgagatgataacagattttcaccaaaaaggccaatttttgcatggcaaattttaggtaaactttttttcctcttttcccccttagccggcgacctcccgcccgaaacggtcatccttaacagtgtaaaaactcaaaaatctgctctcgtgagtagacgacgacacaaacacaattgccccttggatatatcgcgggggggggggggggggggttttaaagatttttgtgacagtaacggcatttgtcacctcttttcgccaccataccacgcacagtcaaacggagcagccgaaaagtttgttgatttcttcaaaagacagttgaagaaatgcagtggggataaaaattggttgaaacaatcacttttgtcttatcgctccatcccaattgcagttttaaacaatcgatcaccagcagaactgtttctcggccgaccactccggaccaaactttctcttatgaaaccggaacggccgagtccattcttccgaggcccgtatcaataacgcatggcacaacagtttgataagaagcatggagcaaaaagggtagagtttaacatcggcgacaaggtgcaatttgtgaattaccgtgatggaaaaacattatggttatttggggaagttgtcaccaaaaaagggttaatttttggcattcgttccccacaaattgcaaacagaattgtcactcgccatgcaaacgccatgcgactcacacaagcattgggcactgatcaaacatggccaaattttgatgaagagcccaagaagaacaaatcacccgttcgagcaccacaaattcagcgaaatgtcacaccaacaccaccagccgaaagaacccatgatcaatttgaacagaacgaagaacaagaacagaaccaacagcaaacaccagtgcttcggcgatcagaaagagttccaaaacgtgtccgtttcctgagtccaagcatgacgggacaacggcacaatattcgccagtgatcagacttttaagagagggaggtgttgtgtgggcaatcatggacctattatttatttatatttttatgcattcatttttc

SEQ ID NO: 2638 - DNA, 1113 bp, Heterodera glycines
gcagcaaattgtttgactcgttaattaataattatcttttagtgtaacgcttgagaagttcatttatattcttgcccttgcaactggactcattggaatattggaactctgcacctgagtccacaaattacgcgtagttttggatgtttttggttgctttgtgtaaatcgtttgttgtttgattggttccgtcgggtgcttttagtaatagctcttttcgggatttgaattaagttcgatttatctgaggggtatattatttatactaggttgtgagaatttgtctctgcaatctgcatcataaatcatcagagatttatatatagggcaattaattaaaggtaaattgaaggagtctgtctctgccgtggtgctgatagttaccgccgggggaaaaattaagaatttttaccatatttttagcatattttcattaaaaaattctttattttgcggttttttttcaaaaaaccacaaaaggcctcaaaatttctcaaaaaaccacaaaaagcctcaaagcctcattttgaaaatttagcctcattgacctatcaaaaaacccaaaatgaggctaaagcctcagatatggcagccctggctatagtgaaggtgctgatgtccagcccagaatacgaggaagggaacgagtgagaacgaggattggatttgggggaaaaaggaataagccaaaatccgggccctggataaaatggcctccccaaattggtaatcccttgggcgcccactagatcgaatacgcgtgcggggatgggcgataaggagtaaaatataagataaatattggccaatcacataaaataataattccgccgcgctttgctctcggctctcgctcgccgattaactgcccactcaactgactccttatcgagagaatgctcccgattaaatagttggacttatggaacggaaaatggaatggaatagagcggagatatgtgcttgggaaagagattaaacggatgtgattaattgcgctttacactatgacagaattttttcaacacccgaataacataaaactctcgaatattctcaatgaatcgagttaaacatttgttcctcagattttccttcgttgagagacaattt

SEQ ID NO: 2639 - DNA, 2033 bp, Heterodera glycines
  misc_feature (16)..(16): n is a, c, g, or t
  misc_feature (38)..(38): n is a, c, g, or t
  misc_feature (40)..(40): n is a, c, g, or t
  misc_feature (1934)..(1934): n is a, c, g, or t
  misc_feature (1970)..(1970): n is a, c, g, or t
  misc_feature (1972)..(1972): n is a, c, g, or t
  misc_feature (1984)..(1984): n is a, c, g, or t
  misc_feature (1987)..(1988): n is a, c, g, or t
  misc_feature (1994)..(1995): n is a, c, g, or t
caatgtgaatttttgnttgtaaactgtctaaaatttcncnaagcactcatatgaaagatttctagaaaatgtctagttgagcacactacgtggagctcaagtagagttcatcactaaaatataagatattcacgcaagtgaacacgacatttgcccgaggggaatgtgaaaagtgctggataaagtgtcaattttatgtcgaaagcctagtgcatataactcagcgcctactccatggattgcagcgcttttactcttttctgaaagcgcttcaaagcagctttcgaatggtgtgtctgatttgtttggatctcgaattatcgcagagatatactcaaataagtcagcaatgtttattttttgaattaccaggtggtattctgacaaaataattttttcaatgtgaatttttgtttgtaaactgtctaaaatttcccaaggcactcatattgaagattttctagaaaatgtctagttgagcacactacgtggagctcaagtagagttcatcactaaaatataagatattcacgcaagtgaacacgacatttgcccgaggggaatgtgaaaagtgctggataaagtgtcaattttatgtcgaaagtctagtgcatataactcagcgcctactccatggattgcagcgcttttactcttttctgaaagcgcttcaaagcagctttcgaatggtgtgtctgatttgtttggatctcgaattatcgcagagatatactcaaataagtcagcaatgtttattttttgaattaccaggtggtattctgacaaaataattttttcaatgtgaatttttgtttgtaaactgtctaaaatttcccaaggcactcatattgaagattttctagaaaatgtctagttgagcacactacgtggagctcaagtagagttcatcactaaaatataagatattcacgcaagtgaacacgacatttgcccgaggggaatgtgaaaagtgctggataaagtgtcaattttatgtcgaaagtctagtgcatataactcagcgcctactccatggattgcagcgcttttactcttttctgaaagcgcttcaaagcagctttcgaatggtgtgtctgatttgtttggatctcgaattatcgcagagatatactcaaataagtcagcaatgtttattttttgaattaccaggtggtattctgacaaaataattttttcaatatgaatttttgtttgtaaactgtctaaaatttcccaaatgcactcatattgaagattttctagaaaatgtctagttgagcacactacgtggagctcaagtagagttcatcactaaaatataagatattcacgcaagtgaacacgacatttgcccgaggggaatgtgaaaagtgctggataaagtgtcaattttatgtcgaaagtctagtgcatataactcagcgcctactccatggattgcagcgcttttactcttttctgaaagcgcttcaaagcagctttcgaatggtgtgtctgatttgtttggatctcgaattatcgcagagatatactcaaataagtcagcaatgtttattttttgaattaccaggtggtattctgacaaaataattttttcaatatgaatttttgtttgtaaactgtctaaaatttcccaaatgcactcatattaaagattttctagaaaatgtctagttgagcacactacgtggagatcaagtagagttcatcactaaaatataaaatattcacgcaagtgaacacgacatttgcccgaggggaatgtgaaaagtgctggataaagtgtaaattttatgtcgaaagtctagtgcatataactcagcgcctactccatggattgcagcgcttttactcttttctgaaagcgcttcaaagcagctttcgaatggtgtgtctgatttgtttggatctcgaattatcgcagagatatactncaataagtcagcaatgtttattttttgaattaccangntggtattctgancannatattnntttcatgtgaattttttgtttgtaactgtctaaaattt

SEQ ID NO: 2640 - DNA, 1202 bp, Heterodera glycines
  misc_feature (84)..(84): n is a, c, g, or t
agcgcctactccatggattgcagcgcttttactcttttctgaaagcgcttcaaagcagctttcgaatggtgtgtctgatttgtntggatctcgaattatcgcagagatatactcaaataagtcagcaatgtttattttttgaattaccaggtggtattctgacaaaataattttttcaatatgaatttttgtttgtaaactgtctaaaatttcccaaggcactcatattaaagattttctagaaaatgtctagttgagcacactacgtggagatcaagtagagttcatcactaaaatataaaatattcacgcaagtgaacacgacatttgcccgaggggaatgtgaaaagtgctggataaagtgtaaattttatgtcgaaagtctagtgcatataactcagcgcctactccatggattgcagcgcttttactcttttctgaaagcgcttcaaagcagctttcgaatggtgtgtctgatttgtttggatctcgaattatcgcagagatatactcaaataagtcagcaatgtttattttttgaattaccaggtggtattctgacaaaataattttttcaatgtgaatttttgtttgtaaactgtctaaaatttcccaaggcactcatattgaagattttctagaaaatgtctagttgagcacactacgtggagctcaagtagagttcatcactaaaatataagatattcacgcaagtgaacacgacatttgcccgaggggaatgtgaaaagtgctggataaagtgtcaattttatgtcgaaagtctagtgcatataactcagcgcctactccatggattgcagcgcttttactcttttctgaaagcgcttcaaagcagctttcgaatggtgtgtctgatttgtttggatctcgaattatcgcagagatatactcaaataagtcagcaatgtttattttttgaattaccaggtggtattctgacaaaataattttttcaatgtgaatttttgtttgtaaactgtctaaaatttcccaaggcactcatattgaagattttctagaaaatgtctagttgagcacactacgtggagctcaagtagagttcatcactaaaatataaaatattcacgcaagtgaacacgacatttgcccgaggggaatgtgaaaagtgctagataaagtgtcaattttatgtcgaaagtctagtgcatataactcagcgc

SEQ ID NO: 2641 - DNA, 2353 bp, Heterodera glycines
  misc_feature (6)..(6): n is a, c, g, or t
  misc_feature (14)..(14): n is a, c, g, or t
ggcgtntgggctcncatctgaccccaaatcaaaaaattctttttcttcatcactttgatctcctcttttgatcagtgcttttaacccttttgtaatctcaactttagttggacgattttgctgttcatctcgcaggtggagataacgtgccaattcctggttataatgaacattcttcgccgtcacattttccctccttctttttgttctctccaaggtacgttgcgcaaagcccaaattgatattccccgaatcattgtttgttaaaccatgataaatttcatcggggacgagaataaattttgatgccataataaatggttagttgtcagattttaagcctgaatttatagcggtgcgcgccaaatcaatcaaaattggagtgagcaacgccgcgaacactcctccaagtccgctaccggtttgaactaaaagcttgcgtgctcctttctctgtctttctgcgagcaagagtccggacaaagcttgcatacggtaacaaacgctttctttgacgtgtcgtcatcttgaaacgcgaacaaagaatgttcaaacaaatttcaacaagtgttagcaattgatctgctgttgcgcgttttaaaattcgttttttgttcttgcacgattttgtttttgccaatgaacgaataaaatcaatatttttatgaacaatatttccaatttcacaagacaccatttttgggaatgaaaatgatcttttctccatcttcttcgtcctccttaaatatcccacttcgaagcctcagcaatgggtttgaggcagcatgcatatcgatcagaaggtatccatagggtttattggtcgcaatacggtatgccgagagaaaataatccagtttcccgggaaagagttgaactccaatattccgaacagcaagtgctgagttgggggcccgcattagtaccaaatattgagcgttttgtcttgccactttaatccgtctttcaaacaaattttgggtgacaaaaacaacggcaaagttctgatggtgcgatttttttgtgaataatgcacttaaataggcctcatcaatcgatagcaaaaggtcgtcaaggattataagcagtggtttaggtaagcgtttaattaactcttccggagggactcccgaatacacactaataccacatttttggagggtaggcacaatgctggacatttcaccgaatgcgtaaagaatggaagcgggcttagggtcaataagttctgaggactcggcaataaacttgactagaaagctgctttttccactccccgatggaccagaaataagcataccgaagggcatttttagctttaattctttatctgtgtaaaattggtttccaatcatgataaatgtttaagggctaaatcaaataatcacatgcttttaaatactttattatttacgggtgatcgacgcaattgctgtcatttcctcatcttccatatccttctttactttcttctttggctttcttttctgtgaaacgtccatgttagtcgtggcagccgacacgctctcgagaaattcatcgagaatttcatggtctgtctgctccttctcctttttggttgtagtttgttgttgttgttcactacttattcccattgttgcggccgaaacagctgaaaaaaatcccgaggcatcagccttgttcggttgttcttttggaacggctgtttgacccaaatcaagccccgtcgtagcagctgaaagagaagcagcgaattcggaagcatcggaatttaattgttctttttggcttggcttcggtggtttgtcctgttctacttccatcccatggttgctgccgagatgggagaaaagaagttggaggcatcaactggctgttgtctcggcttaggcttgggttttagatattcagcggtcatccccatagttgcggccgaaatgggtgaaaagaaatctgaggcgtctgccctctgttgtcttagtttaggcttctcgttttttgttcaatgtccattcccatcgtcgccgctgaaattgcaccaaaaaattctttgccgtcgccttgtcgcgtttggtgactcgcaatgtctaatcccgtcgttgctgccgacacagagttgaagaattgatgggaaacacgttgttccgcgtcttgatgactttcctgctttcttttcgggagctgaggcggtggaggaggtggaggcaaatggtacaccggagtcggggtctgggtgcacgcattggagcgaaaaccgtggtcaacgttgaaaacccgtcctttgtttcgaatctgttgagtaataattgtgataaaacaaaacacagaaacaaaccttgaaaaatgtgtaaccaggcaaatcgtagatcaca

SEQ ID NO: 2642 - DNA, 2009 bp, Heterodera glycines
  misc_feature (1944)..(1944): n is a, c, g, or t
cagtttaggcttctcgtttttttgttcaatgtccattcccatggtcgccgctgaaactgcaccaaaaaattctttgccgtcgccttgtcgcgtttggtgccgcgcaatgtctaatcccgtcgttgctgccgacacagagtcgaagaattgatgggcaacacgttgttccgcgtcttggtgactttcctgctttcttttcgggagctgaggcggtggtggaggtggaggcaaatggtacacgggagtcggggtctgggtgcacgcattggagcggaaaccgtggtcaacgttgaaaacccgtcctttgtttcgaatctgttgagtaataattgtgataaaacaaaacacagaaacaaaccttgaaaaatgtgtaaccaggcaaatcgtagatcacatcaaatggcacaaaacgtgggctaattttgaagcgtgtgcaccaaatggtaacgccttccttggaaacgcaccattccgtctcacattcggttgccttacattctcgacatttgccaagaatatcgaattgaaccgttcgtggtatcgcaattcgttcactgctaaccgtaatgccgttgttggtttgatttatctcaaccaccggcaaaatgttgtccatgagcgactttttgtcgtggaggttgatactcatattttttttgaaaatctgatcaaaatgaaactaaatttgtttgtccccatttatataccggaccgttcatccttttttagctttatataatttgcataattttttgagatggcccctttttcttatcagcgtaataaatattgtgagtaggtcgagacgcgaacggagaagagcaaacatatgccgtcatcgacgacgagaatgcccttctcattcatttctttttacattttttttttctgcaaattcttccaatggctcgccaatcgacaattttaccaatctacaaacgacaatcgcgaagacagcagcaacattttcatttcgacaatgtaaaaaaaattttttgaattcaaaaaataattttatttatttcaggttttggtgtttgatggaggaagccgccgacagttccaacttagctggttctgcatcgcactgatcgtcatactttttgttgcctggttcatttggtaagtgaataatttttaatttacaaaatttctatagttaaattttaagaaagcgccgacggagacaatccaaatggtgcatgaaatggatgatgagattgatcaaaaattatcccaatttggttttttctatttaataatattttaatccatttctctcagggcaaataaagtttttttttttatatatgatgagttttttaatttatttgctcggaaaatttcaaaatttaaatgtgatttttttcaaaaatcatcctttaatctttttttccttttttttttaaattctccattctctcttcattattcctcattcttttggggcgctgctcatttggcctccaccccctgcaaaaaaaaaaagattgatgaaatgcattttatgcccacaatcctctcgcccccttcccataccacttcggcgctcgcctcttcggtgcgacgctcgggagggtccttcgagacctggacaaaagaaaaacaaacaaaatatttcccttcccatcctcccccccctctctacctcctccacaccgacgcgctcaacgcgcagcccgaagcgctggggcgactctcgcccagtgcgacgcttcaaaaaaaatgttaaaaatgggggcagaagggaaaaggcaaacattacctcgcgcaccacgctgaacacctggagaggacgcggcgcattgtcctcagtggcaccatccggacgacgaggacgacgacgacgaatgccggcgccacgggccggcatgttcaaaaacatggcccaaaaaatacacaccttaacacataaaaataattttaaaatgaatgaaaatgaanaatattaaattaaaataaaattaaatttacctgggcgaggaaaatgaagaggaaaagatgaacac

SEQ ID NO: 2643 - DNA, 7802 bp, Heterodera glycines
tggttcggttttatacttttttgggagctggtgtcttcctttttgaattttccaatataatctgtatattttttcatcataattaaaatgaatataaacattttttcgttaattcttatgttcagataattttttagtttttatattatctttttaaaaataattaagtcatttatttaatgaatagaaattaaaaagattttactaattatattattttaagcggagaactgttttaacaagtaaaaataaaaattttaattttcattcaaagatcttaaattttccgggagagtgttactacaaaataaagtatgacataaccataaaataaatttaacgaaaaatctttggctaaactatttaagaattttcaatttttttttattaggaatttgtgcatacatatgttattaattatagtcaggttagttaaataatatttccaaaaacattattaaaaaaattaattaataataattttacagaaaagaaaattattttaattgggtgagcattatttttttagaagaattataaattatgttaattattttgtattgattattcctctctcttttcattaactaaaagtctaatatgtttttatagaaaaaaaaagatttacctttgctcttttatttatatatattaaaaaaatgaaagtcgttaaataatacattatattcttataaaggataatagctttatatgagaaataaaaatatatgagcaatttagttaaattattgtatttctgatagtataatataaataatttgtatacgtttaattttttaatttcagcatttgtcgaccattaaattaattttaaaatatttgttacctaattatttagtccctaatttgagttattttttcaatgtttaaaattatttgttgatttatattcattaattgagaaaattaattcttttgtgatttattctcatggtgaatctcgtcctaaaatttaatgaattgagttttaaccttaaattaatatatttttttttttaatatgtatagattcattaaataatttaattctatgattctatataatattaatatggttttttaatcccattaaatttttaaaaaaataactatttatttcttatataatgaaattgtatttattttttgcttttaatttttgcttttattatgtttcctcattcgcgcaatgacttgctgaatttgattcgctttcggagattcattctaaattttgtttgtttcattattattatttaaccaaggccccaaggggcactgtgaaagcgccggggccgctttcaacactacccacctggatttattggttaaacaataatcaaataaaattttgttcactttgatggtccgtttgtgagtcggcattccagatggagtttcgttgtgcaccgcctccatgttgaagtcggtgcggaaattgtgcatctcctcgtttattgattatactttaagtttatggaatgctaaataaggatataaaaaaaatatttgtattttaaatactcattaatatattctctgccaatttgaattttatggcccgtttaattggatacaataaaaaataaaggaattttatatataattttaataaataatttttaatcaatgattggttgatagtttcacgaaaaattatttatttaaaatatcttttaatttgtgtctatcatgtcatttatgtaaaaagaccttttagtctttatcatattataatttgggtctatcacagtgatttccgtaaaatattttcgcttttccaataaaatttttaacgatccctcaccttcttgataaaatcgcggcctttatccagaaattacttaattaatattttttataaattatttaaattcattttttgttgtatttgatagataaatgaacttttgactcaaatgcatttcttttgacaatttatacacaaaaatttatatttatgaaaaaagtaccttaattattttggtcttttaattaacattttaataatttttttatttttcctggctcttacttttacaaaaaaattcaaaataaatttaagaacataaactatataatcttttgtgaaattttgacatattcctttcatatttacttttttttactatgagtaatataatagaataattcatctaattgctgataaattgacgaaatatgcaaaatcctgctgtacagacttgatgtctcattaataaaagtagcggctatgacttattaatttattgttttggaattaaattttatgatataatattattatacaaacttttcgattgaatatatattctttgttattagtgaaaagaagtgtctgtcaaaaatatcagtcagttgtttgccaacattataagtgaatataagtttaataattttaatagttattcatttatacaaattttttacattgcaatacgtctataaataaacaaaaattattatattttaatattgtttgccgttgttgctataatcatgatgttcgctacataaattagggacaaaaacgctatgattgtgataaatatttttgcaattgtctaaataaatttaactgttttttcatatttttggtagataggtttaaagaaaaatgaaagattcatcatttattggattatttcatgaatcatgatataatataattaagttgtatttacttttatttataagtattctattaaaagtgcacttttcattttgtatgttaatttactagcacagaaccgacagttcacgcacccgctattaaaatatatatattaacattttacgtattttactttagaagcaaaaatttaaaaatgaaattaaaattacaatctttaatttaaataaaagaaaataaatgatataatacataaagatttagtaataataaaaatatatgtatactcataaaaagaatatttttaaattttctaatttcatattttcaaatataaatttcttcattatcataaatttgattataattaaataaaaaatttattttcataagtcaataggatttaaatagaagatataaacaaaaaattataaaaataaaataaatacatgaagaaataaaattggtcgaattcacccatttgaagacggaaatgggagtttggtcgtgaattgaaaaaagaaaagttaatgagaaaaaaatattccaattaaaaaaaaataattaaaaaaagaaaaacaaaacaaagcaataaaaaggtaatttataaaataaaagcaaaaatgttaaataaaattcatcgcaacaaaaatataaaaaaaaaccgaagcagcaaaaattatcactatttttcaaataaattttcaaactttcaaatctgtctataaaaggaatagatttttcacttatttgttttatttcattaatcaattctaaattgaaattacacattattttttaattaaagtttattttatttttgtttatatgagaattattttagtataaactataaataggctcaaaatatcattctttactatttattggataattttttcgaaaattattaaaataatgatataacttaatataaattagtgaactcaataataacttatatattaatttaaaaattaaaataaaagtaaaattatcattattttttaaaacattttttaaaacaaatgaaaaatttatgttgttctatgcccatgaatgaattatatgttaatgattaactttatatctacattttacttttccacggtttcttttataccacagcttattatttaataatattttaataattttttacttttttgattaaattaaaatttattagcattcttttatctttagcaatttctcctataccctttaatatattcctgataaatatttattatttaagtaaatttttcattcaaaattctgcaagttcatttttttctattttaattctcaaactcgtaaactcgcaatattatctatgtagttgaatttgtgctaataaataattatttaacaatatttttggttatagttttattagtaataattttcatttgatttgtttttatacgaaaaaatgtttattaaattcaaaatttatgctttataaatttcaatttcattttaatcaagtttatatttatattattataaataaatataacttctttaaattatttttgttatatttgttgtcatgtaaaaaagaaaatataaatattattttttactaaattatattttagtagcaattcaaacaaaggagtagttaagtttgattacatttttttacaatttaagaaaaattacttaaaccttttttttgtgtaatttttaaacattttattttcttttttttttaactgattgccaattataatacgtttcattttttaataattaattgtattaattctatatttttctaattttacttttaattcctttcattaatttaattatttcagaacaaagaaatatgcattgaattgcattaataaatgatttcacaatgataatttaacatttgtttttaaaaatcaaaaatcagaaaagagagcatgattttttacaatttcaaaatatacaaaaaattaaatactttttatttatttaaaaagctattcataaaaattctgcaagttatctgaatgctatttctttgcaagcactacataccattgtgaaattaactatttaagcaattcaaagcatatttctttgttctaaaataattaaattaatgaaaggaattccaaaagtaatatttaactaaaaattaaatgtactgatcaatatttaaaaaaatgctgtattttaaaattataaaaatataagtttactaaataataaaaaaaataaagaataaaatttatttattcaaattaggaatacggaagacaagattcatttaaaataaaaaaggctaattttgcgttcgcaaattatcgactaattaataattatataatgaaatcaaaaaaacattaaaataaaatctaagtgaagaattttaatcacaataatactaaaaaatacaattacataataataaaaattttttaataattataccataagttcatttaaattgtgatcctttattaaataattggtcttgtctttatatttatttactttaatttaataaattttaatatcggtgattgttaaaaatgctataaaaacaacacatatataaattccttggtcagtaaaggaaatggagttaatttatttattttttctataattttttagattatttttaaagcgatatatattatggtattccatgaataaaattaaacataaaaatttaaaaaagataaattttttcatggatttcaaatacactatttaatctaaatttattttattaatttagtaaattaatttttagtgaataattattttaaaattatttttaaatttaactacattaatatgcagttaattaggtacaattattcataattttagttaattttaatgaatattcaattatattgcttattttaataatataattaaatataaaaggttgattaaatttcgtttataaattgtgaattaatatttttagaataaattaaatttgttttaagtgaatcttttttaatgtcatattctcatgatccatggggtcgctggcggcgcgcggcgcttagcttatcataaatgcattttttatttcttaaattcttgataattaaatgcaaatcgataaatttgctttgtgctttgaatatttaatttttctagttttaataatattattcaaaaaacgttttaaaaagaaaacatttttatttaaattttcttgacaccattcaagcatttggagcagggctgcacgcaattacggattgcggattacggatattacggggttttgggagttacggattacgggttacggatttttgggatttttccgtaattttgatccgtaatttgacttttggattattttttcgagacgatttcttgtacgattatttttataaaaaacaaatttttctattttttatttaaagggctacccatatttcgatttatttaagaattaaaatagatttataattttttatttgttgttgttaaggctatttgggtagttcgcctagaaaatagaggcatcacttttttgtcacacctatttttcacgcattttatgaaaattcataaaaccttagccaggtgaggggaggaattccccccttcccccgcccgaaatgaaaaattaaaaatttttacaggaaaaattgggacttttaaatttttttgtcgatttttcttaataaaatcattaaaattaaaaaaaaatttgcccggcggcacctatcggcaccgccggaccacgatttgcgtaaagaatggaagcgggcttagggccaataagttctgaggactcggcaataaacttgactagaaagctgctttttccactccccgatggaccagaaataagcataccgaagggcatttttagttttaattctttatctgtgtaaaattggtttccaatcatgatgaatgtttaagggctaaatcaaataatcacatgcttttaaatactttattatttacgggtgatcgacgcaattgctgtcatttcctcatcttccatatccttctttactttcttctttggctttcttttctgtgaaacgtccatgttagtcgtggcagccgacacgctctcgagaaattcatcgagaatttcatggtctgtctgctccttctcctttttggttgtagtttgttgttgttgttcactacttattcccattgttgcggccgaaacagctgaaaaaaatcccgaggcatcagccttgttcggttgttcttttggaacggctgtttgacccaaatcaagccccgtcgtagccgcagaaagagaagcagcgaattcggaagcatcggaatttaattgttctttttggcttggcttcggtggtttgtcctgttctacttccattcccatggttgctgccgagatgggagaaaagaagttggaggcatcaactggctgttgtctcggcttaggcttgggttttagatattcagcggtcatccccatagttgcggccgaaatgggtgaaaagaaatctgaggcgtctgccctctgttgtcttagtttaggcttctcgtttttttgttcaatgtccattcccatggtcgccgctgaaactgcaccaaaaaattctttgccgtcgccttgtcgcgtttggtgactcgcaatgactaatcccgtcgttgctgccgacacagagttgaagaattgatgggaaacacgttgttccgcgtcttgatgactttcctgctttcttttcgggagctgaggcggtggaggaggtggaggcaaatggtacaccggagtcggggtctgggtgcacgcattggagcggaaaccgtggtcaacgttgaaaacccgtcctttgtttcgaatctgttgagtaataattgtgataaaacaaaacacagaaacaaaccttgaaaaatgtgtaaccaggcaaatcgtagatcacatcaaatggcacaaaacgtgggctaattttgaagcgtgtgcaccaaatggtaacgccttccttggaaacgcaccattccgtctcacattcggttgacttacattctcgacatttgccaagaatatcgaattgaaccgttcgtggtatcgcaattcgttcactgctaaccgtaatgccgttgttggtttgatttatctcaaccaccggcaaaatgttgtccatgagcgactttttgtcgtggaggttgatactcatttttttgaaaatctgatcaaaat

SEQ ID NO: 2644 - DNA, 3123 bp, Heterodera glycines
aatggttaatgacactacttaatggttaaattgctttcatctcccaaaagcaaggtttatgcgcttttacctgttcaacaccaaaaaacgataaacgaactgaacacacaacccaaacattgaaaagaaataaacgattagccaactgtcgaacagcagttctttaaactgagccgaaagtgaaaaataatcggagaactgcaaaacggaaaaattcatggaccaaccattgtttgatagagtaacctaaaatattcatttaggaatcatatttaattaccaattaaatttgtatgttaaatacccacattttgcgacagaaaggaaagaacagacaaaacaatgtcaacaagcgcagtttggagcaaaattcgcttgtacactttcatttcctttggcgatcgcttcacaaccaacaaaattaaaattgcatttaaacacaacgccagaaacaggctgattgatgcattaagacgatgaatttggattagcattttaaaggttgtgaatttttggatgattaaagtcgatatttgaattctaaaatgaaagaaatgttaataaacgtcacttgtaatttgttcgctaaatccacagtgtaagaaaatggaaaaataaactcataactttggttgaaaagtaaataattttcaattcttaataaaattcggcaatatatgaaaaatgcgaattttgtcaccatggaaattgaaaaactttaaataatgacaacgaattaagaatatttgttggcacttttttaaaacgggtaagaatggcgagtggtctgatgagagaaataatttttgaaaattgagagaaaagggaattttttgggaagaaataattattttaatcagttctttttagggattttggaatttttcagtaaaaaaaaattcgtgttcgtttttcgtattttcgtgtttttagggcgtttcgtgttcgtgtttagtattttatttttgtttcgtatttttcatttttcgcattttatttttcgattcgcaacaaccctgttgtagataatgattctgagcttttcgattcccaaactaaatgcctttcttcatattggaatcacgcccgactcaaaattaggcatcatttaaatgaaacacataaagcttaaaattcccaaagacaaaaattttagaataattgatttggttggcagaaatatcaaaaaattgtattacaacaactgcagcaaaatgtttacatatgtacgaatgatgtaacatgaacaagaatcgcattcgaagagagcactgccctaaaaagaagaaggatggatttttaaccataaatgaaaatatccagaaaatttgcttttcaatgcaaaattcaggcataaaaaagcctttatgaaactgagattcggattttttgaattgaaaaaccgaaattctgagtctgacgggtcaaagccggaaccgaaaattatatcatttaacgatttggacaataagctgacggattttcttcaaatatggattttgagaaaaataaattaaatgcctttcttcatatttttggaacagactactcttttgcaaaagcatatcttgtgaaaagttctgaccttttttaaagcagatacatcaagccaaaaatttcctggtagcgcctgttggaactacaagactaaatttttttttgaatttcaaaaaaatcccaaaacctttctaaatagtttgtggcaaaatatattatgaattttagtgaattcaaaaaataataaaatccgttgaaataggttatttttattttgtaataaagtaagctataaatacataccgttgaaaaattatgttaaaaggacaaggaatgaatgaaagacacaatctttattaatggcacaaagaaaaaattaatatttttgagtgcattccgtgttcattttacactatccgttagggttaatttctttttcattgtgccattgtcaaaacaattgcatatgttatttcttgtccattaaacacgcgaatatgtttttcgaaacattgcatgcaattgaatctttcaattgtcagccggttaggtcataaatgcaatgtcgaaggtatttcgcagaaatttttgagaccgcatctgggtgaccgttgaaaaattatatttcgaatttttttttttttgccttatttaaaaggacaaggaatgaatgaatgaaagacacaatttttggtcacaatgaaaaaataatgtgtatgaaggattccgtgttcattttaccatatagaggagatttcaagtgatggtggaatttagagaccggaaatttcaaatttgcggatcccgctgcgggattggtactgaaaatttttgcgggacgggatcccgcaggcataaatcccgcaaaatcccgcaaatcccgcatttaaaatttgcgggatcccgcgcgggattgcgggattttggaaatttcgaaaaaatttagaattaaattttgaaaatctctaaaaaaactaaatatacctggccattttaaaaaagaaatttttagaggctggcggtatacgtgaaaaggggttaatgggttgatcaagatttttaagggtcagcagaaggttggagagagatcggcggacaaattattaatggggtcaatccataattttaacgattttatttttaagtcgttttttgcggcgcgctttttgaaaagattttcgggaacagagtgtccggcggtgccgataggcgccgccgggaaattttttttgaaaattttgtcaatttcttaactgatcttgtacaaaaaatgaccaaatatcgcacttttggactcaatttctgccgagttaataagtaagagccggtccggtgctcaactgcctattgttgcgtcataaatatttggaattaaaaaatgaaaaaacaaatgctttggttcggaacaaacctgaaaattttggccgtgctaccgggagcaaacattcccagtttttatgaccccccgaatcctgatcatttttcaaaaattccgtaaaacccaacgggaaaaattgcgaatgctatgttttttttagaaaatatattttattattaatttcacttctctaatgtaaatattggttcacatttctttaattatttaaaagattcccatcgtaatta

SEQ ID NO: 2645 - DNA, 1933 bp, Heterodera glycines
  misc_feature (1791)..(1791): n is a, c, g, or t
  misc_feature (1824)..(1824): n is a, c, g, or t
  misc_feature (1832)..(1832): n is a, c, g, or t
agggtcagcagaagggtggagagagatcggcggacaaattattaatggggtcaatccatatttttaaggattttattttttagtcgttttttgcggcgcgctttttgtaaaagattttctggaacacagatttccgccgggcccaaaaatcccccccccgcggaaaaatattttttgaatttgtcaattcttaactgatcttgtacaaaaaatgaccaaatatcgcacttttggactcaatttctgccgagttaataagtaagagccggtccggtgctcaactgcctattgttgcgtcataaatattaggaattaaaaaatgaaaaaacaaatgctttggttcggcaccaaacctgaaaattttggccctgctaccgggagcaaacatcccagtttttatgaccccccgaatcctgatcatttttcaaaaattccgtaaaacccaacgggaaaaattgcgaatgctatgtttttttagaaaatatattttattattaatttcacttctctaatgtaatatataggttcacatttctttaattatttaaaagattcatatcgtaattatcattgacacattaccgccaaaaaaagccgtccaatttttgttataaaactggtaatttcttcccattctcccccttttttggctctcttcaatttttgagtttaatgaattttcatttttcttttatcaatttctttttttctccaaacagcacgaactaatttgcccatttaaaatataataaaatttaaaaaattatgaaataataaaatttttaattcggttgcattgggcgaatttgtcgcgagaaaaaaatgcgatggtgaaaattttgaacggcggacggagcacagcagcagaagcgcaatatgtgtgggagtgggagaaaatgtgaaaatgggcaaaaattggggaggggcggagaaataggaaaattgggcacatcgacgagtgatcgatggatgggcgacgaaatttccattttcaataatattttaatgcgatataataataataataatagcaacgacacgaccattgtgtgttttgttcatccctaatcatccccagcctcattcttattttgttatacatattttatttggtttgtaaaaaaaaaattaatataatttaattatttatttaaaaattaatgaaaattacaaaattttatgaattcccccgtcagtgaattagaaaatctaagactaataaaataaacgtcaagagatgtgaattaaattaaacaagtttattaaaaataataataaaatgaatttacggtttttttccaaaaatataaattttttttttttcaatgtttttaattgtaactttcttttttatttctgtttcttttttgcaaataacaaatgagttaattaaaaaaacatccacccctcactgttttcatcacaaatattgcgctattttcccgttgattatttttctgtaacgaaaagattttaaatcaaatgcaaattcattgttgaaatttatttttgtcattttttgtccaaagtttgcctaaaccaaaagcccatttaaaccatcccttccctcggcccctccattttcgtcatttttccaacaaaaatcgatgattatttttgattttttattttttttcgcaaaactttaacaattctcatagaatacagcagttctccgcgctcattcgctttgaatgaatgaattcattttgttgtgcaaacacaaaaaatgttcacaaattggcgttggccaaaagcacaatcatcgcataaattatacattttccttantatatttatgtccctaattaataaataacctgngtaattanatggacatgctgatttagcgaacaaattgaacggacttacaaaattaatatttttattactaacttcacattctccatataattacacaacttactaatta

SEQ ID NO: 2646 - DNA, 3953 bp, Heterodera glycines
aatttttgatggtttgatcaattttatgcgtgtttactcccattacttatttctcaatttcacatgattgttgtaccgtcctctgtttgacgcattcagaaatttccgcgtgggctaatttccgttcttgacaatgtcacgtcatcaattgtcacgttggttttgtttccgcaattgatgcagtgaaagtatttgaatttgtccgcaaatgtcctgtgctctaagcacttcccgagtctcgtaattagctaattatcgaatcagtttttcgttgtcaaagagtcctcacactttttttgtctcatgtctaaatttgtgcagcttttccaatttgttggttggcgtttggttcggtcagtcatcagttgaacaatggaattgtttaaatttaatctgccagtggtcctatcagcgatctctgcccgctgtttttgttgtctcgccgcgacgcattcatcgtcgctgcaaaatcattgctgtcatttccctatgtaattagctaatcagtgaagtgaaaaatggcttaacgcatgtggaaggccattaaaggtgtggtgataagaaagtgtgttgtgcaatgaatgcgatgataagggcaaaaagcatttaatttctctcattagttgttttaatataatttgctttgttcttcgccctaatcatttttgaattctttgcaagttttaatttttggcctttttcacataagcgaaaaatatgcctttctctcgacttgttgcttcataagaattttttctgttaaaatttatccgttaaaatgattaaaattcgtggctggagtgtttcctctctgttggatgatcactcctctgccatccgatcggctgccaacagtggtgcctcgtcctcgtccgctttgtcaccggcggttggcattaatgccaccggtgtaaaaagtgccgctgtttcgaaaaccgctaaaattgatagaaaaaagtgctgtggtgatggtggtgataaattcagaaagaaaatggattggttggaaaaacaagtaaaaataattaaaatcaaaatacaaaatattctcatgtttataatctctacataatattatttattttatatttttaagcattcattttttaatttctatttcctttcttttttataatgaaattttattaattttaaattactttagcgagccacacaccagtttttgcttgctaaaatggtgtctatgaatattgtttcgccaaccgccgctggtccaaaacttccaaaacacaagccaaagcttgggaaatttatctatttggtgggatttctttttatttcttaatataaattaaaatttggtatttataataaaatattcaaaacaaaacaaaaattaattttaatgtgccaattttatgctttcagctcgcttttattgctgtcattggtggttttttgtttggttatgacacaggtgaaaaacattcttctatattgtaaaatatgataaattatattctaaatttcaggggacttaaattaaaacagtaatttattttttaattgaacaattcaaattaaggcattgtctccgctgcgatgctttacgtgccaaaaaattcggacctgaagccgatgagcaacgcatggattgggcttattggtgaggaatttttgttttagaaaattaaatttttattatagtttcaattacgccgggaatggccggggttggagcactgcttgccggaaaagcatcagacatttttggcagaagaaaagtaaaattgtttaaatgatggaatttaaaaatagtagaaatttaattgattcacaaaatcttttatttaaatataaaacataaaaattaattaattttcctttccagatgatcattctttccacaataattttcacatttggtgcaattgtatgtgcaattggtgtaagcaaatggattttgttggccggacgaatttttttagggatagcaattggtattatatcttaataatataataaaaaataatattcaatttgtaggttttgcctcaatgattgtcccaatttatgttagtgaatcctcaccagcgcatattcgaggtgtgttttgtattaattaaatttatttatttaattcttatattatttttaatttatctttaaatggttgttataatataatagaaatattaaacaaaaattgagagttcgagtgatcagccagctttcagatgatgatcaacttttgtcgtagtagcagcaaatatttttgcgtttgcgttttcttacatgaatccgttgaattgggtcgagaggtaatcattaggatacttattaattatcatctaaatttaataaaaaatctgtatatgactattggtcggatttgccgcaatttcaagtgaaatgcaatttgtcataatttgttttttgtccgataaccttttgaagcatccaatctgccattctaataaaagtgtgcctcattcaattctataaatgatatatcatttgacgtctctcggtctgtaaatgccgaattcgaaagaattttttagacaaaagatgggtaaactccaaatgaggggaaccgttttagattttgttgaacattatgcgttttacccactcgaaggttcagtctcgaaggcatttagcctacccatttttgttccttaaaaaggatccctcgtttggttttcgaaccccactttgatttttgtcgacccttctctaaatagtgctcttttttgtaatatacatatgtccaacatgctttaataaaaatcaacaagctaagtaaacgctttaatgtttttatgtaataaatagggccgcaaatttagtgaaaaaacttgtttgctcaattgttttgaagaaaggagctcaaaaaacgcatttctgcattaaaatttttcgattctgatgtctttatcggtcactagaaatcactattttggcaaatgtgattgaaagtgtacgcacacaaatttgtgaatatgcaaaattcacattaaaaataggcgctatctcggatccaccttcctcgtcgtcaattaattttacagtatctttttaagtacagtaaaaatgaaaagcattatggacacaaaaaatgaattaatggcttaaatctttttcgtatggcctgtaaaatccgtcactacaaaccaatttcaaaattgcattcactttcatagactgtaatttaaatgaaaatatgaaaaaaaagtaaacacttaaaataaaaacaacatctaaaaggtcgctattttgttagcacacactaattttgcgaataaagtccttttttatttttatgtgttgtgactaggcactttcaacccttatcttgacctatctatgccttctccaactgaacatctcgcctatttgcattaattcttatctcgaatctgttcacttaaatgggttctacgcacaccgtttcaattttggcctctcagttccaaaaagatttgcatgtgtggcgaagtggtttttgtaagatagtaaagggacaaagggtggtggttcgagtccgttgtgcaacatgaatatttttatttatttttgtccaaaatattaaaaaatgacgaattttgggaattatttttgaagggttttcccaaccaaattggaaaaacttgatacagtcatggtcataagtgttgtcccatcatgctttgaaaaaaaaattgcgtataaaattgtcattttccaatttcaacagataagtagcataccattggatagcattttttatgggctttacaatgataccatatttgcattttcaaaaaaccgcatgactctatgacttataccgtctgaggtatgggcacttcaattttgacggagagtaaattgcactattttcttatgatatacagtactttttataagcaccgaaataaaagacgacgtatctcaacgggcctaaatcgtacacccactattccataggccattctgaagcagatttt

SEQ ID NO: 2647 - DNA, 4627 bp, Heterodera glycines
atcgatatgcaaaattggtgcagatgtatgggattgaaaaaaagttatatgagaggaagtaaattcggtttttctctattaacagagataaagaaatagtacgccaaaaagagagatgttttttctctgcactctctctttattgacacatgtctcgttttttgactcggtgtgtactatatttgtgccaaataaaacaaacaagctagaaataaacaaacaattttaaattagttcattttagctaaatttattacataaattaattttattttggttgaatttttcatatttaccttaattattttattttctactcattgtcagaaatacatgtatttaaccaacaaaacaaatatgtatattaacatgttgaattgacaacaaactttttttcttgtcattccttattcattcatctttatcaagaaatatcgaaatggaattccttgtacgactggtccaactcctgcactcggacataaccgtcctctcccccagagacaactaaacgaaaacataaaaaacaggataaagagtagttttaaatttttttagtttttattctcatcggtttggatcaaaatggccaaaacggtttgaagccggttagaaatcggagcatgttgtccccccccccacggaaaaatttaaaaaattttctaattttttttttgtaaaatttctgttttaattttcaggggggaaatgaagtgcacccgttagaaatggctggtttataaatccatctaataacctagttgattttatcttcaatgcaaaagaccccatccgcaaattagggctcgacctattcctaatcattggagccccagttagcaaagtctacacggttaaaaatcataatacaaaaaacaaacaaactaaaatcatcctttgactttaataaatccaaaggccacctttttagaatttatttcattttcattcttatcagtattttcttattgtaagtgccttgccccgatgactgaccaatgtcccccgtggggtcgaaaatgatggaattgatgggtccgaaatggcccctgaatcgggcaaattcctcttcgaaaatcaaatggtacagtcgggccacgaattgctccgctgttgtggccgtctgagtgacttccatgtgttcttcaccaccgcctaaaacgatgtggtcgcggctgggagagacggaggcggtgttcaccgggcgattggacctggaaaacgttatttgaaaatcacaaaataaatagttaaaaatgttctcctgatgacactcacttgtacgttttcaaatgctgcagatcatgtgcactgtgcagttgtgccgttttgtccttaaacttgtaaaattcaaatacaacacgtaagaaattgtaagagaacggaaaaattaaatttcaccttcgatgctgtgatgataaatgtctgatcggcggtgatctgaaggtcgttgatttggtatttgtgcgggtgtgtgaaattgctagcggcgcccggctgccgcaggtcccacatcgccagctgtccggtatgatcacctaaaaaactcacaatcagaccattaactgaagtccatattgctcccgaattttcaaaaattagggagattgggaagaaaacgataccgaaagacggcgaaggaattttttttgaaaatcgttgaaattattaaaagattttgtttataaataaataaatttgggggatttttggttattagtgcttgaaacccaatgtcgactgaaattaaaaagaaaatcgcagctaacttaccggctacaatgtgatcgtctaagtgtgagaagagacatgcgttgcattggtcgtcgaaagtgtcgcgtaggatgggttgcgtcattttgtcgcgaaggtcggccacgacaatgcccgggagaccgcccgtggtcggcttgttcagcgtgaaaaccaccaaattgccgctgtaggagagaccgatggaacggacaacggaaccaggctcagagaaccccttggaaacgcccgtctcaatgtcccaaacctaaacaaaaccaattaaagagggaggaaaatatagtttggagcacagaatcgggggtatttccgaatttatcgaactgttctgtttcatcaacttaccataactttctggtcaccagatgcggataccatcgtttgtgtgtcccaactgacgtcgatgtcccaaacgacaccggaatgtccttcataagtgccaattctttctccattctccgtatacctaaggcagtgtatgaaaactaaaaattgatgaaaaaaagacgacgacataccatgcacagacggcggaacctttggaagcggagaagagaatgtcgccctcgcgattcagtcggactcgggtgatcgctctttcgtgacctttgagtgcaagcggtcgcattttaaacaactggaggagattaaaggacaaattcagagcaaatgaaataagtattttaacggatggaatgtccaaaatggtaaagacagaataaaccgaaagatatttgttgctttccaaataaaaacgataacaaaaacaaatgtaacaataacaacaacaacaacaacaacaaaaaaacaagaaaaatgagatagcaaagtgaaacaaattcaaaatgtttctaatgaaaaacaaaattcgccttttagccaattaatgtgttcgtctcgtttttgtaaatcgctgtcaacggcaattcgttggtcagaacggagatgcgcaacaatctgaaaaagggacccaattctataaaaaattggtataatgaaaatgctgccttattcgcatttatgcgcagttttgcatttagcaaggtccgccgcacttccaaattcgaatcattcgccaattttttccgttttttcgccttcggctcactttcacaattcgtttcattgtttaaattggcgagtccattctcaacgagacgacgaaaaagcgcaatgagttcgaacatttccattggcgtagttcgaggatgcttaaaaattgttgaaaattctttgaaatctcaatgagatgcatttttatactgaaattgcattggttagccaagtcacaaagtctaagcgaatgaaaaggtcgcgcgcggccgaccgaaggccgacgcaaatggcgaacactttgagcagcaaaagctttgtccaatagtcggccaatggcgtgcagaaaatggccatgcaatactcaacagcgaagctaatgaaaatttgaaggagataaaacccgataatttttaaataaatggaaatgcgcaattacactttgcaaatggctccgtagtcctgcgggtccacgattccgttggtcagcagtcgaagaatccattgcctttccttgagacaattttcagtggacgaactaaaaccaattgacaaatgacaccatagaacagtaaacaacagtatgcatttgcacctgaagaagagtttgaagaattcgggcactgaattgagctgaagccatggcttttgggtcaggtaggacatcagcggggcgtatatcggctcatgcggcagcaaaataattttggcgatccgcgcgaggaattggctgaccactaaagtatacgcagcagtgaactcactgtttgttattcatggtaacctcccattagcctatgttttacaaaccgtgcgtcgttcgttcgttgcattccaacaatgagtttttgaacacgtttaacatatgtcgaaaaagtattcgttgtggaaaatgttcgtcgctaagctccacaagtcggccgcgaaaacgctccaaaaaggcgtaggccaaagctcgaaggtccgccgattggaaactcgtggaggcaagcgcaaaagacaaagcattggactgaacgatggggcgacaggagagctgaaaaggaaggggaaaaatacgaataaagcacattgaatgcggcaatgaacttttgatagcaaaaaaaaacaaagaatcgaaatggaagaccaaaaatttgaaaaatagttttgtgagtgatacaatttaaaagtgcttattgtaggctgggtattgtgacgtatttggaatttgctatttttttattattgtgctacgaaaactctgtgtgtatgaacttgttggtatcgagcttcaacaaaatattgtataaacgatggcaagcccattcttttgcaaaatctgagctcatgtcgtaatcagcgcctttttttactcgagacaaaaataaaaaaaatttagttattttttgtcgtgacatcaattccgcagtattaacgaatttacaatatttggttgtacctttgtacccggagcaatcaattggacgagcaaacgaagcacaaaacgagggtcgtaacagctcggatcaatcttgacgaaatgatttgatcagctcatcccagctgaaaaagttatttgccccttttctaacacctctcccgttgcaatttccatcgccgcattgacggtggatcctttagacagtgcggcactgaaatgacggtcaaaatgggccaatttcagcaaggatttccacattcgttttgaatcgaaataggcaagaacctaaaacaaaattgttttactaatgatttgaattttttaaacctgctcaggtataggtatttgtgcaaagcacgcccatattggatcagctct

SEQ ID NO: 2648 - DNA, 2267 bp, Heterodera glycines
aaaaaaaaatatatattttgtgagtactgaccgtgaagccgcccttttcgggctgagaaaagtaaaacagtgccgtggcaattcgattgcccgtccccaaatcactgaacgcttttgtctcttccttctgaacaatttaaataattgtcgttttacagaacgaaaaaccctagcaaagtcgtagtgcgggtcgtaatggcctccgattccgtaattggccacctgaaattgaaaagggaaatgtgccaaaacaaaagtcatttgattgagtacttgcagttcctccgccgtttccatctccaaattggtcatcaaattcagtcttttattgattcgatcgaccacttcgtcctccgtgccttttagccaagcacttttgcttattcggtacgatgccgtctccaactttcccgtttgactgttttgcaccgtggcacgtgccaactaaaataaaatttgggttttgtcatttggtataaccaaagttaggggagggaggggtaattttgaccatttcttagcaaagaaaatagacctaacatcagaattcataaaaatgtttggtccgtgccattccgaccaccttcggcttggccaactcctgaatgcgctcaatttcctcatctgtcacgacatttctgaagagcacagcgagcggattgaagcgcacaatttcgactttgaacggcgccaataggagaaaggggcggtcccttttgtagtagcaatacaacttggaggtttgtttcacgctcttaaaggtgaaatcagaaaaaaagccaaaaagtgagcttacaacgggcacttcatcacggcacaaagcctcgtaaatattcctaaaatagaaaagtaagaattgaatttaattgtcattggcacgggatgcgctcgcctttccgagttgtccaatgagtcgtcacggcgtcgattgtccatcgggggaatgtccctgcggtaatccgcggatttcactccatccgcagtcaattggtcttcgtacctttcgtgtgtttttgccattgttgaaatattcaacgaattgtcactttcccaacttccaaattttaatttaccattttatatttcctttggctcgcgggtgcgtcggagctgaacaaattttcttttgaaagtcatattttgaaagttcgcaccaatctcagcaagacgatctgtcgttacgagggctcttttgaggtttccctgtttaaacatggcaaaggcgaggtattctgagagaaagtgcattttacaaagtcaaaaagcgaagagacaaaccgagcacatcggactctgaaaagaaagggaaaagttaataaattcacttttttttgggggggggggaaataaattattggacatttctctgaatttagtaaaatccgaccagaaattgtcggcgttttttcgcgctttgccctgccgagtgcttcttgcatccaaagcaaagtgtggtaaaaatcctgaaactcaaaagtttattcgggtgaacggaaatgaaagtgttcgcctcgtcattgtacgcaatgcgaccgatttcaaagcaatcaaatgctaaaacaatgtgaaaatgtacataagattttgatttgattttaacttttgtcctaaattattgaaattttttttggcaatttggtgaaactacggccattcattcattcattcagtacctgtcatttcattgccaatttttatgtcctgcacaaatccgttggccaaatccctcgtgtccaatcggtaagtgtcctgcaaacgaagcaatccgatcgctgcgccactcaaatcctcctaaaaaggcatccattgtttcccaaatttgtcatttttgctaacatctgtaggaaaaagcgcatggccatcagtcgtcacattttgcaaatattcgtccgccacgtccgcccgcatttcgttttgaagttctttccacgcattcgatagccgtttgatcagtcggaaagcgtttatcggattggacacactttggatgttcgtctgcaatttctcattgctctgtcggtatttggaagccatgctaaacaaaagcgaattcaccaatttcaaaatgaaaacagtttccctcaaagacctcttcaaatgttccaaccgttccgtctccaattttatgtaattatttatcagttgcggaatttcccattccgcgtgagtcaatcgttgcaaatcggcggaagaagtgaagaaatcggcactgaccgcaccaaaaggcgacaaaggaaaggacagaaaggaggaaatcatggcaaaaa

SEQ ID NO: 2649 - DNA, 1687 bp, Heterodera glycines
cactgtcaatcaaattaagaattgctggtgttgttcgatagctctatgtgtttattattaatttgcaaaatctcaaaaattttggttaagtttcaaaaaagttatggccagaaggaactcaaaaacccagtaattcgaactttttttgctctgatttttttgtgcataaataaaaatttttgaaaatttgcaggctaatagcatttttcgaatgctttcgaataataccaagaatggttaatttggttgagaaagaaaaaagttatggtcgaaaaattcgttcgacgacgtttcggctgacgacgttttgtcctactccgtacagcagggcttggcgaatgagtcataaaattagctgaaaagcaaaaaagagcattaaaatcaattttaaaaatttattaactgagcgtccgctacttctcactcctcatgattcattctgttaatttaactttgatttcactaatgcacttttttattatgatacatattgttttatttctttaatttaactgccgtacctccccttggtaataagcgaatgtcgtcggtacacaaagcaaatgctggaagataccactattattctaacagaagcgacactgcttcgatcccccccccctatcatttcgattagccaggtccctttttagcattcaatcgaaatcccccccccccctctcggtggatttggtgttttggtgggtcagatgtgtccttgtcccccccccccctttctctccttcccccattatttttattttggatgtcctcgcaacagaatgaatgcgcaatttgagttcccgttatttctcgtgttgggctcaagacaatgaatgactgaatgaatgagctgactctgtcgttggcccttctcccaatccgtccttctccgccaaattcccacagaacgggcgagggacggattgaattgctggcaccgaaacgcatggacaaatggacaacattgtggaggcaatgggaagattaaccgcaattggtcattcgccggagggggggggggggaaattacccattcgagaaagggacaaaacattaggcggggaattaattaatccaattaacgtaaacgaaagtgagaaattgaggagcttctaattaatttgccataattagtgacgcatcaacatgacagtacactaatgagaagatgctacgaaaggaaaacgaaaatttattttctgcaatttacaggagagggggggggggggagaggtcgcggatttattttcacacaaataaaaatcatttccgaaagttaaaattgtttttaactgtattttgtcagtccaacgaatggcaaattgccaaccatcgcccgccttcgccggagattcaccgtgccctttttgccacaaattccaattgaagtgaatcttcgaattcatcaaagatgttcttgggatgaaggcaaataaataaataacaaataaataaattgaaaagtgcttgttgctaaaaagaaacagaaactttgctgccattgtccgaagtttttccctctgcgcccattggcaagtcgaaattcggaaagtaaaaatttagccaattctaaggaaagaagggggggggggggcgagaggctgcaaattgccccaatttcctacgctcgcatcgcatacaatttgattggtcgccggggaattgggggagggggggggggaga

SEQ ID NO: 2650 - DNA, 1072 bp, Heterodera glycines
ttttaggtatttttgagtatatttacaacatcaatttttgagcaatttctaaagatgaaggaaaataatttttttatcaatattttatattaagttatgtttttgaattgattgaccttatcaaatgaacagagatgcagttgtaaaatttttcgccttctcgcgcaaagtttttcctgaactgtttctgccagatggttgagataatatttgtagatgtttgttcatatctcaatacattatttatggggcagtgggagggttttgccttagggtgcgctggtccgcccgccttcgaatgattacggtagggcttccgcaatttgtgtggtggtgccgcccgttccacacccaattggccccaattgaggaaatggattaaatgagtggctgctgcttgctgagcggaggagtgccctcccccccccccctccgtctcccctcgcccgcccccatttgactcttcgccaatcagccgactaatgtcattaaccccttaggcgctaacggctgaaaatgcattctaatgacacggaaggacaacagctgactgccgtcaacggcaccagtgcgtccttattgcagcagcatgacacccgctacatgctgaatgggtacggcattggccgcacgaattttgccatcaacgagattctcggcttagcctccgtggccaccatgccgcagatcgcaacactgccgaacggcggtgttggcacggtgtccaatggcacttttgccaattacttcatgacgccttcgtcgtattgcccttcggtgttggtaaatgctccattcggggaccaatcggcaattattagctctatgacgggcaccaattgtgcttctcaaaatgggttgtctgggctcgagttcatgcctatgatgcacttccagcaggaatatggcgactattcgtcgttcattggaaatgcaaattcaaattcgggtggaattttgagggatggcattcattgggcgacaaaacccaatttgatacaggcacttcaagataacttgtccaaagattgctgaatgatatctgccgacagcaaaagcagaagaattgcag

SEQ ID NO: 2651 - DNA, 4937 bp, Heterodera glycines
  misc_feature (1721)..(1721): n is a, c, g, or t
tgaatgaaatctgccaacagcagaagcagaacaattgctttgcgaacactgcacaaaatatggccgaattggcagcgaaaaatttgatggcggcgaaaggggcgacggaaagcgcaagacgaagcaacggcggaacgaatgcgaacggtgtggtgggcgcggggggcggctcaaaaaagaaacggcgccatcgcaccattttcacacaggcgcaaattggtaaggaaaacaggcgaaaatggcacaaaatgaaaagaaatgcaaatgccaaaaagtcaaaaagcaaatccaatcagtaaatcattcattgctttgttattttctgaatcaaattctgcattgattcatcgaaataatttcatggcacttttgagatgagttggaatcggtgttcgaaaaggcccactatccggatgttgtgcaaagggaggaattggcaaacaaaacgcaattggcagaagatcgaattcaagtaaagtgaagtcaaaagaggaaagagcacaaagatgggcctaaattaaggtgtggttccaaaacagaagagcaaaatggtaaaaaatagtgaaaaattaattaaatttcttttaaattaaggcgaaaaacggaaaaaacgtggggaaaaagcacaattatggccgagtaagtgagaaaaagaaggcaaaacgaattgagccacccaaaagatacggattatacggggcgatggtccgccaccaattgccattgcccgacaccatcacgaaatgtgttggcaatccggacgacccccaagaatcagccgctccctggcttttgggtacgttcactgctcctccatcgcaaatggcattttcctatgccaaaacattttgaaggaatgcataagaagagtatggaggctgccgttcaatttgatcagatcggagaccaccaggacattgatgagatgggggaggaactgaaggcgatggtcgtgggaggggtggggacgaagtgcggcgcgggggcactgatggaattctcggaggacgagaaattcccgaaggaagagcagcgcaattgcagtggccaagggcacgagaagaagcggagaccgcacgggaaatacggcggcaagggaatgccaacggcgaacaacgacagcacattggaaacgcaattggggggcggcgacagtcgccaatacatttttggaattagcggacaataaattaattgttaaattaattgttttgttttgcttgggtaaaatggtcaaaaggacggaggggccaaagcagcagagattagggagttcagcagaaaggacaaccaaaagtgaggaccattttacctttttgacaataccctcaccattttatttgacaatggcaattgtacatttaatttaattgtgaaaaagacaattttttatggaattgttaggaggacgaaagaaattcgataggtatttcattcattggccaccctgaaggccggcaaattgacttttcgtcggagaattgccgtaggaaatgaccgaccccatcattcgtcgccggcggcgcgacattcgtttcctcgccggcaccacccaattcttttgtttgtccttcacatgcctttctctttaggactatcaaacgaagatgaagagggggggggggggcacttggccaaatgggcaaacacaaaaaggggcggctttgttcgccctttcggcgccatttaattcgttaagtgttcgcgcttctttccccccnccccttggcatggcattggcaccccttccactcttcttaagcatcacacccatcatcaccagagcaagagttcatcattacctaaactaattaacctcctaaatttaatgagtctgaagagaaaacgccaatggcagagaatacgcttttatgtaacaaagctgttttttgaacaatagatttactaattaggtagctaattaagtaaatgaattgaaaaaatattttaattaaatttattaaatttatttgcccacaaaattaaattaaccaaaagtaaaaaattgcgaaaacattttcttattgttctttttgcgtcttttcgctttctttttttttgatttgataattttagaattaaacccatttgaaaatctttcttccgtctctttcaacaattgttttgcatttgtcgtgttatgcttgtaaaatcatttcttggtccgacgaaactttgtcaatttcgtttgtcgttctttcacaattcggtggtaaaaatgaattctgataatttccgcgttgaacgcgacactttcggtgaactacggtaatttcgaattaattttactttgaataaacaaatcgtgactttcgctttgttttagtgttccttctgatcgttattatggagctcaaacggcaaggtaaaagattcgaaaaataagaaaataactacaaaatggacctttatttagatcgatgcaattcttcaaaatcggaggacccgaggagagaatgcctttgcccgttattcatgcatttggctatctgaagaaggctgcagcaacagttaaccaagattttggattgaattctaaagtggcagcggcgatttgtgaagctgcgggtaaattcgcattttattaaaattgacgacattttttattctatttttagatgacgttatttctggcaaattggatgagcattttccgcttgttatttggcaaactggaagtgggacgcagtccaacatgaatgtgaacgaagtcatctcgaacagagcaattgaaattctcggaggcgaacttggctcgaaggtacacccaatgattttcaaattttaaccgccaaaagtcggccctttttcagactcccgtacatccgaatgaccacgttaatatgtcccaatcgagcaatgacacttttccgactgcaatgcatgtcgcggtggccgttgagataaacactcgtcttttgccttcgctgcgtttgcttcacgacgaattgtcgaaaaagtcaaaggaatttgagcacatcatcaaaatcggccgtacccatactcaagacgcggttccgctgactttgggtcaggaattcagtgcttatgtcactcaaattggaaacggaatttcgcgtgtggacgcaacgcttggccgactgtacgaattggccgccggaggaacggccgtagggacgggactgaacacacggaagggatttgcggaaaaggtggcaaggtataacaaacaaaagcgaataattaagcaacattattcggaagtataataatttgatttgggccgctttgtcaaaaaattttcattttttcaacgcttaggataaatttaaaaaattcaaaattatcttcgtgatttattttgaaatatttttacaaaagcggatccaaattaatttgtcttggccgagtttagcaaattggctgagttgacgcgtttgcccttcaaaacggcaccaaataaattcgaagcattggctgctcatgacgcccttgtcgaggtgttttttcgataattaagtttttattattttttttattgagattaggttcatggcgcgcttaacgtggtggcaacttcgcttatgaaaattgcaaatgatattcgctttctcggctcgggcccccgttgcgggttgggcgaattgtcacttcccgaaaatgagccgggctcttcgattatgcctggcaaagtgaatcccacacaatgcgaagcactaacgatggttgctgcacaagtattcgggaatcaggtgaaaagcgtgaacgagcggcgcatttaaaagggattagagtcccaatgtttgcaaatctgatcattttgctcaatttcccacttttgtaaggttgccgtcactgtcggtgcgtcaaacggtcactttgagctgaacgtattcaaaccgttgatcgtccgaaatgtgcttcagtccgttcgtttgttggccgatggtgccgaatcgttcactaaacattgtgtgataggaataatagccaatgaagaaaacatcaaaaaactgttgaacgactcgttgatgctcgtcacggcactgaacccgcacattggctatgacaacgcggcgaaaattgcaaaaacggcacacaaaaacgggacgactttgaaagtgaatgttattttgttggatttgggtggtccacctgtttataaattggcacattttcaaagaaaataattttacttttcatttattgggagttttaacatttaaaattgcggattaatttttcctttttgaatccttattgaccattctctaatcctaaggaggaagctgtcaagtccgggctccttactgctgaacaattcgatcaatgggtgcgacccgagcaaatgatcagtcccaaataagacagacagaaacctttgaatcaaaagtgatctgctaaaattgtctacaatttattttagtgtgcctttatttgcaagtttttttttttgctttgattagtttttaaagcgctgtcaatattttttttgtgtgtttttccttttagcaaagttaaaaagcgactcatatacacaatgctattttactttatacttttcgttttggttatctcaatttaccattaactttggcatttttctttattcatttgacattgctcaaagcaaatccctttgttttgtctttgccgagcacaaatggctctctgcgtggcgatttatgataagcatgtgagtgagtgtttgtttatttgttcgattaccattaattgctcccaactttctctttttaggatgccctcctctatttacgcctcaaagatcgaatgtccgcttctcccttggaagtccaacgtttcctgcacagttcgtgtgacattgttgcggacaaaatgaactcccctggtaacaaggccacccaacaggaaaattttctcggtgcacttcttttgagtgatcgctttcgggtgatcaatttccctttgattccttttgcatttttcaaatttct

SEQ ID NO: 2652 - DNA, 1154 bp, Heterodera glycines
ttatctgacaacaccggtacgaagttccttttggtcatcgatgcggaggagggcactctcaaagatcacgaaattcggctctttttcaaaaacattcacacaaaatattgcagcgccatttcaaatccgttttattcgtttggaagtactttgcaatccaggtgatcatctccttttgcaatgtcactgctattttggagggcggaaattgaattggaattgtttcgccttcccccccccccatctcctaatcgtttttcaaattagaattccctcttttagtaaaatagatgccgtggttaacgaactgcttgcatccttttgactgttcagaaaagcagtaattgatcacagaaaagagaactattgcaaataaatataaattattttcttttgagcattttacacactttcgcttgaccgtattgaggttgtaaattaccttaatattatcagaaaacaaagttttacataatttaataagactgatatttttagcctctaaaatgtcaaaacccggtggaattgtacgcatcaaaaatgtcagtgatttcgtcgagccaagtcaggttagctgcaattttgtaatgttttgaccggaacaattcaaaaaaaaaccctgaaatttcatttgaagcggattattaaatatcaaatttcgaatctgaccatgagaaagtcgctgacattatattcgtttagaaatgcattcttccacttcgtcaaaacggggaaggccaaaaggctgtggtcggcaagcgattggtcggaatccatgccaaatccgtcccctccgccgcgacggccaaaagggtcaaagtgacgctggacgactgtttggtgtgcagcggttgtgtcaccacgggggaagtcgaattcttctgaccttccatttttttgtttttcttttcatggtaaaaaaatgtgaaaattttattatgcagaattgtatttgtttaatagtaataataattaaatcgtgattcgatcatttccatttgaaagtttgatttggtacgttcagccaacattttacttttcttcactccgaaggccacacaattcgcacgtcgcgctgtgttaagagaaatttatggtggttttaaagtttaaacattcctctaaaacaaataaatgcgtgcgatattgtttgg

SEQ ID NO: 2653 - DNA, 1567 bp, Heterodera glycines
tggaaatttcaaccaaacctttccacgaaaatgtctctcttcaccaattcgtacacttaaacattgtcctttccctagttttctgtcaaataatcatctgtccaaaggcgaagtggcggccaatcattctcagaaagaaaattgcgtaagacaaatggatgcatatgaagaaataaaataagcaaagcaaggctagtcaacgaaaataattcttaggcgtctatttcgtgattttcggaaaaatccttagcaaaaaatgcaacaaagacgaaaatatagccctaagaaacttgaaaaactttcagaaaatacacccaatgaaaaactcaaaaattcatcactctattcatttttacaaatgccaaataattgatttggatgttggaacatttggacttttatattctttttaaaaacggattgaataaacggaaagatggtttactgtaactcaatcttttcactttctgacagttggtaaattattacttatttgactcgttgcttgtcattattcattgttgattttcacttactcttctgaattttttaaattctccaaccattcccgacaaattctgtagggaaatttcctctatgatcccttaattgtacttggagcccaaaattgaatcgccgtgtttgaatacttttaagaaattatgaagcgttgaagttgtcatgttttttttatattcctttaaactgcaatagtgccaaatctgacattaaattctgcttattcttcctcatccttaacccggattagaacgaagatttaaattttctaaaattcataaataatactccaaattgatttcaaaaatttcgactacatacagtcgaatccgggttacggatgcggaattgactttaaatcttcttatcttcaacaagcgacctagtctgcatcctaaatgtaataaatgctacttagaaattttttagagtaaataagcaaaaatgtcttctgtgagcaaatttatcaccaacaaagggccctttattgctgttggaatgggtgtggttggaatgggctattttggctactacaaattttggcgttcggtacgttctccaattcctttttggattccaattgttactgccgttttcacttaatgattacttaatttttaagtcgcgtgagattgctatgtcttacaaacaagaagacgaatcggatggatacacagtgaaacgcattgaggaggcatacaaaactcttcaggaggcaaaggattgtaaatccctgttgaaaaagcactttactgctgatgtgaaagacaaattgaagtacaagaagacgaaattgggtgcctctctcttcgacgtcatcagatcgggttaaattattaatttttattcccgggctcctattgcagttcacacgaccataaaaaaagacacgaccataaaatttttttgcaagtttagtgaaccataactttttcaagaagcatccaaattaaatattcttagtatattcgatagccttaagaatcctctattagccagtaaaagttcaaaaaattttgtttggtttcaaaaaatttatggccagaaa

SEQ ID NO: 2654 - DNA, 4351 bp, Heterodera glycines
caaactttggcgaggaccgattgggcgaatgaaaggacttggacccagatgggaaatacattctttctaccaggtttgtgaaatttttcttatattaaaacaaaacgaaaatactcgcttaattctgattaaaactttgattaggattcgctgcggtcgttctttgcttggctatcctttcaatccgttgttaatgcgtgacgattatttggtcatgcaacaaaaggttcgaatggctctcgagaatttggaagatgaccctgaaatcggtggaacttattatccactcgaaggtgaatttcttatttgtcctacatataaaaaaacatattttttattatttaaggaatgacgaaagaaacccagaaacaactcatcgccgatcatttccttttcaaggaaggcgaccgttttttggaggccgcaaattcaagtaaattcgccgctgttatattttctggtaaacccaaaattttagaccacttttggcctgcaggacgtggcattttccacaatgctaaaaaggtgcttataaatgaaagattgcatagtctttttgcttgcattacattcattacctataactattgttcagacctttttggtgtgggttaatgaagaggaccatttgcgcattatctccatgcagaaagggggcgatgttggcaacgttttgaaacgattgatccgcgggttcttgaaatttttttttacaattttttagttttctattagtgtgaaaggtatcgagaagcaagttccatttgcgcgtgatgatcgactcggctatctgacgttttgcccctccaatctggtttgtttcgtgcaaatttatacgtgaaaaaaatgtattttttagggcacgaccatccgtgctagtgtgcacatccgtttgcctaaaataagcgcaaagcctgaattcaaaaagtcattcatttaatagattaagatttatataaaaaattgtactgtaggatctgcgaggacctcaagttgcaagttcgcggcattcacggagaacactcggaaagtgaaggcggggtttacgacgtgtcgaacaaggctcggcttggacttaccgaatttgagggtaactttttatttgcttatacccacaatgatattgattttttctgttcattttcagcggtcaagcaaatgtatgacggtgttaagaaactcattgaacttgagaaggcgtcgaagtgaatgaattaaatatctatatccatttgacgcctcgtaattgcattgctttaatcacaatattgtatttttgtataggtctatagggtcagaaaatgtattgcattatgaaattgtatggacaagtaaaatggttaattgactaacctcttattttatctgtaatttaataaaagtaaacaattaattttcgtttccatttacatgagaggttccgtcgcttcaattgatttggacacattttttgaggtcgatcgcatctgctcatggattttgtcaaacaaatttcaaaggacggctttacaactgcccgatgaacttctcgaacattcattccatctcgtagaagcggttgaacgtagggtggaatcggcaggaacttgggaagaacagagggggaggctgtatgtgttggccgacacgtcctatcgaaggtgggacaaatcaccggcaaccgtggcgaatggttcaggactttagttgtcagaaatttgtgtgccttgttattatattcccaaaatcagttgttgtctggatgagattgcggctgaacatgtcgcgtgcgactccatcgttcactttggagacgcgtgtctaagtgcccgcagcagttccattcccgcgctatacattttctgcaggttggaaattaagattgaaactaacaaaaaaagttacaggcacccattcgaattggaaaaattcgtcgagcagtttcgaattgaattttctgaatttggaactgaaaaacagtgggatgactgtttactgttatgtgaagccgcctatacacacattcaaagtcatccattcagagaaagattttataaaaaacataatttaaatgaacaataaattaaatttgagattcacttggaagtgccatttctcgcattcttccgccgtctgttcgtctgttcaattttgaagtgtcggagccaaattcgccctcttcctccattctcgggcgccaggtgccggtcggattcgtcatcgatcagtgttctgagaaaaagcggcattgttttttgctttttgttggatctactgacagtcctttattgcccatcgcgcatatgacatttcgacacattgaaaaggtaaatgatcgtttttggttgttcttcatttaacaatagcaatctttgaacatgttctggttcttttggaaaaagctgattattaatttaagaccattgtctacacccccgaaacaggccaattcaatgcttcagagtgagtttctttgcccgcttttttcttagatttggattagcttcaatttgtcatttttgtttgcaactctgtcttccatttctgataaaagccaaactgtttttccagcactctgaccaatcggatgttattgcggcgattgtatttgatagagcgactacgcgacgcgcgtacggttggcttggtggttggagcggtggcattacgcgggtgccgtgaggcggtggcccgagtgcgcaaactttgcgaaatggccgggaagaaactgtacgtcatgtacataggaaaggtggggagcaagggtttaaacacttggtattttaaattgcgcagctgaacgaggcgaaattgtccaactttggcattgatgtggaggtgtttgtgttgctcagttgtccctttggcattatcctagacggcaccaaattttgtcgacccattctcagtgtgtttgaggccgaaatggcgttggacccggcacaaagtaattggctggccgaaatgcgatggacatcggacattgaacggatttctatgggtaagtttaggacgaaataaaatattttaatgaaaaatatagtcgacattagctgttgtaacaaaagcaagaaagagggcaccgatgaagatgtcggattaatgagtttaacatcgggcaacattcgccgttgctacggtcctacgaatgccgatgaggaaaaaaacaatggcattggaccaacaacgggtggcacttctaacaccaaacaagtgatggaatataccgcaggtgtttagactcatttttgtatttatttgcaaaaaaattctaggtgatcatttcgcaatgcgttcttggcatggactcgaggacaatagtggcaacaacttttgcatttctgctgatggcgtgacagaacgacaatgcccatgcgaactgaagcaaggaatggatgggattgccacgcgatatgccaatgaaccattcaattctgatgtccaaaaatgaaatttaaaaatttataaaattttaaattgtttgactttgatttggtgcataaactcgcaagagtgcaatttgcggtgcatccctattttaaatttttagaaaaatcactatttataacttattaaatccaatatgtttgcgatttattaagagagagagaagagtggtaattagtatttggttttgttttcagttttgtcattaattctctctttttgttaaaataaattttctttttaaaaatctgataaatggcaaatgttctatgtacatacatacatacttgtgctcaatttgttgatttttcagattcattttccaatctttcagttcctcaaagtgatttgacatttttaaatcaaatggtaaatttacatttaaaagctattatttctaattaacactatttgtgattttatggataaattaaggctcgaaatgctgagaaggcaatgacggcattggcccgatggcgccgaatgaaagaacaggaggagaagggaccgatcgccaaacggccgaacgacgttcgcgagtgcaaaaagttgggcgacgctgaacgatttcgtcgcgaattgatccatgacatttcgaaaagaataacgcgaattcacgtgccgaatttgggaactaacaataagtatttacacaaactattgcctcatgatttttagaacccgcgacttggcgagttcaaaatcaaagacctcaacgaccaaattaaccgactgttgcggataaaattggcatgggaaggacgcattaaggagctcggcggagtctaccatcggtactgaataaaagaattgtaaaattcatacttaattttgctcggctgaatgatttctgaatttgttccgagtgacaaataaacaattcgtcttacaatcagacgaatcgcgccgcgggagttggaccggg

SEQ ID NO: 2655 - DNA, 2412 bp, Heterodera glycines
aaaagggaaatggtaaagcaaaagagtcaaaagacaagatcagaatgggaaaagccaagggtgatggcgaggaggtagagcaaagtgcgaagtcgagaaaaggcgagaagtgtaaccgccagaaaagtgaacattttgtcgagcatccttcattctttttatacggccaaacgggatgggcgggtccacagtgtctgggtgattggtggtaggcgggcaatgctgattggtgggccaggcggtgggtgggcgacagtatccggatgagagcaacgggtaacagatggacggacaacggcgagagttgggcaccatcgggccatgggggggatgaacagggccaagaacgcaagccaattcccgatttaatcagtgcaaatcgccaaaatgcatctggggattaatggaagaagcggaaatggtgggcagagcccacggattagcaatgaatatttataaaatgggacacaaattgggataatccccaaccaaaaaatgtgttttttggttttgttattttatttttgttttaatttctgtcggagacaaggttagccccaatttattgttacccatttgacagaatcccaatcactatcaattcctgtttatggtatattaaatgccacactttttaggaatgggttaaacgtggaccagaaatgaaccgcgagaaggagctaattgaggacatttaccgcgtgcaagcggttggcattttagtctatgttttaaaaaaaatttccattttaggactccgatgatgaagaaccaattccgatcaaagaatctgtggtgattggcgaggatggcaaagaaatgatcatcaaacacgtgatggttccatcgcagtccgaaattgaggagatgatagtcgagcggaagaagcagtatttgctggaaaaattcgcggattgaaccttttttatcttgttttttcgatatttatcttaagttatacaattaaaggattgaattaaatttgattttatcctaagtataatatacctataaaagttggcactttaaccaacacatattgagtcagacgcatttcatttatatttattcaaaaaactaattttacattttcataaattgacccaattccaatgcctgccgtaaaaggtacgtaaatgttgacgaacattgtggcaacttctgctgctcattccgcccacttaaggtgatggaatgcgcggattggccgttttcatcagcgacattcgaaattgcaaaagcaaagaggcggaattgaagcgcatcaacaaggaattagccaacatccgatcgaaattcaaaggtatttagaaacattcaattttgataatttataatttagtccatcaatgtccaaaaatattgtttttaggtgacaaaactttggacggctaccaaaagaagaaatacgtgtgcaaattgctattcatctttctgctaggccatgacatcgattttggccacatggaagcggtcaatttgctgtcctccaacaaatacacggaaaaacaaattgcaagtttccccatccaataaatattgcgatgatttatacgaaatttcgtcaaaaatttctggaaatttcactcaacgtctttgcaactttacagggttatttgttcatttccgtgctgatcaatcttaattccgacttgatgaaactgatcatccaatccatcaaaaatgacttacaatcgcgtaaccccgtccacgtcaatttggcactccaatgcatcgccaatattggctcccgcgacatgtgcgaagcgttcgcccacgacttgcccaaactgttgacttctgggtaaaattttattctccaatttgctcgctccgatctttccaaatgcttgtcccattctttgtcagtgatacgatggattttgtaaagcaaagtgcggccctttgtctgctcaaattatttcgcacctccggcgacgtaattccgcccagcgaatattctattcgaattgtgcatttgctgaacgattctcatttggttggcttttaagcttattgttagcttttaaaaatccatttttgttttcctttagggcgttgtgacagcggccgcttcgctaatcgatgcattgtccaaaaaatggcccgatgagtacaaaggctgcgtttcgttggccatttccaggctgagcagagtcgtcctccccccttttgactccctttccatcagtcttcccattttcagattgttacatcgacttacactgatctccaagtgcttaccattcattaatggactgacagcttatttaattctattctttttatttatgaatttttcatcccatgccaattacattttacactttccccaaggattacacatattacttcgtgtccgccccgtggcaatgtgtcaaactgcttcatctgctgcagaattacccgcct

SEQ ID NO: 2656 - DNA, 4011 bp, Heterodera glycines
cccgtggccttgtgtcaaactgcttcatctgctgcagattacccgcctccggaagaccccggaaaccgcgcgcgactgctcgaatgtttggagggcattctgaacaaagcgcaggacgcgcccaagtcgaagaaagtgcagcatgccaatgcgaaaaacgccgtgcttttcgaggccatcgcactgatcattcactacgacagcgagccgggactgctggtgcgggcatgcaaccaattgggcacatttctgtcccatcgggagaccaatctgaggtgaggagcggtcaaacggctaatttatcgcattttgcttttatgttggcatcttttgcttaggtatttggccctcgagtccatgtgtttgttggcaacctccgaattttcgcatgacgcagtcaagaagcaccaggagaccattatcaactcgttgaaaaatgaaaaggatgtcagtgtacgacagcgggccattgtaatcaccaaactgttcatcgattaaaacatttttccaccgactacaggatcttttgtacgcgatgtgcgaccgttccaacgccgaaaatattgtggcggaaatgctcacttatttggagacggcggactacgccatccgcgaagagatggtgctgaaagtggccatcctggcggagaagtacgcctccgactacacttggtacgtggatgtcattctgaagctgatccgcatggcgggcgattacgtgtcggacgaagtttggtaccgagtcattcaggtcagttcctggcttttcctcaatttggattgttttctttgtattattcaaattgttttctcttttcctggcttagattgtcgtgaatcgggaggacgtgcaagggtatgccgccaaaacggtgttcgaagcactccaacagccaacttgccatgaaaatatggtcaaagtgggcggatacgtcctcggcgagttcggcaatctcattgctggagacccgcgatccaggcacaaacaaatatttttacatttgtacttgtattgatgcttgtgttttgatttatatttgtttatattgatgcttatgtgccatttgctcgctcccttttcccagtgacaatctctccccgccttttcagtccgatggttcagttcgacattttgcacagcaaataccatttgtgcagcatcaccactcgctgcatactgttgaccacctatgtgaagttatgcaaccttttccccgagataaagccgcacattcaggcacattattattccttttgatgcaataactatttcataattaatttattttttgtgcttcatcaggagattgtgttgcgggctgaccacaacctgaagaacccggacgccgagttgcagcagagggcggtggagtatttgcagctgagcaaagtgacgtcgccggatgtgttggcaacggtgagaaaggaacgggcgaatggacgagaatattaatgggcatttgccatcaatttggtaccattttctacagatactcgaagaaatgccccaatttgcggagaaagaaagcagtcttttggccaagctgaagaagtccaagccccaagctgaggagacggacacccaacagatcgaaaagaaacaaaggccatccgccgtaatgtctccgcaaaaaccatccgcggttcgttgagacattgctgttgtaactgttttcatgtttaaattttgtacgtctgttttttctaaaggagtcatcgccagcgacttccactgccaccaaactcgtggacctcagcggtgtcggcaccactggcgacagtttggacaattcgatgaccaacggcggcggggagacggcgaccaatgcattcagtcagctgaacgacctttttgccatgattcagcctccaaaaacgaatggaatcgccgcttcgtccgccgctggcggtgcttcggccgacggaatggcggcgacagaaattgggccaatttggaataaaaatgactatacaaagtgaattcccaaacaatttaaaaaagatcattagaaaataccaattataaggttcgttatgaagtccaacggtgtgctgtacgaagacgaaaccattcaaatcggatgcaaaatggaaaagcgtgccaatttggcacggctgggcatattctacgggaacaagacaaatttcaaattcagcaactttcaaacgacagtcacttgtcctgggatgctcgcagatgaaattctttgtcaagttgctctttttcagattaatttttctattttttcctcacactctctttcctcttctcatgcactcatttttctcccccccccctttttccccctttcttttcactattctcactctctctcttttctctccctctttttttcttacccccattccttctcttctcttccacccaccctctctatcttttacagccccctttctccttttccctcttttctcctctcactctctcctctcccttctcttctttcttcccactttctcaaactctctctatctatctttccccccccccctctctctccccgttttctcttctttactctctctctctctctctacatcaaatttccaggcaaaagctgttgacccggacattgacgccggttcccaagtgcagcagctgatcaatgtcatttgtcttcagtttttcactgcccctccaattttcaatgtttctttcacattttcgtgagtttcttctcttacattgtttttctttttattttctctttttgattttcagtgcccgcgatggctctcctcaacaattttcgcgcagtttttaccttcccgtttttatcagcaaatttttcgaaccctccgacatgtcatccgaacaattctttgcacgttggaagcaactgagcctgtactactgcactcttacaaaaaaataataattttttttttcaggccgtcccaagaatgtcagaaaatttttgcaacgattaatccaattgacagtgaccaaattcggatatcggtgcatttatacatttttgaaataaaaattgggcctcacaatgctatagacctggaattttttaaagaaccggggatggattttgaattgacctgtctgtctttcatgtctaataaccgtttgaattccagcaaatccctgaaattacctaaataattttggaataaatataaaatttagctcgcaaatttgggcgcacaaattctgcaaaatgttgacccgaaccctgaaaattttgtctgtgctggtattttacaaacgcaggctgcgcaaatcggctgtttgatccgcttggaaccgaacaaacagaccaaggtggtctatccgttttatttattaattaatgactccgtttttttgctcacaatcagatgttccgcttgaccattcggagcagtcgggagggagtcgcggcgacactttgcgagctgatgggtgggaatttctgatgagagacgcctctcaaaacgaaaccttctgaattttcataactgatttgtcaaaacaacccaatacaataatagcaaatctgtgttgtgttttctctgtttttcattcctaattacctaattaattattttcctcactgcaatctcatccccatttaaatcatcaatttttattgtctatcattggtcgtaagacagcacaattgaaatgccattacccaaatttagtcgttggacattttttagtaaatgaaaataattatttaaaaactgtttgtggcaagcgtttttctcactgattctgatcggcgacgatattttgggtgatcgtgggaaagagaaactcctccctatattagaattggtagaaatgttttttgtgtgtgaaattcacttttggaatcggtgaatcatttaaattaccgagcccaaatgtaaaatgtatgaattagcttgtcattataaatttaggttatgtacagtttgtctaaaaaccataatttgtgaaattttatcttacaaatgcgcaaaatgtcagtggggagtttctgatcattttcacggcgattcaatttgggc

SEQ ID NO: 2657 - DNA, 794 bp, Heterodera glycines
agacaagaaaatcccggcaaaatattatgccggaaaatttaatttttggcatttttgctaaaaaaaaattttatgctggaaaatttaaattttgtcgaaaaaaacaatttgaaatgggaaccgcgcgggttgaactcggcacggcgcgccattattttttttttgccatatcaggcattattaatctcacaaaagttcaaaaaaaaataattaaatttgtaattgattaattcgaccgtgccgaaatgacccgaacccctgaaatcgcttaaatttttattgatcaatttacccttttaatttaaatctgtataaatttttagaaaagttaggacttaaatattttattttaaacatatatttaattgtaaaaagttttctgaatttaatttggtgtttaaaaaaaaataaaaaattagagaaaaaatttgtaaatttttttgttgtcttcaatttattggtataataatataaagaagccgtagtataataaggtttttcgtccattccgatcactcaaacacaacaaaatcaccccggttgatcaatcaatgatgagaatttccaaatcagtatagctctctctctctcactttctctctgatcagtccttgatcactctctgatcagtgtgcgtccactggggctgccgttttggtcgtgtgatgaatgccgaaatgccctcctgcgcgtcgcgccacttcaaattgtcacacattgttgccgtcgcctgccttaaagtcgggaaaatattttaaaaaatacaaaatttctgaaaattttacataaatttg

SEQ ID NO: 2658 - DNA, 5162 bp, Heterodera glycines
  misc_feature (1354)..(1354): n is a, c, g, or t
  misc_feature (1358)..(1358): n is a, c, g, or t
  misc_feature (1366)..(1366): n is a, c, g, or t
  misc_feature (1371)..(1371): n is a, c, g, or t
  misc_feature (1376)..(1376): n is a, c, g, or t
  misc_feature (1380)..(1380): n is a, c, g, or t
  misc_feature (1387)..(1387): n is a, c, g, or t
  misc_feature (1392)..(1392): n is a, c, g, or t
  misc_feature (1403)..(1404): n is a, c, g, or t
  misc_feature (1406)..(1407): n is a, c, g, or t
  misc_feature (1416)..(1416): n is a, c, g, or t
  misc_feature (1418)..(1418): n is a, c, g, or t
  misc_feature (1424)..(1425): n is a, c, g, or t
  misc_feature (1430)..(1430): n is a, c, g, or t
  misc_feature (1434)..(1436): n is a, c, g, or t
  misc_feature (1438)..(1438): n is a, c, g, or t
  misc_feature (1449)..(1450): n is a, c, g, or t
  misc_feature (1455)..(1455): n is a, c, g, or t
  misc_feature (1462)..(1462): n is a, c, g, or t
  misc_feature (1465)..(1465): n is a, c, g, or t
  misc_feature (1474)..(1474): n is a, c, g, or t
  misc_feature (1482)..(1482): n is a, c, g, or t
  misc_feature (1496)..(1496): n is a, c, g, or t
  misc_feature (1498)..(1500): n is a, c, g, or t
  misc_feature (1506)..(1506): n is a, c, g, or t
  misc_feature (1508)..(1508): n is a, c, g, or t
  misc_feature (1523)..(1523): n is a, c, g, or t
  misc_feature (1534)..(1534): n is a, c, g, or t
  misc_feature (1544)..(1544): n is a, c, g, or t
  misc_feature (1555)..(1555): n is a, c, g, or t
  misc_feature (1590)..(1590): n is a, c, g, or t
  misc_feature (1597)..(1598): n is a, c, g, or t
  misc_feature (1610)..(1611): n is a, c, g, or t
  misc_feature (1618)..(1618): n is a, c, g, or t
  misc_feature (1629)..(1630): n is a, c, g, or t
  misc_feature (1634)..(1634): n is a, c, g, or t
  misc_feature (1640)..(1640): n is a, c, g, or t
  misc_feature (1653)..(1656): n is a, c, g, or t
  misc_feature (1664)..(1665): n is a, c, g, or t
  misc_feature (1667)..(1667): n is a, c, g, or t
  misc_feature (1672)..(1674): n is a, c, g, or t
  misc_feature (1677)..(1677): n is a, c, g, or t
atttatataaaggaaaacattttgaaatttttgttatattatcaagcgaatttcattcaaaaaggggattttttctaaagcgtaaaatgccgaaaaatgaaagatattgtaatgccaaggcgcaaaaatgtggggaaataaagaggaaagatgggcattttcagtcgtgcaaaatggcgcagtcgttaaaaaaagcgttggattgttcaccctataaaataggcgcaagttcgagtccgctcggacgcacggctttctttttttgtgaatatttttgattttcaatattaaaaaatgacatcaatttttgtaaaaaaaaaatgaaatttattaaaatttttttaataattttaggaaatcttatttggtaaaaaatgtaaatttcaaaaatgaaatcataaaaaaacgaaattcatttcgtaaaaaaaatttagatttcttttcagcgattttttaaaatttcataatgaattatcaaatttttctttcctacgtaaatcgttgaaaaaaattaaaaaaacttttttttcaaattttctaaattttctttcttgaaaaatagatcgtggttttaaaaattaaaaaaaaaaatttccgggggagtggagctgctgctcccgattttctcaccccataaccctcccatttttccataaattttccacccccttaaccctcaattgtgagaaaattcaatgtttttttcccccaaaattttcgtcgttcgacctgtacgcgtcgcgctcgttctgctccagctgtgcgtagaagaacgccttgcccatgccgaccactgcgcgactgttgtcacaaatgtgttgcgcggcgccgagcgtctcgcgccggagctccgcggtgccgacgaggcgtgacacgagaccaaatttgtgcgcaactgtggaaaaaaattttttttttttaattcgaacggggaaaggcggcggagccgaataaaacatcgccaaaaaaatgaaaaaatttcaaaaatttttagttacctcttgcttaattccaaaaataaataaaaattaagtaataatgaaattcaaggaaatgaaaaaaaaaatttaattgtacgtttttttctggaaaattcagcaaatttttcctgaattttttgtttttttgtaaaagaatttatttcaaaaaaacagtttttcttaattgtggaagaatatacagaaaatgttaagaataccaaaattaatgaagattgaacccatggaaaactgaaaatggacaaagcaaaaaaaaaattaatgaaaaaaatgaaagaattttggcaaaaaaatccaaaaaatggaccgaaaacatttgattaaatacaaaaattaacaataaataaaactcactnttancttccaanaaacntccantcancaccatntcaancccaatttttnntnncacatttcncnacaacnnaaccnccgnnntnccacaaaacanncccancttaacnctncaaaaacanaaaaaatnaaaaaaaataattntnnnccaaancnactttaaacaaaaanaaaaaaaattnctaacttttnaacaaaatttnattccccaaaaatttttttttccaaattttcttanaaaattnnccacatttttannaattaantcccatttctnnactnattttnactttaataaatnnnnccattttnnanatttnnnttnaataaaaaaaatatttttgtggtccaactgtgccaataggcggcaacatggaaaaattaaatttttgagattttcaacgaaattcattaaaaaaatggcatactgtttaaaaatttaaccattttcgttaaagaaattttgtcggggaaatccggagacttttttttttttactcatcatgccaaaaactgtttttcaagtattatttttcgaaattttaaacccctgggagaagaataagaaatttggtagccgcttttaagccaaaaaaaaaaaagttaaaaagtaacccattttccattttatggagtcaaattttcaaaaaatatgatcaaatgatggtccgtcccatccgactgtgccccattaggcaccgtcaagaaatttttttttttttaattttaatgaatttccccctcccttttccctgggggtcactcacccggcgacattaaagctggcacgaccggacgcaatgacaatgtcacaggctgcgaccagctgcgtgccggccgcagcgacgaggccgtcaacctcggctaaacaaaaaaaaaattaaaaaaaaaaaattgtggaccaccctccgccggtgggcctcgaaccatgaaccccgaggggtcaaaatgtgaacggagccaccaacaaattgtcatgggtaaagtgttaaagggcaatcaagaatttacaatatcgctcgtatcctttcgtagcgataaatcggagggccaaaaaaaaaaatttttttttgaaccgacccaaaaaagtagaggattatcgcaatccgggcagaaaaatggcttgttaaattacaaaaataaaatgacaaatgaaaaatttagaaaacaatgcattgaaaagtgaaatgcgaataaaaaaatttttaaattagaaaaattgcagaaaaacacatctgagtcgaaagtttatggctccgaaacgataattcgaaagttttttttttgaataaacctgatgaattccacatttaaaaatgagtgtttggctcgactctgatatattttggtagggatggggtccggatttcgagcgtcggttttacaaattaaaaaaaatgaaacaaaaaatcacaaaccgatgacgggcaattgcatttgtcgaatgaatgtcatcagttccaaacatttgttgaacactttgcggtgcatttctgtgccggattcggccgtctaaaatgaaattaaaagtaaaatttaaaaagggataaataaaaataaatgttcggttcagtatttttttttttggaaaaaatctcggtccgtaattctgccaaacttcgaatattggcatgactgagcgccaaaacttgaaagaggacagtttttggggtataagtcctttcttttacttcggtttgaaagcatttgttaagcattcgatagccctaagttttctcaatttgcctgcaaaatttcgaaaaaaaattaccaaaaaattgcttttccgaagctttttgggtcataacttttttgatattgtaatgaatttcatgaaattttgcaaggaaatagagaattcttaggcctatctgatgctatcaaattcattcaattcggagaaatatgaacggaattataccccaaaaaccggggccgacatccagttgaccgaccccccattagtgccaacttttccctcgcccatcaagtaaaatttgaatgaaaaccgtgccaattccggtagatggtgtccaccggagtaggcaggccccgaggcggcgaggatcaccacccggacctccggccgagcgtccaactcgcgcagtgtgtcgtgcaacatttccatggcggacaaggacagcgaattgacccgcttgtcgtccataacctgccaaaaatgaaaaacatgcgcttcataccgagccgagacagcctactccctagtttaaagaaaaaaactaaaaaaaaaaattttttttttagttcggaggggaatattggggcggcgaaaactgatgaacagggagtgagtgccgccgaggaaaattttgatttgagtgacattttttgtaaaattcaataatttttagagagtcggcaaggaaaattttgaaatttgagtgccattttttgtaaaattcaataatttttagagtcggcaaggaaaattttgaaatttgagtgccattttttgtaaaattcaataattttttagagtcggcgatgggaaacgcgctaaggcttaggctaggcctaagctttaagctcaggcgttttttatatatattagttgtacgagttgccattgactgactcaccgacggcaccgaacaaaaaaaaaaaaacccccattactgactgaccagccttgccacccggttgcccaggtgccattccgtctttgtcgtcgacggttgttgctgttcaacttgttgatgttggtgttgtgcagcagcacttgcagttggttgttttgttgctgctccatccgttgcgaaggcggcggtggcacgaaacaatggacaaaactttgatgatgataatgcaaataatgctggacgacgaaaacggtgcagcaattggtggccaaatgcttgactcattttttgacaaaaaaatgtttgttatatttttgaaaaattagggcaaattgtggttgtttatttaaatggaggacgccaaaaaagtgccaaaactttgatggattaaaaaaaatgaaatggggatgtagataaattggcgctatttacaaagaggtgcattttgaaacaaaaggggggacccttttgttttgcaaaattttttaagataaaaaaccatgataattttttatccggggttttaaaggtcgctaatcacgaatctgacatgtattttgactaatttctaatccctaacccgaactcgaataaaaatcggaattttgaatttttcaaattatgatttgttgttcgaatctacacccggatatccgcatacttgatgcgaacaatttgatggatctcaagtttcgcgtccattataaatgtattaatataaatcttgaatctatcttgacaaatatattacagggctcatatccagggacctatttcaattcggaccaggtcctcgacttgatttttgcgaaatggactgcaaaaatcctgtttcaattaaatcgaaaaaatcgagtgtcgcacttgattttggcatcaagtcctatttttttgttgcaattaatcaagtcgaggacttgatcaccaagtcaaatgtaaaatcgactgccacattcgattttttaatttttgtttcaattcaaataacagtcatggtgaatgaaaaaagttttcaaatttatcgagagaaaagttaaataaatcgaataaaatttcaaggttgtaagtcgcaataacatgtttatctacatcggtagagcaatttgcgttgcatccggtattgcaaatcgccccttctcacataaaaatcgatagcctaaaacgaataattaatccgtttcttctcatttggtgcgaacaaaacaccttt

SEQ ID NO: 2659 - DNA, 3177 bp, Heterodera glycines
ggaatgcattggcaaactgaaaactctgttttcagacacaaaatcaatttttgtgcgccgttttgagtgttttcagctggcatgtgcgccgactcaaaacgtgctggactttggcgcgattgtcaacgcccgttgcgagcgagccgaaatgacgctgtcgaaagaggaagtcaagtgcatgatcttcatttcaggtttgacagacgcacataaggacttgcggcaggagtgcctccggcagttggaaaaggcaagagccgcaacgccgcctcaggacattaagctggaaaagcttctcgaggagtgccgcgccatcctgtcgctcaaaaactcgtccgctgcgctcgcaaatccaggccaagtccatgcaatttcaacccgaccacaaaaacttggggatgggtcttcaaaaaagcattccaaacccaacaattttcgtcctagccaaccaaattcgggaaattcaaatgttaccaaaacatttacaggcaaatatcaacattctcaggcaccagttagtcaaaagtgtaagcggtgtggtcaagcacacgcggtgcgagactgtttatttcctgtggacgtcaaatgttttggatgtcgaaagcaagggcacacgagaaatatttgccccaattcagctcatccacgtgttcaatcacacgttgtggtttcgactttcagtgtgaatggtgcgaccaaagaatggatatggattccattacaagtcaatggccaccagatcaaacttgcagccgattcgtgttcacatttgtcgatcatacagcttccggtttggcaaagtttaggcgaaccgaggttggaaaaagttggtaaattagtgggttccttttcgggccacaaattgaagttgttgggaagtttcaagtgtgacgttctgttcagaggagtcacaatgcggcttgaactttcagtggcagacaccgaagcgccgagcatcatgggattggattggatcatccctttcgagcgtgccacccaacagccaattgccacgactttggagcagcagtcgctcattgtcaacagtgtgcaaccaacaaatgatccggtcaaattggaagggcaaatcaaggcttccttcccgaaggtgtttcaacctggcctcggacattgtgtgaagacgaaggccacgctgcatttgaagcaaaatgtgaagccagtgttctgccgtgcgcgacctgtgccgcatggagtccaagcagcagtcgacgaagaattggaccgacttttggactcgggagtgctgaagcccattgatttttcgcgctgggcagctcccgttttggcagttcgtaagaaaagtggtaatgtgcggatttgcattgacttttctacgggactaaacgatgcgctggagttgaacaggcatccccttccgcggaccgaagacatttttcatgctctgcgtggagccaaagtgttttcgcagcttgatttgcgtgatgcttatctgcaggtcgaactggacgaaagttcaaagcagttagtcggcatcaacacgcaccgcggactttttcaatatcagcgtcttccttttggcataaaatcggccccgtctatttttcagaaagcgatggaccaattgacgtccggtattccaggcgtgtttgcctatttggacgacatcatcattgcttcggccgatcactcgcagcatgttgctgctctcattgaactcttttcccgaattcaggactatggatttcgagttcaattggacaagtgccactttttgaaggctgaattgaagtttctcggacacgttgtctcgtccgatggtctgaagcccgatcccgctcgatccgatgccatccgtaatatgccgtcaccgcatgacattggcactttgcgctctttcctgggtgcgctcaactattacggtcggtttgtcaaggaaatgcgcgatttgcgtgcacctttggatctgctcttgaagaaggacactccttggttttggggtcctgatcagcagaaggcttttgatcaggccaaacaggttcttcaatcggatttgttgctgacgcagtatgatccgagtttgccgatcattgtcgctgcggatgccagccaatgtggaatcggagctacaatcagccatgtttttccaaacggagtggagcgcgtcatcgagcacgccagtcgaacgctcactcccgctgaacgaaattacgcccaaattgaacgtgaagctttgtctctgattttcgcggttcaaaaatttcacaggatgatttacggtcgtaattttactctgttaacggatcataagcctctcttggctatattcggtaataaaaatgggatcccgatctacacggcttcccgattgcagcgttgggccctaattttgtccaattatgattttacaataaaatatgttaaatctgcaaattttggacaggccgacgttttgtctcgattgatttctgagcaccggacagacgaagaagtcattgtcgcccacacatcggacaacgacgtggacagcactgaagaagtcgaatatgctcttcttgtcaacttggagcagctgccagtcgatgcaaaagaagtgagcgaactgacgacttcggacgatttgttgcagcaggtggcacaattcgtacgttccgggtggccaaacatgttcaattttgacaggaaaccgagtcattgttcctgcgccgcttcgtcaacgtgtactcaaagactttgcactttgctcatcctggcattgtgcgaatgaaggagtcgtacaaaacagaagaggattgttgtcaggagcttttaataatgttgttgcactgcacacggcaaaacagacaacagcccaaagcaaacagcaaaacacaaaacaatgccgaagataatttattaattccaaataaaatagggcgaggacaatcaatagggataactgacgaccgcataaaactaacaactaacacttcacaaaaatcacaaacaaaaatgaaacaaattaaataacaaaacgccaaatatattttaaaatcacaatattagcacatcctcgccctctaagaagcgatgtcctcagcgctttgggctcatcggtagtgcattcggcgttgaaaggggcggcaagggtgtcagcagtggatcggttcggcatgtagtagcgttgcaaggtcagacctgtaaaaacaacggacaaaa

SEQ ID NO: 2660 - DNA, 11109 bp, Heterodera glycines
  misc_feature (936)..(936): n is a, c, g, or t
  misc_feature (11027)..(11027): n is a, c, g, or t
acatcagacagttggcacgtgtgcgaagcgagaggggtgcgcgaaaactagtgcagcagtcaggcggatcactttttgcccctttgttggcccccattctgattgaggctgcccgatacctgctttcgcgcagcaataatggccaataaacattctgctgccgtacgagcactacaaggggctggttgcagcgagggagacaaagaatgacgacgatgacaacattgctgagcggacaaacttgggctttgtcaaacgataagtgaccgctgcagtacagaagcggaagggaaacgtcagcgaacggaacgcatgtacaaccagcagctgcgccggtacctaaagatgcgcaaggagcataaggagcggcccgtccgggtacagctcagcaacggcgctcaactgctaaataaaacagtggagacgggtgtgcaggtacggcctggtccggacgaaccgaaggacaagtccgtgatggttaccgacgaagatgaagaggaagaaattgaagtgccaaagtttttaaccccaacaagccagacgcagggaagcagccgatcacccaggaccaataagaaagcagcaaaacagcaaaaattgatcgagaagaaggaccacctgttggccatcattatgtctgatccgcagagattcggcgcaactgaccgtgtgaaaatcattaacccaaagacgggccgagagttcattgactcggacctggcctggtcaattgaacgcctggtggaccctcgcccggagaatgccccttcgccacgcggaaccaaagagttgaagaggaaactcgcacagaatccgcttgccagtagcctactcaatcgactgtttgttgggtctgggttcgtcggacaagtcaaacaaagcgggcgttttattccctcaaaatggacaagaaaataaacaaaatatacaccgacncggccaatccgggcgggtatgcgggtgcgagtgccctgtacgcggcggtgaaggagaagcacccaaagttaaagcgtaccgagtttgaggactttttgcagaggaacaccacctacacgttgttcaagccaaagagagacaagttccgacgcctacgcactgtgcctgcgggttttatgactggtgagattttgtgcggcctttttacagtttattcacgggttcagatgttcaggcggacttggccgatttccaagccctttcgcgcaagaacagcggctaccggtacctgctgttggctgtggatgttctatcgaggcgaatgttcggcacccccgtaaagagtaaacgaccgacggacatgaaaagggcttttgaggagctatttgagcaaatgccaagggtgcctgacacactgtacaccgatcggggactggaatttgtggcaaacccgctgaaggagttttacgctgataagggcattcaaaagtttgagaccagttcaaagaagaaggccgccatggcggagcgggccatccgcaccgtaaagactcggctgtacaaatatttttccgccaacaacacgtcggtgtgggtggatgtactgccaaagtttttgagtgctatcaacaactcggtgtgccgcgcgaccggacttagacccaacgaaatcagcgacaccaatgcgagggaggtgtggaagagggtgtacggcgaaggactcgcacaattggacaagacaccaaagatcagagccggggaagcggtcagaattcccgagcctaagcacattttcgaaaagggtactgtaattcacacattttccgatcaatttattttaatttttaaggctatatccccaattactctgatcacgtgtacactgtggatgagacccgctcaaccaacccccagcactatttgctcaaagactattatggcacaaagttgaagagaaaattttatttgccagaattaacaaaagtacaagtggatgaaaacacaatgtatcgaattgaaaagaaatacaaagaacgagtgagagatggaaaaagagaagtattggtgaaattcattggatttcctgaaaaatattgggtgaaaaatgatgaaataaatgaataaaaatattacaaatttaatgaaaattaaaaaataaaaacaattatggcataatgtcggggtcgttcagctcctcttctgtgaacatgttcacattgaggtctgggttgaacagacaggtgcaagcgccagggcagttccacttacaccactcttcgtcgctgtacccaaagggcaccaccttcaacccgtgatccctgaccacccccttattcacggtcgggttgaactgcttgaccaaggggacggtgaaaatctctcccttcttggtgatccggaagttcttcgttgggtagttgaagcggacgttgttgtccggctgtcccagcttgttctgcaccatctccttcatcttctcgaaggtgatgcgctcgcaggcatccgagtccagggtgatcccgcgcagcttcagcttgtactcgtcctcccccgttgcgttgttgcgcagccacaatccgtacgccttgggccccgctaaacaaaaaatttccatttattttgatctatttttaatgagtcttaccacaaatgaattccataatcgtgtggttcgggtactcgtcggcgagctccccgagctgctcaccacccggaagtgggtcccccagccgcgtcaagtagtcgtaaaagatgctgtccgtgtcctgattttaaaaaattacttcacattttcattttattttttgaattttaccatgtagagaatgcgggtgtcgtagcgctctacacctggtgcagggccatacacctttttcagcgattccagcaagtggattcgcgcagcagaggtggtccatagggcaatggccacctgagaaaatttcaattgtctttttttaaatattttaaaacttttcttacattgcttgtgctgtgctccaccacatgctcatctttggccttgtagcagaccatccagaacttttccgtcagctgatcaatgctgctgacctcaatcttcgagtcgttgagcagtttggccagctcggcatggcactcgacgatttcggttttggtaagccggtttctgtatgatttgtattttttcataattcttaaccaaaattttaccgaagtgcgaaccggccccacagcgagtttaaacacaacttggacaggtagcggagcccgggattgtgcttgatccggtcagcctccagatgaacgtgggccttttgtttggccttgtcgctgtggtcctgcttgcgccgttccgactcctcctcactgatgcccgcctccgtacaagacgctggatatccgcttgcttaaatttttgttaatgatttttattaattttttttttaaattttaccttcaaatttcattttgagaaacttcagcaggtacgagtggaacagcccattgctccaatcgcacgccagaggccagatataggcacggtacacatgcgtcaccttgtaccacgagcggagagcggcttccagctcaatgtgtgtgactgttgtcgaaaagcctattaagaaaaaatatttgcttaattacaagcttcaaactcacccctttcagagtcctcaaaatgatcgcaattgtactcggggtcgatcaagccgcgcgggtacatttcggaacacgtccggcagaggggaaacagcgtgcggttgttgagccggtacggaaggaccgggatatcgtagtggcagtggcggggcggcactacgaagcacttgatgatgccctcaaggcggatgccgtcgtcgccaacaacgtcctctggacgcctccattccacgtccttgtcaaactgcaccacggtcgggtggccaaccggataattggtgaacatattccttaaagtgccaaagatttttcaactattcatttttttccgacatttcttaccgcgacggataaagactgttaaagtccttcactttgatcgtacggctcttccagtcgcccgtctcagggttgatcaccgaagcgcccaaatattcgggccctgttcgacctgtgcccaaaattattttgcaaatttaaacccaaaaataccgccaaagaaggcgtcgtggaagtcaattggtccggagtccgggcagttgtcgaagtacgccttcatggctgggttgtcctccagcattgcgttcaggtggcactcccagatgatttccacctcgaactcccgcgcaatgtcccgggttcgcttggcatcacgggccctgagggccccggccgtttctcctccgcccacaatcgccgcatcatcgggaaagcagcttgggcatccatgccaatagcaccttttgaatgggtaaattggcacatttttcgaattctttccttacccattgacctcgatggccaagtttttgtcctcatcagggcgctccatcatcccgtccaagctgtagttgccgaatttgaactcccctccagggctttcgacatggcgcaggactcggccattctcccgcaattcttcttcggcacgccactgagagtcgacaaaatgtaaaattaaaataatttggatacaccttcaaatatttccgggcgatggagctctgtttgcctcacttctcgtatcccaggtgaggaataatggcgacacgttctttgtcgtggtgagccaactgcacccaatacttcatgcagccggacgggatggtgaccgaatccgtgatgtcatgccgagtctcggacaagaacagctgccgcatctttaccataccatgggccaggatttggacatcttcaattttttttgttatttttgcatgtttttttttcaaaaattgtacctgtcttgcagtagtccgcgatgacttcactgagctcaaaaccagtttcccggttctcgtcgtaccactgctcaaactttgcgcgctctgccgggaagagtccacctgggtaataattctcaatcggtggcagggtgtccaacacagtgccataattttccgcctaagattgtattaatttttatttaatttttttataaattcctcttaccttattgaatttgtgtggaaaatatttcttgttttccacgccctcaatttctaggccaaacgtcttgacaaaattggcaagttttattgggatcaacttgtaactaaagtgatcaaaaattttaaaagatttaatattcaaaatatttacctgtcccggaaaacggtggttgtgtagactcctgttttgcgggccttcatttccaggagatggttcacctggcggatgagttcagggcggacacccatgcgcagcatttcaccataaatcagcacatgatcgtagcgggaacctttaaattttatttcttccaagtttttttaaataattccaaaattaccggcgtgggcgtacgcgtatgttgtcaccgactccggcttctccccggcttcttcgtaccccagcatccagttgttctcggcgtcctcatctacggcatcctcttcttcttcgcattccatagcctcgccgtcggtgttttcggcattcttcctttttctgcgcttcttcgcaccgggctccatgccgaggacttccgtttcgaagttcagcaaccacttggtgaaggctgccagtgggtcttcgaccaccttgcggcattccacgtccgtgtgccagaattcgaacggggaccaggcataagttcggaatcggccacaaagcgcgcaggccttttccaattcctgatcccaaacgcccttttcaatgcagcgggtgcatgtgacatgggcaaagcagaagttgacctttgaatttttcataatttgctaaagttgaaaaaacaaaatacctgatgcttgaaccgcatgagttgcgggtcaggcttgaagtccgttgtgcactcaaagtcaaagaacacaaagcgcttctccttcttaactttgggccggtagggaatgtagcagtcgcggggggcgtggaagccaaggcaaatcttgcagaatttgtggccgcagacatgcccctttttcttgtcttgatcctgtgatatttattattttattttacgaatcttaaaatacaaggcctaccgccattcggtaaatcacaccacagtcaacacattttttcgagctcatgcagattgattttcccacaatttcctcttcgttgtcacgtttgacccggcagtttgtgcatttggcatggtgttcatagcaatcacgacttttaaatgtctaaacaaaaaaattctttaaacgaaactcaaataactttactttattgcaccccaagcaggtctgaaaaaagttgtcattgccttggacgcagtttcctcgaaaggcagacccaacacgcaggcagttgtggcatttccatttgcattttgctgtgtgttgcgtttgttgatgaaatggcatctcacactgtaacatatttatttaattacagtataaaatatattattatagatactccaaaacaatagttgcgggcactgaacagttttccaacatttttaaccgggtcgtaatgcccgtcaccgccgttttcgccatcgataaaaagaacgcaaagctcatttttatactgttccacagttgatttccacgaaggcttcatttttccaaacgtctcaaagcagaaaagccgaaacattccgggatggagcacctcataatagtccttaatgataaatattacgaagaataaaataaattttgtgcctgaattatttctccatattcctctatggaatagaagggtaggtgcatgtcaatgttgcacccctggcccagagcctgcacgccttcaagctgttttctctcatccctcttatactcagagaagcgttgtcggggcaaaatgcatttcattcgcagcatttcaaacgcacggaagagacaaaggttgtcattggtctgcagcgcaaaagtagcaccatcggcaatacggtagtcgatgttgaagtcatttctcccttttccagccattttcggtttggcgcacttgctctcgattgccgtgatgtcaattacaaatggttcttcaaggagtgatggcctttccttcgctttgttgctttggtcgaccatttcaaaacgcgtcaggattttttctgttgccgagttgtccaactttttaaagtgtacagccacttcgtagtcaaggtgttttgacgtcagaaggaaaatgaagtggtccgcggatattttcattgatttggccccctcggaggcataagaaaggcacatggtgaataaattgcgcagaatgtcctccggaaaaacagcactaaacgttaggctcatcaaaaattgcccaataaaacggaacgctaaacaccattttaaaaaaatacctcaatcaatcaaagcacaacaaaaattttttttaaatataattttcatagataaattaaataataataattttatatgatgtattatttacaaccacacctttaaaacgtcccgcttccacctgtgtggcagagagacatgtaaagccatcgccgttgaacaattccgcctccaattcgcgggtaattgacggctccttctgggccttgcgctcattgttgtccgatggcacaacctgaaaatgtctcccaaaattagaaaagaattttagaaaaacatttcgtaaaaactaaccgagatcggaaggcgtttcataacctcatccaatggcggtgcttcgtccatcaattcggtgccgtcatccccaacaggggaatacggtccgtcgagggtagaggggagggaattgtcggaatattggctcattgttttctttcttaaatttaaaaaaaaagaaaattcaaccattgagtttagttaaaaatgtcaaagaaaatggccgatcaaaaaaaaatcgggcatgacccgtcccctgagcgatgttttgggccatttttggagagccaaaaacgcgcataggtcagcccctacacgtgtttttaaccttccggcccaaagccatcacattggagggcatacccaccaactatgactatcatagcaagcgattatggaaccgctcatggaactcaaagtgtgtggcactaccataccaaagtgcggaggtatggtgtaggcatctctatgtcgggtaattactcccttcacagagcattttcgccaacgcccacagcacatatgagttccgtcaacgcggattttaatccggggtgttgagtttgagcagctgcgcgttcgacactgctcagtgactcgcggtcctccgggccagccagtcccggttattctctcgctgtaccaatgcagcccgtaggcagggcacattagggctaggaaccgccacccccgctgctaggaacaggcacaccttcaccctcaaggccagcgagtgaagggcccccatccacaccagaccgactatctggttaggcttaaacatcgctgtgacacccggcgggctatgacggaaacatggtttcggtcagtcactgccgcagccctggataccagcggaataagccccgtggacagtgaacgcccgtgcccacccctctgggaagtaacccagtaccggggcaggactcctcggtttaaggatggcccccaggatatttgaaaaggcttaacaaatatcctaaaggggtttagtaccgagtaaaccaacaaaatgaaaaaatggggagagaaaggacagtgcaaagtacttgtgatcaaagaaaaatgaaaaaaaaacaagggaaaaatgaagaaaaagataaatttggcaataataaaattaattttaaaagaggaaaagaaaaaatttatagaaaaaatagtcaaaaatggaaataatttgaagttaaaaattttaaataggacaaacataatgccaagagtcgaaataaatttttaaatttgttaaaacagaaagccaagagtgaaaataattttaaatttgaaaaaaacagaatgccaagggttaaaataatttttaaatttggaaaaacagaatgccaagagtgaaaataatttttaaatttgaaaaaaacagaatgccaagggttaaaataatttttaaatttgaaaaaacagaatgccaagagtcaaaataattttttaaatttgaaaaaaaatgcaaagggttgaaataatttttaaatttgaaaaaaacagaatgccaagggttaaaataatttttaaatttgaaaaaacagaatgccaagagtcaaaataattttttaaattcgaaaaaaaaatgcaaagggttgaaataatttttaaatttgaaaaaaacagaacgccataatttaattttgaaaaaacagaatgccaagaattaaaataatttataaatttgagaaaacagaatgccaagaattgaaataaaagaaaaataatttttaaatttgaaaaaacagaatgccaaggattgaatatttattaaaatttaaaaaagagaatgccaaaaactggcaagaaataattgaggagttttggcacgaaaaggtgcgacaattggcaaatgaaaatgtgaaaaaagggggcaaaacaatgccaaaaatggaaggaaataattgaagaattttggcacaaaaaggtgcaataattggcaaataaaaatgtgaaaaaaagggggcaaaacaatgccaaaaatggaaggaaataattgaagaattttggcacaaaaaggtgcaataattggcaaataaaaatgtgaaaaaaagggggcaaataatgcaaaaaattgaggcaaaataaatgataagggattattgattggcttttccatccgtaaagtgaattaaattaaatgaaaatgaccaaatggacaaaaaatcaattagtaaattgtttattgtctgaaggtgtcagattacataataagcgtgcgggagtgtgggcggcactacaaagtacgcgacctattaaaaaatttgatttgtttatttggcaccttttcaacacccccgcccctccttaattgatttgtttatttgaccccctccccccttctcgccgcctgctctcgcccccctctcgccgctggtgacgtcaatttttccctttatgagagcaaattaatgtttatcatcaattgccaatgtggccgagtggttagtgcgtcagtctggccgcccccctggggttcggatccgcttggtgcgtggaatttttggagaattttaaatgaatttaaattcaacgtctttgaccttttaagacgtttaaaataatttagaattaaataaatttaattaaaataatttgcataaagtcgcgcagtcaaaaaagtcgcgcacccccctgcaataggtttgggtttgcaagaaaaactcgcgcaataggtttgggtttgcaaaaaaaagtcgcgcaataggttttggcttcagtactgaaaagtctggcgctcagatggcccgcgctcacttggcggcgctcaaatggctggcgctcagttggccatacacccctcccacacctatggggggctaccgtaatccggacaaaatggagtgggtaactactcagatggatgaaaaattttacaaatttgtgccatttccgttgcccgagcgtccgttgcccagaaaaatccgctttaaattccttaagattgagtaatttaaaatcagagttatggcaataaaagcatttattccattttcagttacatcgatcacttcgtcatcgcttttcttcgttcaaatcaacaaatttttgacaaaagaggcaccaatttagagttgtggatttattccgcacacagctcggatgaccagccgatttgggatgtttttgtgcgtgaaatatggccaatttttgcatcaaacattcgccacttgcgctttatcgatggtgatggtttggacaatttgcgtcgtcgcacttcgccgacaattctcactgatctcaaactgttgaattcaatctattcatttggtctgttgcctgatccaattagtgattttgacgggccaaatgcaactgctggctaagcgttgtacaaatggttgcaaactccgagaaaagatggccaacccaagcgattgcgttgcaaagattttaacaaacatgtggatattgattggngtcacaaatcaaggaggtgtggccataatttcggcaaatcactgatttttgatttgacggacaaacaacaaataaaaacaat

SEQ ID NO: 2661 - DNA, 1676 bp, Heterodera glycines
ccggaatattattttctgccgaaatggctggattttcctttttttgaggcctagaccttaattttaaggtctatgagaattttttcgttcgttgtaccttcccgtcttttggccattttttgcgaacattaattatttctcgcttggaatggcgtgtatttaaactcctaggattttcttaattcttttttaaatttccaccttctcaccccaagggcaaattacggcggaatggtgggcgccatatttttcttggaacattgtcacacattcatgcattgttgtccaagcttaaaaaattgagaattttgagaatttaacaaatttgaattgccttgggcacgtgcaaaatcttttgaaacgaaaaacagattgcctaacgaaacaaatttgttcatgatcggctcatccaacggatgctcaaattcgattgaaataattttctgtgatttttcggccacatttgaagaagagttgttgctggcagagtaaatatattcaaccatttcgaccaccgactcaatttttgacgtaaaaccagctaaaaatttttgcaacttttaaaatttaaaaataaattaaattccataagaagtaacaattagttacaaattactcaattagcaaaagttaattatttccaagatgcgttatgtatagaaattgggcactacaaaaaagataaatttttctggttattcaattaagaaaaattctgatgagtaacaatcaatcaatgagtcaaacaaaataaattaaataccgtttaagtctaacaaacatttataattacctaattagtaaaaaccaataagtttgcccggctgggcaattattattcgcatcccgaattgctcgagaaaattataataattcccagtgactcaagaattgacatactttcaaaatggaaccaactgaacccgtccaaagacggcaaatagcgtcgcaaatcggccccattaggccaacgtttgttgcccagtgaagaaagcagtgttcggctcccgttcagctcattaattaggcaaacctacggtgaaaataagcatttaatttattttttattatataatttaaatagaaatattaggccattttctcccggccgaaggccgggagcgccctgaaagtggtggaagggtcttacaactttttgaggcgcatccgggaaaaatatagagaaaaattctgcgcggacgactgagtcccggggaccgatttctcactttttcttgcgtttgttagcccataactttttttctaaaactcggatcaaaaaattcccgctgtgagggccctaagtgagaatgttgcctaaaagttaaaaaaaattctaggcctctagctctaaccccctgggctgggtgcttctagaacttttcagtaccaactttgtccagttcagtccccgttgaataactcattaggctttgacctgagcgtagggtggccagcagacttattgtagagatcaatgagctggatttttccaaattttaaaatttcgaaaattttcaaaatttttcgagctaggcctaatatacggtttttttggtttttgaattttttgattttttaacgaaatttcccaaaaaaatgaagaccacttccaaaacatcggtttttcgagttctatcgattggttaatttttttggaaaatttttcgattttt

SEQ ID NO: 2662 - DNA, 4134 bp, Heterodera glycines
cacttttcaaacaacgcatttccgttgggaatggcactgaacaaaagtgccgactcgggcccgctcagctgtaccgccactttggcactgttggtctatgaaaattgaatttttacacaaggagcccaatataaatggcaaaattaaactcactgcattgcctcccagtgttagtgtctgtaaaattaaaaaacacttgaatttaaaaattaaaaaatataatttgcagcacagtgtttttgtttttattttaattggcccaagatattttttcagaattaatccgggaagaaaactggtttcatttaaggaatttcgatctgtgtttaatcaaaatgcagcaccatcgaaaatattaaaagtgtcatgaaaaaataaataaaatatgcatttttaaaatagtgccggattttcttaatgatttggctacacttaattgtacctggtcaagaaagcgcaaatccgaatcttcttccggaaatccttgaacatatgtgacaacatccaaacaacaattacccacgaaaagaatttttcccattcaaaactggagaaaaccgaaataaatatttttttctcactcaatcaatgatctcacaataacatttccgatacttttttacatttttcggtagatttttatttttacaaaagaactaaagcaaaatatgtacacacaacaccatcaaattaaaaaccggagaataaaatatcaaaaaaagaggaggtggatagaacaaaaaaataaaataattttaatttttttcaaacgcaaataatgaaaaattaattagctagttcagttagattttattgattctaaattaaggaattgtttgtaactgaaatgtaaataatttggcgaaaaaaaaacaaattttatttggttcctttctcttatctatggaggttaaggaccgtaacgaatgaattgggcgcccatttttatgatgggatgaatgaaagtacaacattttaagaaaaaatacagatgatgatgctgttataatgaaaattgttggagcaattgataatataacatttgataggaaagtaaagaattttttttctaaattttattataaatcaaacggaaggactttaaatttaaaaaaaataaatatatttattattagggcagccaattttatgtaaatacatacaatattttttcctggcttcttctccatgctctaaatagtaggaaaaacacttacgaaactcatattaaatttttcagaaatacttttggcattgctcagaagtaaaaaagattacaaaaaaattaataaaatcctgagttttaatgttggagtttaattaatactgaaattgtttttatttatattattattattgtattattaaatgcgaccaatcagtagagagagagaaagagaaattattcagtttttaaaaattgcatttttaattattcaaattgaaattgaagcagaaaagaaaaaagtggaacaaaaaccatttgacgaaatatttggagaacaatgggaagaaaaatgtaatgatcaaaatggaaatgatcagaaaaagagagaaatcgttgaaaaattcaacaaaataaaagagaaaactaaacaaaaagaaagaaaatgttcaataaaagaatggagtaaaattgaagtaaaaatagcgaaaaaattggggacaaatcgccaaaacatttataaatggatcaaagaattaggcctatataaatgccacaacaaatcaaaaacggatgaaaaaaaaattgaaattgtgcaaaaatttattgcaaagaaaaatgagtataaacaaaaaagaaaatatttgaaaaaggaatgagagaaaaattatagtgaaatttgtaagaaaatcggagttggccatacggtaattgaaaaatggaagaaacaattcggaatgagtgaaaaaagaataacgaagaaagaaaaaatggaaaaagcgaaaatgtattttcaaatgaagaaatatttttgagaagaattaaatgaggattaaaaaattaatgattataaatttggttcattgttcgcttttttctttacggattataaatgattatttatatatcttttagaaataaaaagctaatttttggttgaatttggtgattataaaaaatccctactttctaccgtatttcaagggaaaatggccaaaaattgatcatttttgagttgtccaattttcatatctacaagtcgtagccctaacattcaaaaggcaattcggtagagaattttgtgccctttcaatgagcctatccaaaatttccagaaaaattttttaagcaagcatgaattatttaaatttttaaatatacctatgtattctagaacagaaaaaatatttaaaaaatccgaccttggcgccaaaacatggccaccaaaatgacctttactcttttgaaatgcctatttagcaaaaggttaattaaagtggctcaaaaattttaaaatataatctggaagcgtctaatatgatggctagcgcgggcttgttcagttctgcgtttgcgtttcgcccatcacaaacataattgcgatttccgggttcaaaattttcaactccacgaaatgtttgccgtccaaaattctgctgaaaattctccatttgttgctgcgggttgttgtggcaaagaatattctccgttcgagcgttcagagcaaggtgttcggccgaatttgtcgctataccagatcggtggttagccgattgacgcagagctgtcagttgggagtggacagccatttgacgcacaaaaactgggtgggcgccgtccaatctcgactgcgtatactgcacatcatttctcgccgacccaatagcatttccatgtccgccaactcttcggccaataccatgcaataaactcactggatttgattcatgggcgggggaataggtaggcactaatcccgcagtgttcaaattactgacacccaaatcgaaattgtttgacaaaaatctttcgtttgtctctcccaaaccattttctctcacatttcttttgttcacgcttgaactagaactcacaaccggtacattcatcgccgttcgctcgttttgttcaatttcatccaccacaatcaccactgagttgccggtgttccttgtcgctggcaacaatctgtttctcaattgctgttccccgccaaaattttcttgccacgttagtggtggcgttctcacaaacattctcgtttaaccgtcttggttcaattccaaaatcaaattcgacaatcttctcagtctctgagcaattttcgacaactttcaacaatttaaaaatttcggcactttctcagtctttgagcaaaaattttgtgcaatttctcaatctttgagcaatttgcaatgccgtctgctgcgtttattcccagtcttcgggctctaacaacgccgcagatatgaaagtcgaagtagaaaaacaaaagccaaatttggtctcctaccaaatttaaaattcaagaaaacctgcagtgagcttacccaaaatgtcaggagcgccaggtaatattattttggtccaccgcactcgaagaacactcacaacccaatgaccaaataagctttcactttattaaaatcaaacacaaacaaattcagaagacgagggggaacaaaacaatcaatcaaatccaaaatgacggagaacagcaaaacatgacaaaaactttaagaggggagaaataattgcatgaaaatgagaatgaataaaacaaacatcaataaatggtcaaaacgacaagcaattacgcactaatttaaataataacacagtgggaaatgttatggtcatccaagttgacgtccttggcgaaaagacgaaagcaatgctattgacggaggagcccaaatttcggtaattgatgccgcatttttgtacaagctgatgaaaaaccaaacattgaacatgcatgacttgcgagtggccaaatcggagacacgaatttccgatgctaatgggaatccattggcttgtttaggcgttgtatgccacccgattttgagaaatgattacactaagaaagtgcaagttgctttgcatatcgctcaggcaccaattgggtttaatcttttgttcggaacgaatgctttgaattccttgggttttaaactttttgatga

SEQ ID NO: 2663 - DNA, 2020 bp, Heterodera glycines
  misc_feature (1965)..(1965): n is a, c, g, or t
caaaatttttggattgagccaacaattggaattggaaaggacgagaaagtcatagccccaatgacgaatttttcgagtttgtcagtcaaattggacccagggaattccatcgggaaaaatgaagtcgtgagtcatgtcgaagaatgcgaaaattttcttgcaacttcgaatgaatacttcaaaaataattatgtagcaacagatgatcaaaatgtgtcaatcgatagaattttgattgaaattctggaaaaaaggcaattccagattcggaaaaacaaagtctgttggaattggtttcgcaattcaagagtattttcgctgtttccgattcacagctaacccaaacaacccttattcagcatgaaattgagacaggaattgcagcaccagtgagatcgaaaatgagaccagtgccttacgcatatagagaaaaagtggccgaaatgttgaaagattatttagaaagggatttaattcgtccttcatattccccgtgggccagcccagttatcgtgccaaagcgcgatgggtcgctccgtttttgtgttgactatcgtgccgtgaattcgataacacgaaaggatagttttccattgccaaacatagacaatactcttgttactgggaggtaaaaaattttttacaacgcttgatttcatgtcaggctactggcaaattcggatgaaacccgaatcggtcgaaaaaacggcgttcataactgagtttgggctccacgagtttgtggtaatgccgtgggttatcgaatgcagtggccacttttcagcgttttatgaatcgactttttgaaggaatgatcaataaatttttatttgtttatatcgatgatgtgttaattgcttccgaatcacttgaaagccatctcgaacactagaaatgcgtttttgagcgtattgaaaaatcaggcttaaaattgaactctcgaaatgccaatttagtgccgaagaattgccgtttttaggtcacactttgactagaaatggaatcaaaatgaacgaagaaaaaatacaaccagtcaaaaatttaccggttcctaaaacaaaaaaagaattacagtcattattaggcttcttcacttattataggaagtttatttactcggttggaaccattgcagcaccactttttcgtttgttaaagaaggagacaaaatttgaaattggcgaaatggaaaagaatgcaattgataaattgaaagagaaaattttaagtgatgttgtactttatttcccaaattttgaggcagcgaaaaatgacccattgaggaatttcattataatgacggatgccagtaaaattggcatttcggcaattctcagtcagcagaatgaaaaaggcagaattcgtccaatttattttgcctcaaggcaatgtaacaaatttgagtcgttatgcgccgaccgagctggaagcattggcaattcgatttggagtcatcagttcataacaatgattcctactagagtaataacggaccataaatcgctgatcggaatgtttaaaagtaaaaaggaaaccggaaatgcacgagttgacaaatggatccttgaattaaactcaaaattcactctgaaagttgaataccaaccggggaaaaagaatatgattgcggatgttttgtcaagaacattcgagacaaaagagtgtgaaacgttagaaattgctgcgccggaagatattgcattgattgggatgttaagaattgaattggggcaagaaaagaatttgactgttcatgagaaaatggaatgtgttcgtgaaacaaaagaaagcgaaatgaaatttgtttatgattttttgagtcagagatttattcctgaagatcctaggcaacaaaaaagtctgatggacatttgccacaaatatattttgctagatgaattgttgtatttttgtaaatcggacggaaaattgaaacttttcgttccagaaaaattcagaaatgangtgttgagacagcggcatgaaagtaaatgtgcagagcatatgagtggcaaaaaat

SEQ ID NO: 2664 - DNA, 1735 bp, Heterodera glycines
ggcgggcgaagtgatcgaggtgtacctgcgcaccatgcagaaccaatgggattggatgctgaacctgagcaagtgctggagggccacctgcgcgacgcgtacaatgccaaggcatttgtggaggagtcggagcaggtggagcagcagatgcagcaacagttggaccatcttgatcgtgaatattctcgtactgatttttcgctggacgatggtgaacagatgttgcgacagcttgactctgtccgtgaatacatccaacaattgcatgcgcgactcatttcactgaccgacaggtgtgcccaaatttcaccgctttggcaacgtggcgaacgcatttcaaaaccgctgccggtgatggcactttgcgagtacaagagcaaggacaaaattcacatcagacaaggggatgagtgcactctgttggacaaccatgaccaaattcagtggcgagtgcgcggtatggacggcgttgaggcttccgtcccatcggtggtgttccgcattcctccgcctgacccgcgattggcctcgttcctcagccgactgcacaaccaattcgagaagttgcgcaaactgtgggatcgcacccatcatttggtccgttacaacatggtgctgaacacaatgcgcacagtgcgtgcatgggacttggacactttcctgtcgattccatccgatcaacgggacgagatcatcaaagctttgaatgaggacgtgaacaagctgctgtccgagatggaccccaacgatcccttggccaagcggcttaaggacgagctgcggatgacgaacgaacatttctacgatttgttggcacgcgctcagaaagagccggagcccgactactccaaccagttcgatgctgcatgtgccgagttggtgcgcaagttcgaggagggctggaagcagctgaaccaccgggtgcaggaacgagtggccaccaacttggaggagttggaacgccaaatcaaagagcacaaggcattcgaagatgcactgcagacgcttgacgtggacgtgtcgaatgtgaaggaactgtaccgccagctgccccacccaacgcccacccagcgtgcagcgcacgacaacatggtgcagcgctggcaagacatttgggagctgtcgcgcatgtacgtggagcggctgaaggggcttgaatcggtgttgaacgggttggacgaagtgacggacattgtgcgacgccatgagatcacgctggcctcctttgacgacatgccggccgcgctggagcgcctgcgcggcgtgcacgcccagctgctggagctgaatatggtactgcaacagcaggaaaacatcgtcaagaagctgaaccgggacactgcaacgctgcgccaacatgttgcgcgcacgcgtttcggcgctgcaaaccatccggtgctaccagttaagccgtgccgggtttcgggattcggcctgcttagttccgacccctgagatcgatctcctccgtccaccgacggattgttggactgggccgtagcccccgcggaaaggctccgtcccatcggtcggctttgggggagggccagtagtgggagtgatgactggggaattgactgactgactggcctcgacggctgggagagccatcgcttaaaaggggaatcccggtgggcgttccaatggggaggtgcctaagcccttcaatcccaatcggtagccgagacccgagtccagacgtacacctccaccccagggcaggaaccgtccctgg

SEQ ID NO: 2665 - DNA, 1375 bp, Heterodera glycines
  misc_feature (1317)..(1317): n is a, c, g, or t
tattggaggccttgtaacttttgaactaggcggaatgcaccgctaaaattaaaaattcacactagaagtcgaccctgctctatccaatggtatatcatttatatgcattttcctagttacagctcggaatgttcccttgtaaggtgtataaaacgtgtttcagagggttttcggggtcgctaatcacgaatcaagcatccatttcgcccaattccgaaccccggactcgattgattgtcgttaagctgtgttgtctgtcagctgactggttcttacgcggcctattttaattcttgagaaaatttagaattcttagaggtgtattttctgaaattttttgggtcatttcttggtgtcgtttttattgcaaaaaaataggcaccaaaaatggcgaacaaggtacaaaatatgtaggatatcctacgatacttttattctgaaaagtcgtcttctgaaagcgccataaaaaattttattttcaattcgttgctgtattaattttttttgatcctacactgtgtaacattagaataaggacaccctatttttgggagtttgaccacttcccatgaaccgatcgagttgaaattttaactgtacgtagcaattctgaaaatattaagattctaaaattgagaacccgaaataaaacaaaaagcaaataattgtttatatttttgttagagtcgatatttaaccaaacgcccctcagcggacactagccgtagagcaatcattcaaaggcctttttgtagagaattttgtgctctttctgttcatcatattcatcttccacggaaaatttcaccaacgccctagaaattttttgacgaatttgcccagattttcacattttttgcccacaaaaattttgtgtttaatgaattttttcttacataaagtgaatagaaaatgcttaagggatgtctataagttattttagtgttaattgcttccagttcgattcagtgggtcacatgtttgagttgatttaagtctcataagccttgatttctctgaaaaatttggaaaattcaacataactttccctaaaagacatatttctgtctgcaaaactaacaaaaatatgaacaatacatttcgtttaattcttatttaaatgggagaacagaatcttatccaggttcgattttatcccccaaagattaaaaaacaacaaatttagcggtataatcacgacccaaattttgcggaaatggcgcgctgcatcacatcattggcatttgttccgctgggtgcactcattgaagcaattgttgcgcttgaccaccacataccccgcgaattagaccgcgntttttgattggtccccaacaacgaaattttaaacaacaaatttgaaaaaatactttta

SEQ ID NO: 2666 - DNA, 1583 bp, Heterodera glycines
cagcgccaagttggcggcgcccagttggcggcgcccagttggcgtcgcccagtcggcggcgcccagtcgacccccaccggcgacgaggggaaaagtcagagacggagggctaagaaagagagacgacttcgtaaaagtgaaaagaaatttaaatattttaaaagattttcaaattagtgaactaatgaatagataagtctcgctcttcaatttcattccaaattcaaaaaaaaattacgaaattgagtaatatttttataaataggacatcgtaaaattataaaaaaaattttcttcacaaaaaattaaaatttttccttagtggtgtctataaaaattaatttttctcaaaaaaattggctcaaaatcgtaaaattttgatttttctgaaaatctgttaataaatcacacccaagcctgtaagcagcgtcggtcccctgtttcctaaaagtttcttttttggaaaaaccgcgccgcaaaaaagcggttttgaaaagcaaaaatttggtctccgacccccccccccctccggtggatttcttccgtatggagtcgggtcgaccccgcccccgcctttgattgcatgtatgtgtcgagattctgacattttatgggggaaagggtgtgcataacggaaaatacctcaaatacaattatatttattatcattaggtgatgcgacttttagttacgaaaaatctcgaaatagttaattaaaatagtgaggaaaaataccaaaataatgacaaaatcgtaaccaaaagtcagaaataatagtgacaaataatgaatataattctcagcctttaggacatgaaaataagaaaattttattcaaaaagcaacaaaattaagccaaatcatgaaaataaatgattaaactttggagatgaattttaagaaaatttttctttcttagggggtttatttttaaaattttagggtcgattcttaatggtacatttttcttaaattcttggagacgattcttaggggctattattcgttttcattacatttttgttaataaattttgggcaaaacgccaaaatagtgatttctagtgacgaaaattgattttcaaacgaaaaattcaacacagaaatgcgttttttgctcctctcttcaaaataaatgaaacaaaaaaaaattaagtcgctaaaaattttttaaaaaatcatatgatcaaacttaatggcggtaattaattttttttttttttagtttaataaataatttcaatgattttttggtgccatcctttgactatttatacgcattttggcaccacaaacattgcacttttattacatgtttttgcactttgattgtttgtttgtatgtgccaccaaaaatgcatcggcggagtgtgtggccaaaagaagaaaaattttctggaaaaattcttcaaaatgattgatcaatgcgcaattatgtttgatcatatgctctttaaaaaaaatttttatttgagtaattgtctgaattaaaaccattaaaatgttcttcggctatggacattatgaaggatcacatttttaagtcaaaaacaaacaaatccatcaaagtgcaaaaacatgtaa

SEQ ID NO: 2667 - DNA, 1492 bp, Heterodera glycines
ctctttttggcctcctccgttttggccgtgcttataattggcattaaaatggacggaccgacaaaggcaaaaggcgccgccccaccaaacgccgcggggccaatgggacttttggtgattttttaattgcataattaaataaatcaaaattcagcatttattgaatggcaatgaaaagggaaaagcgccctctggcgaaagtaagccaattttggggcagaagccgagcgtagaacggcaaaagagggacgttttggggcacgccggcggatacgtcggaggatgggaccatcccattgactcgacactgtaagaacataaatttaataaaaatggtatattcaaaaatggaaaatgtattttaaattaaataattattattaatttgaattattatttttaaaaagtttagaaaattaaaatatttatttcttttgaatttaattgtcctttattttagtgattgggtaaagagtcagtggaatgatgccaattggctcgccgatgttgtcaacagaaacgggtgggaaaataccggctctcctaccggcggacgatgaatcagtgaattgtgccgacaaaagaacgaaagatgatggcatttttgtttgggaaggaatttaattcgacatttcgggtgaccaaaaagactttcctttttagttttctatgtattaataaaatagcattttcttcactgtttacagattggtcggtgtgataaaaaattttcatactcttttggatagttttgcggttaagcaaaaacggcaaaaatcacttactgacgaaatcaccgggaaccgttttggcccagccgttgggctataacttttttttattcaaccaaatctgacgatcttgatatcattcgaaagccattcacatttcaatttggcgcatgctttaaataaaattgtaattttcttatgagtaaaaaaattttttgaccaaaattttcgatgtgtaaaatcttccggtggctcataaaatctttgtaaaaaaattggttcaaaattgcaaaatttgatctttttttttggacaaaatctgaatctattaacaattgcattaaaaattacaaaatttttcccggtgcgatttcttctcgaatccatccattgtatgcttgtatatgcacctgaaaccttcaccatatcaaaaaatgttaacgaagaaaatctatttttgagcccctttcttcatagaatatgatgcagaaaaaatatggccccctactcatcaagtacctaattttttctaagatttgatcattgtaaattttcttttccgatgaatctagggggcaagaatgagttatcacgattcccgagctcagattcttaatcagcgcatttttctatcccagaaaaaatcgcctcttaaattctcaaacttatttccacgccaaaaaccacaaacggccccattgccagaatccctgcatgtatacaaactccaaacaaaaacaaatttcaaatttgtgccccaa

SEQ ID NO: 2668 - DNA, 3629 bp, Heterodera glycines
  misc_feature (41)..(41): n is a, c, g, or t
ttttgttcttccgattgataaaatatgtattaaattttttntaattcattaatattaagcaatatttattgtttcaggtacaggccatttgagaaatacaggtacaggtacatgcttttttcaaaatgtcgacccataaaatgaaggaataaatctttaattgaaattttattggcaataaaaagcaaaattcccaaactgatgcattaatttataatgaaaatttcttatattaggcaccactctcacttcataaagcaacattcgaggagatttaaattttttagggacttgggcgacagggaccgaattctcattattactgtagtttatggtctcataattttttctcgaaaacccgaatcaaaaaaagttctcttgggagggccctaattcaaatggtggctaaatttaacaacttcaaggcctctatctctacccccccctagcatgggtacaaaaatccagtaccaactttgtcccattcattcctaagcgaataactaattttcttgggtttcctatgagtgggggtggccagcgaacttattgtagtaaaatttatctttcatgttaaattttgaaattttagggtctcctcgaagggtgctagtgcatttcgtaaaaaccgccacccatgcgcgtttcgtaaatccgccagcgcgtttcgtaaatccgccaatgggttcgaaacaaaaaatatgtaacaaataaaaattcataacttggcccaagttcaaccaaattaatatttcatggtattttttaatagctatgggtgtattctttcagaatataatattacaaaatttttatcttaaatataaaaaaagttatcaatcattgaacattctaagttttttgcaatggtcaagcatatataattataaacccaatgttttaaatctataaaatgcaattgagccaaattaatttatatattcgatagctctaagaattctctatttacctttaaaatttcagaaaatttaattgaatttcaaaaaagttctggacaagaaattctgacataagactttttgaaattttatgacgataacttttttatacttaagataaaaattttgtaatattatattctgaaagaatacacacatagctattaaaaaataccatgaaatattaatttggttgaacttgggccaagttatgaattttatttgttacatattttttgtttcgaacccattggcggattacgaaacgcgctggcggttttacgaaacgcgcatgggtagtggctttagcaacccagggggtttcgaggtcgccgatcacgaatatgaaaattattacgaaaatttgaatttttgaaaattctcactactgccataaaattgatttaaaaaaagctaaaagtagtcataaatcattgaaacaccaaaaaatgatcagtttgttcagattctaacataaaagcaaatttttaaaaaattcgaggttttcgaccttttgttcgaatttggtttcgggttcggagtaggcaaaagtgtgcaactgttcatcttgttaatgaaatcattgccgaaattgaaaaaaaatcacatttttaattccgaaatggtgagctggtacttatgtcgtttacgcactataaaaaaaatagtttttataaatcaaacatataaacatttgtacgtggttttcgggctcgctgaccacgaatctgatacccatttcgaccaattccgaaccgcggacctgaattctgtttagattctaacataaagggaatttaagtgaaaaattaattttgacttttgtgcgaattcgggcccaggattcgaaataggtcgaaatggatgtcagattcgtgatcaaggatcccgaaaccccctagaaatgttttatgtatgatttataaactttttttatggtctgtaaacagcataagtaccaccggtgagcttacaaatttggatgcctaacagtcgaattagtttaaaaaagtgcgcatgaagatgaagctgttagaaatattgtttatacaattatagggctttactccacaaacaatacatacacacaatataggaatcacaacaaagaatcatcctacacacattacacagtgatatgttgtctcctcgatcacaacatcttcttcatcttgtccaatacgttcgtcatggcaatccatttgcggatatgcttcacgtacatgttgtgagcgccataagtttgcggaagggccaagtagagcagaaagacggtcttcaaaggcacgtacagcagcagaaggcagccattgatagagccaaagagaaggtccaactggcaaaactcggcgaacacgcaccaataaacgagccactgggtgtattccgctggaaattggggaattggctttgtactcggagagaaagcacagcagaaaactcacatgtgttttgagtgttgagggtcaacaagctcgcgtacattgggtaggccacagcttaaacaaaggaaagcgattagttagcagaggctgcacaaaaacggcactctctcctcaaaacgcactgataagagtagagagaaacaaattgccagggcagtacatcaacacgagcagcacaagagaggaagtgatgtagaagagctgaaaacccgggcaaaacagtgtaaattaaaagaagaaacaagagattaggctggctccaccttttcacgttccattccgcttatttcttcagccttcttgatgaacggatgttccaattggttgagcgttttctgcagcaccggaagcacgtcattgaagtctttgatgggcacttcacgcagctgaacgctcacagcactggcagaagaagtcgtcgattcgtcagaagacattgttgcgctttgattgtcagcccaagacactttagtttaatacaaatgtaagtgaaaaatgacgaaaatcaataatcctatttaaacacattttcaactcgtttgtacctatgtgtgttaggtaataggtcggtataaaaataggtaggtaaaatgccagtcagacacttacttacacatgtatttaaatactgtattccacaatatttttcatttatttcccttctcattgatggaattattgtaaaattttggtgggtgcccgccagggatgtgcctaggtttcgcatttcgcctttcgcataattcgcattttttggcgtttcgcattttggcgcgaaacgcgacttttacacccctaagaattggattaaattccaataaaatttttcaaaattttacctataaattggctaattttcagtgaaaacctgtttataaatgatcaaaatttccaattttttccccggcggcgcctatcggcatcgccgcgcccccaaaactcctattttttcttagaaaatggcccaaaatcgcaaaattggtaatttgatgaaaaactgttctcagcggcgccccaaaactcttatttctcattagaaaaaagataaaaatcacaaaatttgatcattttttagtgaaaatctgtcaacaaattttaatcaaattttcaaaaattttcccggcggcgcctgcctcctcttcccaaaaagtttttggaaaaagcgcgcctcaaaaaagcgttttattgatttttaaatttggaataaaattttaaaaaatgattt

SEQ ID NO: 2669 - DNA, 4369 bp, Heterodera glycines
atccgggttcggggttcgaattgggtcaaaacagatgccagaatcggttttctcgaccccgaaaaccctaaaacaagtttattctaataaaaattttttgaaaatctggacgcagataacccacaagtaccgatttttctatcatttttcatcaaatttgatttatttttttaaacttctctacgtggtgtgctcggttttacgcgtaccatgacattttggcgtctgaaaaatgttttacgcgtctcatccaaattggtttattgcaaatagaaattaaaaaacctcaatattttagctgaaaatctgacaattaaatcagaccacaaataacgaattcatttactcctaggctcataatgaaatttttgaagacaaacgatcaattacggcttgaaaataacacagcaaaatacgttttttccaaaagaaaaatagccatttcgtgcttttgaactggacataaaatttgaattttgaaaatgtatacttgaattatcacgtttatcgatatccggtgattagccaattatacatacatacaatatatatatatatatatatacacaaataatgatcacacaacggttttacaatgacaagtgatcacagacaatatagcacattaggcacatatgggggaacaatatgggatcatttaaaatcatttctgatcactgtcgatgaacatcattgaagcgggttgtagagcgtcttgttcttgtgccgtccggtggttgttcaggccttctgcgacgcggctcctccagctgccgacttctgcgacgcggtgcccagtgccgacgctcctccagcaggcgctgctgacttctgtgacacggttcctccggcggctgacttctgcgacgcggtgctcagtgccgaggctcctccagcaggcgctgctgacttctgcgatgtcgtgctcatagccgtccccgtgccgggcgccgcgtacgctgagggcactgaaaatgaggaaaaatgttagggtgaacaaaaaaacgcttccccgcccgcccgtccctctcctctcacccgccgatccggtccccgctggagccaatgatttcttggaggcttcggctggcagctgtcccaccgcggaagttccaccaggtgctgcgctctgtcccgtcggtttggcgctggcctccgccccttcctgtcccgccggcatttgcggctcttccgtgttctgaaaatgaaaagggaaatgattttaaaaaatcagccacgacagaagcatcgctaccttctgtccactgccgcagcattaagcggcaccggctggaggaacatcggcactgggcaccgcatcgcagaagaccgcagcggcaccggctggaggaacatcggcactgggcaccgcatcgcagaagaccgcagcggcaccggctggaggaacatcgacactgggcaccgcatcgcagaagaccgcagcggcaccggctggaggaacatcgacactgggcaccgcatcgccaccgcatcgcagaagaccgcagcggcaccggctggaggaacatcgacactgggcaccgcatcgccaccgcatcgcagaagaccgcagcggcaccggctggaggaacatcgacactgggcaccgcatcgcagaagaccgcagcggcaccggctggaggaacatcgacactgggcaccgcatcgccaccgcatcgcagaagaccgcagcggcaccggctggaggaacatcgacactgggcaacgcatcgccaccgcatcgcagaagaccgcagcggcaccggctggaggaacatcgacactgggcaacgcatcgccaccgcatcgcagaagaccgcagcggcaccggctggaggaacatcgacactgggcaccacatcgcagaagaccgcagcggcttcttttatcgactttcacagttttaaaagactttagactttgcaatgtaaatatttttatagaattttttcgtctaatttttttatagttgatttaattattaatatgattttactgattataaattaataataataatctatttattattgtccaattgatcagtcttacaagtgctgtaaggaacacatacaaaaaattgaacatttttcgaccaaaaatttatttttcgatcgagaaaataattgaaaatgtcgtctatcgtttttatcataacacattttttcatcatcccatgtaaagggcttaaagaaagccggaaaagcgtccgcgcgatccgtaagcggcgccaaagccgccggcatcaaagcgtttggccggcacaagagggtagaagctgaataagcagaaggtaggtacattgagtataaccagtgctgtcgaagacagctttatgtaataggattaagatttgccaattttttgcctttggttccccggggtacggtagaaggaaagtcaacaaaagtaaacagccgacagcggatttccattcactttcgattattatccaaagcttagtttaaaattatgccgcttttatttcgaaaaaggattgtatattcggccacttccaccccgaaaatgggtaaatggccttagaattacgaggtaatggttttctcagggtggtctacactttcacaaagtccaaatttggtcaaacacccccccctctcccccaaatattgtggccccaaaattcattgttccgcttattgatcacataattttgattattccgtgttttattacctctcatagctgtaggggtctgtcggtacgtaatcgaaccgcttctgctgcagttgttggggcgcgaatgcggcgccgctatacgatacaccaccaacaccgccaccgtactaagcagtagctggcgacggcacgaatgggaccacacgctgcggctccatcacaaagcgctcaaaatgtttctgctgctgctgtagctccatcgcaacttgctggtccatggccgcttttggtggtgccatttctgcgctgggaggcgcttggcgcttcagaaacgcgcggggaccaaatgccaatgcgctataattaagtgaaaattgataccaccaaacccaagttaaaagaaaaacaaatttgtcacttactcatcaagaaaaagtgcagtaacagcaaaaagtgtcgcaatgaatcgcaatgtgccgaacattttgaatttggccaaatgctttttaaaaagataaatgtcggagtaggaaaaacttttgtagggagctgaaaatgtggccaaaaattagttttagttgcaagaaaaaacgttatgccaaaaaggacaattttccgtggcttatattccctggcgggcttaaatttcatgcggactgatagagggagggggcggggaatgcaatgtgccaagttcccacagaatgccaacattcaatcaactgaaatccttgtgtgcactataaagtatatttttttatattacattggcacactcacatgatttttctcttcgggagaagaggagataatccgctgaagggcaaagcacccgggggagggagtggggagggatttgagacagaatggaaggataaatggcactcgttaaagaaaaatttctgcttaaatgaggacagacagccgaaggctttcagaaaaagatgaagcggcggtgccaatttgccctaatgaacagaggaagggatgataataacgatgaaagtgatgattaaactcagacaaattgcgttaatgaaatttgtcacaaaattttcagaacgaggcaaagtgctgttgacgcatttctcacaaaattaatgacagttaattttttttcttgctgaaatggatgtaaagccaatggtcggggattaaattgcgcattaagcatttgggaccttacaaaaattttattgaaattgagacgcactcagaaataaaaatgatgattactaaacaaaaaataatccttttcaatgcacactatgagagcaacgaaaaagcaagcgtaaatcctgcaatttgttggagcaattgcattgtatcatcatatcaattttgcatagataatatagatttaaaaaagccaaaatgtcgagaatttttcgtaacacctgtttttaatgacaaattcataagaaaagcactttaataggctgaatttctcattttcgttcttagaattctgtgtcgttgaagaaacagattttctccgctcaatttcgaatatgaatgactttttagctcataaaaacatattaaaaagttttagcaaaaaagtctaaaaaattatctttttatataatataaatttttatcctgatttaattatggcgtataaataaatccgataattttgatacattaaaaaatagaagcgaccttttttaaacacaaaatatattggcatccggaagagcaaatctctgttaattatggagaaatt

SEQ ID NO: 2670 - DNA, 7210 bp, Heterodera glycines
gaaaagaggcaatcccttcagaatgggtgtctctattaaaaaattggcaagtgggcgttatcccggggttatgatcacgaatctgagtcaaaagcttcacagtttggtaccgaaacaaatgcaataaaaatacggtaaataaaatattgtctatttactactagagcacggacatttaaaatttgcgtatctagctgtgggattgggacccttttttttgcggggcgggatccccgacgggattatcccgcaaccaaattgctctgtattatccggtcaataattgacgaagcttttgcctcatttgtgatgttttcattggaaaacgattacttaatgaaaaatgacaattttaataaataaaagcatagttggcaaggtaatatgacaaatccaaggtccaattcgtgatcataactcctggaaaacccaatatagcaatttttagctcaaaaattacaaagataaattagggacacccattctgaaggattgccgcacaatatgtcaaatagttttttcttcatttctttaaaatgagatagcgaaaatccatcaaaaccgagagttttcgggacataattttgtttgccttttttcaaatcccggatattgcatgtcagaatgccaaagtcgagttttccacctgctgattgtgagctcaaaatggaatttttacccggaattttaaacttgtttaaatttatgattttggccaaattcgttaaactcaagtgataaaattgccattgcaaaagtgccaacttcgtcgtccagccaattgccgtcgcagccattcgtcggccgttcaaagtccaagtcgccaagttcgtccagtctgtccacattctgacaaaaatggcaaaattaaaaaaaaccttttattttattagaaattaaatcgtaaattaaacttgacaaattcaattcggcattttttttgtggtgccaacctcaatggagaagccgctttcggccggttgtacagcgaacaaattgcgctgtttgatgccgatctgttgcttttgcttcagcaaaagctaaatgaaacattcatgattttacaataatttccaattttaaatttgccttttttggcgccttcacattgggctgaagttcgctgaacaaatcgacgcattgctgaactcacaacagaaaattaatcgaatttaaaatttaatttgttttcgatttggcctaaattcaaggtcccaaaaataataagaaaattgaatgatcacttctatctttaacaaatgggacatttcggcacaatttaatcggttgccacttcgaatttactaaaagtggaggcaataaattcttatttatttgtctttggtataaattgttttcccccattcttgatggtttttatcattaaatggcacatttgtctctgtgcttccctgctttttcgctaattagtctgctaattacttcttgcggcactgccccggccaattgctgttggcactgctgcgctttgccttttgttttcgctttgtttgccgctgccgctgcttcttcctgccgatgtcttcggtattgggcaatttggtcggccactgccaccggaggttcggcattccaattgttgtcccaatctgttacggtggtgccaaattaaaaccaacaaattaaggagcctcagaaactgtggcataatgccaaatgaaacagcagaggaggcaatgcttgtcaaatttatgttcaaaaccgtcacattagacggcattaactcagattattgggtaattttaatctttaaatttaaaatggcacaatttcgtcccatttaaaaagtcatatgctcagggaaatgcccaattttttaattgggaaatttcatgccaacaaagcattcagacaattaaaaaggctatataatagctttgggtccgttcaataaatttaatttgaaatattttgttgtgtcctaaatgtatactctctgttttttcaaattgccattcactcatttttctgtccaattaaatttaattgcaaaacccgtgtaaagtgccaaattatttttgtattttaaatgaatatttgccaatttattcaccactaccgccattcgtcgtgttttgctgctgcgatttctcaacatttgccacaataaatggcaattcgccgatgcgattttggcgacccaaaaaacggcacgtaatcagccgaaagaaggcaccaaaaagtgccaaaatggcggacaaaatgcgccgtaacaaaaacaacggaacggagaccaaagacattcggacgaaagccctgtgaaaatttaggtatttttgtcacagttggaataacgattaaaactttaaaaaaaaaattcggaattttatgccaaaaattaagttgtgccgtaaaatttcatttatgagccgaacctgtcagattatattcaccactaccgattatatttgtattgacgaatgcaaaacattcatatgcaaatcattgaaattaaactctaaaattcaaatgaattatcatttacatatttaatgggaccaaaaacgaaattgaggcatttgtgcccgaaggcaaagcagcggaaaattaaaaatggcgaattaataataattgacaaaacatatcgccaaaaaatttaaatcaaaaattgatccaatgccctttcaaaatgacagtaatacaaaaaataaacttataaaatttcgtttaattttatttaaacaatcattagggctataaattatatgcactaaaaaatgccaaagatgcgcataaaatatgcattaaaaatacctcaaaataaaaactcgaaaaatgcccaaattttagacaattgtaaaaaaagtatatgcactaaaaaccttcaccaaatcaaaaattttaacgtaaaaatgctatttttgagcctctttcttatatgcgcagaaaaaatatgcaaaagcatataatttatagccctaacaatcacatattagctactaaaccgacaagataaaatcatataaattccaatttatagaaccacatttttcaattcaaataaaagcaaattttattttgatactttttcaataaatttctcgctaatggggtgttaattagttgtaaaaccgtgtattattaatttccaattagcagcaaattgatgacattttgattttttattgttcgtttttctcgcagcaattctgataagaagaatggaaaggaattatggaacaattcgatcatttaatcttaatcaccactttttctatacattctttttgtgattttgcttttacatttcccgattttagcaattataattaattagtgttcgcattttcatttaatcacttttaaaattgtaaaaattttaaagcaatcagctatattaatcctttaaatatttacttatttctaatggagctcattaataatgaattgaactgaaattaaatatggtcaaattgaaattaatgaattaattacttattaattaactaattaccttagaatggctgtcattcgtccgtttttgctttttcttccatttttgcttttttctccttccgctgcgttcgttgatgaccccaatttgtgccttcgtctcacatcggcggcccatgacgaaatccaagagttgcccggactcagctttcggccaaacttcaaacattactcgggtccgtccgtcctctaattgcgtgcattaatcgcccaattttaatttttttttaaattcaaaaaaaaacatttactttgcattatgaggagtatttggtattttgtattacgccatttgctgtttggtgctgtattttaataagaaatattcttatgaatattttatttatttggaaaattaaaatttgcaagaaatggcggctaaaaaattatttttttcaattgaataattaatttaatcgattcaaaaaaggatttccactcgtttaaaaatttatggcaacattttttcaggctttttgaaaacaacgtcaaaaaatctattccattattggtttgtgacctcggagaataagccgtgccaagacccattggtctgaaaaatattttctttttggccaaatgaaattgccaattctttaaagcttttttggttcaatgggggccccggctgttcatcattgggcggtctgctggacgaattgggcccatatttgatcaacgccgacgggaaaacattacgcaaaagcccatacgcttggaacaaaaatgcctccgtattaaaattaattcctcaaaattaaataaattttaaatttcataaatttcattaatgtgttatttttgtcagattgtttacatcgagtcgcccgctggcgtcggcttttcccactcagtcgacggattgcctgccccgtcaagcgatgactcagtaagaaaaaaattgtaaaaataattatccaattaattaatgaaagcaattaaaaagagggaagattcacgattcaaaaagaaccgaaaatttgtgatttgtcaatttcagacggctgcagaaaattacgaagcggtcaagcagttcttcaacaaattcccactgttccgttccaacccaacgttcatcaccggagagtcgtatgccggcatttatgtgccaatgttagtggccaaaattgtagatggacaggcggaattccccatcaatttggaggtgtttaatttttttaattattcatttctaatttaaaataatttttttttcgtttattttaaatgtttagggaatggccattggcaatggctttgtgaacgcgccgttggacaccgacacattggcacgttttgcctatgcccatgggcttgttgaggagtccaaatggaatcagattgccaaacagtgttgtggaggatgtcttggtaaattggcattggcgtgtgccatacacttcacgataaaatgcctaatattaaatttaatggattttttttcaatttcttaagatacctgcgatttgggctcactttacggctcatgtcgatcaattgtaattaactaattgaagaattaatgtcatctcattaatgaaaacataaagattttcccggaaaattgcatttttgataaatattaaaaaattataaatatcattttatctatttaattataaaatttattttttaggtggctgagattgtccatttctgttggaggggcggactgaacgtttacgatatttatgaaaattgcagtaaattttgcaaattaatttactcattagccttatgatttttttttgaaattttaatttatttttctaagtgccgcacccaaacaatttggacataatgagaagaggcattttcaacgcaaagtcaatgcactcaaacgattcagttttgtggcggactgacgacgcttttgaagtaaaataaataaataaaaaataaattttcaatcaaattttctgtcagaacgccaatcagccgaaggaggaaaaagtgaattatttgctccgctgtttgaatggtaattaaaattaaatgtttttattaaatttaaaaatattttaggtcaaccattggttgattatttgaacaaggaccagggtaagaggccaattgttatttgttagagatcggaattccagcccttatccgatctctatttttgtataaagtgctgctgctggagctgtgcaagaattaattttgactcaaagttaaccgagaaattaaaaaaaaataccgaaaaaatttgtccaaaaaagacctaaaaaacgagaaattcgtcgagccaagaaacaagactctcgaagatgatccatatacaaaatttctgtttgctgactttttacagtacgaaaagcgctgcacattccgccgacagtaccctcttggacccaatgcagccgatgggtggccatgcattaccgtaaccaatacggtaagtgacatttctttttttgtaaaaaatgagaggaacttcttccctagccgacatgtcccatttcgtgtggaaagcgttgtgggccaatgttcgggtactgctcttttacggagacacggacatggcgtgcaactttctgctgggccaacgcttctccgaaatgctgggcttaaaggtgaggcgggagagggacacgacatctttattaaaattttatttttaaattttctatttttgcaatatttatttctgttttaaaatgcttcaaatttagcgactcggcactaatccttggcattttggtggccaaattgccggcataaaaacggaatatggcagcggacttacatacataaccggttagtttaataaatatatttttactatttttctgtttaagtgcgcggtgctggacacatggcaagccatttgaaaaatttataatattaaatactatgaattattttattcaatttgaaaatataattttaaatttcattaaatattttaattataaatttatttattttaaaacatgaaaatatataatccgttcaagaatttcttttaggtacctcaaaaacgtggaagtgaaattgaatatgcgatagggcaatttctgacaaacagaaccatttgagaaaatacagctacaatttgcaggctaatgggttcatccaattactgttaattagtgtgatttttttttcttaaaatttgcttaatttttataaaacttaaatttcagcaatatttatttattactctaaaatagcgtcaaaagttcaagttcaaccacaaactgatactttctctggtcgaaactgatttcacactaaaaaaataatacaaaaattcgcctgtttgtaaaacttgacgcacgcattaaaatattaatataaaaatccgcctacttgtaaaacttgacgcactataaaattaatatgaaatccgcccgtttgtaaaacttgacgcacacattaaaatattagtataaaaatgcgcctatttgtaaaacttgacgcggcattaaaaaattaatacaaaatccgcctgtttgtaaaacttgactcacgcattaaaaaattaatataaaaatgcgcatacttgtaaaacttgacgcactataaaattaatacacaatccagctatttgtaaaacttagtgcatttaaaatgaatacaaaagtctgcctatttttaaaacttggtaaaatccgcctatttgtaaaacttggtgcattaaaaaggtaataatccgcctatgtaaaacttgatgcaataaaaaaataatacaaaaatccgccttttttataaaagttgactcacgcattaa

SEQ ID NO: 2671 - DNA, 1854 bp, Heterodera glycines
  misc_feature (104)..(104): n is a, c, g, or t
  misc_feature (1826)..(1826): n is a, c, g, or t
gctgcaataaaaaaagcaatgcataaatggtgacaattacaagcaattagcaatgaatgccttttccgctcctttgtttttatccaaatccaaaaaagttgacnttttggtagagtcgaaggtaacgctaaaaattggaaaaaaacattaatgaacttattaaatttagcgattccattacgaaaaaagggcaattaagaaattattgtaaattggccaaattaccatttttcgcttaaatgtccgttcgtcgggttcggctgtttccaatgcttgggagcctagagctaaatacagtagaaaaattaattggctcaatatgttttttcacctgattttttgcattccgatgtccgctttatgtaaatgtttgtgtacggtgtgtacagtggggaacggacggtggcatctgaaaataataatccaattgctaattacaattaaaatttaatttattattgctaaatgcctattttggtaaattaaggagtacctacaaaaatattaataatatttattaattttaatcaaaattatactggtttttatgctaattaccctgataaaattcgcatgcgaaaacttcgcggccgccctaaattattaaaattaattaatatttaaatatttatcacattttttaaattatttgttttaccacatagccatagaccaccagacggcacttttgttcattcatacaatgtgccaagcatctgtcctatcggcgaggaaatattggcattttttatacaaattaaacaaaaatttcaattttaaataatttttcaatttgcccatctgtcagctgttgggcttacctcagtggcctgaaaataattttataaggtttttatttatttttaaaattgtaatgacttcgtaagcaaatgtcgtgttcaaaacttggtacggctgcgtaaattggttcacatctctgtcagtgtaagtaatgaagcatctgaaaatgaataaaattgaaaaaataaaaaataaagtttctttttccgaattttacccactcgcaaaagtgacacggcgctccaaaatgttgcgcttaaatattgctgttcattatttttgtggcttaattcccttttaaaactaatttgcgagggtgtttgggcgcaaagacttctaaaagttcattaaaaatgttttttggtcatttcttggtgttggagccaatgatttttaaaaaactattttttagcatataatcttaataattaatgtccctacaaataaggactaaaactcaaacagatgaaacatctgaggacaatgtattcattttgaagtcccaaaaggggcggaaatgtctccgtagctcaatgataaagctttcctcaatgggaaggcatgcttctccaattcaaactgtcagtcgctttcggcattttaaatgtcgttcttgacgcccaaaaacttcctccccatcatagttcccatccatgtcaattattaccgggtactgtcagtgcgcaaactgttgttactgtaacggcacaaataaagtgaagaatgcgtaaatgaactgacatttttgcctgaataaaataacattaaagaatggtgtcacttaaaaatggggcgggaaataattagtgatacatcaaaaacaattattaaacggattaaaattcaataatttttcataaagcaatataatgaaaaaagaaaatagataaaattcataaatacgcttccatttttcagtaaaatctgttgccgagttcggtacaaaatttttatgggtataggaatttttccattaaaattcccttcttcttttcgatccgtttccacctcttctaatgcaattntcgttgagattctcgcattaatatatgc

SEQ ID NO: 2672 - DNA, 1839 bp, Heterodera glycines
  misc_feature (1374)..(1374): n is a, c, g, or t
tcgccgcacaatgcgcatcgagactcttgactcggtcggctgatctgatcagctaatcatcgccggcggcggaatgatccgtctcattagcaaaagagtcagccacccgcacttttctcgaccgatccattcttctcgcggctcctgcccattaatcattgcagatcaaaaagtgcccacccccgagggggatcatttctcccccctacccaagaaatttgatcactcccccgggcgattcgggaacagagtccatctaagcgccgatcagtgcgggtgccaaatggtcacaattagatgcgcaatgagtggacaactcgagaagctttgtttctgagatcaaagagccatgaccgctttagccgccaaaaatatattttaattttcttacaaaattagactatacctttcttatttatttttccaaaaagtcgccggaatctgtacaattgtgacggtgcttaaatgacgcacccgaaaacacagcgccgaccccgggggatttatttgggttaatcacagagggcgcggggaaacaaaacgcccacttttgttttagggctaatgtggcggcaccaacagaagcataaagttaatgggaaaagatcaatcttttacaattaattagcttaacttttttgcgggcggtgtaataaaagaagaagcgaaatcaatgagaagagtgaaagataaattgataagtaaagcttaaaaaaagctagaactgggaaatctgctgggcaaatctagggataattagggtaatcaatatttacatttaggcgcgacgtcactccaagacaaaatgttttgccgcccgttttctctcacaaattctcagacatttattttatccgcctttttgggggcgggaaggaaaagcgcaaaaatgttgggcatttgtgccgcggcggcgcacagacggacggaggatgaccttcaaaagaccaccaaatggcgaaatttccgcttaaatacaccgcacaaattcgatttggtggttggaccggtttttgaacgaaatgtgcgagcaaagctttgctttggaatttgaatgaatttttcagcatttttaagccattccctgcgggcagaattcaattaagtaattaattaattaactgattaaagaattacatattaattaatcgctggtttatggcagataataatgacgaaaaaatggtatttgattgaatataaaaataatgacgaataaataactttttaaagtgtctattttatatttttaattgccattatacaatataaaattacgtaactacttctttatctttgccataagttcgttttttttattttattgccgtttttagtaaaattttatagtcaattatgtgcatttaatccganaactgctttaattgactcattaggtaatctgataatcagaaaaatttttaatttaatttcaccttttaacaatttgccgttccgacactttgcttttaaatttgtctcattaaaaggcaatttttacgctttttgctcatttgtcagtcatttgtccctgctgctgatgatgaacaggttcttaatgctttctttacgccatgggatcgttttgttgtgtgttgggccgtgatttctgcaccttttgcggtctctcattagccacaaaagcgcctcgggcgatccccccaaggacagagcagcgaaaaaaactgcaacaagaacagcatcaattaagaagaagaagcaccgtgggagagggaggatgggcggaagaaaagcgtaccgaatttcccacaaatttggacgagcgatgaaaagcggcttcatctcattgctgttcatagcagtggaatggacagatta

SEQ ID NO: 2673 - DNA, 2305 bp, Heterodera glycines
aaaaaagcgttttattgattttaaatttggaataaaattttaaaaaatgatttttgctttatgattttaactataaaaaagtgttagaaaaaatttcgcttttcgcatttcgcttttcgcattttcgcatattttggcttttcgcatttcgctttttttttcatttcgcatttttcagtttcgcaaatttcgcttttcgcatttcgctttttatttttcaatttggcccatccctgatttgcactgcttctgaatttgcacgcacgtgagtagttacaagggggccagggtcccacttttggcgctaaatttgctttggcgccaaatttaaattcaaaattcctgaaagtgttgaaaattgaataatttatgttttaaaatattgtactattatttttgtaaataacaaaattttttattctcctagaaacaggaaattttttaattgttttcggcttttgtatcggaatgggaaattttttttctacgggaattgctgaacgtaattttacaaaatttttaatttttctaatatttttctatctaaagctgacgttgaacagccgtttggaccagaccagcgaccgagtgcgccggtcgtgtgtgtgtgtcgtcgtgtgatgacttgggcatggaatgaacgagtgaccatgctgctgctgctcattctgctcgtactgatgtgccagttcgttttttggaacatcaccatttgagattttttttggatttttaaatgattcgatgctttcaatttgatattaaaaaacttttttcattctttattaattttattaagtgtttttcctcatttaaatatcgcgaatattttcttagcagctaatttattgtttgtttttgtcagtggccgcacttcgaagaggccgattgttttgcaggtttgattgggtttagatgaaaatgaagagaaatcagggcactaatttggtttaaacatccaatgatcattaatgaacatctcagttatcaggtcatttctattttagggaattgttattagcacatgtttaaacacttctaatgactcagctttcatttgatattgtgaatgttaatcacgtaagaaaaaagttatggtccgataactgagtatgatcattgtatgactcataaagtgcaattcattttgaactgattaggaactaaattcgtaatctaaaacaaaaattataatttacatagtcatgtgtgctaatattggttgtatgatttacaccgaatcaacccatggcttcccctattattagatttgtcgtccaaaaaattgtgagcacggtttgctttcgtcattatcgtcgaccattgaccggttgaccatcgctgctgcaacttttgtttggattggtccgcttaatgttcgccgacatttttatgttttttttgctgtgacactttttaaaccggtactattatttagtgccctttacaatcattttgcggtcgctttgtgcgccgtttccgtcaacgaattgcaacacgtgggacgtgagcggagggcatttttggctcatttttgcaggtttacaaatttacggtttttcggctctgatttagctaattttattcataaaaattgtaaattacgaaaaagctaggatcaaaaactctaataaacttgcatatcggaaccctttatgtataatttttgaaattttcaaactgacgatcatgtattagggatatctaatgtagcaaaaagtttttatttctgaaagaagttataccataaagccataatggcgtcctgctgtgttctcttttatgatttagttaggtcattcatttatacacattttcgatattttcattcttctatttccttcacatctcttttttcagctttgccattgttttgaaggcgtcgcccattccaaccgccatattcattggcaaattcaccgtccgttttctgaatggcaccaaaaatgacaaagcaacgaaagcagagtggacaacggaaagcaatttccagaaagaaggcggactgtgataacggggtaggaggaattttaaagttaaaaatcataaataataaacaaaatggatttaaaaatgagtaaagcggagcactttgcttataatgttaatataataagggtcaatgacggacagccccctaactgatggtttattttccgaaaggatttcactgttaatcgaaacagtcgtttacggtaacatacttccttttggtttactgattggttgttagatggtgattaccccgctgtctaacagcgaattccaccgctccgctgtctaacagcgaatcccccacttgctg

SEQ ID NO: 2674 - DNA, 5544 bp, Heterodera glycines
gcatcggttcggggggaccgcccagaacacaaaaaacttgattttttcaagtgtccgttagtggtactcaaacaattatggggatcaaaaatccaatgcagaacaaatgactaggctatagggaagctacttccgaagaattcggtctcaccatatatctgtgtcgcatcggttcggggggacttgcaccgaaaacaaaaaaatcgattctttcaagtgttctttaggggtactcataccaaaaaggatggtgttacagagaatgagtgtgtcgattaatagtatgatctattcattggatttgacgggcaaacagaaaattaaatgaattatatatgccatctctattttattgacattgtgcgatattagattaataagttctgccctgtcgattttttaaatttttaaaaaccaaaatttttactaattgctcctcacaatcaatattctcacatcatttcttctgatcaatcgctcctcagtactgtgcgcttcctcgtatgcctcctttcctcaacaaaacgcgcaccgtgcgctcagaccgcggcacacccgaaagggattgcgtcgcaatttctgtacacaaatgatgcatttatatttgggcccgtctaatgtgcatttcctcaccaatttcatgcgggtctccgacattaaatgacggcgttgatgggcgaccgccgggggtgatttctgtacaccaatgatacatttgtattggggtccgttccgtttgcactttcttaccaattgcctgcgagcctccagcattaagtgttgccgacgccgtgcgaccaccggtggtgtgtgcgcgtttgtcaaactcatttgtattgaaccaatagggcgtggcgtaggcgagcgcattgaaaaaattcctctttttgaaggaggtggcaaaaagcgtcctgtataaatatggtataaagtcaaagatagaaaaaatgagtgtttaccactgcttttgggtgtttccgcaagcggtggcatgttttccttgtcgtgccgacactcagcatgggcgtattggcgtggagaacagggcgaccaaggcgtatcagctaacatttcttaaagaaccccgaataggatttaaaactttttaactttcacactacttacggcgtatgacgtttcgctctccactataatcttcatcctccccctcctccccgttgttatcgttaggcgtccaatggtccgtcggatacggttgcggatgttgcacaccatcttccataacaaattggtgcggattgtgtgggtgttgacgatgcggttgtaattgatgaatccaccacggtgtttccacagtgtatataggcatcggtatgtcgtttacgagtagggccactcccggtcgctcatgttgctgaaatggcacgggtacacatgcaccgatggaaatatcaatacccagccagctcagacttactccaagaataatttggcgctcagcgggaggttggtcgatttcgtcagcccaaatccaccagcgctgagcgtcagggatattgttgtctgtagttggggcatacgcagtttcggcataggtattattgtggctgttgttgaagttgctcatttggattattttatttaaaattatgtagcgaaaaaaaaacgaagcgaacggaggaaaatggtgcaagaatggcagaatgagatcatttggtccaaactccggcaccgccctttcactcagtgatggatgtcacaaagaacatttgttgccatagggcgcggttgtgggggacatacaatgcgacgatcaaaacgaatgtgtcaatcaatcatcagattaggggcacaggaccacaaagactaagggttttgtccatagttagggccgagaatacacatacgcggtaattagtcaaaggattaaactttatatttggccaccaaaaatttggacacagatgtaattaatcaattttaatccgtttagaggccgtacataacttacaaataaaaaaatttaatattttaaatatcaattcatgtcgttcatgtcaattctttccaagcactttcgttttccttgcatgtagttgtttcttggaccacctctacagtatgtaggaccgcaattatcgtaccaaaagttattttgactgtcattttcgtcattatcgttgtttttattgtttctgtttttattgctgttgttggtgttgttgtagttgttattacgtggatgatatgccataaattgcacagaattcatatcgctgagtcgcatgttgagcattgtacaatgtttgcacaggtgaaagttcaagtccacacctccatcgttacactctgttatgtcgtccttacggttgtatagctcttgtgcacacattttacatagtttaaatgtcaacatgtatttttgtcttttcaatttccataactggtttgtggggcgcgcgtagcagtgatcatgttcgatcacatcagtttgatgttgttgatcttcttgttgttgttgttgttgttgttgttgttgttggtgttgttttggcattttgtcctcatgctgaaattgattattcatacaaactccttcactttttttaatgaaattgtccatttttcaaaaaattagttttaatgaatgattaaagtgtatacttaagcatacaatctgcacttaaataggctgctatgtacgattttttgaagcgaattttttagcgcaaaatttgaatacaaattttgagggtgtgtagtgagtgattcgaccattcattctttcaaaaagcacgcattcacttttcgtgtaactaactcctgctcagatgagtttgctcgatcaattcacgaatttgtttaactgttctgcttatgacgttagtaacagactgcttagtgatgctgagcgaacaaaggctttagtgttgtgtaatcacaaacttctcactaccatgtacaaggaccgtaatggactgaatcacacgttcacgtgtactggtctgtccgcagagggagcagaatcccttctcgcttatggaaaactgagagaaccgttcaatatttctgtcgctgcccattattacgcacgtcatcgtataatgctgagtcaccccaaagcaccatgtgctattgagcgaacaactttgtctcatcgtggcggtcagcgaaccaccgtattaaagttctatcccttggaactcgtccgattctcctcctattgtgcaattccatcacggtctcctcatatgaacacctatgttgattatgctgattactatgctgacgatgatgatgatgaattatctgatactacgcttctccgtgataataccaatggggataatggtgatgatgatgactctgacggtccactaatggttttaccatccaataacctacctccaatgtgttccttacgtctggaatattggaaagtgtccgatgacggagaatgggcaagggatgaagtatgggttgcggatgatgagctagacaaattgcgtacaatactgcataatttataactttctcttctatttattaatttttatcaaatttactctctcttgcactaattttatatttttctgcttaaaattatacatttcccaaagctaattttgtaaaagtttactctttaaaataaatttatcgataagacattttatacaaatccaaaattaagtacacgagtgtcgtttggggaaacaatacctttcgtaacaacgggtcggtaacgcttggtaagtgctaccgagtgtacactacctgtgcgtatattgggtcgtaggaaattaggattatcaattagtataacttcgtcatcggtattgttaccgtcgtactcttttggtcctttggcgtaccgcagaaccgctcgcttgaacgtatcaaaatgtagaagacggcatgcgtcgccgctaagtgttatgccgcgcactttgaccaccgtctgctccttaccagtttgacggtggcgcattctcagtgcatattgcttacacccccctgacacgaattcgagcagttcatgatccggccattcatctgacaagtctccaaggtggggtccaatatccagcggacacccgtcctcttcccgatgggcaaaacagacactgtccgtgtctgtgtatatcagctctgtgttttctgcacgcacaactcgtttcatcaattttagaagatggaggcgtgctgccgatgttgtccataaggagagaacaatgttggagcaatcgtgctcatcggtccattcctttttagcggtgtatgtaatcagcacacactgttcatttaatgggtccacagagctgacttccagctgaggattgtcgaggtacgcacgtagttctgatggcgaatcagtaaccacagtctttgatagaccgttacgtagtgagaaccgtccccaaagggaattgttgcatagcttggctatagtccgcttcgccttattgtgttgcatgcgcgccgggtcaatgaccataccaaagcgctcctcacactctgtgatgaatttttcgcgttcctcctccccatttcccacctcttccggaaacccgctagcatgtgttttcattgtcataaattctgcaacgtaaccgcgaaaaacacgctcactccattgttcctgtgtccattctatggatcgataataggcggtgcagcggtacccattgcgtaatgcctctgccagttcgatcgatgtaaccgtagaaacccaaccgcgctgctcatcgctgtgcgtgcatcgataagaagcggagacgcctccctctggatgaaggcgtgcgcatgttccgcaaagtgggaacagcaaacgctgatcaaatttaaccggtagaagaacggacgtcaaagtatcgcatacgccacccttccgggacctgatagtgaaggcgttgcggcccaactcgaccaccatgatagcaatcccttagattaataggtccgctgtttcgataggaagagaacgcctgccgcatgtcgggttcccgtcttagccgttcctcaatatcacattcccagaatatactaacagttccacgaatttgtgagcgaatgaaagccattcttcgcgcatcgtcctcccgaattctagcagctgtctttccgctcggcattacagtgtcagctttaaatcggtgtcgttgatggtcatgcgcatgccagcagcacccgttcacctcaattacgctatccgtctcatgtatataaccgtccactgtatagcggccaatgcggtgctctccgcccgaggaatgggcggtctgaatttgcagtccattctcctctgcgtaccattccatgaatttgagcgcgagcaagctctgattgtttgccgtgtcatatccgctctctgggacgattgcgagctgatcactccgtaaatgattgaggcggaagtgtttcattgatgcgctcgcaatggtcagcgcgtcccaagtgatgtcgatccctccgtttccgttatctccaagctcaattcctccagcgtcttcctcttcctcctcctctaccctctccttcatcctccgtcagacgggtgttgtttatcccgggttcgtgaccatc

SEQ ID NO: 2675 - DNA, 2885 bp, Heterodera glycines
  misc_feature (51)..(51): n is a, c, g, or t
  misc_feature (98)..(98): n is a, c, g, or t
  misc_feature (124)..(124): n is a, c, g, or t
ttcggtcgcctgcacttttggtgcacgctgaattgactcagcgcgtgcggncaatgcaacgaattcatcgtacgacatttctggccttcgcgacattncgagcgttaatgagagatcgggattngacagtgctctgattaggtgccgaattgcataatcatcgcacaaattttgcgtcaagcccgggtacgcacgggaaacaagactttgaattcgatcggctaatgcgtccagactttcgtttgactttcgctttactccgctcattaactcgtcgaatgcgctcatttcgcgacaatccgtgtcctcgagctgttgttgcattgcccgtcgaattgaatcgaaacgatagggctgggtgttaagcgcagcattaaaggcacgctctgcccgtccattgactttggattccaacgctttaatccgttttttctccggccattcttccgtggcatttgaaaattttttgaaaaaacttttcattttgtcagttccctcattgccatttagctcgggaagtcggtccatggtcagcacatattccaaattaccgatttttaattcattattccccgagtttggttgttctctgccgtcgggatacaaatgtcttccgccgtaatattcaggaaaatattcatttctccccgccattggctgctgatgatgcatcactcctcgcatattttgttgctggagcagcataggctgatgcgcaccgtgttgctccatatacgcagcttgttgaatttgtccgtgacaggtttgtcgcatcggcaccggtgcatgaaaagcactcgaataatgtcgatcgatttcgacgtgttgctctcgaaaaacttggagacgggcattaggatttggcggtacatcaattcggtccgaaaaatgcagattgggtccccggttttcgttacgggtcgggtttacaatcacattcgggtttacaaccacattttcccgaaaattttgttcgaatggtgaccgaagtggacttatattacgccgctctatgttttgttgcctcaattgttgcatttcgatgtaaggagtcgatgtcgctacgcgctgttcccccacaattacgttttgccgcaattcgttttcgaaattttgctgtatttgttgtggttggtcattgaccaatggttgaacaaaacttttttccacattttcacccaaatttgcattcgccaacaaattgttaccatggtcattcagaagcacttcttctcggtgcacttgctgctgtccgtttcgtccatccgctgcattgttggcattttccgtcattttcagtctgcgtcgaatttcgtttgcgtcgagtactgatgtgttcgctgaagaaacagaattacgcctatttccctcgttgacattcgggtttgctgccaaattcacaggattctccactatctgttgtcccctctgttggtcattgtctccacttaacggctgaaccccaagattcaccgtcctctggcgagtgttttttggcgatctcacaataatcattggctttacttcgccgtttttcaatttctcttccaaattcaaattcgaagtgccaatgtcggatatcgaagcggcggaattactttaccgttttgataaaaactcagctttgttgacggttttactttaccgagctgataactgtcgacttctttccgcttttctccaccaaatgtgatttgcttttcacttttacactccttccaactcgtgatttacttttcacttttccgaatctcgcagcttgtgagttacttttcacttttttggagacgctgtcggacttatagtctacaaatgccccggatagtaccgcgttgatcgtcacctttttccaggagcgccacgtcgtaaaattagccgcctttttgccggggtcctcctctgctcttttgccgaattccaaaacggggcgaaggagaagaatgagaaggaagacttttaaaatcacttaaagccacagcaatcccaatcaattaaatttaaacaacacaacaattaaaagtaccattaaaattaccacacacaatccgcatcacaaatttttaagtccgggcgaagagagccaaaaaacataaaatgaaaatgaaagacacaaaaaaataaacaaaatgccaaattaattaaaactttaaaagtcaaatgaggtcattatttaattatcacaataatttagtctaaagaagacaaagctaatatcttaaaaccgcatttttaatgcgacaattaatgtcactcttacaataagcattttctcgcacagaaaatgacataacaaattgggccacggaccaggctggaaaacttacaaagccgtgcttaattttacaattttacagttcattcatttttcactttttcttaaattattaattatttaaaattaaaattaaaaaacaaatggaacaattgatgattactgaattcgtttaaattaaaataagtgtaagtgatctattaaaagaaatttatgcagtcgtataaattatttttaaaattggaaatgccaaaattaaaaaacaaaagaagtaaacaagagtgcatcaaccagagaaacgatcagaggaagctgagcttgattcgcattcagaacttgaaaataaaatgtatacgtaaataaatgaggcatttttcgacaaaaataattcgtggaaattgacaactttccgcagacaaaaatacagataatatattattattttatatatattatacgtataaatatatatattataaaattaatttaccccaagaaagtccctcaatgtcgaacgcggtcgaaacgggagcatcgcaacaggcgacaacgatttgcacacattctcgcatcaaacgattgaccttctgaaaaaaaacatacatattggggg

SEQ ID NO: 2676 - DNA, 3805 bp, Heterodera glycines
aaaaataaaaaaatttttgtttttaaaataatccttaaaaaacccctttttttaaaataggttttaaaaaattgaatttttaaaattttaaaatgggattcggaacctaatttaagattattttaaggcattttggtgcttatttcaacccttagggaagaattttctttcaaaaaaaacatttaaattttttttttaaattatttataggtgcatattaaactattttagttatggaacttatttcacgaacaatgacatcggaggatggcaattgaaaaacattttgtttgcctataagaaaatatcatcaaaaaccgacaacaacgaaattgggtttaaatttatttatttttaaaacttattttatttaaaatcatttgaaaatgaatttaaatggctaaaaaaaaagtcttaattcataattagattcaaaaaatttatgatgaatcgtttttaaatgatcatttgtatttgttgtggttggtcattgaccaatggttgaacaaaacttttttccacattttcacccaaatttgcattcgccaacaaattgttaccatggtcattcagaaacacttcttctcggtgcacttgctgctgtccgtttcgtccatccgctgcattgttggcattttccgtcattttcagtctgcgtcgaatttcgtttgcgtcgagtactgatgtgttcgctgaagaaacagaattgcgcctatttccctcgttgacattcggatttgctgccaaattcacaggattctccactatctgttgtcccctctgttggtcagtgtctccacttaacggctgaaccccaagattcaccgtcctctggcgagtgttttttggtgatctcacaataatcattggctttacttcgccgtttttcaatttctcttccaaattcaaattcgaagtgccaagtcggttgtccaagcagcggaattactttaccgttttgataaaaactcagctttgttgacggttttactttaccgagctgataactgtcaacttctttccgcttttctccaccaaatgtgatttgcttttcacttttacactccttccaactcgtgatttacttttcacttttccgaatctcgcagcttgtgagttacttttcactttttggagacgctgtcggacttatagtctacaaatgccccggatagtaccgcgttgatcgtcacctttttccaggagcgccacgtcgtaaaatagccgcctttttgccggggtccttctctgctcttttgcctaattccaaaacggggcgaaggagaagaatgagaaggaagttaaaatcacttaaagccacagcaatccaaatcaattaaatttaaacaacacaacaattaaaagcaccattaaaattaccacacacaatccgcatcacaaattttaagtccgggcgaagagtgaaaaaaaaaaataaaatgaaaatgaaagacacaaaaaaataaacaaaatgccaaattaattaaaactaaaaagaattttcaattttttattggatagaaatttcatttttattagtattttcttgaattttagcatttttcttaatttcatgatttttgtaaatgtataaatcctcgccctcctacttattaaattttttagcttataacttgatcaataatagactaaataaaaccattttatgctcattttgaaggaaaaatttgagttagatacatgaaaatagtgcgccaatatgagagaaaaaaaaaatttttttttcacctggtcaaaaatttttcctcggctcattctctttaaatttttcatagcttcctattttgatcccctctaccgattccaagtttattttatcaaacttaagtttttaatttgagatcggctcttgcatttttacatgggaaaagcccaaaaataaaattaagttttacaaagttttggcgttctgattactgtataaataaaaaacaaacttatttgcaatgggagcttaaaattgactcgcttgtacatacagtatggcacagaattccgacaagttttttaagattcaccattttctgagtggaaaaaaaggacagtgtttcatttgacatttgtcaaatgggcgtctgaacttgcccattttcatttgatcaacgacagcaacaacaacaacaacaacagtgaaaaacaatttcgaaatttgaaccttgattctaaatacactaaacaacacaatgtttttctgcattatgaccaatcgcttggccatcaaattgccaacaaatttaaaaatgaattttcgccatgtgaaaagcagcaaattgaaagccaaattttgcaattgactttttcattagctgcgcgaattcttctttctctgatgttggcatatatttaaataaacaataattcatatacacatacaaatagaaaaaatgggaccaaaaacaaaaaatttaaaatttttttcgattgtctataattagggttgtcaattttatgtaaatacatatatttctttcagagattctcgtaaatattttatattttttagcactttttcataccttttttaatggatattttatgaaatttttattaaatgtcccaaaagcccaaaatttcgcaatttcgcaattttttcgtacatatttcattttctttacatatttttggagatatttttgagaatttatcaaaaatttcttgtgaaaaataaaaaatttttgtttgtaaatatatccctaaaaaccctttttttaaaataggtatcaaaaattgatttttaaaatactaaaatgtgattcgaaacctatttaagactattttaaggcattttgtgcctatttcaacctttaggaagaattttcttccaaaaaaaacatttaaatttttttaaaattatttataggtgcatattaaactattttagttatggaacttatttcacgaacaatgacatcggaggatggcaattgaaaaacattttgtttgcctataagaaaatatcatcaaaaagcgacaacaacgaaattgggtttaaatttatttatttttaaaacttattttatttaaaatcatttgaaaatgaatttaaatggctaaaaaaaagtcttaattcagggatgggatccgtccttgaatggcaaggacgtccttgaaattgggccctctttcttgaaaataaaaaatgtccttgtatgcaaggacgtccttgaaaatgagcatttggaaaagtttaaaaaaatcaaagaaatttgagaaatctttgtaattttcaacaatattttgattaaattttttggtcatttttggacaaaaatctgtaaacaactcgcattaaaaattacaaatttttccggacccccctatcctcaaaaaattttttaaaaagcgcgccgtaaaaaaacccattttataaacaaaaaaagtcgttgcatggcttaaaatcgcaaaaattaggcagtttttggtgaaaatctgttaacaaattgcattcaaattttaaaaatttttccccggcggcgcctgtcggcaccgccggacccccccccccccctctgtcccacaaaatttttggaaaaagcgcgccacaaaaaaagcgtttttaaagcagaaaaaagtcgtcgtaaatgaagaaaatgataagtgaaaacaaaaaagtgttggaaaaaatcaattccggtgaaaaatccatttgaataaatattaaccattttgcattgcatataataaaaattttaaatgtccttgaatttcatgaattttccccactatgtccttgcaaatcggcatacccgtccttggaaaccgacttcggacgataccatccctg

SEQ ID NO: 2677 - DNA, 1624 bp, Heterodera glycines
gggttattctgttccaaatttatgcagggatcggggtcaactttgttactacatcagaacatcaaattcaaaaaaatcgcatatgagggtcaaaaaaatatgcaaaattgcttcaaatgattaccttacaattttttcgttcaaaaataataaattatttttatctctcgtctctcatctctagcgttataaattaatatgatctttaatatatttttctttgcgcatatgctattaaaaagcggctcagaaatagcatttctacgttaaaatttttttggttgttttggtgtttattctcctgatgagataacacaaaaaattattaaagcaacaaagattcatttttagagaaagggaaaccattaaaatagtgtatgccagagatattttctgcttttccaaaaaatccaaccaaaaaggggaccaaaactaatttgtaagtcaacattagtaccaaaaatatacatattctaaatttagtgtaaataaaggcacaactttttttgtagttattttgttcaaattataattttaaattaaaaaaattaagccgtccaaggccaacaaaatttgaaaaacgggcgcgaagcggccgactgaggccgcgaagcggcctaacgagctaaaaaatgggcgcgaagcgcccttatgagttcaacaaatttaaaaaacgagcgcgaagcgcccgtcttgagcctcgatgtggactaaaaaaacccctataattttttttaaattcaaaaaaatctctccaaccaattcgatcaatttgaatcgcttcacagcctaggtagcgaagctcggaaagcgtgaagcgctttatccccactaaatacccgacggttcacgcacccgctagttgtatatataaacttgcaataatttattttcacaaaaaaaaataaataaatcgttttttgctgtattatttttgcattttttcactagcatttattaccactttttcggcatattattttgcccctttttagttaattattttgggattttcgccacaaaatccctagtcattttaaacaaaacaattttaagcaaaatggattgtgcgttggtcagttttgggagagagttggcacatcgttatgttttaaaataccattcatttactgagtttgccaacgcaaatgaaatcaaatgcggcaaagatccgcgcaaatggaattggaatggtgacaatacgccggaaaatgggtaaataaattctctctaaattttaacataaattgcaatatttggacattttgctatttgccaaagtattgtatcgattcatactgttttctctgggtgttcgagcatacagtaacacacattacagtatgtacatacaataatacttataattgggtgagaattttcagtttttttaaccaaagtctcggtctcgattctgcgttctcgggttttgttgtctcgaggctcgggccagagtcacagtgtaaggcaatagttcggtatatgatcattgatcaataggaattcgttttttaggcaaattgtctaaaatttgtgcgcattttatacgcacagataagcacgaaaaatgcgttttctacttggtttgggatgtctatgatgacttttataatgccttttttgt

SEQ ID NO: 2678 - DNA, 4431 bp, Heterodera glycines
ataaatgctctttgaaacggttcccgacctgcttgactcacccaacccgtctgatcacgttctgttttgtgatcagtgccctcttccgggtctttcattgctgccaatgctgactctgctgaccgcatgcaccgtacttgcgccgacaccgctctcctgaactcgcgcactgcccatttcgatcccatcatactttctctgatccgcaattccgtgagcactcgcaccggcaattttgcctccagcaatgggccgaatgagtcgtcgtccacgttcgccccaagctgctcgagttggcacacgcaccgctcaaactcgtcgatcatcgttgtcaggctgttcacgctgtcctttgccggtggcaagtgaagaagccgggcccgaattgcccgctgtaaatcgtcagtgtcgccgaatcgctcttttaacaggtgcacgaccaccgggtagttgccgtcggagggagggtagacttcaacagcccgccgggctggcgatccctcctttaagcagcgcagaagatgcaattgtttttcaaacccgggaatgggtttgtcgtccacagctcgcttgaaataggcccaaaatgttgtccaatcctcgggctttccggaaaaagtcggcggttgcagccgaacagtctcgaatgttgtcatttccgtgatttcgtccctcccgtgcttccgatcatgttctccctcgtctcgagcatgccgtcgaatcgggtatgtctgacgctcccgatagtcgtcgttcacgtgagtctgctgcttttcgatttttggttgcatcagtgccagccgatgggctgttgctgggggaaacgcccccatctcgtctcgatttcgattgatccattctcgcgctgggttcgtcactctcatgctggcgacggatggtactttggcacgccgctgaaaaatcccgtccaaattcgacatgacgggtgtcgcgacccgtcccattggtcttcggttgtgttgcggtacaccttgtccgtcgttttgccatcgtttggccgccccttggaaggatctctcccattcttccatgttccgattttccagtggaggtgggtcgtcccccaccggatggctgttgttggtcccgaatgacccgctcaatcgagaccgcgcgattgcttcttcttcatcctcgagtgcctgtcgcatcgtccttaagtctccgatgtgctcgtccgcaatttgaagcagttcagctggtgttggatggtttcgcaactgcaactctttcgttgctgccggcagtggcgctgtcagtaggtcgtagaagaagtcctggtgacctgcgggttctgctcccgctgctgccattccaatctcgaaatgtccttggaagatttgagttgcctccttgagtcctctctccatggccaaaagtcgcgctgcttggtagcctgcctccccttcggtaaggtcttggtcgatcacttctcgagcctccgcaattcgagcggcgagagtcccggatgctctctcgattctgtcccgcgctgtccgtaccgggatggatacactccgcaaattgcgtgatgggaagggtagcatcccttgctgatttgtcgccacgcctgtcgccatgttgcttcctctcgttgcttcgtttactctggcaactttttgttgctcttcgttcgttgaagcgacgggaccatccccgtcctgcacattttcgtcgtgctgtgcgccgttgcgatggtggccctcattcgctgggtccatgttgctctcgcttccgttctcgaactcgaattgttgcatttgtcgtctctcgaaatgttgagctggagccccctgctaacggcaccagtttgccgttagcttctcgaattcgtgctcgttggtcgctcgtagaccgattggtcgctcgtagaccgattgttggtggctgcagttgccccctgctaacggcaccagtttgccgttagcttctcttcgttgtgctgttggtcctcggcgaccaaaactctcgactgatgctttgccgacgtttgcagaaagcccctgctaacggcaccagtttgtcgccaatcttttactcgggcgggctttggccaaatgcggcttggcccagctgaggcgggattggttcccgctcctcttcaccgctctcgtccctttttcctctgctcactccgctcgctgtgccgtaaagggaatggcgccctttttgccgttcgttttgatgggtctgatgctgctgaccgatccgatcagcgccaaagggggacgagaatgggaggggggaggggtgacaaaattgaactggtactgttggatgttatacagcgatttgctggttgcttaacggcaccaccgacaagattttggtgaagggcttgtcggacccctttgagcagctccgaacgggcgggagttgctcgacaagattggttgtgaagggggcttgtccgaccctttgagctgctccgaacgggcgggagttgctcttcgctcttgactcgatgaaacgggttttgactcccgtttcctgcggcggatgctccggctggcgggagactgagaccgaaccgcgagactccggctgcgggaatctgaactgctcgaacttcgtgacgttcgctctcgacttgatgagcacgggtttcgactcccgtctcctcctgtggatgctccggctggcgggagactgactccggcgatgcgcgcttctccggctggtgggattagcggcgacgaacgggcctgcccttcggtggacggtttggcaccgctcggctcttccttccttctctgccctgcttggtttcgtcgacgacgggaattcgccccgtccctacggctgctccggctggcgggagactgacaccgatccgcgagactccggctgcgggagtctgaactgcttgaaattcgctgacgctccgggccaactcccggattctccaatgccaaagggaaaggaactgggatcgggaggattgggggagaacgacgagggctgccaggaaaggaagggggtcaagacgtgaatgggcgcctccgtttggccccgcacgagaatttgccgaatgtgatggagtgtggagggtgcttttccctcctttccgaatcctccaagccgtttcagcacgaatttattaaagcaaaacgaataatgaataaaagcgacgaattgatcgaattgggcgatgggacgggggaattggaggaattggtcacaggcagaccgaatatgaagcgaaggggagtggaagcaagagaagagaagagaagagaagagagcgaccccttggccgggggcgcttaaatagacaattttcgaagggggcgggcaaaaggccatgcacttagacaaattgtgagagagacaaaaaatggacagaaaattctagaagcgaattgcgaacaaaggaaatgggcgcacaaaaattgaatgtgaaatggcagatgtaaaaagtgagaaattgtgaaaggaaatctgagcacaaagttggccgaagatgagccaaccgatgagaaaagatttgaattgtgaagggatgcgatggggcaaaaatgggacaaaggaacggacaaaatgtgaatggtacgaaatggagaaatgcatatgagaaattggatggaaaaggggcaaaaattaggaatgatcaattttgaatgaattgatgaatcgggactcgccccgatcttctccaagaacatccctcattctttttgcttcgattgagtcccgtcccgttcatttgtgcaataggcggggattgacccgccttctcgtcgccaatgaaaaaattggcgacaacttagttaaaataaacaaatcaaaaacctaacgctttatcaatatataaaaaaacaataaataaatgttaacaaaaaacaacaattttcaagggttcatttgataatggtgggaaatacctcgaagaaattccaaaatagtgtgaaatttttctcaggtgacaatccagcgatcgcagaattgtatttgtggtcggcaattttctgttcacgtcgaagaacatcagtgaaatgccacaattttagtgaaaattcaatcactcataattttacgagtagtgatcagaaatgcaccagattttgcagggtaacagctgagaagaatgcttattcatataattatttaactgtcccataatgtttctttaaaaattttaaacattgcaattttgcgtacttttccaattttttgcaaaattaattcatgaatattttttcagaaagtgctctgaaacgcaccaaattttatttacatgttaataaggccctcttatgattgcattctgaaaataggtgctgaataaaaaatttaaaaatttttaattgcttttttaaatgggccaatgtttaggcttaactttttagtgaaaattcaatcactcataattttacgagtagtgatcagaaatgcaccagattttgcagg

SEQ ID NO: 2679 - DNA, 4538 bp, Heterodera glycines
cccccgacttcgtctgcctgaactgcttgaggttcgtgcgcgccaaacctatctcctccttcagatatcgtcgaattcggctgaaacttggtaggaacattgaggagacttggggccatcgaactatctcccagatattttttctcatgtctctgagccgaatgcgggcgtgccgaatttcccgcttttgattgtgccgccgaaggcacttctgccgctttttcgaaaactgccgatttctccgtcgtcgttgcgctgccatatttctcgtccgaatagtgagggccattccctcgagaattgtcgtcccgaatttgtcgatttgcctttttgtcaggctgtacatcttcaacttctcgtcctcgcttttcggcactttttccgttcctcttggtttcgtttctctcctccctccttgttgccgagggtttgttccgatccctcgtttcgctctgagtcttggctgctcgcgtttcttcttcgtgtcgttcatgtactgcttcgtcagctcggtcgtccgtttcgcccgtttttggccgcgcttctttcagcggccaaattttcttgatcggtcgtctccgagttcgtccgttggctattctgatcatggcatttctgttatgttcgctcgctccttttgtctcgactatccgtccgatgggccactttcgctgtttagggtccatttccccaattggctcctctcgagacgtaataacttcgttcgcacccgaccgatcgggaccaaactctgcaggtgagttgtggcggtctcggctaacaatccctcgcgaattgtttttccgactctttcgttttcgcttccaatttcgacgtacttctccgatttgttgtcgtttatttgttcgagtttggtggatatttccgcatggcatggttgttaggattgatgccgcgggagttaccccgctgctcgcttgtgtgccttcgccgcacaaaacttgtccaaacacggtgtcgatcacatgcgcgccactctcaattttccgaaatccgatcacgtaatcccagaactttcgaatgccgatcattatttgaggttgcgttgtctgtgtgacggttcgcggttcgctatcgggtgttgctcccgactcgatgagttctgttttgattggcgtacagatctgaggtacttcggacacctcaatgctctcccatttgccgtcggtccgtttgagtcgtaggcgataagttgctgaccgaatccgctgcttctttcctccgaacacttgaactgtaagcggccgcttgtcgataggttgcggtccgagttgttgaattagctccgtatctgcgccgtcgacatggcttcccgggtcaagcaacaaagttgtttggcactcgtcttcgccttcctctgcagctgcgatcactctgcatatcatttgctgggccgggagtcggcttccgaaagtggtaaaagctcgttgttccccggcattcatatcgaactcgtctcgattgttctgctcgtctcgtactgcagtgaagtgagttggtcgatccatcccactgatcagcgtcgcatggttctttgcccttcgttcgtgctcagtgaaggatcgggattggccacccgatatgctcttccagcacagaagccaatgatggtcgtcttttcggcatgcgttgcaccggtttactcgttggcattgtttgaataagtgattggagctcatacagcgcaagcatcgtttctgctcaatgagtctcttcctccgtgcctgtgctgtcggataggcttggcatttgcttggtcgatgtccacttcttaggcatagtgaacagttccatatctccgttgtggcaattggtccgtttgatgcgacacggggccaattcccgcctgagctctcgttctcgttggcatgtgtgatcgatcgtctggcgaaacgggcgttcgtcccgtacctctcctcgcttcgtgttccgttggattgtgcacgggttggttggctgtcccgtaccataaatgctctttgaaacggttcccgacctgcttgaacttccagtcccgtctgatcacgttctgttttgtgatcagtgcgtacttccgggtctttcattgctgccaatgctgactctgctgaccgcatgcaccgtacttgcgccgccaccgctctcctgaactcgcgcactgaccatttcgatcccatcatgctttctctgatccgcaattccgtgagcactcgcaccggcaattttgcctccagcaatgggccaaatgagtcgtcgtccacgttcgctccgagctgctcgagttggcatacgcaccgctcaaattcgtcgatcatcgtcgtcaggctgttcacgttgtcctttgccggtgccaaatgaagaagccgggcccgaattgcccgctgtaaatcgtccgtgtcgccgaatcgctcttttaaaagttgcacgaccaccgggtagttgccgtcggagggagggtagacttcgacagcccgccgggctggtgatccctcctttaagcagcgcagaagatgcaattgtttttcaaacccgggaatgggtttgtcgtccacagctcgcttgaaataggcccaaaatgttgtccaatcctcgggctttccggaaaaagtcggcggttgcagtcgaacagtctcgaatgttgtcattcccgtgatttcgtccttcccgtgcttccgatcatgttctccctcgtctcgagcatgccgtcgaatcgggtatgtctgacgctcccgatagtcgtcgttcacgtgagcctgctgcttttcgatttttggttgcatcagtgccggccgatgggctgttgctgtgggaaacgcccccatctcgtctcgatttcgattgatccattctcgcgctgggttcgtcactctcatgctggcgacggatggtactttggcacgccgctgaaaaatcccgtccaaattcgacatgacgggtgttgcgactcgtcccattggtcttcggttgtgttgcggtacaccttgtccgtcgttttgccattgtttggccgccacttggaaggatctctcccattcttccatgttccgattttccagtggaggtgggtcgtcccccaccggatggctgttgttggtcccgaatgacccgctcaatcgagaccgcgcgattgcttcttcttcattctcgagtgcctgtcgcatcgtccttaagtctccgatgtgctcgtccgcaatttgaagcagttcagctggtgttggatggtttcgcaactgcaactctttcgtcgccgccggcagtggcgctgtcagtatgtcgtagaagaagtcctggtgacctgcgggttctgctcccgttgctgccattccaatctcgaaatgtccttgaaaaatttggattgcttcctggagtcccctctccatggccaaaagtcgcgccgcttggtacgctgcctccccttcggtaaggtcttggtcgatcacttctcgagcctccgcaattcgagtagcgagagtcccggattgcgccacgcgcttgggggttggggtgggccaagctgaggcgggattggttcccgctcctctgcaccgctctcgtcccttctctttctgttcactccgctcgcgatgccgtaaagggaattgcgcccccttttgccgttagctctgatgggtctgatgctgccgaccgatcctatcggcgccaaatggggacgagaatgggagggggaggggtgacaaaatggactggtgcttgatggaattgtgcagcgatttgctgcttgcttaacggcaccaccgacaaggtttggagaagggcttgtcggacccctttgaactgctgcttcgttctcgactcgacgatcacgggtttcgactcccgcccactgcgcgcttctccggctggtgggagttgcgctgacgaacggccctgtccttcgttggacgatttggcaccgcccggctcttccttccctcactaccctgctcggacttgacgacgacgggagttcacacccgtctcttcggctgctccgactggtgggagaccgaactgctcgaatttgccgctgcttcgggcactcccgaacttccccccggcccggcccgataatgcgatgagaaaaatgggacaaaaaaatgggcagaaattgtgatgtgaaaagtgtgaacaaagaaatggcgcataaaaataaaatgtaaattggcagatgtgaaaagttaaggaatttgaaaagaaataactttgtgcaaaattgttttgcacaaagtttgggccggagattagccagcagatgagaaatgaatttgaaaagtgaagggatgcgattgggcaaaaatgagacaaagaaacgggcaaaaaatgaatggtacgaaatggagcaaaaatgcaaatgagaaattggaataagagattttatgaaaaaggcaaaaattaggactgatcaattttgaatgagttgatgaatcgggattcgccccgaccgtctccgagcacgtccctcattcttcttgctttgattggtcccagtccctttccatatcgtgcagtaggcgggagttgaccccccatcttgtcgc

SEQ ID NO: 2680 - DNA, 3707 bp, Heterodera glycines
caccaaaaatgttgaattcgataagtccgatgatcgatgtcctcaggtcgacccatcgtgccgaattgtcgccggtccaatgagtgccgtaatggcccgagctgacaaaagtcgaacgtgccaacacttggctgcgcttcccaaacaaatcgtctaaatttcatatttgactttttcgcaaatattttggccaatttcaccgagtgcttttcgtgtggccaccatttgagaccatccgtacaaattgtgcgtgttgaacattcgttgttggcctcgcattgtcatggccgacatgcaaagcgttttttcactcaaaaccgacccgtattggtacacatttatggtcttaaatgtgctaattggttatttaatcagataaattcacctcataagttggcttatcaaactgggaatccgtcccgctgagtggacattgtaacggctgaaggttgtgactttgggccgacggcttttcatttgtgccaaacgacgacggctcgttcatgtcgatccaaatgccatcaaaagggacctaaaatatttttttaataataataaaattaaacaattatcactttcttgtgaaagttttgcagctcctctgaccacctaaagcaacaaaaacataaatttgaacattaaaatattgtaccatttttgggttttgttctcggggtccaaaaagtcgggaaaggccacgtggcgtcccggccaaacgacgctgagcataatctgtcaaaggattcgtcccatttaagaacccatcaatttgcattttgcctttgtttctttggccattgggtaaagattttgcacatctttcggcacttggtcaaatcgttcccattccacaaaggaaacgtccgcttggatggcacgttggaacacttcgtaatcgacttgaattgccgggtcgaggattggtacaaatttaaggccctgccggtgcaacgcgtccacgtattcgccaagagcaccccatttctcaaaaattaagtagaacaacacaaattggcaaattttactgattgtgagatatttgcttaacattacattctttatacttccttcatctctcttctcccctctctctgtctgtcgtcctctctctctctcacgctttctctctctatctctgtgtccctttctctttctttgttttgctatcattgaactgatcaatttgatcagaatctgctctctgtgctgatcagctgacattacagtccttcttcacctgttgaccaacagtgaagtccatgtactgctccatgtgatcgatgtccacaaagacaacatccaatgggattactgcagcctgaattcttccaattgttgccttcaaatcgttcaagtctttgtagccgtatcggcaaaattggtagccgaatgcccaatatggaggcaaatagggccggccgatgaattggtggtattggcgaacgacgagttcgggggaggggccggggaagaagaacaggtccaactgaccaccgatggtactgaaaattataacttaacgaaagcgattgacaaaatgttagccccgcgtaagtcttcaatcccgcgaatcacccaaaccaaaacattgcgtttgaaaatgatctaccgaattagtcaccgctcttaacttttcaatcctcgccttacggtacttaacagttcagcaagggttctcccaatcgggcggctgattgaccgatcaatcgaattgactgaccgatagaccaaatgcggcgctgggcccgtcgttatttcctgcgggttcgagttcagaatcaaaactccgtgcgcttttccgctcggttccaaggccaaataaaagggatgaacgcctggagcaatggaattttgtttgtttttttgtcactttttgcaatttatacaaattattcaccgtaccatataaattctcgacattttccaccaacggattcggcgcttcgtcccgcgtgaacattccccacgtggtgtacttgctgaagtcgtgcttcaactgctggtgcgcattttcgccaaagccatagaccaaatcagtaggcaaataagtggcgatttgaatgaattggtcggcgaacaaaagtccgcctaaattatcgttaataattgaaagaattttcaaaaagtttctgcattaccaatggatgtgtcccaaattttttgtccgtcgcttcgctcaacggtaaaataaaacatttggtcatgtgttggttttttaggataaacattgacaaaaatctgttcatatgtcgactcaattggtgcttcgaaattaaacggaagtggtggtcgaaatctgtttaaaaatttaaatttgagagattttctttttggtcctaccgattttcggcataaatgctgacatggagagcggacccgaactgcttggtgaccaattccaacgcggcaaagtctttaccgtagggatttgctaccccattgtttaagcgtatcaaattgaaatggtggtcattcgttttgccggccaaaccataacccgtccccggtgggaaatagcacagcggaacggtaccgtggtactgtaatgaaagaaaaaagtgatcaggcaatgactacgcattggtaccttgtcataagcaccatcccaaaggcagcccctggccaaacagtcggatttgccctctccgaatttgggggcacaatccacgcgagcatttggcccaatggcagaaaaaacggagcaaaaaagcagaggaaacaaaaatgaggacaaaatgagaaagggaaactgcggcatttttatagataattattctgaaaagaatgaattattatgagtcgtacttccaggaaagtgcacaaatttataaactaaaggtttcaggagtgatattaaagcaatgactttcgatgcctttgaattgttcacaaatcatatatttttaatatttaaactacatttttatgataaatgacatttaatttgtcatcattaagcagaagagaatgttttttatcctcttacatttttcataaaaaatatcttttgctctattaatgttaaataaaaattatctgctgggaatgaaaaaagtgaaaaaaacaaatgttaaacttttttattaaatttaccgtcctttataaaatgcgaaagcatttaaaaataattaataaataaataaagaggagaaatttgcttgttttattcactgattttgattaagccatttggcgatggcactttgtcatatgaaagtgaaagaatttccgcctttgcttttgctgattttccaaccattggcagaaatcgatcggccgctttttccgttaaatcagtggcaaatgaccgacccatcggagtgttcgtcggaggccaaagattttccgaacaaagcttcaaattaaaaatatggagcaaatggtaaaaagaaaacagaaggtgtgccatgtgccggcggggcgacgaatgattaaaagttttgtttggttttgcaattttcaatcagtcggttgattaatgtggagcaatttagcgctctttttcttggaatcaaccaatttacaaccttttgaaatgttttaaaaaaatggattaaatgatgggttttggatgataatatcataaaattatgattaaaaacaaatgagtgaattggaaagaattaaatagatgaattagagattatgctttttcttttcagaacaaaggagaatttttatcctctatattaccaaaaaaaatattt

SEQ ID NO: 2681 - DNA, 4470 bp, Heterodera glycines
  misc_feature (2869)..(2869): n is a, c, g, or t
gcttccgtcagaaggaattccaaagattgaactttctcaaattggaggacaacacttcctttaattggccaacatgtgttgatggaaatggccataccagaaacgaaggcagcagcaacaggtgactggccttcctggtggaatgggccggcaaacgtgggttagctttttctttttttttgcgtgggctgaggggggggggggggcaaatcgcaaaaaaagcgatcggtcggttcactcactcccatccgttcatttcgcccattttcaatcagtgaattttaaaagcataaattcatttcgaaaatcaacgcaaatgagtggctacaaaatccaccgctcccgttcctcgccaatggtcgcgtgggcttcgaattcgtcggtctgtgtaaatcattttttcataatccccctttattcagttatctcgcacatattccgtctccgacatttcggcctatgcgagtgccacggattactttaaacaacggtggtccaccgcgtacaatccgtaccataacagcagaaaggcctattattggcctcaccatcggcacacgtcgttgttcccagtgggtgaaatcaatcaatcaatttatacgcaaaagcgtgacaccgacataaataacaatataaataaatttggtcactgaatgagatgaggtggtttcaaaagtaaagaatcaacatcataggtgtcaagaagtttagcaaagtcaatggaattaagtaacctcgcctctttaggcaaacacctatagaggcgagaggtacgaataaaaaacgaatgataccgaacattggttgaacaataagcggttttaataataaaatcatttttcagttctgaatatgtttttgaaaaggaatcattatgctgaatatggatcttttccaaaattatatcatggaagagttttaaatctatttttattctgcgttttaagagggattcttgtttaaagagttgaagaagttcgttatacccgggtatatcatccttattattattacgtctaaaaacaatacgtaaaaatgttttttgaacattttcaagagcatcaatgtcttttttcatgtatggattaaaaatcggagaaccaaattccaaaatggatcgacaataaacattgaatatatttatgagaatttttgggcttttagttttaagtgacttgagtaaagcaaaagatgttcttattgcttttttagtaataaattctatatgtttttcccattttaagttatttgaaaaataaatgccaaggtctctaactggttcaccttcttcattttttaaaattggaatattatttattaagtaacattcattagggtttttaggcccaagatgtgaaactaagcatttattaggagcgattttaaggccatttaattcacaataattccgaaatttattaatgaaagaatggagtggagaaatagtattttttgatagtatagaataggccttaagatcgtcggcaaaaagcttaatttcaacgttttcagttttacaaaaattaggaagatctgaaatataaattaaaaacaaaagtggtcccaaatttgatccctgaggaacaccacttaagcaagggaattcatcagaaaacgcagaaccaactcgaacaaaaaatgtacgattttgtaaataattttgaagccatttaagcaaagtaccatttataccaacatttttgagtttagaaactaatctttcgtgtggaacagtatcaaatgcctttgctagatcaaaatatataacatcaattgattttttgttttccaaagctaaactaaagtcatcaatgacttccaaaagttgagttgtaacagagtgttttctcctaaagccatgttggcaattcggaagtacattatttgtctcaacaaaattagtgattttctgggtaatattttcttctagaatttttgaaattgagcataaaagtgaaattggccgaaaatcaacaggatttattggattgggtattttcggtactggataaataattgattttttccaaatgtttgggacttggccagtcatcattgaaaaacaaaaaatatgaaatagcggataaaccaaattttctttacaatttttgagaaaaatattcgggatgctgtcaatggaagtattattattgttttctagtttattaagagccaaataaatttcattaagtgtcattgtgaaaaagtcaatattttttttaggggtgacttcacatgaaacaggaattttttggtcagtgaagaccgagtaaaattgttcggctaataaattggatttagctttttcggaaaaggcaattttgttttcgctatttttaagagggggaatttttgtgtttttagtttttaaaaaagaaccaatatatcgaaatcgttgtttagggtctaaaccacttaaaaatttattttcacgatttgtaaggtatttctttatttcatattcaagttttttagaggtttctataaatttttctctagttttttcttttttaaggtctttccaaagttgtcgacgataaagcataatttttttaatatggtctgggaaattatgttttgaatttgatactgttaatggaacatatttcgatattaaaaaatgcaaaaatgctgcgaatttgttataaatttggtcaatttctatacagtccgaaaaaaaggtaacccaatcagtagaagagagtatggcatttatttccaagtaactagcttttttaaagttaaagtgtttaaattttctacaaggaaaaacatttagtcttaagtcgaattttacagtgttgtgatcactaagtgagaatgggggaccaactgaaatgtcttttatgagaaatttattatttgttanaattaaatccaaaaaattgcattccctggtgggttctttaatcatttgatcaagtcgtaaaccttcaacaaaaccaaggaaattactttcataatttgtcaaattattttggacagagaaagggccattttggttccagtgaatattagtaaaattaaaatctccaagaatgacaaaattttctgttgagactgttagtgacgaaattaattctacaagttgcataaaattttcgagtgtttcagtagttacaggtctataaaccaaaataagacggatttttgattctgtaatgggcgaaaaaacatcgatacaaagtatatcagaattttgtatttttggagtttttataatttcaaacggtatttcattcgaaatgacaaatgctacccctcctccctttttattttttctatcttttcttattaaagaaaaaggaaaattttctaaaatttgcgagtcgcttattttattgttcaaccagctttcggttattgcgataattttatacctattttctaaaagtaaaagcctaaactcatccattttgtttactaaacttcttgagttaaagtaaaaacaattgagaaagttttgtgacctcaaaagtttttttccattgtgcctccacgccgcgtcgtcaccatttcgttctttttgctttcttcataattcatccgcctttgttcacgtgtctcccgttcagccgccaattcttccttcgtcaaggagggcctgacgagcagtcgctgccaaccgacacgctgtttcagttccgtccggttgcgcccccattgtgccagtgcaaaacgttggaacgtcgtcgctggcaagacaactttgaccaaacgcggcccctttcgcttatcatcaatccgccgccccattctatacaccatctgtgggcaaacctccacatccaaagcgtccaacacttccgcaactgtttccgcgtcctctttggcgcgttctgatggcttttcggccacagcctccggaagtccgatcaaaacgaggctccgttttcgttctttctgcacaagtgccacggcatcgcttaatcgttccatccaatggcattggtatttgctgggctttggtggcaaatccgaagctgacaatgcttaaaaattagttttcttgaaattcgtgcataaaatgccaaaataaaatctaaaggtaattttctaaagaaatttgtgattaattttatatatttttttcaattttccttacagttgctcatttgtgaccgtaatttcatagtagaaaattccagcaacatttaatggagccgcgcattttgcgaagacagtgcgaagaccttttgaagagaaaacaatgttttatgaattaattaaagtgaaattaattaaaattcaccgtttccgactcccttataatgtaccgtaagacattcggtgccagtgatttccaggtcactgtgacaagcatcggcatcccaacaatttttggggaaattttgataaaactaaaatttattttacaattaaaattagtgatcgagtttagaaaaactaattaaaagatgaatttttttttgtcaaaatttcaattttggataaaatctgaacaagaaa

SEQ ID NO: 2682 - DNA, 524 bp, Heterodera glycines
gggggggggggggggggaatgattatcgaattttgaatcactctttttatgcgtaattttaattaatctaaaaattagggtaattaataatcattttgaaaatttgcataaaataatgcaaatcaaaaattatattttactaatctttaaaaaatcaaagttttatcagacagaaattgaaaacatattttttcaaatagataaataataagtagaagctctttttcctacttctcatacttcccatgttccaatcggtgctatatcattattaaaaatagggttgcgccccgacattttcgaggttttacgaaattcgtcaattgcactttaaatgagatggaagtgtcttttaatgagtttttaagacttttttgttctgaaactttttcttttatctttttcccgaaatctcgcccccgacaaaggtgtctgcccccgacattttttaaatttttccagccacccccgacaaatttagtcagggaattttcaccccgaaccccggcttttccaaccccgac

SEQ ID NO: 2683 - DNA, 2046 bp, Heterodera glycines
caatagtaggaacgcaagtagtacttttgacagttttaaaaatacagcgcactgattcgtgcgatttatcagttttaaaatatgtttgaagtcaatattgatgggttccgcgggttctaaattggccaggttgctgttttgaaaaactggctcatgaactccaacaataaaaatttcaatattcgtgaataattaaccctcgcatagaagtcaacatcacttttcttgcaaagcttcataggcaataatttaaattgcttgtgattatattcaatcgctggaaaagcattcttttatacgttaaacctgcaaaaagcagtccgaaattggttgctgaccattctattccctaagaaaagtctcacacggaagcaatagtaggaacgcaagtagtacttttgacagtcttaaaaatacagcgcactgattcgtgcgatttatcagttttaaaatatgtttgaagtcaatattgatgggttccgcgggttctaaattggccaggttgctgttttgaaaaactggctcatgaactccaacaataaaaatttcaatattcgtgaataattaaccctcgcatagaagtcaacatcacttttcttgcaaagcttcataggcaataatttaaattgcttgtgattatattcaatcgctggaaaagcattctttatacgttaaacctgcaaaaagcgtccgaaattggttgctgaccattctattccctaagaaaagtctcacacggaagcaatagtaggaacgcaagtagtacttttgacagtcttaaaaatacagcgcactgattcgtgcgatttatcagttttaaaatatgtttgaagtcaatattgatgggttccgcgggttctaaattggccaggttgctgttttgaaaaactggctcatgaactccaacaataaaaatttcaatattcgtgaataattaaccctcgcatagaagtcaacatcacttttcttgcaaagcttcataggcaataatttaaattgcttgtgattatattcaatcgctggaaaagcattctttatacgttaaacctgcaaaaagcgtccgaaattggttgctgaccattctattccctaagaaaagtctcacacggaagcaatagtaggaacgcaagtagtacttttgacagtcttaaaaatacagcgcactgattcgtgcgatttatcagttttaaaatatgtttgaagtcaatattgatgggttccgcgggttctaaattggccaggttgctgttttgaaaaactggctcatgaactccaacaataaaaatttcaatattcgtgaataattaaccctcgcatagaagtcaacatcacttttcttgcaaagcttcataggcaataatttaaattgcttgtgattatattcaatcgctggaaaagcattctttatacgttaaacctgcaaaaagcgtccgaaattggttgctgaccattctattccctaagaaaagtctcacacggaagcaatagtaggaacgcaagtagtacttttgacagtcttaaaaatacagcgcactgattcgtgagatttatcagttttaaaatatgtttaaagtcaatattgatgggttccgcgggttctaaattggccaggttgctgttttgaaaaactggctcatgaactccaacaataaaaatttcaatattcgtgaataattaaccctcgcatagaagtcaacatcacttttcttgcaaagcttcataggcaataatttaaattgcttgtgattatattcaatcgctggaaaagcattcttttatacgttaaacctgcaaaaagcgtccgaaattggttgctgaccattctattccctaaaaaaagtctcacacggaagcaatagtaggaacgcaagtagtacttttgacagtcttaaaaatacagcgcactgattcgtgcgatttatcagttttaaaatatgtttgaagtcaatattgatgggttccgcgggttctaaattggccaggttgctgttttgaaaaactggcacatgaactccaacaataaaaatttcaatattcgtgaataat

SEQ ID NO: 2684 - DNA, 6121 bp, Heterodera glycines
cacataatgatcgatactaagtattaacaacacaattatggtgaataaaatgtatattcacgatttttatccaaaaaaaatttacaaaacaatagggtcccccctatggtttttgataaaatacaaaatttatcactttataactagcgccaaatttgcttaataggcccaaataattgtcatgttcgtaatcaatgacctttaaaacccccgggtatttggtttcaggactttttaaacaaaaaaaaattttgaccaaaaaaaagttgaaaaaattttcaaaatacacctctttgtaaatagtgccttctaattcatttaacaactatttagtttgatgtaaaacaatgcttaaattgttaattggacaaaaatgcgcaatttgcgtcctaaatttgaccgattttaacgaatactttgcaaattttgccccgccccgactccaaaattgtacaaagttatactcgattgctgacaatccctgttattttttccactcttacacagggacaaaaccattgtttatgcgttaatttgtgtttttgtttgtgcggtttaattattggcgttttaatctattttgaatttattaaaatattttaaaaatcggaaaaatttgtaaaccaaattccaaaccaaagcaaaaactttattcatcaaattttcttctattacaatattttatccttcacaatgtcagatttaagaatggaggtaaaaataaatgatttcctttcatttattcctttcatcttaaggccagcaatgatgtgatcattcccgtcaatgttgcaattcgcatattcagttttgtcagtagagatgatttggaaaattgcaaactcacctgcaaatcatggaaagacgtgtaaggcattgaattttgttttttgcaataaaacattggcaaataaaaccgattattttaagaattgattacgcagacaaccgaaagaactcggagttgcaactgaggcacattgacgccatttgtctctcaaccaattctgaattttctatcaaaatttactacaaccaaactattcgcgagttttactacaaaaaatatttcgctgataggttaggcctttttttaaataaaatagaaacattttatcttcagggaaattgatgaaattgaagtgaaaaaagtcaggcatttaacgagtcaatttgacgagaaaaaatacgttttcccatgtggagagcatttgccaattcggcaaagtcattcctttgtttttccagcggttgatatttttcaccaacacaggtgtaaaagtaggtaattctttgggttaagggcagttcgtacaatttttttttttaattttcattaaaaccgaattttttatcaaatgatttttttaaatttttgcgacacttttgctgtttaattttttgggtggtttcgagtctctgaattctaaagaactgcgatgacatcaattcttttgattaatttgtaagctaaaaataatttcaattttttcagtggtgaggccaaccgtttaccaggaccatgtcaattacacgcgaaaactcttcacacctccgctcagtttttatgaacgccttcaacgaatgctcaaaaaatgtaaaattcgtctggtgattttccacgcgttcactttcactgatttctttgttgaaaaaatgcgtgaatttgcgtccgatgcgttttcgagggtcgtttttctttcccttcactgtaagtccaatttttcgttaattggttcattttcttccaccttcttttctcaggttgcaatctccgctgcgttagtccgaattctttccacgaatttctctcttctgtttatgctgctcattttcttttggatcgccttaggaattgtgtgccgaatcattttaacgctcttttgctgagcaaaccctccattcaaatgtaagtgcattcattgtccatcttttcgttgatagtttttaaaaatttttcaaacaaattgctaatttttgtgaactctatagggcgcgtacgttttacgttggcttttgtatcggaagacgacacacaaacagtggtgcccttcccgatcgacgacgacgacttcataaaatatgtgaaactgctcggtgccgctaaacgacgagatttttttggcattgctctctgtcgagtgacacaacaatttcgaccattttatgaaaaggcaaggaataccgtaattataagtaaattgcaatgtataaatttttagataattaccagcaacaaataccgccggttgaatttatatactcacgtattatttggggacgttcgctatttatctaatgaattcggatttacaaattcacattcagtccaacaataatgtcaatgcttttgttttgttgattgaattgtatatgaaaataattgaggattttcagtaaataaacggcagttcgatttggatccaaaagtcatgaatcaattccataaattttttttattaactacaaaaataccgttgaataggatttaaacatattgttgtcaaatagacacttaggtattataagtaaataatcaattttttagcttattaatactaaaaaagcctggatcattcctggacctgggttttcctagatttttatttagaaagtacaggttctctaactataaattgaaaattttttggcgttttatcttaattaaggatgactaatcgtaccagaccggccctaatgttttcaccaacctgtgtctacactaattaacattactaattgatccgcacagcataaatacccgttttttgttcactattattaaattgtcgtttttaaccaattatttaatttgtaacatcaattcgaatgactttcctggatcacgtcgacaaagatttcttcaaggcttggccttttggagtgttgaaaacgattcattgggttgttgaaatggcattttggcttttcccccgttcatttcacttttccgttcagttcgctcccctcgccattctcattacacttggaaatagtcgttacatttatgactccctcggttttgtccttttcacagcatggaatgcattcatcgtttcgctgatcacttggctttgttatatcttccgattaaaccgaaaggccttccaatttggtgccggttatctcttcgtccctttcgcactgattgtatgaacaaactttgcccatttttgatgatcttctttggagtttttaggacttcattgtgtctctgttggctatgctttgtttcggcatcagttcgttgatttgcgccattgcgctgcttgactcattggaatacagcttaggccacatcatctcataccttctcgccacggtcctttttatagccaaatattttagccgggttcgcaacatttaaggttttctgtcttatttctggctcggccttcggctattttgccattcttgtctaccgtctgattccgaatggccaattccgccatctgatgacgatggtaatcgaaggtcatcagaccactacgttggatggccaaggcggtgtgggcccagtaaatgccggccccccaccggggagaccgcccgtgtgaaaattcgcaatattttaatttatcattttttgcttatttgctcacttcccaaaatgcttatcagcccttcctcactttattcttcatatatgcaaccgatcctctccaaattatcatttttgcgagctccggtctcccccttcgtatcccatccttttttaatagaatatatcgctttctttttaatccaaaagcataaataaaaagaatatccgtaacggtggaagagagatcagtagataaaccattgacggaataatttgttgggttattcttgggtaattccagccaaggaaagtgtcaaattgcattccggttcttgggcaataaatattgctccatgcccatcgaaaatttcttaacattgtttaaataaaataagttttttaaagattgatttaattaactcattgttaatctggaggcaagtgcatggagtgcactaagaaaggcatgaaaattcctgatgtccaacgtaacgttaaaaaaatgctcgggctgtggtgcagtttgcgaaagacctgaacaaaggaaaggaatttaggctattgaaacatttacataacttggccactgggaccattattttttaaacatggcataaaccatttgaaaaaaaaatttttgaatctcggaaagctaaataatgagtcataccctcagctccgctgatgctctgattgtgaagcccttgagcatagacagcgacttttgcctggtcggcataaccaatgatgttgaactctccacgattgtttgcgcgaaatatcttaagaaattcaatcacaatatttttcgtttaataaactgatttaccaaatgccttccgccaatgtccttcacacccgagacaatttttgtctaaaagagtaaagaaaatgaaagaaagcggacaagacaataaatttgggcagccccactttaaaattgtgatccatttctaattgtaggtaaatatgggcccatttgttcattttcatccaatagtaactgaccaatgttttgacgtttggaagtgcaactgccaactgagaaatgcccatgtttggtgggttgaagtcgggccattgtcgtagaacaaccaaaacaatgggaatttcgttgaccagggaattggcactgagctccacgcgaaggtgcggcaccccgtcctttttggtcattttcaatttgatttgagtggcacgcgaatgcagcgaacggacgaagtcgtcggtggacaattcgaagaaaatcgcgttgttgtccagggaaaggccgtcaaagctccatgaattaaataaattatcctgaaaaatgaaagaaaatgttgggcggtcatttccattcgatagcaaatgaattcatacaaagtggcaaataatgaatcacttcccattgaacaccttgtgaatgcggaagtcgacgtgcattccctcacggacattgtacacattgacaaaactgaactcattcggcgtgattcggacgaccgctctcttccgacacaattttgaaacgaccgctgccacttcttaacaaataaaattagaagaattttaacacctaaaacatactgacgaaaatatccactgctttcccatcgccaatcaccgcaacgaaacgcatttttacgcaactttttgactttaaatgtaacagtgaaacatgtcaaacaaaataaatcaaaaacatcctcactccaatcaattttggaacggaaaaataggcatttaaaaaaccaaatggaaaggtaaaagaacgtaaagaataatttatttgttaaattttttcttaacaattgagcgaatttccaaccaaacaataaaatccaatgctttgtttaatattttttgttctgtcctccgttgctcatgaagcggacttcgccttctgtacaatcaatgggccaacattgtcccccgtctttttgttgtgctcattgtgggacccgtcacacaaaggaaactcaaaggaaattctaataatttatttgggttttatttcgttttacttttttggattgccaacagcgacaatatgcctttttctcgccaatgtcctccaattcgacagtgtccaccactttgtccttgctcaactgcactcgcgtgttgcatcgggccaattttgaagccgcggttcgccagccgagcaaatagccaatggccaaacccccggccaaaaaggacaccgcaaaggaaatgttggaacggtcgaagagagcttaataaaaatgaaatcgactcaattccgacgcacacaaattagactccatcactttttttgtttgaaagtatccaatgggagtgggaaggaagtagaaaagctcaccgggttgagttcccatcgcagacgaagacattctccagcaataaaaatattatatacctaattaaattggataaaattattttactatacaaagtagactttctgacatattttttgatcacattcgcatgtcaacaaattatgtgtaaaaaattaaacacataaaacaactaaatttaatcatcaaaaataaaaattgtaacaacaaaataatttttctgaacttaaatttttttttgattaaatcatca

SEQ ID NO: 2685 - DNA, 5750 bp, Heterodera glycines
  misc_feature (5001)..(5001): n is a, c, g, or t
  misc_feature (5028)..(5028): n is a, c, g, or t
ctttcacgcataagaattcagattaaagaccagcaggaaaagtaccatcaccgaattatgcgacgatttgtgaggtttcaataggacatatctcccggtttaaatttgctgggattccatgaaaggcctttttgcgataaaatgttctatctgcccactgttgttgttgtcattatctgttggagggggaagtcgaaccggcgcatttggtttcgattcttcggaacttgaggacgaccttaagtttggcaaagatatgaaaagtgtaagcgaactacacaaaaagtaagtaaatattcgaagttaaccaaaggagcgataaatttattcatttaatattaaaaaaaaaacaaaacagtgagcataacatgggatatttaaacacaacaatgcggacaacactttgacctgctcgaagttatggtgttctgttcccccaacaaatatttgaaaagttcgtagacactccaactgagtgcagcggacggcatttggtaaagcacccgagcatgaagaccaactaaaaagccagcgaagccacgggttgaataaatggaggaaattgcatcgagaatgcctaaaatttatactataagaggaaaataaaatgtaaatattgaccattgtacgagcctttgagataaaggagactccgtttgtcgataaccggttgaggggattgttgggtgtttaaaacctgaaaatgtggtcttatgaatttgtggatgagttaattgattttttaagatattcgatggcttaagcgccagagaagatgaattagccaatcgaacagtaatgagatttgggcattttgagtttgaaggcacagcgcccattagaacgcctaatttctaattgtgagacacctatcccctaatattacattgggcgttgttaaaaaaaagtaatttttggaagaaaccacttaatattatacggttttgacgcagtcaagtgggtttgtaacagcggccgcaagtccaccggcaagtcctcccgaaaccaaatgcgaagttgggtcgtatttacgttcccggttaaattgctaaagcaaaggtcaattaaaaaaacaatatacggcgagatagacgacctcttgccagaattcatagcatacgaaatggacggcttggaacggaacgttcataaacaattgggtggagtaagagcgatagaaagcggccattccctcgttccgaaagatgcaacgcacacattccaacgaaccgccgtacggactgtacagcatttgcatgcgctgtttgaccacctcggccgggttcatcaccaaatcgtggaccactgttgccgccatgccggccaatgcgtacgaaaacgaattcgaatggccatgagtgttgccagtcagtgaagactaaaaacgaaatcaaattttacaccttccttatatttttgaaccgaaaacaccttgaacttttcgtagaccgtgaagtaaagggcgtgggctggcactgagccgacagcgaccgcattgactccgcgaaacgtccgccaaaatccctccctgcggaccattgaagcaacgccatggataggagtcggacacgtggactcgggacaagggcacagcgactggagacgcgttttgacactgtccaatgggaacatcacacaatgctcagccattcccgccgctgcgcccgccgccaaatgaacccaaagcgaataagtgggagccaacgattcgtactcatcggcaccgctgctctgttccggcatttcaatttgctggattataaattcttaaacggagtgtaaagcaaaaatgataacaaagaaaagataaggatggatcagacaccaaagatgcatcagacatttctacccaataacaatttattattagcaatttttgttagtatttattaattgctcatttgtatcttcgaatggcggattttcgaggcgctgaaacaccgccgcccatttatttccgctgttccgcgtcactttttgtccctcttcggtgctttcaaatagcaatggcacaacaacatcgtcggcatattctttgtcagtaagtcgtcggaacaatggaaatccttgcaggtgattgaccatccaatggtgcaactcttcaacatccgttattgtgtaaatacggcctaaaataaaacatatttaatcgaatgaaacaacaatattcatagtacaaaattagcaaaattcatctttatgatttcaaatacatctatgtttaaaaagacaactttggcaagttcaaaatccactcaccgcccggcatcagaacataagcatattcagcaagcaaatttgttgaaataatcctccatttatgctttgtctttttgaagtgtgggtcgggaaaaagaaagaacattttgctcagttgacttttgcggaaaaaattgggtaagtttttcatcgcattgcttcgcatgcaacaaatgttgtcgtaacgaccagggttttgtgcacggagtgccttcactctttcctgcacgaaatcggctacctaaataaatttttaaataaaaaaacggattagtcgtatttcaaacagaccttcacccgaatttccataccaaccattgttacgtctggaaacatcggagccaattttaccaactaacaaataagtaaattttagattgaatattctgggagttttcttaccaatccgccatagccacaaccgatgtcagcaaactcaggggaatgcccttcggcactgggcccaaacaattcgttccagtccatacttgaaaatacgaatggaaaaatatgcaaattcaaatataaatttaccaatccggcgagattgggtattttagatcatgatctgacattgggttgctatgtgctcgctgtctgtagaatcttttttgtggatatttcgtttttttactgttttcggtgatagaaaaaacatcctcaggttgcgaaagagacatgttcggtcgaacaattatattattataatctataaaataagtaataatttttttatgacatattaaatccaccaaataattttttttcgtgatgtgaggctatagctcaaaataggtcgatttttagagaattttatccagattattcaatttggattttaaaacaatttgccaatgaaattagcacaatgaattttaaaatctctgcagttttccttttgctgactgtcaattctcaaagtacagtaatattcctggaatgatttattcgtttaacagtaggaaattgctttggatcatcgcaaaatgttaattctgattgtttctcttcgatcatttttctgactttttatcacgctctttctgctcttttttttctgtggttgttgcttaatgtttcccgccttcttttgctctgttttcaatgttttgtcccaatttccccctctttctctctctcactctcactctctccctctctcaatgtctcttttctctccaaatcgtctcctttttgatcaaagcactcaattttgactatttttgccacaatcggtcatatgtaataaacattactacactttaaaataattccattttttattttacccatttgaaaattgttttgtttccccggtaactaataaatgtgagctgcctttctgttgttattaagagaatggaatatttattttctcgcggagaatgccatcaaagaaaatgatttaaatttcgttttcttttcacttcggcgcttgtttaatttgaatctccgatttatggattataatgggtaactcttactcggagctttctcgtctcgacgacaacgatgtgattatggtacagacgggacgagactttcccacgtaatttgttcaattacaaaaacccactctcacttctgaaagtaatgcagaaacagacggactgctgctgggctgtacttcccgccccgtcgaaggcatccgatcgtccggccaactgtccatttggacacggtcaattggctgtcgtcggttcggcctgagattgtgatcagctgcagttcggacaaagtccgcaaagaaggaatttctgtatcaaagacggggcaattacatttagtcaattgctttgcataacatcgacacgggcgcgtgtttgacgcggtggcgaggccatcagaaagaagtgaccaaagttgtgtacaaacgcgtcggatgcgcacatttcctcctcagcggctcaaaagatgctagtaaaagtgtcatcaaaataattaatgttaaacaaaatgccgcccattagcgatcagactttggcatttcaatgcgtccgaatgtcgcaaagttttcgccggctatcacaaattgacagtcaccggattaactgctttggatggcatgtttttttcaaaaatggctgatccttgtgacttgtaagtacactttttgctcagaattcagatttgtgtctggaggaagagacggccgaatggccctttgggatgttggagaagcggataggcccgtaagaagtgttggaaacagtcaaaatgtggtaataattcattagactaatggatgcccttgggcataaagtgactaaaatgccaaggtgacgcacatcgagcaaagttcggatgccaagacattttaccaaacggctgaagacggcactttgaggctgtgggacgcacagaatctgtcgccgatttgtcagctgtcctcctccaccagcctttgccactgcagcacatcgaatgctgagccgaacaattgcctaactgccggagggggtccccttggtgacggatgtgtcgtcgaagtgatttagacatcagcagatatttctgctggtgttgtaattggcaattgcttaagctgtgggacctccgccgacggaaacgtctccagcaattccgtggccacgaaaagtccgtccgttgtgccattttcctccaacagcaacaagtcacgaggaaaaacctaatttttgagcgttagtggcgacaaaactgtgcgactttgggaggcgaattccgcgagtgcggcgcatttcctttttgcaattaagagtntaatgatggccccttaaggatgcgttnggacagaaaccgccccccgcggcatgaattgttgcgtcggctcttccgacggaaggtggcatgttttctattttcgattgtttcttatcggcatcactttaatcgtttcagtgtcgtcgttggcggagaatgtgccacactttgcgattttcggctgtccgaaaaggcgggacggccttttcttttttgcaattcgtttcaatcgaacaatgacattaattaagcaaagctcaaaatgaattgatacaaaatgaattctgctaaatggtcatttcgctttttctttgcttcgcttaatttccctcttaattaattggctctttttttgtgtttttctctctgatagcgaagactgaacttattttgtttgaacgcggaacgatacaaaacaatcacttcgtcggattcgcttacaaaaatatttttttgaattgaatcacaaaatctgaaaaaaaattcgcggaggaattaggggaaaatgaaagttttactctaccgtactccgacagagcccaaatcgctgcgataccgtatttcgacctttgtgggaccatttcactcattagtgcttccatgcttacataagattcctgctggcacttagtctcgttgtcaacgaaatggatggagtcaatagaaacattgacccgtgtcccaagcgaaccctaaacgaaagggtactgtgggattaattaacatccattaattaatttatccgtaat

SEQ ID NO: 2686 - DNA, 1816 bp, Heterodera glycines
ggaaaaacctaattttgagcgtaagtggcgacaaaactgtgcgactttgggaggcgaattccgcgagtgcggcacatttcctttttgcaattaattaagagtgtaatgatggccccttaaggatgcgtttggacagaaaccgcccccgcggcattgaattgttgcgtcggctcttccgacggaaggtggcatgttttctattttcgattgtttcttatcggcatcactttaatcgtttcagtgtcgtcgttggcggagaatgtgccacactttgcgattttcggctgtccgaaaaggcgggacggccttttcttttttgcaattcgtttcaatcgaacaatgacattaattaagcaaagctcaaaatgaattgatacaaaatggtgaattctgctaaatggtcatttcgctttttctttgcttcgcttaatttccctcttaattaattggctctttttttgtgtttttctctctgatagcgaagactgaacttattttgtttgaacgcggaacgatacaaaacaatcacttcgtcggattcgcttacaaaaatatttttttgaattgaattacaaaatctgaaaaaaaattcgcggaggaattaggggaaaatgaaagttttactctaccgtactccgatagagcccaaatcgctgcgataccgtatttcgacctttgtgggaccatttcactcattagtgcttccatgcttacttacataagattcctgctggcacttagtctcgttgtcaacgaaatggatggagtcaatagaaacattgattgacccgtgtcccaagcgaaccctaaacgaaagggtactgtgggattaattaacatcattaattaatttatcctaattgtaagggaatgcctttatcataaaattgcatttcccgacaccgaaatgggacagcgtttgttcccggtcgattgcttgcagaagcacttccccgcaatgattgtctgttgcttccactcggtcacagaatcgtccggccaaaccattgggacagcgacaacgatcgcatgcctaaacaactgacaaattgaataattagagaagcaccgacagaagaatgacctttgggtcggtgtaccccgaacgttggcaggacaattcgaacggacaaatgccttagagggaaaagaggcgaaaaaagggggagggaacatcgtcgaattaaaggcgtactgtgacagtatgccaagttcatctttttgacgtcgttgaaggacaattggaagcgttgtccgatggtgttttggtaatttgggttcaccgtttggatggaggagagtcccctgctggaaaatgcctaaacattgtcataaacgcacgcgcaaagaaaggcaagggaaagacacgcacaaaagcatcgtaatgcatcaccgaaccaaagtcatactgtaaggaagaagcgcatgattaagggttcttagcgactgatagattatttccgaattcgatcggttcgcgaattttttgccaaatgactgaccgaaacgtcaaaggtggtctcttgggattgggaaaagcgagtgaattggttaaggaagccgagctgaatgtttttgggctgaatttggacgaatttatcacggtcaaagcgcgactgttcatggaaataccgagagaatgagctgagaaagaattgccggattaaaaaataaattttaatttgcccaccgatttcatgggacacaacgaaaggattgtcacaacgcggcccaatggacactttttgggggtgtccgtcgcgcaattggccaacagtggaatagcaactaattttgttatatttttgttaattat

SEQ ID NO: 2687 - DNA, 2810 bp, Heterodera glycines
aaggtgaataaaaaaatggatacacagaaaaataaatttggaagttctggacagaaatgaaaattaaaatataatgacaacgattagtgcgaatatgtattaagtaattaaattcacatataaattgatgaaagggagcaaatgaaatgtcaaattaaatgagagagaaacgcgaattatctatttgtctttttgttttgtctattttctttacctactctccttttctcctcactctatttctctctctttgttctgtgttatctctttttctcactgtctctttcctttacatgacagaccagacacagagcttcacctttaatattttccgctctgtcttcccctaaacgtacgaaatttttttaaatttaattagcctaattaatcttatttttgatcctttattctcctacaatacttcattatgttgttgcggataatttgttctgctgtttttctgctcccattcttcgtttccgactctttggctaaagttgtgagctgcgagggctttgtcaaaaccaaaattcccggcattgacctctccaaagttgaggttctctttctattcctaattgttgttgaaaaaaagttggtttttaccctatttttaaggctaaactcttcacgaaccacggcaatttgaagtatgagacggaatgcaatgcgcagaatggtcactttctgatcccaatttacaacaaagggcattatgtgatcaaagtgtcagggccaaccggatggatattttcaggtataatagcggaagaaatgttcgatcggatttcttaaaatttgaatttatttaatcttttctaattttttcgcaagtatatttcactaaaacaagatttaggtaaatagaattattgcttaaataattgctcaacatccaaccttttcagaaccgaacagccgagcggtggaaattgctgacgacggcacgggctgttccaacgacataatcgtcgaattggtcggctttgaaattgttggtgaagtgctaaatgagggcggtgtcaaactgtcgttgggcctttacacgacggaaaaggatggcggcgttttggtgaccaaaacggagacggacgggcgcggacattacaaatttaacgcaaaaccaggtgaaaatttggggttttttgaaaggacttttgattgggtttaaattgaactgggaagtttttgaattgttcgcccaataaatactcacaaatagcttttgaattattcgaacatgcaaatccacagccataggaacactaaacttttattcttcatcaatttcatcttttttaaaaattaagttgggcagctatttttacaatgattcaaactaaaacatgtatgcaaaaatatggaaaattttatttacaaaaaataaatgagattatagcaaaaatgacggacaattcttctagggatatacatatttatctattctgtcaggcgtttatgtgatttcgacaatgaccgacgcgggccaatgcgttgcgcgtggcaccgtttcggtggaagtgaccaacggaccggtgaaagtgcagccggacatcattttggccggacacaatgtgcgggtggtggtggtggacgaatggggcaacaaaatgacgggcgaagaggggaaagcggcggtggtggagacactcgttgaactccattcgaacagccaaattgatgtgaggaatcgcattccaatgaaaaagttctaacgtttttctaaattttataataaattactaaattttatgatgtgaggaattgcactacaataataatgaacagagcaggtcacccccactcctcccgaaaaaaaatttgaaaaagttaaaatgtttttctaattttttttcaaaaaatcggtagacaattcaaatttttattttcttgtagtttccacataaaaatttctctaaatttttttttttcatgttcctgtccagtctttaaactcaattcatttaatttgcagctaaattattatttcaaaaacttgaaaaaaatcaaaataattgccatattttgccggaaattgtgctgacatttttattttcatcaagaccctctcaattcatttagttccaacatttgccggtcaatgtgccgagaccgcaagcgaaaaacacgcgcagcactgcccagcccggcggtgccacgggcgacgatgggtggacatacgcagtggagacgcgctcgggcaccgctctgttcgcctgcctgccctccgctcgctacacattctccgccgccgcactgctccgccgcaaagacggcacccaacggattggcgtccaatttgagcgcaaacccatccaattgggcgccaacgctgttgaagtacgtccaaaccgttgatgggttatcatagtagtggtgaaaaaaaccaaaatggtggagaaataaagtactataaaaacataacgaaaaatggaatcataagtacccaccaatctttgtggcaaaaatttcgattgataactttgttgaattttcgggtttgaaccagggctgcacgaaaacttcaaaaaaaaattttcgtggacgtccttggcatccaaggacggatggcaaccggtgggcacggcggcgtcgataggcgaatactaaaaaaagtcattcttaagggtgtaaatattttcgtctttttcgtaaaattttgctctaacgaaaacgaaacacgaaacgaaaaacaaaaatttgaaaaccgaaaccgaaacgaaaaaactttagcggacgaaaacgaaacacgaaaagaaactcaaaaagtgccgaaaaaagaggacgacacgaaatttcgtgcagccctg

SEQ ID NO: 2688 - DNA, 3933 bp, Heterodera glycines
ttacagaattgccttttgcggctcagtttcgcccatggcttcggctgatgtgtcaattgaagttgcacagttgaaaaacaacgacggtggtcaaatgggcacaaatgcccctgcggttattattaagccggaacgcaatggccatttctgtcgaatgttcgcacccggcaaatacaccgctcgtgtcagtgtggccaacatgtgtttttttacattttaaggcttatttttaggggtttctgtcaaaaatgcttatttctgtcaaatttttgcattttgggtatttaaacggtctattaaaaatttgataaattgcaaaaaattttattggggtggaccatttaattgggccagttttctttttcgaactcgttgtcctgacttttcctctgtttcagatcatttctccaacggcatacacaccgaaacaacaattggtcgatttgacggaaaagcctttggtcggcgtgcaattcacacaatttttgggcaaaatttccggatggattgaatgcattggtgccaaataaatgcacttatttacatatttattaggtggtattggtcacaaaacactaaattaactatttaagggacttgtgatggcatttccttggaattgtcgtcgcacggcgggggtcactcaccggcagttgttgccaacataaagccaaatgaaagcgacgggacgtttcaatttgcggagatttccccttccatttacaaaggtgacaacatttaattgggtgcaaaaataaggaatttcataaaatttcgaaaaattgctaaatttcatgaattatatttttttaaacaattccatgaaatttcaatttttttctcgagttatgctaataaaccttttttatgtgaattatgttacagtgcgcgttgtgagcagcgaaaatgtttggtgggattcaaccgaacaatcggttcatgtggtggaaaaggacgtggacggagttcactttgtacagaagggcttcagaatggacatacaaagcacacatcccgcaaaaatggtaatttaagtgttggaatgtctatttattataatttttatacaaaattaaatgccaatcagaaaatcactgttcttccattctttttccaggaatatgcgccgatcgttcaacacaaaaagccctccactgatgccgttcagcagctcaaaatggtgcatttggtttccggcctcaacactttgttcttcccgatgccatcgtcgccaaccgaaaagagtgccgccaaaggcaaatgccaaaatcaccgcacaccgccgcaaccgttcaaatttgcgctttcctcatgccacgactttgacattgttgttgccgatggcgacggaaaagcggcggaaaatgcttttaatgaccaacaaaaggacgacaacaacagcggcaagttcactgtgcctggcacaaaacgtgttgaacttgtcgccaaagcgacacgattgcctatcagaattgagttggatggcgacagtacggggcgtgacgagttgaacttggtggacatgaagctgacttggtaaagatatgcctctttattcagaaaaaccgttagaatcacacgaagaattatttatttttccttcgccgtaaaaaaatagacctactatcttttccgggtttttaagggaaaaaagtcgcaaatattttttgtggaatatgactcatttatttttgcttttttcattgcctttttccagtgacggatgttcttcggaggaggcaaaatcgtcgcccatttccgactcgatcaatggcaccgttaggacattcgttttccgcttggaacagcagaaagttggcattaaatttgttgcgacggcatactcggctcttcacctgttcatcccggaaaccatcgcaatcaaattcaatggtgcagataatggagttttaaaaatgcaagatttaaattattaattgcattttgtaaaggtgattgtcaggaggagccgattgttttccgagcgcatttgggcaaattcatcgagggccatgtacgtccggccatttctgaagtgagtgtcaccgcaaaacgccgaaagaccatcggcgacgggaaagggacagatttgcgcacgcagacggatgccgatggaaaattcaggtggcgaagggacccaatataaaaggatttttgcggctgggagtgtgtactttttgggttttttaaatttaattttaagataaatttaaaattgtgtcaatcctctcatttttaggtttggtccggtttgggatgagcaggactttgagctgatgctggaaaaggatggcttcgagttcaagccgtacacaccaactgccgatggtataaagatacggaaggcgggtggttggggagagggactccgtttggttaacagtaaattaataactgacaatgagattcaatttggattgaatttttgtttctgggtcgcataccgttgattatgccagagttctctttcatccattcattcttttgccattgccttcaaagatggcccttcccatcgccaactccgttcgcccttcgttttctctgccaccaaattgtcgcaactgattgtccgttttgtggacaccgatttgaaaacgccgttgtcggatgtgctcgtctctgtcagcggttcgtcttcctcctccgacttccgctccaacacagtgaccgacccgaccggcactctgaacatcgtcggattggtcagtttctccggcctcgggaatcctcgcccaaaaaattagaaaatgagtccccccccccttcatcgaaatgaaaaattaatgaaaaaataacattttaatttttaaatatcattttaccacattaaaggcacccggcacgtatttcatcaggccaattctgaaggagtacaaattcacggcaaattccttctccgcccaaattgcagagggtcaaacggaagagatggttttggaggcaaagcgatacgcatacaggtgggggggggattgatggatcaacaactacaaacatccataaattatgccatactgattgtgagccaccatttagcatttatggcaaagtgtccaccatcagtagcaaaatgcttccatcgccaatttatgtcgaagcactctccgagcaatgtgaaaatcatttggttggttgttttataaaataataattttaaatattatcatgaaaacaaatccatatctggcattaaggttggttttttatttttattttttttgagtttttattgaggaataaccaaaattaagcgaatttaattgtggaaaagcatttttaagtcatattcctttcagggtatccaaaacccttcccctttcaggaggacgatgtggtcgattcgtccaccaacgaatttcgcgtccgcggcctcaagccgtcgtgccgatacaaagtgtttttgaaggctgagagtggagagcaaatcaaagcatttccgccccttttcaatgttcaggtggacgggggcaaatcaaaaattatataaagacaattaattaattatttattaccgacattttcaattgaattctgtcattgtcaagacgggcaatgaggacaggcgtgacgtgcactttgtcgtgttccccaacgaattgcccgcggcgacggttgtcagcgaattggaacttccggcaaatgccaccattggcgggggcgtcagcagcagcacttttcgtgtgcttttgaaggacagtgccaccggcaaaataattcaggaacaaaatgtgccgggcaccgtattctttttcacattacccgcctataaaaaggtggaattttattaaattaattacctaatttcattctttattgctcatagcattatgccattgaaattggtcggagtgaggcaaaaaagctgaaaattgagcccatttctgaagaattcttcgccgactctcttttcacttttgtcaggtaatcaat

SEQ ID NO: 2689 - DNA, 2694 bp, Heterodera glycines
tttaaaagcaaagaaaatagcgaatagtgagatcggtagaaacattattttaaagtgttgaagtgtctaacattaatttcccaaccccgaaaaaagatcattaaactattttagactaacaattagaaatttgaattttagacattttgctcgaacccgggttcgggaaattaatgttagattcggattctccgacccttcaaactcccaaaatactttttcaagagaaaaaaataaaaaattttgttttttttttaaaaaggggctaccagttaaactattaccgaaaaatagtagggttattaaataaattcataaacgaatcgtcagcagcagcggaatgacctcactttattattcaaaaaatgctttcaaattgaaattacacattgtaaattggatgattaaacaaattttgcaaaaagaattgggcacaaaaattcttttcttggcatttttttttatgccaccaattttgaatttcatcgccttcggcgtcgtccgaacacgcccataccgccgctgttggccatgtcaatggcaccgccattggcaatgccattcatcaaattattgttgccgttgttgaagccggtaaattcgttggctgttggcatgccaataaaattgttgttgttgctgttgccgttcgtctcctgctgctgctgacaacacgtgccacaattgcaattgccgccgccgcccattgtgccgaaggcattccccccattttgctgctgctgttggcctccgcccatgaaatttgggctaagattcactgaaagaattgaaaaaaagattgaaaattgctcgtcaggggaccctaattagccattgcaaaaagtatctaattagcgttaattgaataatgagcaagcaacccgctcaaagaggaagcgaccagttttgatcggctggcggccttaattggtgccaaaaaaccacgaggaacgtaacggatgttccgatgccgtcgatgtcccctaattagtccattccgagtgatttcaagacacaaatgatagcaatcgatcaaaaaaccaaaataactttgcgttgaatccataggtcagagtggtatcatttgttttatctctgatcaattttactttttcctacactctctaatcaatgaaaatggtcaaaaaggcctttggcaatcagcaaatgccaaacaaataattattaattaattgagattgattaccggtctggccttgcatcgatggaaattggcctccgatgcccggcggtgggggcggcggcggtgggggaaatgggcgcccaaaagcacccagcggattcagcgggcagccaaaagccggcccaaagggctgctgaaactgtgccgcggcgccgccgccgtttggctgttgcgccgcgctgataacggcgattggggaacatccgccaggggcgcccaaaagatggcacagcgaagggacggcaccgaaggcgcaaagggcgccgaggaagaggcacagaagcgttaagtgatggtggacgaaggacggcattgcgacgaatttttggcacattgtacggcaaatgaccgaaaattcttaaataatcaaagataatattttatttgaaaatggaagaaaaacggtgtcagaaaactcgtgcaaggcttaagccagacctaagctatatgcttgtgcttaggccgaagctttaggctaggctatgcctaagttttaggctttttcattgtatgagttgccattgactcgaaaaacatttcacccaaaatagaaaatgaaaaaccatttcagaaacataaattctttgctaaatctttaaaattaaaaaatttcacaaaaattaattgggagaaacagtgagaaagtggaagcattttgaggaggagcaattaaataacaactgactgatgagtgaccatttggggcggtctcttccaagcaaaatgtgcccggaaggcgctccccgccccgctcaaaaaatccccaaattgctttaatgggccgcccacccccgggggatgcgcgagacgaccgaaaaacggagagcaaatatttatttacattttcactcattgagcagccctatttgtggagagtgaaaacggaacggaagacgaagctgtcgagcagtccggaattgaatgattgcttgggatacattggacgaggtcaaccactgctaattgaacggggggggggatattagcgctgtttaatggccaacgaaaaattcattcccaattttggagaggcgacagccgacccgaggaagcggatgatggtccagtttggacaccacagcacgacaagcaaatgcagcagcatgtggggaaaagcggaaaaagttgaagagagatttacagaatccccgagggatatttcggggattaaatgaatacggtagcggagtgcaaagaacacggaaaattgttaattgaccatcaaataaatataaaaattgtaatcaatctaagaaacgaattaattaattgttaattgaccatcaaataaatataaaattgtaatcaatcaaagaaacgaattaattaagtatttaatcattttaaattttatcattcattttcataaaataaaacttcaaaaaataacataaacaaaaacaacatttgctccttttttcgtcgtccacccgccgttcgtttttgctgtccttttttttcttccgccacctgtcacggctctgattttt

SEQ ID NO: 2690 - DNA, 1466 bp, Heterodera glycines
acactgagactattttcggttcgcccctactgagactattttcggttcgaccacactgagactattttcggttcgaccacactgagactattttcggttcgaccacactgagactattttcggttcgacctagcaccaaaagtgtggggcatcggatgggacggaacgccaaacatcggacagttcaaaaatatattcttttttaaactgaaaagcaataaaatgagaagtgaaaggtccaatttcgaataaaaattcaaaacatttcaaaattcatatttgtccaacaaaatcgcttcaatcgcacgaagcataaaaagcagcaatggcaaaaaaaaattgaaccagttaaaaatgcggaaaattggaccaagtggggcccttctaacggtctacctcagttgggccccagcatattaaaaattttttcaggcttaaaaatcttttggttttttgttaggctaatagagcatgttaagagctttcgaatgataccaagattattggatttggatgccaaagaaaaaagcttaagtggaaaaacgagctggggcacaaccgtgccggcccaactgagcggttccgccttcctcgtctaaatttcgatgattggtccctgcttaaattgaaaatgcgaataacatgcaccggatatcgcgaatgccgtgcctttgggtgaatggcactttttttcctatgtgacaacgtaataaaattcaaattttaacattgaaatacccaattaaactaataaataggcttttgctgagatggactccaaaaattgacttttacgaattgaaatgaactgactgatgattagagtttttttaatcctaattgccgattgaccaaaatcggataacaatcatcagggatatatctatagatattttcatttttcataaattcatggaaatttcgtaactctccagcctctttttcacggagtatttattgttaattttaaacaattttaagtgtgtggaaattccgtgcggttaaatataaagtaaaagaaaaatgataaatccgattttaaaattaaaatggaaaatgtcgcaatgatgaaactcccaaacaaacaccaatcattcttgctcgtcatgccattcgctgttctctcattcggcctgtctcttgaacgcattgtacaacgtcaccagaactgtggttaataatttatttttgtttgaattaatgataaatgtgtggctagagaatctcggggtcaaattattggtaatgcttcgaccaagcccgtagcaagaaagcttttcgccaaaaaaagaactaatttttgtcatgttggtccaaattaaaaaaataaataaagtatgagggtccggcggtgccaatagaagtcgccgggaaaaaattcaaaattctaccaatttgataagaaaagttgataaaaaattgcttatttccctggaataacattttatttctacaaaggggggggg

SEQ ID NO: 2691 - DNA, 1261 bp, Heterodera glycines
acgcgtcgacatcttcaaaataggtattggttgtaagaaaataaatcaacaaattttctgaaaaaaaagaacttcagaacaaagaaaatgataattaatcacaagaaaacgagcgaaataatcaaggaaaaaaaagataaaaaataatacaaaggtatgcaccaatcagaggaaaagaacagaaaaggaaagagagtgatcaggcagaaaaacgaacagagtttaatgacaccttctgatcaaaagtaaatgcagacagtgattagggatcagtgaggaaagtaaatctgatcaggggaacaccggaaacgtttgtttatcatgaagacaaagcacatactgatcagggcaaaaaatgaatctgatcatggagtataagaaccacgctgatcaatgggaaatggatgcggtgtttagggttgaaatgaacaaacagatcagtgaggaaaaaggatctgatcacacatcagggaacggatatttatcatgtcaaaaggacacattgacatagagtaaaaagacatgctgatcatgtacgaaaagaggacatctaatcagcgaaaaaggaacaaaatgatcaaagaggaaagggaaaacggcataatgatcagaggggaaaatgaacaccatctgatcagaaatgatcaggctaaagaagaaaggaattccaattcaaagacaaaatatcacattaatcgtaactaaatccaagtgttaattgctccattaaagcacagtaataattaacaccgcggattgtgaaaaattgcatctaatggcaatggaatttccattgctttcccattcgttcacttttcattaaaatgcggccaacgccgtcccctcagctcccccgccccctttggccattcattcattgtcctctggccaacgttcgttttcccatccaacaacattttgttttttttctcatttggccaattgtccgtctccattttttgctcatttagtacaaatatatgcaacagttgaagcaaatgggaagagaaaaatgttgtttacaattagattttatctgatgctgcatttagcgacttttctgacattgcaaaaaataaataaaatttgccgccaattgaaactacaaaaggatgcgtacagtacttttttcaaatttattagcgctggggcgaaaaataggaattttatagcgattttgtgtctaaaaatgacacaaatttgcaatttttgtgctcaaatttccgtaaaaccgaaaaatgatggtacaattgagtccggc

SEQ ID NO: 2692 - DNA, 9460 bp, Heterodera glycines
acaagcatcgaacactccatgtctataaaataagttaacggatttttctttatttattttaatttaaaataataggatggtgaaagacaggacctgaaaaatcattaaatattgtttatattttaattttcttaaaaatttctatgaaataatcaagaatttattcaattgcattagaataaaataaaatttaaatcaaggaaatcaattcttaaaaattaatttttaagaatataaaattcagaatacaaagatcagcatgattaattttgtttaaaattattcattatgtaataagtataagtaaagtaaataaaaattaaattttttatgtggaattggtgcaacaagaagagaggcattcctgtaaaaaggacatgaaagtaaaaaaataaaacattttaaaattttgaataaatttaaatttatactaaaataatatgagacataaaatcgtaaacaaaacaaaaataaatgctaaaaggaaagtacgtccgattttgcaatgatttgaccgaaatctgtgagttagtcaaaaaaattatgcaaaaaaaaatattaaataaataaataaaacaaatacaaacgagacatttattttgtaactaaacaaatataatttctaattaacattttaaccacaataaattattaaactgcaattttatacaattagataatgttgtttctttgttagatcaattataaagaaacattgatgggcttggccagcattttttaaaagattcaaaactaaatccgtacaaaatacagcataactgatcagcgatagtctacaaaacaagagtttatttaaaaatatttttttcagtaaaaaatgacatcaaaagaaagaaaaaaaattaattaataaaataaactaatacattaaataactatatttaaaaaataaataaaattgctaaaaaactattaattaattaattctttttcataattaacttaatttaatttgaatttaagttttttaatttttaaaaattcattagatgtattaacacacagtttttcccatcaaatttatttcgttttattttgcaaaaaaaagtaaaaaatttaattttaaaacttaatgttttatgtccataaactatttattttaaaaaatatattttttaaaactcttctcgtgggttatatctatctgtactttacttcctttcaaaaagttaacatcggcttgtaatttaatttctgcctttcaataaagatgaattaagatgcatatttttattttttcaatgtggctttatttaaaaaagtaacatatttatcatttgtacgaggaagagaagatcatttaatttgttttggcgattttgacattctgtttaaatattttttttaaatcgtttcattttttttgtaccattatttttcttcgatttttgttttttgtgcacacaatttccatctttaaaaatataatttatcgcccttaaaaaataaagttatacaccaaaattgactttgtgttgctatttaaaaaattgtgaccaattatccaaattaatttcctctccatcgccggattccgacccaaatacccgaaaaatcgtacttggcgctcctggccgaaacccggactgcatcaacctttcggttaacagcgattgcaggtcgaactcaacagaaagccacaattagcaacgatggcgggcagaaatcaaggtttaaatgtggggcaaaatcagggaggacgaccaccagaagatggaaggtacaatttgcgggcaagacaaaaccggcgaaattgggctgagttcgaagcagagtacgacgcggaaattgatcgtgagctgcgaattttggaaagaaaccgctcagaaaatttggctgaacaagcaccgaatcagcaaaattcaaggaatttgcggttgaatcagaacagaacgtacgttctggcggcaagaccgccagaggatggaaatcaaggacgtgaagttgccttatggaatcgttttcaattcgaaggagtgcaaaatgagaatgcaaatttggggaggccggtagcgcaatccagttcaatttcggggaatgcaggggtacaaaatcgaattgtaatggatgaaagcccacacatttcgtatgagcataatcctagaaaccgggctggacaagcacatgaaatgagagagagacaaaatatactatacgaagaattactggaaactttggaaagacaagttctaagaaatgaaaatgaatttttgggaggacgagaagtgccggtagagcagcgaaatgagcagagaaatggacgacatgttgaaaacctgcattggtatcatagggcacaggaaaatgagcacgatggccgccacttcgaaagaaacaatcaaatttataagccgcggtatgaaatgaactggagacaagaacagtacacgaattctgaacaagggagaaaccgcagggcatatgatcgatttcaaagtcatgaagaaaattttcccaggccaaaccagtttgagagaaatcttttaatgaatcccatggtaccggtcgagaccaatccaagagctatggataatttggcttttcaaatgtaccgtatgactctggcaacacagtatgcaagtgttctcagggaaataccgacaattgaaggcaccgaagggcgagataagattcaagatttctttttaaccgtggagacgttgttaagtgactgggaacctgacaagcaaattaatgtccttaaaacgagactacgggggaaagcattgaaggcattaaatatggcacttataaaatttggtcccgttcccccctttaatatcctaaaaacggaaataatgtcaactttgagagaaactgactgcagggaggcttcagcttttactgagctcactcaattcgccaaaagaacaatgaatgaggatttaatgagttttggtgaaaaaatctatcgtttggtcaaatgctcatactcgggattaaatgcaactcaaattgacgaaatcgcaaaaaagtttttcattatgaacataaacgacggggaactggcgagatttttggagtgccaaaataaaccggagcaaacatttgatgagattttgatgctggcaaaccgcatacatttggcagaccccgaaaaagtcaaagagagaattgagtctaggatgagaaacgaacaacaaaccagaccatttcagagcagatcaaattggaacagtagaactgagtggaatcctgaccgaaatcgaccaccgaataccggaaacttttggggaaataggaggaatgaatttcgtcgagacaatcaaaatcagaattggagaatccatcaaacgaatcagttctcagggtctaatgccacgccattaaattctgtccaaccgaataggcaaactgctgaaagagctaacccgagaagcacaaactcgatttttcttagacaagaagaaaaacaggtaaaagaagcaacagaagtgaatattggccgtcttggagtatcggagcatgaaaaatttttcgattctctgatccttcatacaaaagcattcccggctgagaacccggccattccccaaatttcggaatgcttaactttgcatttgtctgtgattggagtcacatcgaaggcgcttaccgattccggtgccgaaactgcaattgttaatccgattttcttgcacactttggcgaaggagaaaggtgtaaatttgttggattgtgggtttaacccaaattcgggaaacagcaagttgccatttgaagtttcatcgttcactgacacaaaaattaatgtaattggagtgatcaatgtcccggtacaaatgaaatcggttgagtgtcaaattccttgcctcataacacgtgaaccatttgcctatgaccttattttgggcactacagctctacacaaccttggattttacattggaaatacattatccggggaaatttttaattttccctcacaaaaaacggataaaaaatacggtcaaatgcatgaagttaaagtgcttaattctcattacattccgcctttctcctcccattttgttagtgcttacataaacaattttcattgtttagaaaaagaaaattttctaattatggaaaaaaaggacacggagtcactgctcgactatgacgaggacgaccaagaaaagtcgacggagcagctaaaaaaatgagcggagaggaagagcagttggctttggagaaattgggcgtggtcgaaagtggagacaaagaaaatgctggacggacggacaaaagtgacaaaattgtggtggagactggagtcgtggaggccggggagaaaggtttgttgcacattttggtacataataaatcctctaatacattgatgttggagagtggcgataaaattggtacggcagaagtggttgaaaaaattttcaaacctggaactgaaatcatttctaatgaatttgatggtatttttcggtcaaaaattttgacagtaaacacgaatcaaaaaggaaacaatgaaaaattttctgaattattgtcagtcttgaagcatgatgttggtccgcttaaagaaaatgaacaggagttaattgagaaattttggtcccaattttgtgacgttttggttttgagtgaagcggaattaacccagactgagttagccgagcataaaattgacacgggtgatgcatccccaataaaatgttccccccgcccaattccatttggaattcgtactaaagttactgaaatgttggaggattatttgagtaaaggggtcataaggccgtcaaatagtccttgggctgctccagtggtattggtaaataaaaaagatggaagtctgagaatgtgtgtggactaccgaaaattaaactcggttacccgaaaggacagctatccaattccaaacattgaagaaatgttaatgtatcttggcgagagaaaaattttttcatgccttgatttaatcagtggttactggcaaatcaaagttcaccctgaagacattccaaaaacagcatttgctgtccaaaacggcttgtttgaatttgttgtgatgccatttgggttaagcaatgctcccgcaacctttcaaagagtaatgaacaaagtactggagggtttaataaacaaaagcgtttttgtttatctcgatgacattttggtggccagctcaacattcgaagaacacattcaagatttgagtcaagtttttgaacgaatcagacagtatgggttgaaagtcaaagcaaaaaagtgcaagtttgcgcaactaactgtaccatttttagggcatattctcacaagcgaaggccttaaaaaggaccccgagaaattcatgccaattttggatttcccaagaccaattaccctaaaggaactacagagattccttggcatgctgaattggcaccgaaaatttattaaggattttgccaaaattgcaggaccactaacccgacttatgaaaaaatcggaggatcacaaaaaattgggatggaatgagccagctgaaaacgcatttcaaaccgtgaaaaaactaattgttgaagacgtcgtcctaaaatatccgaatttcgaaatggcagagaaaaacctggattttcgttttcacatttatacagatgcaagtgcaactggactcggcgcagtccattgtcaaaaagacaattccgaaaaaatgcgcccaatttgttatgcatcgcgtcgttgtagtgatgctgagaagaaatacggtccgacagtgcttgaatgtcttggaataaaatttgctgtttcaaaatttaaacattatattgcttggctgcctactgttgtcataactgatcataaagcacttcccgcgatgtttaggtcaaaaaaatcagtagggaatgcaagggttgatcggtggattatggaattgggggcaccattcgaattggaagtgatttattcccccggaaaatttaattatgttgcggatgccctttcacgggcttatcaccctgaaaatgaccaagaaatggacacgaagaagaatcgattaagatttcaaatgtaaatgtccaagagaaacgcccaaaacttccaaacagtgtcactctcgaagaatggattagtgctactgaaaaatcagaattatctttcattatggaatttctttcgaaaagaaaaattccagaagacacaaaactaaaagaaaaattgatcaaatcattggcgaacttcatgctgatggatggagtgctttatcggttaaatggaaaaggggagcccgaaatttttgtaccagaacaatttcgaaaacaattgttcaaagaacatcacatcggaatttgtgcctcgcatcagagcggaaagaaagtttatgggcgtttaaaatcccttggatttttctggcctaatcttctcggagattgtatgcattggacccgttcttgccgtgtttgtgcgcacaaccgaattccaacacggaatcatccaggcttgaaccctatagtcacaattcgtccaaatgaattgttgtgcatggacattttgaaattagggccaacccgaaatggaaataaatatacattaacaatgatagaccattttactcggtttgcggaagcaatcccgattccggacaaaaaagcagaaacagttgcacaaaatctcattgagaaatggatcttaaaatttggggccccggaacggattcacacagatttgggtaccgaattcgtgaacgaaactttaaaagaaatttcagaaaaaatgttaattgctcggtccacaacatcaggttatgatcccgcatgtaacggaatgtgtgaacgtttgaacagatcaattgttgagatgatgagaaaatgcataacatcgccctgggaatgggacacacgaattggatttattgtcttttcatacaatattactccaaatgagtccactgggtttcctccttttactctcttttttgggagaacagccaacttcccgacgaacctcacagtaccaaaacgaccaaatccggtttatttggttgatcacgatgattatcttcagcattttcgagaaaattttgaaaatatcctaaatgaggcaaaacaaaatatggttaaggctcgggagtcccaaaaaacccaatttaatgaaaaatcgcacgtgcgtttgaataagtatgctttgggagagaaagttatggtgttttttcgaccacgagcgcagggtgaacacaaaaaactgtaatggcgttattttggaccatttattatcacacaaatctctcccacttccgcctgggttgtgccaatcgataaaagacacgttgaaccaatgaaagtgccattggaacatttaactcatgtgccaaaagaaatccccgacaaagtgtttttacccaggcaacagcgcaaaaaactcttagaaaacccattttctgatttagtgatcaatgaccagcataacaatcgaattcggattaatccgatcagtttaaaaaattgttataattcagagccgacgccaaacagtgccatttcatggtcgaccgaatgcaacggagaaggacacgccaattgctgccggattacgcttggcaaaatttttaaggatttgccaagcaatgaccctctgcgtcggttgccaatttcaaagctcagcgagctcatctgccttcactttgcctccgatgtcctccatggccaattaagggaatgggcatccaaaaaagacagagaccctacggcactgattcgattcgtctcagagccgcagaggaaaattcgtggaattgaagaaaccatggaaaaatggctgaataactgcagcaaagcttttccagaactgaaggcatcgaaattcaagccgatcattttcgaaattccaccagggccattggaaaaatttggcaccgaaattgcgaaggcattcgagaatatccgcgccgtaaaaattcacggattacaccgaacgatccgaactccgcacatcatcgcaggggacagaacagccgaagaaattggaaagagatgtgaagcggaaataatcctggctgaaaactgcattggattaagtgatttattgggaaagacggcctttggacgggaagtgaaagaagtgattgtatgtgttggcacttccgacttggacattgacactccattggaatggtgtgaaaaggctgtcaaaaaactgctcactcaccttggacaatttgccataaaaatttgggtcgttccgcccccattttatcggcaaaaggctgttaagcatgaagaattcctaaaaatgctggtggagacggtaccaaaagaagacctttgcttaatgaagggatttcggtcaatcattgaagtcacgatgtggggaaatcaagaggagaagcgatatgtggatgagcggggccgattgaaattctcaggtgtcactgcaacacttaagcatttaaaagaagtgttcggtctggaagttccggtaaaaaaagtgccatattcgtttgcgccggagggtcagaataccgaaaaagtggagaaaatgcggtctgtagtggtcccggttaaattcggaaggctggaaaacgcaaattcgaattcgggaggaaaaaatttcccggtgtcccgcccaagtcacagtcgttggtcggagacaaagccaagaaatgaccacaaacagcagccgccgcataagaaaggaaggtttgattaggccggaaaattatgcctaaatgacgcctctgacctcaaataattaaaagatatttattttacactgtttatttatttctcattttttcgaccatgaatttattttaaattgtaataaaattgtgtgtgcttaaatgaggctttgaataatcaaaacgcaattaatcgccaattcaatgtcttgcctttgatcggaaagattgttcaaacctaaatccactcacttatgattggttgaaataacaaatccattttccactctcttgttaaagctgctaatcagaatggaaaccccatggctgtaacagcaatttacaatattttaactcaattcgatccgtttcccatcttccctccctcttttcaaaacccccccccttcctctcccctctctatccttttcagattaagaaacttcaactggacaaaatgagcgaatttccaaaatatgcgccgggacgtcgctttagtcggtgccgggggagcagtgctttcagaattggggaccaattcttgagcgaacgggggcatgtacgaggaagagaagatcatttaatttgttttggcgattttgacattctgtttaaatatttttttaaatcgtttcatttttttttgtaccattcttttttttcgatttttgtttttttgtgcacacaatttccatctttacaaatataatttatcgcccttaaaaaataaagttatacaccaaaattgactttgtgttgctatttaaaaaattgtgaccaattatccaaattaatttcctctccatcgccggattccgacccaaatacccgaaaaatcgtact

SEQ ID NO: 2693 - DNA, 1493 bp, Heterodera glycines
  misc_feature (26)..(26): n is a, c, g, or t
  misc_feature (77)..(77): n is a, c, g, or t
aatgaatagatgcaattattaataanacataaatttcaaaaatgaatttttaaatatgaaattaaaaaagaattgtntaattatacaatgtgcaaatttatttaatttttcattaattataggaatcagagaaataaaaatgcagttattaatataaaaacagttttttatatttcgatccaaactatgactttataccccacattctacaattcatatgttggtatcaataaaaagaaataatatcatacatcgcataatgaaaaaattatatcccataattatctttacaatatatctaaatatatcaaaaatcgtataataaataaaataaaattatattaataatatgaaaaagcttaataaaattattcgacaatcgaagccaaatggttaagagcattaaacccttttaaaattaaaaatattataaatttttcttagtaagataggaaaaaaccaaaattaaaatttttaaaacctaaaataatgcttttaaaagaaaaaggattaaaaatgaatttaatcacgatttaaaaaataagccaaaaggtattcctttatttcaaatatgtcaaataaactataaaaagaattaaaataaactaaaaataattattatcataaaatttctagcagatatttgctattatttgaacatatttaaatggaaaacctcttaaataatatttaaaaagagcacaacgaaaattaaagatacaaggatcggagtttaaaaagatatttatatctagaataaaaattaaaagactaagtcataattcattattgtaaaaataataattaatattctaatggattgacaatgaatttcttatttgatcaaaaaccttaaccttgctatatttattttaaataaatctaaataatgataagtaatcattaaataatgtaattttcaagtagaccactctctatttcttgactaagtcgagagaatacttaaacttgaactaatgaagattaaaaaagacatagatactaattttattgtaaaaactaaatagtatatctcatataacgacttctactttcttatttattcaaaaaacaaaggaaagaaatttttgttataatttaataatcaagaaacacttcaaatgcgcaatgaaaatttgagacaaagaaaggataaaaacaataaacattttaaatttcaaatttcaaataaaaaatgaaaaattatagaaaatgaatgcaaaatgaattaatgaataaaattcgcaatcaaataataatattatgtagaaagacaagttcgagacgaaacgcattgcttacgcctggacaatttgaaaataaataaatttttaattttacatattattgtaactaaacaaataatggcaatgaataaaatagattttcatacataaaaaacatgcgcaaaataaaaaaaaaatttttgaaaaaatgaattaaggagaattgagagggaaaattaaatttttttttgcttaaaataaaattaa

SEQ ID NO: 2694 - DNA, 2952 bp, Heterodera glycines
tgctgcttcatttgcctgaaatgccaacgctggctaaaaaaaccaagggtcagttttttttggggggggggaaacaaaggggtaaaaagaaaaagctgagaatggacaaaaataagaacatgagaaagtgcattttaattatataaaattattttgttaaaattgaaaaaaaataattttcgttaggacatgtttttttaactaacaaattaaaatatgaattaaatctttttttaggttccctttttcactgggcttttgtaaattttaatgaactctttcctaattgcctttaaagtgcctttgcccatttccttccttttgttatccgttcgttgcccacggcaccaaaaatcgattgacccctttttccccttcccctttttccccttcccctttttcctcccatcccttttccctttaccttttcccgacacaatgtttaagccatggcttttcctattttttttaactttttccgttcaaccgaaaaccaaatgttacaatgagaaaagaagggaattaaaatgaagaaagaaatggcggagaaagagaagaaaagagatcaatgggagagaagggaagggaattaatattaattgcatttcttttcgtttcgtttcgccttttctttctttcaattattttcttcaaaaacaatagtccgttttaatcggactttttcaattttcctttttaattaaattaaaatccctccccttttttcccttttttaaacttttgccaattttccccctcagaaaggcttccccccgagttggagatgacttggcccaactttttgctgcccgtctttctctcctccgttttaatgtgcgcatgttgggccgtcggccatttccaattgtccttcctttggattgtcctcttcaccgttctttatgtggtcggttttgtcgtttttcgtctcgtcacttttttccccacttattttgccccgacggattttcccttttttcgttttgtttttgacttatttattttgaaagaatcgattttcgcgtgctgctgcaaatatttcccctcgcattttcccctctgtcactaattaatattgatgcgatttttaggttttaactaaattttttgctcaattgatttgaagaaaggagctaaaaaaacgcatttctgcattaaaaattttcgattctgatgtcactatcggtcactagaaatcgctattttgggggtcggggccattttggcgcagacaagtttaaagattcataacttcgaccaaataaaataatgttgatattaatcaataggtctaaatgttccttattagtctgcaaaatttcaaaaaattatattgggttttaaaaaagatatggcgcgctgcgccaaaatggccaggaaaatgcaattttttgaggttttttggccataacttttttgtttctcagctaaattttttgaaactttgcaggttaataggcactatcagtagttaaccccccgggaccgtaacaagcttggttgaccatccctttgaagcatgcgccgcggtgggaggggtggggctaattaaaatattaattgaggtaattaattagtgaaggcagattggggacagtaagtagatagttttagtggaggcagagtgagagaggaggcatcgatttgaaaatagtgtttgaactattgatgagttaagtattgatcgctctgttattgctgagattttgacttgcagtgctatttaattaaccattggacagtggagatgaatgaatggcaaatcagcataacatagaagaaatttttagtcaatcccaaagagtctgttctaattttttgtcattattaattttattatagctcttatcgtaaggagattgttcaaattttcttgctaattggactaggtctcagattacgaggtgtatgggtgcttctcactcaaattgttatccctattgagatctggagtagaattattaatatcaagcatagaatggcaactcatacataattttacagtataaactaagccaatgcccaaggaagcataatcctaggccaaagctttagccattaccaccacaatcgaaagcttgcaatcaatgtttaaaaagggtgttggtttgtttcagttttataaaatcaatattttattattattactaataaaaattataattcattaataattttaaagattttaaattaaatgatttaaatatggtaaaattcaaaaatactgaagaggatgaaacatcttttttcaaaaaactaatcactaaacttctaaaaactcccctctttctttagtactaggcttttctttgcatagtgggatggatccatattataaagttattatttatttaccttctttttggaagatgcatctatattatttaggcctaaacctggattccttgcttatgtgttaagatattgatatcatacattttaatacgaaatagtcataattatctagagaacactatgtaattactctcgtttcttttccagcaaaatctcttcagcttctacactctatcattggtttagttctgcttcttttccttatgtgtattttttttgtgaaagtttaatctatccccatagaatttttactttaatcaacccgtccgcttttcagtaatataaatctattaatctgttaacaacgaaaagccctctcccctctttctcttcctctctctttctctctctgtttctcattttatttctctctcactctcgttctctttatccatttcattctctctgttgtccctctctccccctctctttctctctctcgcctttctcctctatttcctctctctctctttctttctctttcactcttgctctatcttttctctttcactttctccctctttcctctctctctctcctctgttgtccctttctcctctctctttctctctctgttactcactctctttctctctc

SEQ ID NO: 2695 - DNA, 6420 bp, Heterodera glycines
ctttctcctctctctttctctctctgtttctttctcttctatatctctctctacccctctctctcgtctttctctctctatttcctctctctctctctcactctcgttctctctatccatttctttctctcttcctctctctcccctctgttgtacctctctcccccctctctttctctctctcgcctttctcctctatttcctctctctctctttctttctctttcactcttgctctatcttttctctttcactttctccctctttcccctctctctcctctcttcccctttctcctctctctttctctctctgtttctcattttatttctctctcactctcctctctctttctctctctctcgttctctctctgtttctttctcttctatatctctctctacccctctctctcgtttttctcctctatttcctctctctctctcactctttctctttcactctctatctttcactttctttctccctctttcctctctctcccctctgttgtccctttctcctctctctttctctctctgtttctttctcttctatatctctctctacccctctctctcgtctttctcctctatttcctctctctctttctctctttctttctctttcactttctccctctttcctcactctcctttgttgtccctttctcctctctctctctctatttctttctcctctcccccttcctctctatactcgctctctctctcactctcttgtttctctctctccacccaacggcaaaaatgttttttttcacggtttttaaaaatgcattgtttattttgatctgtcttaaatcggttaatcaccaactaaactggacaattctagtatcgctctaaactttcaattttcatgtccctataggcatgcaaaatttgatttgaataacatgcagaaaaagagttatacaagtacgtcaaattgagagaaatgacaaagaaaaagagaaacgaggagatattatcgaatgaatccatagtgtatagttcatattctcctgaaagacccctctttatcatttaggcctaagcctggattccttgctcatatattattttttaatcgaaaattattaaagaaacaagagcatttcatttaaaattactcttgtttcttttccagcaaaatctcttcagcttctacactctatcgttggtttatttctgcttcttttccttatgaggtttttttttttaaatttaatctatacccatagaatttttactttaatttacccgtccgcttttcagtaatattaaatttatattgtatcaatggaaagccactcaactaaacactcttctaactcccctattgaccatattctccccaaaaagccacgacaagggatcgttcaacaaggagaaggagggacagaatcttcaaaaagagatgcagaagcttacgtgaagaagttatacagctccattgaacatgtggtcaaataccattacgccaaagtcaaatcgcagttcagcattgaggatgtccccgctgatcccgagggtcttttggttggaatatttcaatattgcatagataacggaataaaggatagccgtgagcgtgggattgagcctactcatgttggatgtgtgataagcagctctctgttggatggtggagacatcccaattcccttacggaaaatcaacgacaacacaataaactccatccttaatctgtttctcaaggtggcacaaagtaaacaacagcaaaaagttacgctatggggtgagcctttcatggtgactataacaacagttgatcgttatgggcttccatctaaacgacatgtcaaagggggccaacgacggaagctcgcgactgtgcgacatcaaattaacgatcaatgcttgataaaaataagtaatccagatgacttaaactactgtttgttttacgctctccaagcaacaatggttgctaaaacgcgaggatggccccgaatgaagtttcaccgctatttgaataacaaacacggacaaaagggacaacttcaatgtgacacggttcaactcatgcaacaaattgaagccccaatgaatttggagggttatgatgcagagactttcgttccacgtgttgtgaatcattggaaccaggcacaacagcagcatcgttttgcagtgttcatcttcggctcttcgggacagtacaaaccactctacaaatacattgacaacagctacgatacaccactcctcttgtactacagcaataaccattttgatggtgtccagaagcagggtggattgttcgggaaaccatattgcttggagtgtgaacgaccatatgataaagcatcggaacacagcaaatcttgtaaagcccgctgcgtgttgtgctcaaggatgggtcctgaatttccatgttcttcgactcccggattctataaggaatgctccggctgttataaaagattccgaaacaacgattgttaccattaccatcttcattcaaacttctgcatgcggtcaaagaagtgcaaaaactgtggtgttatctgggacgttttggacaacaacaagaaagggagaaaaggacatcaatgtggcgaaaacttctgtcgtctttgcaataattatcacaacaccgaaagaggctgctttattcaaccgtttgagcctaaacaacagaacgttccctatcgcatcgttgcgttcgacctggaaacgatgcagcaccaagcgatggacccccgtcagccagagaagaaacaacatcagcctaacttcatcgcagcgagagttgcgtgccccgattgcatagacaatggcaaaagaaataaggcgacagcggtctgccagatctgcggaccatatcgtaccgtcgccttctgccaacgccgattcatggacacacaagtgaataaacaagtggtgacagagaacccactgaaggcatttgtggactggctagtctttcaacttccaaagaaatacgacacctatgcctattcacattttggaggacgcttcgatatggtgcttgtcttccgcgagctcttccggattggctttaacccaaacatgctaagaaaaggaaacaagctttatgagatgaaggtgcaccagaagaaaaatagtaaccccaacataatttttcgcgactcgtataatttgatgccctgctcattgggtgagcttataccatcatacggtttggatgtcgacgacaagccgttcttcccacatttggctaacagacccgaaaactatggccgtgagatatttccaactcccaatgactacttggctagcggaatgatgccagagaagagaaaaaagtttgatgaatggtacgccgagcaccgccacgagccatttcttttggatgaagcgctagcaagctattgtaccaacgacgttgaaattttaatggcagctctggtggcatttcgacgcgaattcttcgaagtgtcacgaagaaatgaaggaattgtcgcgaaacgcgctgcttcagatgagcatcacaatggtatcgacgttctgagagagtgtatgacaattgctggagcctgtatgcgtcacttccgcatgaatcatcttccttccgggcacttggcaattgttccagaacggggatatgacaatgcacaaaatcaaagcgagctctctcggcgtttcttacattggtacatggaacaacacaaagtccaagtgcgaatggccaactcacctggcggagagaaaagaattggacaatactttgtcgatggatgggtggaggcagagagaagagcaatcgaagtaaatggatgtgtatggcatgcatgcacagcttgttatcccgacgatgagatgctgatgccaaacggaaagacagccggagcagtgagggagcgcaatgtcaaaaggatggaattcatacggaaccaagttgacaaattggatgtgtattgggaatgcgagattgagcgcatgttggcgaaagataaacaaatgaagatgagatttgaagaatacccagatgatggaccgctgagaattcgcgacgcttttatgggaggaagaacgggaccattgaaactacttcataatgtgggcgcggatgaaaaaatttcttactttgacttcacttctctctacccttacatcaactgcactactcgttacccggtgggtcatcccaaagtgcacgtgctcaattttgaagtggagtggagaagtgccgcggacaacccatacccattggcgctgctcaaagtgtgggtcgtgccgccacgacaaatcgatgtgcccgttctaccggtgaaagtggatgaccgactgtgctttcctctgtgcatcgcctgtgccaaagaatatccaactggaggcgtggacaacgactaccactgtcagcacactgatcaacaacgcggatgggtcagcacctgcacatcgattgagctcaacgtcgcgctcgacgagggttaccgcgtcacgagggtgttccgcgttctggagtacgaacagagcgacgacaagctattccgcccctacattgcggaattcatggctcaaaaaatccaggctagcggctttgacagcagcatcagagggaatgcggagaaggaacaacagtttgtccgagagtgtgccgaacagttcgacatcacgatcgatccaacaaaaatggccgccaataagggaaagcgatcgatagcaaagctttgtcttaacaatttgtggggccgattttctttgcgcaattacggcttgtcgcaaacattaataacggatgacccagctgttctaggagactttttggataatcgctcaatcgacgtcatgactatagatgaactcgaagaagaacatattttgatcacctacgaaaaaaagaaggagtgggtgactgagcatggatgctcaaatattgttatttcgttgtggacaacttcggctgcgcgtttattgttgctcaaggctatgcagaaagtagtgagatcgtggggatgtcaacttctctacaccgacaccgacagtcttgttttatcacatccacttgatttttgccctctcaagacgggacaacaccttggcgaattcaccgatgagtaccccgaccatgaaatacgtgagttctgcagtggtggagccaaacaatatggattagtgcttcggcgcaaaaacacttcatctgatgcagaattggaatatgtactgaaagtccgaggaatgacgctgaattacgacgtcattaacaatcaaggtctccgctatgagacgttcaaacaacaggtgatgcgttatgcgagaactggagagattgagcagataaggatcgaatacccaaactttcttcaaccaaatattcgaagtggtggatcagtgacatcgactcaaatgcaaaaatgttaccgtccatatgttgggaagggaattataggcaacgatttcaatgtgaagaattttggccacactttgtaatgtttttgttttctgatgtatctctctttctcatcaatacaccataaattgtctctctttctctctttgtttctctcacacgtacacacatgtgctcttttatctaaattatgtaatttatcatattttgttattttgtttaatattaaataaaaaaatatatacataattaagaacggaagatgaactttggaactaattaatcattagaagatgtcgtttttaggtggaaaaatgcataattaagcgaaagaagaaataatttgtgaaaaattaagacatggaagttgaaattcaaaataattaagcatttcaacatgtcatttttaggtagaaaaaagcaaaattaaccatttgaagcagaaattactcgaaattcactaaaaatatgccaaaatacagcaatttcaggttttgtgcgcgtgagtgcgtgcgtgcgtgcgtgtgtgcgtgcgtacgtgcgtgtgagtgtgtgcgtgcgttgtctgtatgtgtgtgtgttagaagttagttggatttgtctgtgatgtagttaacgaagtaaatctaatacatcatataattttagttagtttccctttagttcacccttttaagtttccaaatttctcgacttaaatcctattgtctttatctcactcgtctacaacatcacctttaagccggcctcattttcttctctcactttcttaccctcctcctccccttttccaatgtgcgccaaaatctaccgcactgaactttcccatatccctcttagactttccgcactattcctcccctttccgcagccctccaaattttaccgcactattcaaacttagcgcacaacttttccatccttaaaaaatgtacggcacccaatttaccctacttctacaaggcttaccgcactcttcctatcaactttaaacggtccgccaaagtttactgcactattccaagtcacagcaaaacgttctctattcttcta

SEQ ID NO: 2696 - DNA, 1402 bp, Heterodera glycines
  misc_feature (9)..(9): n is a, c, g, or t
atataaatntctccggtaaaaattaaaattctcaattcgtgcatcatttactgtacgaaatttcttgaaacacgtgaattataaatggaaaatgattgtgcatcgatccgcgcttatcttcggtcgtgtcatttcgaatcaaatgaaattttgggcattttaaactcaagaaaatgaaaaaaaatatttttttcaaaattaattaattcaagtattcgcttcataaaaaaattatatcaaaatagtaatttaaattttgtattttcaaatcgaaaaataagcacgtaatgctgaaataagcatacttgggaactctgaactaaattgttgtctaaaaggaacagacaaaaatcttaaatattctcgatggccactcgtccgaagtgaacagaatatctcaaaaatgggctgaaaattatgaaatccttctcgaaacatgatttagtaacccaacctaacaatttaaattagtacaaatttttccatctccaaaaaatggtgctgaatcgttaagaaaaaccatcaaaaagggcgttatataaaaaaccatcaaatgaaaattttcaacataaaattttggtcaagtttgagccaagttatggctaaaagtacacaagcaaccaggttttcacacatttttggccataacttttttgaaacttagccaaattttttgaaattttgcaggctaatagaggacagacacttagggttttcgaatgatatcaagttttcttaattttgttgtttctgagaaagttttgaagataaaaaaccatgataattttttatccggggttttaaaggtcgctaatcacgaatctgacatgtattttgactaatttctaatccctaacccgaactcgaataaaaatcgaaattttgaatttttcaaattatgattttttgttcaaatttagattaggaaatcggaattgatcaaaataattgaaggattcgtgatcggggaccccaaaaaccccagagaataaatttttatgactatcacaaaaaaaattttgcaaaacaaaagggtccccccttttgaaaaaaatttcaaaaacggccactttccatatagtgccgaatttttgatgatcaaaataattttatttttaatttaaaaattttagttagaaaatatttttattttcttgttattattcgatagccacacgtgtcctctattaatctgcaaaatttcaaaaaatttcgttgggttaaaaaaaagttatggcctaaaatgtgtgaaaacctggccacatgtatacttttggccataactttgctcaacctcgaccgaattttttcaaatttaggtgagctaatagagaactattagccctatcgaatgatactaagaatgtcaaatttggttgactttggaaaaaattatagacag

SEQ ID NO: 2697 - DNA, 1738 bp, Heterodera glycines
tattgatatttgtgccaaaaaatgaaatgggacaacacttttgatcactatattttgatccaattgtggatatggtaaaataaatcaaataaatggtttagtcaaaatgcaaaatatgggtatcctttgagaagccccataaaaaaatgctatttccattgtatgcttcttttttttttttttgaatggaaaatgacaattttatacgcaattatttttttcaaagcatgatgggacaacacttatgaccatgactgtatttttttttttgtgaattttaatatgccgccttcaactattttgcgagataataaattagaagaaattttagaattttgcttttcgtttataatgcttcacaatacactgagttgcaaggccaaaatctcagtagacaccataatatctattgaaaaatttctcaatcgagatataactactcgaaattcagcgcagaaaaaaggtgagcacagtttatacataattttctttattgcagtttttgcttcttattatagataagcacatgaataccttagtaacagaattcaattttgttttcgaattaggcaaaaaagagttattcaattgttcaatttttattttggaataattcagatgatcaacgaaagaacctcaacgaatcattgttatattcaccggaagacttgaatgagtacagttttgagacagaggacgaagacgaaagagaaggcgaaggaagcgcaagtgtggaactgctcaattgggtagataaatacgaaccgataaatattgttactataatacaaattaagggtaatttcgctgatgaattcgaagggacaaattttgagatggtacggaaacgatggctacgcaaatcgctgatctccatgagcatgaacatggacattctggtgatttgcactgcgcaaaagttcgtgatattggaatgctccaaacggccaaccgatgggttaaattcgatggaaatggctgcgagggttgagattgaacgtgtcgatgaccggtctttcattttgtcattagccgtctttggagtacagccgcctcagtccaactcctccagccaatcattgacgacagattggacttgcatttgcattgtatataatcattccgccaaatactaccaaaatgtgagacatttgcttctctaagggcttgagcactggcgaattgatgttttacaccgagcggggaactctcattttcacggaaaggtgcgcaaactgtcccattctatcgttgcgactcggccattcaattctgcctgggaatcaaggttggccattcgtgtcgccttttcctctcaattccccgaagaactcgtcgcacttacttccgctgccaaactcgtcatcatcgagggcctttctctttacacaactcttcgtacggcgagggcacagattgcccgtggggatcgctcattcagcgaaatttgcgggaatttgcaacttaacgcgcaccaactgaagctggacagatatgagcatgttggcgattttcagtccattggattaacgagacccggcacttttgaccagtatatgagtgcgttttattcagccggaagaagtgtgagttttaaaaatcgggttttcatatttctattttaaaaattattaaatatttcctcgcgcgtgcctatacaccaattttttcctaaactttttgaaaaaagaatgttaagtggaagcaatctttttttacgagaatcagttttgttaat

SEQ ID NO: 2698 - DNA, 1843 bp, Heterodera glycines
  misc_feature (102)..(102): n is a, c, g, or t
  misc_feature (147)..(147): n is a, c, g, or t
aaaacgggggctatccatgattatgtttttgaaaatcattaaaacccttacggggaaattctatgatgatttcaagtcggaaaaggtgttaaacaaaacacntgctaactcgtctaaatttgtgtttcagatcaccaacaatattcncttcttttggcttccgttctttcactggtattggcacttctcgtaaggaccgttatgtcaagaaatctgctgccgatgtgcgtacaaattgggtgccgattaagagtattctcagggatggaaaaagaagtgccgatcggacatttattgcgccaactcccgggtggccatttgtcgctgtttccgataactatggacggattgtgctcatcaatacgcgcactagacgtatcattcgaatttggaaagggtacgactgccaagagggtagcagcccttgtcttacaattagggaggggttcgaaatttttaaatgcgctattcaacaaaacaaaaaaacatcgaaagtctggtgtggtgggtacccgcagagaaagaaaactttccatgttttgttaaaaacgtctccgaggaggggggggggggttacacccctcattgtttgtttatcctggcctacgcctatgcccttgacgatgtgcttccttcgtttcctattttcacgatttgtttttcagttaccgtcaagcgaggtgcgcatggattgagacagtcagcacttcacgaacgacgccaatgaaaaaagctctttttctagcaatttttgctccaaaaagagggcttttggaaatatggtcgatgctggtgagggttttttacaccgtttcaaacaaggcgaccagactatggtttcagaggagcccaaattcctaattagtgaggggaactcgcagcgtagcaggacagaacgtcgccggaacaaaacagcgccgggacataacgtcgctacaaaaaataaatatattagaaaaattcaaaaaaaaaattaagaaacaaacgttctcatggattttttttggttttctggcaatttattgttagcaatttattatataatatctaattttaaatatttcaaatgttttggttttttgcgccgctttatgtctcggtggccggcgatgtttttgggggcactggaatccgaaaatttattaatttatcttcgtctcaaaagtttattttctagaatggaccacgcgttttggcttttcaagttgaggagggcagtcggttgctctcattgcctgttgttcacggtggcattttatttgggggctctgatgttcgtgagactgaatcgcaggaagcgggtggtcgagcgggggccgtttttctgacgcctgacggactcctttatgtgatgaaaatttatttgtgaatctgaattcattttttacagtccgtcgatgtgcccttttatctctccgcactttcgacgagtgcgacatcgatttatgacgaacatttgataaaagatgttgggtttcattttcctaattaattaaaatgtatcatttcagttcagtctcgaacattttatgattaaaactgagaatgctgacaatgaatcggacgttgacttagaaaaactggctgaatttgcgcttcgaattaaaaccaacctggcaagacaaagatttctggaagctttaattgtttcatcgagggggacttcgaccaaaaagagcgatgccgggaataagaaattgcgaactttgatatcagttcgatcgttgcgcgaacttgtgaaccgaatggttggaaaatgtgagctacttattcgtaaagaataataagttacgctaaaacaacaaatttttcaggataaagttgcaacggataaatctgaatc

SEQ ID NO: 2699 - DNA, 6604 bp, Heterodera glycines
tcccctatttgttggctttgcattctgccatcgatttttactcaattttggatgaaaaatttaccgattgtatatcgactgacgaccaaccaattgctgagattgaagcgtgtgtgaagcatctgtctcaaattcaatgtgatcgtactaatccgttgttggcaaaggctttgtcaatactcgaattcgtctatgacaataggtgggtttcttctaattttccgaagcattgcttttcaattttaagcggttcttcggccattgcttcatctctattaaatatcgccaagtgtcgtttggaattaaacgatttcgttggctttttcaatttgaatctgtatcaaacttttgacaataatgctcaagttggaacgccaataactgccaaatatgatgaaaataatttatcgacaaaaattcccacaaaccttttggcaaaattgggtgcaactttatttgctccgttcctcgtgaattctttttcggacttcgaaccatttctgaagagtctgacatcaaaatttcggctgagaaaggtagggttgtgttgccatcaaatttactctatatcaaaattgctgattgaatttgcttaacttttaggatttcttcgtcacttctctctgcgctttttggctttacccgccgtgtaactttaaattggactgtttttcggctcattttgctgaatttatgctcggtcttttcaatttgctcgtcgaagactctgacaacagcaattggaccacatcctttaaagaaacactcaaaacaattgaacaaatggtaattgaaaggtacacagtttcgttaaatttatgtataaagcttttcttttattttgtaatttcgtggaaactgagaaaagcctttcaattcttggatttgatttggaatttctaattcagcactaatgtgccggctgctctgatggtcgctgtgcaaatgggcgatttgtgtcaaaaaatgtcagttacgctcaatgaaagaaaggccagtcgaggaagcggtgattttttaaattaggttcggttgtaatttcacacaattttatccaatttagaacagaaaactccaacggaagatggcgatgcttttattgttttcgataaacccgaattggagctttattcggagctgtgcaacgaattgccatccttttgggcacttttgtcattgcatttgagcgttttacaccttttgcaatggctttcacagcaaatgacagatgaatcgctttcgtcgcaattgtcgacatcaaatttctccgttgccaaactcctccaaaagggtgttagtttctatcgggaacaggttggttggtcggttgtcgttgttttcaacccattcttttagttgggtctttgggtttctaatctcccgactttttctgcccatggcattgtgtcgcttttttcttcgaatgtccacattgaaaaaaataccgatgagattcattttaacgcaaaaaccttccacgctcttcggttgctttgcaaagggacacttccgcacaatttgcgattggaattgatactttgcgactgcgtctgggaatgcgccagtgcttggtacaaggacgaatcgcgaagagtcacaaaactgaaggttgttttttggcgttgcattcattgcttctcatttcggccaattccctcgtcagcgttctatcgacctgctccaattccttagttcggttccaaagttgcaaaatggcatggctttgctcctttgggacactttcattgcgtccagcttcaagaagtgtttccttttgattgaggaacagatgggttctgctgggcccggaaggtcagacggcggaactttgccattgatgggcaaagaccgactgctgcgaagggatgtcttaatcgtggagagggatttggtgatgcattttaaagtacaatctcatgattactgtaaatttaagcctgactacacgagttgcatacgcaaattcctcgaaatgttggccgagtcgtgctgtcacctctgttcgagacaagacattgcctacggcccattggcgggatccttgcattcggaggaccgcgaacttactgattttatctgtcaccacaagttcaaacaacactcatcactctctgaaaggtcaactttttattgtcattttttaatttattttaattttttatttctagaaaattcgctggaaacttaactggccaaactttgattcagttgattgactgtcaaaagtcagtcaattatcacttggctttgcatatgtctcatctcgctgcagtcattgaacttcaggtgaatttttagtagaatattttagtttattttgctactgcgctcttctttttgttccccaatttctgccaaattgcacagattaatcttgcaacgaatgcttatccgaagcccagctcactgttcgattccaatggcaaacgcgcgtttttcaaccctttccacacccatccgcttcttcccatgggacgagtcgacgatcggacaaaaacccgaaggcaacgctttattgagcaatgcatggaggcacatgggagagagaatgagaggacgggacagagcagcgaacgctgtcgagaattgcgaaaagtgatcgatcggctgacgaaggaatgggcgttgaatgtgaccacgctccaagtcaatgtgagggcgggggagagcgtttcccaatgaaatcactcgtttttcaatttatttattatgggaattttgttggttttaggaggtcacgcggctttacctcaacggggcagacgaagaagcagaagttaaatgtgataagctttctggaaatcgtcaaaaactggcactcgagctcgtcccggttatttccggtcggataaaactactaaatgagaagagccgctcggcattgtttgacaaaattggccaatcttcggctgcttctccggggttaattgaatgggaaagtgcgaatgttcactttgttgtttcagcacaatgactttcatcaacgacacacccgatgagtatttgccaaatttcgaccaaatcgattcaaaacgaatacggcgcttagtggcgctttcgagttcttgtctcgttggaaagagtggaagaagccagcagatgaacagaagggatgaaaatcaaaccatggaattttcaaaatgccaacaacttttgcgtgaatttaatgaaatttgcaatgttatcgactggatggagaacagaaagtgaccttaaaaccagaaatagaatatcccaacgagaccaacatgttcatgtgatacaaataatttaattcgaatttatgtttaattattgtgacgtctttcttacagattaaaaaaatgcatttcaacaaaaaaaagtagaatttttgtgtagcgtccgctgagatatgctcacaaaaatattcgcttacatcgtatatttacatccaataatatggactcattttttagaaataaaagccaattttacgtaaaagggattaatggaagatgccagcagcagcagtttattgggcgagaataaaactatcgagcttaatgaagaagcggattttagcgcgccaatgattatccgaaatgaaagcgaagacaatttgccgattaccgaaagccttgcggaaacaaatgattcgcttcagcaggagaccgattctctgttgtcattgtcgcaatcggaaagtaaacagaattcctccgcctctttaaaccttcattaattgtcaattaggcgatgttgcctctaagccaaagtcaaaaacgccgagccgcgctgttttggcaccggacgttactcacgtgccaattcaggcggcggacattgtcgaatacgaatggccaagcaaatcgggcgacaaattcttcctccaggcaaaaaacgggaaaaaataaatcgttttttttgggtgtaacatggcatttgttcaggagcaaatatcggaactgctcggcattaactctttcaagcgcaaataccccgaattggtgcgcagaacggtggagccagcggaacgcgactatttgctgaaggaactgagggcgaacatcgcactgcccgcccaccacctcaccgcactgcaagcggcggatgtgcacgaactgatggcatcggagtaccctttcgaatacgccgaataccaaaaagtgtgcaatgagcgcgtgaaacggacacttttggagaaacaaaaagaaatggaaacggtgggcaacaaaaattgggtgagagcttacacatatttggcagattaaattggatgcacgaaaaatggccgaaattaggcaaaaagccgtgaaaagtgcgagcgaattcaattccgagttgcaatttgtacgccgaacggagagacaacagttttgggagatgaacacaaatgtgtgactgttgggcttttgggaaaggatccatcggatgccaattcctttcagttgattcattctccgctcaacaaatggatgcgattgtccgccgaacacacaaaaccgtcggattatcccgtggttttgatgcccggacagtacgccacattttacaaaaagttgccgcttttccaattaaactaaccgttccaccgttgccttcacaatattgcaggttcgattcttcgctgctccgttcgtttccttttggttcggtggttaaaagcgacgaattgttccgcccgaaaagggacgcttctccgcctgcgatttccatctccgaaaacgaattggaagcagcgaaaaataacagtgacaaaagcggacaaaacagcggacggagagaagtgaataaaaagtgaaagaaacaaaatgattggacagtttagcacggttttgttgacattgaccaattggaaaggaacaatttgcccaaaatgacagaacagccccaggcgaagacacggaaaatgtcggcgacatcaaactcagccaagtttagtcgaaattggccaacaaattgcaggcgagggaagaggaaaacgaaacgacaaacattttaggtgtcaatttcatggacaacgaccgcaccaaaaatggcaccgcaaaaagcaaatggaacggacatggcgaaaccacggggatatgtacaacagcagcagcccaaacaagccgaacgtgacgaacagaagcccagcatttgttcgatgtgccaatcggccgacccgagcccggcgcaccgggcttctctgctcgtccaatgttccgcttgtcaacaccaaatgcattcgttggtcacttccccaacaattgttcaatttccctttgtttaagctcgtgcattgacatgccgttgaacatggtcgaagtgatccgcaaatacgattggctgtgcattgaatgcaaacggtgctcagtgtgtgagcagcccgaccaggaggtgaccgggggggcggaataagcaaaatgtgggcacctccctccctctccaggcggcgatgatgtgctgcgacgcgtgcgaccgcggctaccacaccttttgcatcggccttgaaatgccgccgaatgggacttggcactgtcccaagtgcaaaggttgctgatactgctcactcactgtccaccgcccgttcggccgaccttccgtcgctgcttaattaatgtttataaggcctcactgaattccttcctatccctttttttgcgttcattaggggggggggggcggaggtgcggcaattgaccgatggtcggtcgctcttcccaaattacgccatggagtgaattaggttcgcaacatttccaactgtttaaggcactgtcatggacgaacaattgaagaaacggtatctgagtgtaaaggaacccgaaacaccgaccgaaggacaacaaaagatggtgtacatggacttgggaagcaaaagtcagggagaaattgacggagcatttgaaatgcctccaaagaggcggaaaggaaggccaccgaacaaaaaggcataggaaagttcagtcgaattgtacaattgttggtccgaatctgacaacgataatcccatcttttacatttgtttttttgtccatttttctattccaaatttttgttcgatttttttgaatgttaaattgctttttattctccatttttaaatgtaattttaattgaattgatttgcttttacttttatctttcacttcaccttttttctgttgttcgtccctctcgaacgatgtcgagcatttccagcggcgtcgacttaaccacaaaataccagcgactcgccgttgaatatgttaaggtgtcagtcaaaccgttcacctaaacatgcaaaggggctttgaacagttaaggtgcggaaccaagtggcggtgcttaagtcggctttggtggaagaacagtcgaaaagggccgatttgggcaaggaaatggcacagagagagacgaaactgttcaaattggagggcgaaagggactcgctgctattccgcaacgaacagttgctgaaacgggtggagggactgcaggagagcatggacgcccaacaagcgacctttggcatggccaaaggtaaaaaggtgggaaaagggcgaacggacggactgtcgaatggcaaaaatcgaaaaaataaaacatttattgtcagggaattacacattttatgagagtgtcgaatttgatcaatctctccctttttctgattcctttt

SEQ ID NO: 2700 - DNA, 592 bp, Heterodera glycines
aaaattattacgtgtatccagccatgcaattcacttcctcgtcatcatcgtccaaatcgtcttgataactagcggagactggatgacgactaatcaaaaacagcacgatcggcaatagacaaaatggaataatcaaaaacgtctacatttttctattaatatagcaaaaatgttttttattccataaaaagtattttattttagtatttattaaaataaattaaaaagtgtattattaaaatattaatagaatcaaaaagtttgtgaaaatgtattattggtgatatttgggggggggggcattcatcgacgagcgaagggtcaaaaacggacggaacaaattctgatgagagatggaggggaattttcaaatggaaaagaaaggaaatggggagcagacgaaacgccaatgcccttaccctggccaatgccaatgcccttaccctggccaatgccctccaattcgtattcatcgcttgttgaatgttcgggattggcaagaattgagccgattgggtcaacggcaattatctaagataatgagtgcttaattacacaaagactacgtacgcggccacaaattggcactaat

SEQ ID NO: 2701 - DNA, 3683 bp, Heterodera glycines
  misc_feature (962)..(962): n is a, c, g, or t
aaacaattattaataaattcgataaattgtttttcccttttttcttaaagtcaaataattcaacccttcacttttttattggatttttttgcctaatgttagccatttttgtgatgacatctgattgatgaatcactaaaccaaacattactgctcagaataattaattccaaatagttttggttactaaaagaaaaaaataaaattgaaattttgaactataaattaattaattaaaaaaataatttaaatgtttttgaatgacaatgtaaagttatgaataacacatttgtcaccccagtagttagccccgtattttttggcccctaaagttcgagtcctcttgactgcaaatcattttttgggaattaaatttttggtgcattttaatgggtctggggagtgtttttcttctatgtccgcttggctgcaacaattttttagtaatcaaaccaaaaggttttggtgtatttttaatgggtctggggagttttttttgctgtaactcatttttttgaattaaatcctaaggtctagggcatttttttaaaatgcaatccattggttttggtgtgtataaaaatgacaataaattttttcccatgtcaaaacctattgttttttgttcatccatgaccggcccattctacagtacgggtacaaatgtccaaaataatacatctcgaactcggtgatgtcataattttacagtggagcgttaattattttcacaaataaattatgaatgtattttaatttatttttagatgaccactgtattgtatgactgaaaaaaagtttaaggatttttaatggtgaaaaatcccaaaaataattaactaaattggcaaaatatagtgtcgttacaaatgaccagtttttgtgctttgtatgaaactaaactgtaaagaaaatgctaaaaaaaattaaccgacaaaaaagcgcaaaaataaaaggatttncggttctttgacgaaagtacctctaaattttagaaaaatttcggtgcttgtctctttgaaaaattcatagaaaaaaacaaccgatttgaataaaagatttccctactgcattgcttttaataaaatttttgtttttccctttgatctccttgggaatcgacatgtttctttggaatctacatgtctttttagaaacggtactcagccgatgagaactttatattgtaatataaactttttaaatttcagtcaattaaatgttttttccacttactgcaattgttgttaaatattattgaaaaatttgttaaaatattttaaaattaatgaaaatcattggtgacccattggtccaaattttttatgtttcacagttggagcccatatggggcatcgccgtttagtgcaaaagctccgaaatgcgcacactaattaatttttgtgcattttaggggttgacttacgacgatgaacaatctttttctcgttgtaggataattaattatcacgagacgaaaaaccttttaggaatcgagaataaaatgatcttttagtttgccgaaaaagtaattaataattaaatatggtgagaaaaaagcggcaacttgaaaaaaaggtttcctaaatttcatgaatgcaaaaatgcaaaaaaaaaatcaagctgagaaaaaggggcaaaggggcaatatttaaggcagatgccgttttggcctgccattagtcttaaatccccatctccatttttctcaccacatcattctgtccatgccacaaattttagcactagattgaaaatttaagaattttctgaagcatttacacatccattttagcctttttcccacatcccgtcctaggtaatatttttgttcctaatttttttaccaaaaaaaacttaccactatctttatttgaaaaggacgtccttaaaattcgaattctgtttgagttgttccttaattttttgcagaactttagtattttaaccaatttttaacaaattcacacaaaaaataatttttcatggcgacgcctatcggcgaatcctgactaaaatttcttttaaatttctgcccaaaatctgcaaaaatgctcaaaaaaattgtcaaaaattgcaaaatgaaagaatttttaaagacaaaatttctaaaaaatttttttcccaggcggcgcctatcggcatctccggtgctaaaatatgggagaaacttcattttggagaaaaaaaaaacaactgaattgaataaaaaatgttaccctttttattgatttaataaattttttttgagttatctctgaaaattacacaattcctccattatgtccttgaaacccgacatatttgtcttttcaaaccaaactaagtagatacacctgttttactttaaaaatagaaaaaagttttttagtgtgattgagttatatttttaattattttgtgcctatttctccctattataatattttcaataaatttattataatttccaataaatttaatatattttttcctttagaaccaaaatgtctgacaatatattcgccatgttggatgattttgacatcgaaaacagtaattaaaaaacaaatcattacatatacatatacatttataaatatatattatattattttttagtcgacccgactctaaatttttcaaatgatgcgtggatggaggaagtcggtgaaaccgtcacggtaaataattgtttaaaaatgtttaaataaattaaatacaaacaaatgattttgttctaatttttcttcagaaggcattttttgattcatttttttgattacttatttagaaggtctgaaaaaaacttaaaaattctaaaaaagttttcactgaatagttatgtttactaatttacttattttgcgagattttattacttagggtgtaacataagttttgaacctattttttataaaatttttattttaaaatgtaaaaaataaaataaagatacgataatacattccattattatctataatgagttgccatttttttggcaagagagtaatcccaccggcattaaattagaagttataaatctaaaaaccaaaaattgtcatttttcagtacatattttttgagggtgaggttctcggtcatatggaaaaatttaatgataacctaaatatgtattgatagaggacagttaatactacaaatgccatctgagaaatattttttgtacataattataaaaatttttaaggagtcgagttttaaaatggcacaagaagttgaccattttttaagaccacatttggtacaatttttctattaagtggttttgtattgacccaaaatctatttaaaacatagcaaatttgaaattctgaatccgaatctggcctctgattcgaaccttgacttctcattggtctctgtactgcttgaactttgtgcacggagttgaagcagtacaagcaattatagaaaaaatagacaaaaactaaaaccagattcagattctatggactgatttggtcttaaaatatatggataatagggatttgtgaaggttttgtgttagttagtctaagtgtacaattaatgtgttgatgtacatttttggcatggttaggaaaggagcaggaaaaaccaataaagaaaggaaacaattaaagaatggtatgaaatgaaagagaagactttaacaattaaaataaaaaaaaaaaaaaagaattattaaaaatatgtgc

SEQ ID NO: 2702 - DNA, 3824 bp, Heterodera glycines
  misc_feature (3718)..(3718): n is a, c, g, or t
  misc_feature (3780)..(3780): n is a, c, g, or t
  misc_feature (3791)..(3791): n is a, c, g, or t
attttttttgaatcttaaaaattttttatgctctaattctatggtacacccttaagtaaaatataagattttgaagcgatttttatgaggtgattttatggtgaaatagaataatagattttttaaaaatataatcatttcttttttcagttacacgagcttaagcccatgcgaagagaggaaagccatgttagtttttttactctataacctaaaacaaatttgaaatttccaggaatggttgcaagaaaaagttatcaacatcgaaaaaacacaatttgaaatggagaaacaactccaaatgttaaaacaacaacaacaacaacaacagcaccaacaacaacagcaccaaccgcaacaacaacaacaacaaccacaacagcagaatgctgagatatttgaagtggaacgcatcgttgacgtccgaaaagcacgagatgggaaatcagagtataaggtattaaaaaatgtttttaaacaatcataaattagcaattttaaggtaatttggacgggctacacggagtcgtcctgggagcctctatcaaacctttggggcgccacagaagaactctacaatttaaactgtttcattgttgcggaattattgagttaataaatgataataatctccgatttacaatttcctttagcaaatgtaggcagacatatttagaggaaaatgagctgaaattgtgaaaatttcacaaaaataatcatgaaaataataaatcggagattattagcgctatcaactcgatatttccacaacactgttacagtttacatttagaggataatgagctgaaattttgaggatttcacaagggtgatcgtgaaaataataaatcggagaatattattaacacgatccttctacaacactgatgcagtttatatttagagattaagtcgctgaaattgtgagattctctatctactattttcaagaacaatttttgaaattcttgtaatttcataaatatatactgtaaatataggttgtctcgtcgttgcagaaggattgagttgataagcgccaataaccatcaatttactatttatttttatggctttgtataattcttgcactttcagctccttatcctcttcaaataaactgtttcagtgttgcggaaggattgagttaataaacgataataatctccgatttacaatttcctttcgcaaatgtaggcagacatatttagaggaaaatgagctgaaattgtgaaaatttcacaaagataatcatgaaaataataaatcggagattattagcgctatcaactcgatatttccacaacactgttacagtttatatttagaggataatgagctgaaattttgaggatttaacaagggtgatcgtgaaaataataaatcggagaatattattaacacgatccgtctacaacactgatgcagtttatatttagagattaagtcgctgaaattgtgagattctctatctactattttcaagaacaatttttgaaattcttgtaatttcataaatatatactgtaaatataggttgtctcgtcgttgcagaaggattgagttgataagcgccaataaccatcaatttactatttatttttatggctttgtataattcttgcacttttagctccttatcctcttcaaataaactgtttcattgttgcggaattattgagttaataaatgatactaatctccgatttacaatttcctttagcaaatgtaggcagacatatttagagaaaactgagctgaaattgtgaaacactcaccacgatactcatgtaaataatagatcggaaacgcttaaaccaaatcaccgtgtatccttcctcatgcacctcctcacttttggagcgattatgttggataaatgtgaatttcgaaaaatttgagttttcgatttttgttcgaattcggatcaggggttcggaattgggtgaaatggatgccatattcgtgctcagcgaccccgaaaaccttataataaatatttttaacttttgaaattttttaaaaaaatttcaaaaaaggtgtgataccatcggtactattaccgaaaaaagatataagcgtttgaaattttgttttttgaataattttagatcggagcgtaaaaaaataaaactcgagcgttaaaaatattcataatatttttctctatcgctatgcaaaatttagtacatattgtatgagtagaaaaaaagttatatggagagaagtaaattcggtttttctctattaacagagataaaaaaatagtacgccaaaatgagagatgtttttttctctgcactctctctttattgacacatgtctcgttttttgactcggtgtgtgaattgaatgccaaactctgcaaaaatgactaatttaattaactgaatccaaattctgtaaaaattgcgagtcccgggacgacccccgtttttatcgataatgcacttgatttcgaaattttttggtggcaaaataaattttcattgaacaaaagttgaggccgagttgggatgggcaaaatgggaaaatgtccattcaaaatttcattacatacaatgctgaaatgttaaaaaaaaaaattacgaaagccaaaaaatgattatggatatttttaaataaaaacattttttgcaaaagaaaaaaacaaaggcattgatgaatttaatagatacttgtctcagcaaaaaaaaatttgcggcttcagaattataaacagaaataaaaacaccagtgattataaaatgtacaacaatgattataaaaggtacaacagtgattggaaaagttataagagtaattagaagaggtacaaaagtgattagaaaaagtacaaaaattgtgaaatggtacaaccatggttaacagggtaaaatcatgatttcaaaattaaacaaataaggaaatggtttatgaaaaaatataattaaaaaatgtattaataatttttaaaaaattattaaaaaatgctttcttttattaattaaaaataaactttgaatttacaatgattgagtattattgtattgaaaataaatttttgacaaattataattaaaaaaacaaataaattctttaatttaaaaataaaaaataattaattttaaattaatacatttatttaccaaaattatttacttcaaattaaaaaattttatttattattaataaaagaaatctattttttattaataaaaacattgaaaataatgaaaaaatgcacagaaaaataatgttacaccgcccggattcgaacttcccctcccccctcctcaaaatgatgcctcagaatccccaatcacacagggattctgaggtcttaacgatgtcaaaagtaaaatgtgatcacgtattcgtgatcagcgtcataaactacccctaaagacatgtttttggaagatttttgtcgaaaaaattttttcactcaaaaaccatgtgcacccccctttggtcccgaaaccaaaaatcacttttatttttataacaattcgcaaaaaagagataaaaatgtaaaataaaatttatattatagagaaaaaaaattgcggatttttgtagtatattacttttacagaatgacttttcagaagggagttatgaatttttttctgaaaaatcgaaaattttcagaaattctggaataactttttttctttttaagatagaaatcccaaataaatctcataaaattctcccgattttttgctatttttanagctttattgtatgaaaattgaccctctctgaggtgagttatgaatttccaatattcgcccnaaatccgaggncaaaaattgaaaaatatttttgaattttaaaaa

SEQ ID NO: 2703 - DNA, 1509 bp, Heterodera glycines
aaaaaattgcggattttgttattatattacttttcaagaaggcttttcagaagggagtttataatttttttctgaaaaatggaaaatttcagaaattctggatacacttttttcctttttaagatagaaatttcaaataaagtccataaaattctcctgatttttacctatttttacaaatataatagcatgaaaattgatccacccttcgatttgttatgaattttcgaaaattaacccaaaatcccgaaggccaaaaaattgacgaattttcaaaaattttggaaaaattccaaaaaatctgaaacgaaaaacaaaggtcatattcgtgctcagcacctcaaaataccccagaaaaaaaattttcacccccattttcgtccgaaaaaaaatttccgaaaatttctagggggcctagctcgaaaatttttgaaaattttacatcatgtagtacaccgttcgatagcatttaaaatgctctacaaaaatgttctaagacaatttttcgctaaaatcaacccctgacgagttatgggcccaggactcaaatgtcccgctcaggccaaaatttttttctatttccgggaaaaaaccgaaatttttccaaaaaaattaccagtcgatagaactcgaaaaatgatgttttggaagttgtctccgtttttcccagaaaaatcgttaaaaaatcataaaattcaaaaaccaaaaaaacgttttttaggcctaactcgaaaatttttgaaaattttcgaaattttaaaatttggaaaaatcaagctcattatgctctacaataagtccgctggccaccctgcgctcaggtcaaagcctaatgagttattcaacggggactgaactggacaaatttggtactgaatttttgtagaagcacacaggccatggggttagagatagaggcctggaattttttttaacttttagccaacacttcaacttagggccctcacagcgggaattttttgatccgagttttagaaaaaaagttacgggccctgaactgcaagaaaaagtgagaaatcggtccccgggactcagtcgtccgcgcagaatttttctctatatttttcccggatgcgccgtgaaaagttgtaagaccaatgcacaactttcaaacccgtcccgttagccattcccgagaaatcggttttaaggatgaaaccccttgtcaatataacgtatatactagccggtgtgtgcttatatgtttcttgggtgcttaaagcgcttcgcgctttgggagcttcgctacctaggccttgtgttagggtctttgcgtcagccgacatgcacttggtttcaccttgacacactgcatttttcaatgcaatggaaaccggaagtgccctaactcgcacgtcattggcccacctgcctccttcagtccagctggcagcacttttttgaatatgtgtccgttttaagtgcagatgagaacggagtgacatcaaaaagtgcgcacgcgctggacctaactcgtttgctttattg

SEQ ID NO: 2704 - DNA, 1880 bp, Heterodera glycines
  misc_feature (34)..(34): n is a, c, g, or t
  misc_feature (92)..(92): n is a, c, g, or t
attttgaatttttcctcagtaaaacaaaaatttnagctttcacggtgaaaaaaaaaaacggaaatcccatccctgctgctgaaggcaggggnagagaaccttttcagctgggaacactgatcctagagcacattttttgaaaaatatatattcctgactaattcccgaaaaaatggggcattttaatcatgaaactcgatctgctaatggttacagtttccgacttttgctgattggctatgagcctgggtttttcaaaaattccagattcttctacgaggatttgaaatcccagtaatttttcatttcatatttcgcctcacttactttttaatgaattttccccaatttttggaaccatttaatgatcaaaattttccataaaaaaattactttgcacataaaaaaagaaaatccatcccgactcccactaggcttgaatttttctagaaaatttcagaaaatgaacccgacctactaggcctaaaatttttcgaaaatccaaatcctacgccgattttaaatcccagcctttgattgcttttcgttttttcagttttcatttctcatcaagctaaaatatgtatgcctttgatcagtgatgagtgagtgaactttgatcaatcctttatctccccctaatctccacgtacatttctattttacacactcacacattttgtcatatctcttcgtcgtatgttccaatcggtcgattgctgctgctctgatcgcctccaaatgttctcccccccccctccactctttggcggtttcaaatttcgccgctttcgcgtcaaacctttggcgttttgtcgtttgtggtggcatcaatcacttttctatttttatatgtatatgaatgttatgccagggattaaatgtgtgcaatgaacatatgtgtacattcttttgccttacgacaaattgggtaaattccaaacaaatttaaaaggtaaatttttaattttttatgaggtacaaagtgcagtcatcaattatcgactaatgaccccttttagcgatcgtttctttattggcaaaatgtccctaatacaccgagattttaacccctgggctcaaggcttgccctgtgcccccgagagttgagacgacctaaaccgagacttgacacctgaaaaacttaaactgagactgacccctcatttaaatgagaccagacctgataatctcgagaccaaaatggggagtttaatcgcccgaaaaatcaaaagctactcgagactaaccccctcccccgaaagtcgagaccaaaaccgagacttggctcctgctgaaacttgagactgcgactccaaaaaaaccaagtttctcattagatgaaaccgagactttaagcattattactagccttttttttgtttttgctaatgtacaatgacaaaccattttatctcatcggctaaaaatatttttgtaaattgcccaataatctttggcctttttattcaaaggttgagacatcttttttcagtctgctggcttttgttgtgtaaattgaacaaatgtgagatgattggacacggaaaacattcaaatgaattcacatttctttacacataaaatgagcaatttaaatttattttcatcgcttaaaaaatattatttttttttggaatttttagggcggtcgctaagaaaaatttacataaaaaaatttacattagtgatgacaggccgagaaaatcttggcgatattgcctggaatgatgcagttaattgagttcttaatgataggtagaatattatgactgaataagcctcaaatttaaatatttgaaattttaattttaaaattattttgttgaaattctaaaaagaaattatatttttttgttaaaaatctatttatacaattt

SEQ ID NO: 2705 - DNA, 1763 bp, Heterodera glycines
  misc_feature (65)..(65): n is a, c, g, or t
ttatttttagaatttttggcacttttacatagttttttatgatttttgactggcgcgcagcttgngcactttcaattcctttggcactttgttttttaccatttactttttcttggcatttcattttaccatctttctcgacattttggcactcgcaattcctttggcactttgatttttgcctatttcatgtttgttatattttgaatatataaaacatttgattttacaattttggttagctgattttggcactctcatcaatttccattggcactttgtaggtgccagttacctttatatttattatcattccattttgttaaattcttttggttttggcacttttatttttcctttttaaaaaatgttaaatttatatcctgttttggcatttttatcattttatataattaaattcacaaaaatgcgttccaatttaaattttatttccaatttcttttttacccaacacaaaaaaaaatctcatcacaaaaagtgccgaacacggaagcaaaatttggcatccattttaaggcttcttctcttccatgaaaatgttatgccctcagaggcgaaggcattacttgcatttcaaatgcttctcgaccgaaggaatttagtctcgagactcaatttaataaatggtttttttttaatcaggatttagaatttatttttgggattaagattagctggcggatttttggcctgggatatgtatcagttgggttgagtttttgcctatagaaagctatgataaaatactaaaaatttcgaaaaaatgtaaaaacctaatagccacttaagggaatatttgtgtaattttttttaaaacattttttccccaaaatttcaaaaatttaatttatggaatttatgttaaggcatttaattaaattttgaaatttaatgcatcgggactctcgagaatcgtgctgataaataaatgtcgaatgatacttatttgtctcgagaagcattagactctcgagaacagagctattacagaaaatccgttttacctgccatgttttgaaaaataaaattatttttaaaatcataaattaacaataattattttttcttttctctttttaaatttattctcacccccgccggggttaatgttgtgttattcttcccatcgcattggtctcacccattgatctgccgggagataataatatcacataatacgtattataattgatcttttattacttattttgctgtttcaacgccgggggtaaatttattttatttttaaattatttttatataattaaaattatttttatataattaaatctaattagcgtcgctaattcctaatcagctaatcactattatcacttaatttgtttgctctcacaaatcagcgggggatgaaatgatttggcatatcgttctttgtttatccgtctggagtaattacactaataatgaaacatttcaattaccctaattaatctataattaaccctcatcatcattaaatttatttgagggatcatttgtcactgcttttttgttcgtctccgtcaccctttttagtcactaactttaatagtcccgctaacctctcattaatttgtttgtttgcacggcgaacggataattttgcccatttgtgttcgttcgccgccccgcccctttttcatctctaatatatatttttaattcctttttgtttctccatccggtataattacatataatacacaattaagtttaattaatatttaatgccccccccctaa

SEQ ID NO: 2706 - DNA, 4004 bp, Heterodera glycines
attttgcttttgcctcttttgtgttccgttcgttcgccgccgccgcccctttttcgtcccccgaggggccatccatcgattggctttctttctcggtttttcttcttttctctcttcacacatccgtccccgaccctttttctctcttctttctctctcttctgctgctgcagggggcaaaaaaaaatgatgaagaaaaaaaaacaaaatatattttgtttatgctcttttcgcgaaacacatttttgaggctgcaaattcagcgcgggacaaattgaggcctaggaaaatatttcaaaattttgatttttttttttttgtacaaggccaaagaattttgaaataatttggccaattcaataagtgatgaattgaggcctagcaaaatatttcaaaattttgatttttttttctttgtacaaggccaaagaatcttcaaaaatttggccaatttagcgctggacaaattgaggcctatggcaatttaaaaatttcatttttctttaatttaaatacacactaattgcaactgaagaatcttgactaatttgtggccaattctgtgcaattgtggcctaggaaattcattttttttaaattccaaaattgaggtctaattttaaattacctttctgtttgtttgtgagcagaaaatgtttgtttgttttctttgcccctgcggtggaacagcgaacactttgccatttcagcgcgcctaggctaattgatgctcagggaatttcaaatgcttgttttcataattagcctcattccaaattcctaacaatgttttcccaatgaaaagaggccaaaacaaaacaaaaaatctctgttggatatataaaattgccctcattaaactgctgctggcaaaagagtcacgagtcgcgaaaaattcaaaaaaaatttttctaggaattatttttggaatgcccttaagtttttgtcgttgaatgaatgacttggaatgtgtttttcttgcaaattatgtaattgattccttttttctatatttatgtgtatatatttgtataatcccattttttcaaggactgtccttgcaattttcggcgctttccgcggatgttctttaaaaggataaaaatcaagaaaatatttttcgcattttttaaccacgtttaaaaattacctttattgttctgctggaatataagcacccacttttcaagtacatttctcaaggactgaccttgccatttttatagcagcattcccagcgcaatacgatttgtttttgttcattttcaaaatgattgtcgtccacctttatctcccaacccccgccggccaaagagccaaaaattagcatcgaatttgcattttacacccatttttttttaaaattttctctgctttctcaacccacgccttccttctctgcctaccgtccgccggtggaaaaagccgcccgcccacgccaataaaaaattagcattaaatttcaatttttacgccgcccattttaacaccactcccccccccaagacattccgcctctaatgggcgttggatttcaaataaatttgatttatatagttaaacccccacctgctttaaccccacacatataattagcgctaaattttcattattcaattctgaaatttatcatttttctagttctccgattctcgcttttttaatttaattcattttttgatttttaaaattttgatttttttttcagatttcttagctcgctttgttcagaaaagggttttcaatttttttatcatttttttttaaattcataagttttccgattttcttacctcgccaattttacaaaaaaataataaacaaaacaaaacccattcccttatttcgtaattacgccttttaaattcactaattttcaccatctcattcagcaaacatattatattgactttatttaattgtccccggggtcatggcagttcgtacaatgggactttcatacaatgttccaattgcggatttcgtacaaaaaaaaaatatatattaaagtcgattttttctttaaaaactcttttaactacttgtttttattgcaatttttgtgaatgtttgattaacacaataaattgtatttcctttcttaaaagcaagtatttaagttatgaaatcattgtcgaaaactttcattggccactttcagttgaagtgagcaaatcctccgaaaaagcccgaatgaattattattgtttacgtattaatattgttatttttggtacccattagtttcattacttttttataatttgctttatttttgtcattttgatgaaaagtatgtgtcgctgtcactatcacttattttttaaaatttaatattgtacgaaacgtcaaattgaaacgttgtacgaaaccccattgtacgaactgcccattgtacgaactgcccattgtacgaaccgcctattgtacgaactgcccattgtacgaaccgcctattgtacgaactgccattgtacgaactgctattgacccaattgtccctcccaccttcacaatctcccaagcatttttccaaaatttcaaaatccattaatccctcatccattaatttgcaaatcttttattttctcccatttctcactttgcgttttcttcatttaataatttatttttgattctcatcttcctttttaaattcataatttctccgtttttcgtactttcagcctccaaaataatttttgtaaaaaatttcctcaagcatttgtaaatctttcaaattttcacaatttccgaacgccctctcccctcaaattttcaccgatttcttaactccccctggccccatctctcccccaattttctgcattaatattattatccaatttgtcatcatcattatactaattacccccggattaccccacccaccattaattacaccaccacccccacccacccaccacatgtgaccggggccggccggtgaacgtacccaacgcctcctcctctccaaaacggcccaacaaagctgagcaaacacaataaaataaaatttgtcccccaaggggtggggggcgtggtcgttggcgttttggttttgtgtttggcgaaatatccaatggcaaaaaaaaaattttttttgtgcgttggacggatgacgtaggaaaacgggggcagaggagcggacagagaagaaaaattaggaattccatacattttattgagtattataaagtgtgtttgttcactctactataacatatgatgttgacaaaattgaaaaagttttggaaaacttttatttttttacgaaaattttatattttcttatttttaaccctagttttgtatgaatcattttttcattttcctttttttaattttatataacgattcccactttttacccattttaattctttaatttaatattttaatttatgtagtgactccaacttcacccatttttataaaatatttttattacctaattaaattacatttttaatttaattttcgctttcattttttcacattttcaaaataaaagttcatcttgtgaaaaatcacatgctttttttcaaattagcatcttcatttttgacatttacacctacgtaagaaaaggattaacaccccgggcgcgatgcgcaaagtaattagtgcgatttgtcaataagcggcgcgacggcattcatctctttttttcaaatgttgtactctgtcttggcattctgtgctttaagcccctttttagggacccacgcgtttcggcgctcccgtttcggcgctcgcgtttcggcgctcccgtttcggcgctcgcgtttcggcgccagctcgtttttccacttaagcttttttctttggcatccaaatccaacaatcttggtatcattcgaaagctcttaacatgctctattagccttatcaaaaacgaaaagtttttcaagcctgtaaaaattttattaagaaaaaacttcaaaaatttcgacttttcgcaattttcaatgtataactgttttgataattgtctaatcgca

SEQ ID NO: 2707 - DNA, 1715 bp, Heterodera glycines
ttcgcaattttcaatgtataactgttttgataattgtctaatcgcaaagcaatagcttagaaaaagcttctaaatagattaagctttcgaacgacaccaacaatgttggatttggtttacaaagaaaaaagttatagccaaaaacatgctggcgccgaaacgggagcgccgaaacgcagtggacccccattttattatttgacatagatcaggttttttaaaaaaaggaaaattattgaaattcattttaactatttaataaaattgattgactaagaaaatggatgtatttttgggttaaattttgaaaaaaaaaacttaggaaattggtggccagccgatgagcgctgccggaaagatatctatctatccgagaaaacagagttagccgacatttgagtcgtgacgcttgaggcacagactattgcggcgctgatatttgcagcgcccacttttcaggcgcccacttttgcggcgcccagttataagcgacatttgcggcgccacacacgcggcgccgacatttgagtcgtgacgttaaggcgccgactattgcggcgccgacactcgcggtgccgacatttgagtcgtgacgcttgaggcgcagactattgcggcgccgacactcgcggtgccgacatttgagtcgtgacgcttgaggcacagactatgtattgcggcgcggctgggcggtaaaaaaacgcgtgatttttcggtgatgcaacatttgcggggatggtgccgcaaatttcggcacagatttaaaaagttctttttaatctgtttttatttgtttaaaactaattttcaatttttaattattaaaatacaaaaatagcgaaaaataaaattgttctttttgcagaatacaaaaacaaaaatttcttttgccattatggccaatccttcaaaaaatattgccatgctgcgcgaagcgcgctcctccccgtacattggcggcggcggaagcggcggcactttgccacctgacgcgctgcctgtttcaggcccgatgcacacgcgcctgcaacgcaatcgtcgaccggattcggccaccgcgccctacactgcacgactgcagaacgctgcaagcgctgaacattttgagcaggtgggggagaattgctaaatggttgggtgaacaatttggggagggggggggcaaatgatcaaccaaacttgaacaaatgatcaccccgaatgttgtaatttatcacccaaataaggcaactgatcacacacaggggacgattgaccaattaatctccaaaaaatggaggacaaatggccccaaatggaacaaatgagcacccgaagttgggcaacgggacacatgatcactccaaagtggtgtaattcatcacccaaacagtgcaaccgatcacccgcaagggataattgatcaatttttattgatcaagctcggagagttttattttcagttgaaggaactcatccagttcagcgctggctcgtcctcttcaacctctctgattgctgctggacgccattttggcactgaacaatccattgaaaattatggtaaacattttatttgaaaaatctttttaccgtatccctacaatactgtactctcccctcacaaaatttgagccccaacccctcctaaattagccacaatttcgagctcaggaactactttttccccggatcccgacagtaaccccattcccgaacccaatattcgggaacat

SEQ ID NO: 2708 - DNA, 2867 bp, Heterodera glycines
tggggggggggggggggtgacgggggcggggtccgaatcctagtattgaggaatcagtgtgtgttaccacaaaaaaaggaaggtcggattgtttgagggggacagccccctggaaaaccagggatttttttggtggaaatcgcaatgccaggcttaatccacatggcttagctggtatggaccagggatgtatcggcatgccgatttccgaatttagttggccgtcggaattattgccgaaatttttttgatggcgtcaggatgccgatgtctgattgctgaaaaattttctgggtcgtcggaattgcgatttccgaaattttttgagggcgtcgacacacatccctgttattaatgggaaacaaaaatctccttagtttctggcgcctattggcaaaatccaacacctagttcgcgggatttaaattaaaattatcgattattaattagatttccgagaaatttttgaattcctttctaattaaaaaaaatttccattttaaggattttattttttgaatttcttaaacaattcatagaaaaatgctgttctgtggagctgtcgccggcaaaagtgatgattccgccgtcgcgcttggcgcgtacaaaggtcgccggaaaaaaaatccccaaaaattttaaaatttaccgaaaattttttcaggaaatgcccaatatcatggacattgatgacaacgaatacatttcttgaaggactttgaattaatttattttgttggagcaattttttaggcggatcgttcgcggatttattgaggctcaacggacggacaaacgaaaaatccgttttttaaaataaaaataaaatttatttttttcaattatttatactagagtagagcgggaccgggaccaaaacacggacaactgagtacaactgagtaccgaggtcccggttttgaccgggacgggaccagtcccgggttttttcccggttttcccagccaaaaattcccggtttttcaccccgaaaaggtcccggtcccgggtttgcccaaaattcccggtcccgctctactctaatttatacacttacacatataacctatttttgtgttctatatttgtgtcacatcgtatgaataaatataaggcaaacaattttggataggtaatatttgggtacgctaacgtgaaaatcccgatatcccgattgaaaatccaggtcctctcgtttcggctttctgatcccggcaagtcccagtctcggttttttaagctgctcgttacaagcctatttttattatcctattaattattttcaaagaatttagctaagtttcttaccatggggttctattttttttctattttttaataatccatttttaagagaaatatttaaaaataaattaaaaatgtaatcatttgtttttgtgtaattcaataattgccaacctgctaatggtgtcatacaacactcggatatgcgtaaaatgtataatataggaagtaaaaaattgattaatattatcaattattattattattataaaaaagtagaaactgtcagaataaaaggcaactctcaaatacgactttgatcatcatttttttttgggttttatttctttttatttacaataaaaattctaaattaattttcaatctttctatttttcattgcattttttaaataataatacatacattttaaaaaagtcacgggaacaatattcgaaaattcattcatctttggttgctttttaaaaatatggcctcctatctgtaaaattgtcgagagtattttaaaatatatattttttgtcatttctttttagataaacaaaaaatgtatgccaattttccgggcacttgccgtgccgcttcatcatcattttcggcacaccgccttcgtctgctgctgattgtggtgatttttgttgtgctatcagtggtagctgatgttgcccatgcgatgggaagtatgttctcaaaaaatcaatccgacgtgatgatcggaagagatttatccgatgtggtgatcgggcacgctatgtggcaactttgtatgaaccaatgcggaaaacacaatgccaatttggctctgtgcgaagcgggcttcggctttattataaacaggaagatatgcagatgcaaaatactggaggaaaaatgcgttccattttcatttggtgaaccattgccggatgtaccagtggatgatgacgatgaatatatcaattgttttcgcaactcataaaaaggaattgtggttgttgcatttattattgctttatttagatagaaatatatatttgctatccgttcattaaaatgtagaataaaaaaaaaattaatttttatttttggatttagatttgtcaattttcatcaaatcacataccgtatttcctgaaatataactcccgggggttctatttttcaacccccctcaaaaggggggctataattcaaggtgggtactaattcagaggggggggggggggtatattacagaaatacggtatttcatttcatgtaattctataaaatcaaatcaagataacacatactatttttgaaacaattttgtgcttgcttgttaattctattgtagacaaaaattgtagccattgaatttacaacaaaaatcgaaaataattattttttcataatttttaaaatttactgtcaaaatcaaccattgtcgacagaagaaacactgtcgaaaactttaacaacactatttgttagcctaagttgactaagccccgccatcccttggttgaatttttagctttttatttttaaaaattctaaaaaaaatttctcccggaaattcgcgggacaatttacccaaattaccagaaaattcatttagtatttttatttgatgaagctct

SEQ ID NO: 2709 - DNA, 1021 bp, Heterodera glycines
cgacaacgccgggcggcacacgcggcccggccgtttccttttgtctggactttcgtccacaaagccatccgcgcatgtgcagttgtagccctgtaattttgcatgcgtgtgccgttgaatttaaaaaaaaaattgccatgtttctcgaaatttttttaaccccatgccgacttcgtccgtgtcctgacagttggcgttcggcgaacagtcgctcagcccctgcacgttacactcgttgacgcgcaacagacagcgccggcccggccgcttggccgagtccggcgacacgtccaaatggttgggcggacacgcgcacgtgtacgagtcctccgtgtcggtgcacagtgcgcccggaaaacagtcgttctggccggacgcacactcgtcgatcagccgcttgcagttgcggcccggccgattctttcggtccagcgacacgtcaaggaagttggccgcacagcgacacgtgtacgaatctgtaagacagttaagccattctcggatttctatgatcacttcgtcattcctgaatatatcccatcccttcccaaagcgcttcaattctccaatttttgtgttatttgaagccgattacagtcgagcaagatgctaatgtcgtccacaggcactcaccgggtgtgtcctcgcaaattccgccgtctcgcgcacagtcgtgcgacccctttacgcattcgttctccaacgatttgcacaaccggcccggctttatcgtgatgtttggcgaaatgtccaggaagccttggcgacaccggcacatgtagccttcgtcagtgtcggtgcaaatggcgcggtcgggcgaatcgcaatcgttcagtgtcgggttgtcgcactcggggatcactgacggcggaagggagaaggtggatattagcaggaccgttggtcactgatcggataaattgagacccatattccccgaatgatcaaaccaagaagggagattattggcaggaccgttggtcactgatcagataaatgagatccccatattccccaaaat

SEQ ID NO: 2710 - DNA, 2115 bp, Heterodera glycines
tcctcgcaaattgcgtccggcgagcagcgatgttggcccagcgcacattcgttgacctcggccacacagaggcgccccggcttgttcattgggtccggcgattggtccaaaaagccctgagggcatgcgcaaatgtaccttaattgacgcgtaatgaatgggcatcattttgcgagactctcgaaaaagtaaactctgatgcaaatactcacgattcatctgtgtcaatgcattttgctgatcggtcacaatcgttttctcgtttgtccaagcattcgttgcgcactaagaaatatgttttttagaaaaaaattcttttttttttgaaaaatttctaatttaaaaattaaaaaaaaatttaaagggaaaagtcgctgggtaaatgaagtgcatatcttatacatatgagcttagtttagctcaaatttgcaatgttgtgattgccaaaaaatcaaatccaaaaggcacgccacgcgtcgtacaaaacattgaaaacttacggcatatttccgtcgctgggtgccgcttctcgccatgcaagcattggcacgcgtggaactggccggtcgagtgcagcaaacacttctcacgcttgcgcacatcgcacggctgctcctccgctgggtcgcacgagccgggcaccgcgcatttgccggtccgcgggttcggcacagtgccggccgcacatggcgggaatttgccgccgttgccggcgctgttgttggtgccgccaccggcggtcgattgagtggacacgtggtgctgttggggtgccggtttctgattggtgccaccgctgacaaaagttgtgccaaagttggcattggtcgaggagttcgagaagttcgactgctgttgttgatgttgttggttttgtcgttgttggacactgctcaaacagatgcccagttggtggtcacggctgtgctgcgcggggcacacgcaacggaaattgcctgaaagattttattttttatttctggtatttttcaagattttacgcagcgggagaaaattgcatttttagcagatttaataatgtatctacaatatcaattttaatggttaaaattttgggagtgcattatgctttctcccttatcgtttctatcgtttctgcccaaccagaaagaaaattccaaaaaaaaagataacactttcagctattttttggaaaatttttttgaaatacttattgtttaataattcatgaaaaatttgaaaaatcactagaataggaatgtatttttttcaaattttcatataaaaattttcgaagattttttggaaaaacttctgtttgaaaattttaaagaaatcggggggaggggggggggggataagctgctcccaactccatttttttaatcaaattttcttaaaaaataaatattcatttcattagggaaaacaattgttctcccttctgaattgtttttgatcattcatcattaattaatttttttgatttgcccttttgggtgtgccatacggtaatcatcccaatacagtagtaacaaattgttacgctcgcgtactgaatggcgtcttggcgcacagttcgggatgcgggcatgaggttggcaattccgggttgcacaggtcgccgccgcagacgccggtctgcggatggcgtgcgaatgggcccggacagcggcaggtcggcttgccgttgaccaactcgcagtgctcgttacgcgtccggtcacagccgatctgcgactgcacggaacaaccgccgggcgaagggggcggacgcggcggctgcgggcaggtcagcttttggacaatggaacgcagtcgcatgtccaaatcctatgcgaatcagtgggattggatgtgtctcgcgacagtggcttagtggaaaagctgtccatggaacgggtggaggcgcgggttcgacccccacctgacgccaaacatctttcccatcgcttttgcttggatttggccacaaaaaattgccttgaagcggtccacgtagaaccagcgttgcgcggagtcggaaattgcctccagctcggatgccaacacgtgatcagtgactccgatcgagaacatgttgacgcgcatgtgccgcgccgccttaagcgtctcctgcacattgtcctgact

SEQ ID NO: 2711 - DNA, 2050 bp, Heterodera glycines
  misc_feature (59)..(59): n is a, c, g, or t
  misc_feature (128)..(128): n is a, c, g, or t
gatggcggcacccgtcctaatttatagacagggagagataattttggcacgggattttntaggtcggaggggagatttaggcataagacattctgaaacgagatttttgaataaaaaaattctctcgntattatgactcgggaatttccgatttttttagtcccgacccccaacctcaatacaggagctctcgtcctgcgtaaagttcggataccatttcgaactccctgatctattcctgtcctatactctgggattttgggtcaatcctactgatctgggcctaatcaatcgattgcctttaatctgtataaagagtttctgtagacaccgccttcttccgctacctggtcaatccggtcaagtactgtgtttgcgcgatggcctgcagcagtgacggtttgtccacgtactggttgaggtcaaattcgtgccggatttggtccgagtattggatcagcccaacgcgggtgttctccagaccgatatcgaacagttccacaaagtcgcgcacaaatcgaaggacctatttttgctcggtatttgctctattctcgcattatatttgaccagtggcacctaagtttagtttttctgatcagtagtaattaattagtcattattcgatcaatgccaataaattttcacataaattatgttcgacgtttcattcttttatccactttgtgacaaaattatgggtaaaaaatgatcagacaaattgctccgatcagttataaatatagctgatcaaatgaatcccatgaaacggacctcgttgcggaacacggccgacccaatggagccggatccgtcgatgaggaacatcaggtcagtcttctgtttggggcacgtggtcacaaccgtacacactcggcccggcggcaaattggcgctggaggacacgtccacgtagccggggatgcatttgcagctgtagccggccggcgtgtccacacagtcggcattctcatcgcacgtattcagcgaccgatcagtgcattcgttgctcgctgattggggggatgtggacacgtgccaactccgagacggccatcccagcccatttaattatatggttaagcccattttggccacacccatccgaatgccatttttttatttatggcggtggtgattggaagttatggctttccattaccaaaagcgtcaattaaacttttttttaaattaccgtttgaacattttctgcccggcagcaattcgtactgcgacgacgaatcgacaaagccatcacgacaaacacacgcgtagccatcctgtggaaaatacataccggatgtaattgcccgtaatcagattttgccaatttgtccaatcacttgccaaaatgcgaatgccaatgtctgtctgtttgatcgcttaccgttgcatcaacacattcggcaaatggcgaacagtcgtgcgaatcggttgcgcattcgttgatcactgcaaattttagtaaaatatgtaataattcatcaagaatttcaacgatcattaaaaacgcacattctttgcacgctcggccaggctttgtctccgggtcgggcgacatgtcccaatagccgggtttgcattggcaccggaacgagtcgaacacgttgacgcaaatggcatctgacaaatttaaggtgattagtaaaataggtgcctatttaatcgggtgcttatatccccccccccccccccaaagaattctttttaaaattttctaactaaatttaatcatagaaaatatttataattttttttaggaattatttcaagatttgtgatgaaatactaagtcttttctaaaaaatcttttcaaaaattgctgaatcaacaaaattattttttttaattcttataatttttaacattccaagtttgaaaacttaaaaaaaaatcgttggctggaacgaactgctcccatttaaatcgatcttgtccgatcagtagctgagggtcataggcctcagaataataatagttcactggtctaattggtcaatcaataccaacaattaatgaatctttagttaattagtgtttgctacagtgt

SEQ ID NO: 2712 - DNA, 3794 bp, Heterodera glycines
ttgtcgcattcgcgctgacgcatgccgtcgccaggcgacaggtgccgtccgtgtacaggaattggccctcgggacatgcgcacacgaaagtgcccggttgcattcggtcggtgcactgtaagccgcctttgcacgccgacgctttcagtttggggtcgcacgtgtcgtgcgcgaactcgaaggcggacgacgcgctgccgcccgacaaattgcgatcggatttgatgcacacgcggcctgggtactgaaaatgccaaccccaagttttgagtctatgatggtttttggcaaaatgccaaattttgtgcttgcttttgcagtcaatttggaaaccgagagaatggtcatattttgggttgtatatatttaattttggttcgggttcgaacttcgactctctgactgttctcgatggcaaaacgtcaatcctcgagttccggactaagaatcttcgacttacgaggtttcggtttcgggatgaccccaatttctcggctcctcataatgggtaaatgtcggagtctcaaaaaaacgagctcgacattgttgcttttcatttctaatttttggcttcattctcataaaaaatcttagtcgattactcacttttccggcattttccgaagcatccaagaagccggcccggcatttacacgtatacccctccttggagtcctcgcactgcgcattatcggaacagtcattcaacttccggtccagacactcattgaccgcctccacacagcgacggcccggcaatttgttgaactgctcggaaatgtcggcaaagccgggccgacaacggcacgagaaggactcctccgtgtcaatgcaaatcttgggaatcattaaacagatcagttcgagaaactaatttatcaatgccatttttaaaaactccgatcaagtccaaaatccgacagattaaatcaacaaattgataatattggccaaacaattggatttccaaaattttaccctcaaaagataatcaaatttcatgttcaaaataatttttgaacacttaccgcattcgcgtcacagtccacgtcaaaagcctgaggttgagcacattcgttgatgcgttgtcggcacaatgtgcccggtttgccctgcggcgagatgtcggcgaagccgcttttgcacttgcatgtgtatgcttcggccttaattggacaaaaatagttgtaaagtgatcaaaagtaattagtgtcctaagctaagaccaatccatgatcagcagttgataatttgaaaaatcgaattttatatacatagccaaatcaattttaaatggaccgaaatctgaacagatcagcagttattttattagttcatttttaatcaaattttgatggttctagtacagatcattgagtcatttcctatgatttattgccaatttgctcatcagtcaattaatgattgaattttccgattagccccccccccccaatgggtgagcattttcagtgtgtgtgccgttgctgatcacctgatcaatgcattccgcgtcctctgaacactcgttgagtcgtgcgtcttcacattcgttgatggccaagcagcgtccgtccggcaggcgcccgtagcccatgggacatgagcagtgataagagccgctgatgaacaaacacgccttgatttgataaagcatttttggcaaaccaaacaatcaaaatcccctaactgaagtcacgcttactaaatcatccgatcattgaaaatcttttttataatctgctgaatacactttaatccttttttatgcttttggtcatctaagtgtccaaactctgggttttaccatcctgatcattttaaatcatccactagtaattgttgatcaatcaatcattctttcccatttaaagtcatgctaatcatttcatcacttttccattatttatcattcatgccatttctgcacactgtttatcacctcgtgttttcccttgtcacaactcatcgggtcgttcacgtcgcattccggcgagtcgggcacttccgctgaattaaattatgaaactaaatttctccataatcttgccgctgtttaattagcgcctaattacttcgagtgcacacccttcccggcttctcccggcttggactgtcgtcgcgaaagcctctgaacagaaaatagtggggataaaacctgatcatttgttaattgggcgattttaaacataagcaattcaaattattggcctcaaattctcgaaaagcttaaattttactctttgcagcgacatgtgaatgcgtcagcggtgtcaatgcaattggcgtcccgtgaacaatcgctaaattcaaatacataattatcaaccgaatagaaaaataacgtaaatttggactaattttcgaattaaataatttaatcaattgtgccatgccgacaggcggattattattttttctttcggtgggggatatgctctccccgcgccccttggatacggtcctgggtcgatcagttacttcgatcaaaatcttaaatgggataaactgactgttttccggcattgcattcgttttgaattaatcggcacactttgcccgggcccttcccgtgttgtgccgaaacatccaagaaaccggccaaacaccgacacactgggccctgcggcccttcgttgcattccgcctccggcgcacagttcgcatttcggcactgctcaccttagtggagttgagacggtgatgatgtgataagcagcaaagcatggatcggtatggaaacaagctttcatcaatccaattacaatctttgtttagaaattgaataattgttgaaaatcccataaaatttttcaatttttcaaaagattgaattaaaaaattgtaaaaaaaaaatcaaattttgtttaattttgtccttttggaccataatgactagggattggatttttaggcaaatgcctaaatttttgtgtgcaaatgtaacggtgagaaaagcataaaaaaataacacacttaatttgaggctttaggatcaattttacaatgcctaattgcctataaaatcctttaaaaatgcattaaataacgaaaaatacacccctaagaaatgacccgaaagtttcagaaaatacacccttaagaattgaaaaattccaaccaaaaattcattcctaaaataaattttttttttactgataaaaatttttgttttaaaaattgtccttatttgaaaaaaactttaaatatttaataatttgatgttcaaattaaattataacgaaagtaaagttttatattttttgctacctaaaaatttaaattaaaaaaatcttatttgcttattttagtgtctattcgtaggttttaatgcctattttgcaattttttgtgcctaaaaatcccatcactaataaatgatatttgtgctacagaaccttaaatttactgtataactgaatttggtgttcccgattttcaatcattaatttcttttgatcatttcgatcacccccccccgcagcggccccgtaagtgtgcagcattcattagaggcaattaatttcacaaaattggggcgacagttgggctaggcgctaaatagctaagtgcaggtcgaacaaggctatgacgtagtaacccagcgctaatctagggaagctatagccatacatttttatggcatttttgcgtgggcaaaacggattttatatatgaaaattatgaatttttccaaatttgatttgggcacaggggttaaacggaaatgaaaaaaataaatagcggatttttcgataaaacaaatttttctggggcattttgaccataatcaa

SEQ ID NO: 2713 - DNA, 1309 bp, Heterodera glycines
cccccccccccccctccgcccccatacatacttcgtcggcaacttcggcccgggaaatttgcctgaattcacataaccaattagtgattagtgaaattcttctgatcaaaatcaatgggctctaatcaatcactttgtcctcactgacgtccgtccatccggatttgcaccggcaggtgaacccttccgcggtgtccacacattccgcgttcgcgtcacaattgtgccgccccagcgcgcactcattttcttctgtgccggagagagaatttgtattatttttaaatttttaaattggaagggtcagtttttaaatttaatgaaaatttaaacgaatgaaacaataattattatttcaaaaatgatcatatgtaatggtgcgaaaagataatttatcatgagatgagtttatattcgagagcgagaatttgcaacaattcaaattatggcagcgaccccaaacaattctatgttgatttttgtagacttttaaactttaaataaaaaggaaagggtccattcaggatgaaaaataaaataattgttaaagaaaggagttactattattcaatgaaagaattttaagaaattcttacgatttataaaaccaacaaaatcgaatattataaaactcggtctttatttaaacttttaattaatgaattcattttttcttcataaacatttaaagaagagttaaaaatgattaaagccaaaatttaaaaaattgtcttaaataatttaaagcggaaaaagtttaaaagatattttaatgtaattttaattcttattttaaaatgtattaagcaaagcttcagaaaattccaataaaaaattattccatatatttttagtcacggaattaattttgaataaaaaaaattaaaaatgtttaatcaataaaagaatttaaaaaatcgaagcatcgttttggttgagcccgatttttaaaaatcatgaaaatttgttaaaattcggaaagaaaaaaattatttattaaattaatatgtaattttatttccacaattcattctcgagccgaaacaaacgaaaaagacacccgaaaggccccacttttctcgtacatttttatctcttatgcttcaattgttcaccccactcttctttgacctcatgctgatgaattaaattagcagtgatcatttgtccatttgtccgtcgtcgcccatttggtcaattccatgcccatttgttcaattccatgcccatttggtcaattccatgcccatttgttcaattccatgcccatttgttcaattccatgcccatttgttcaattccatgccca

SEQ ID NO: 2714 - DNA, 1839 bp, Heterodera glycines
aatcaacagtttttatatatttttttattttgttctcaataatttagaataatctggctttaagagaccaagacccaaaaacttgagactttttcaaaaaattttcttattctctaaaaatcgcttaaaaatcgcttaaaaagaacctattttagtcttttttatgattttttcaattaggaacattatcaatccaaaaatacacaaaacaaaatatttgtaaattttttctcttcgtaaattgaatttttcactgcagcattggtgcgactgtttgcttttattagaattttctacatatcttcaaataaaaaagttattactggggccgtgattttagtgaaaaaatatatttttttgctcaattgattaaagaaaggagttcaaaaaacgcatttctgcattaaaaattttcgattctgatgacatttttcgtcactagaaatcattattttggcgtttcttcactaaaatagtgaaaattcactttttttgacattttggcactatttttacactatttcaatttttttttttggaaaaaatttctcaataaaaatgcagtaaaaacgaaaaaaacacccctaattatcacttaagaaatttcagaaaaattcacccataaaaaactacacaaaaatttacaaaaaaaaaacacttctaagaaatgaaaaattttctcaaaaattcattttcttggcaagaatttttaattttaaaattatttttacgtacctttttggggtttttttcccttaaaaatcctagtctactcatttgcaactgcaattagggaatgaaaattatttttgatcaatttttgggcactttttgccactattttgtcattattttggcatttttactcactattttagttaattatttcgatatttttagttactaaaagcgcagccctaagaagtcggacacgcttcaccgaaaaatcgcatccccgcataaattttcttaaaatttaaaataaagaatatcaattttttaagattctgtggaagatggttcagcagttaaaacaggcgaggtttgagaaaatactggttttaatgagatttgataattgattacaaataaccttttgaaaaataggaaaataaatgaataaataaatgaaattcatagaatggtaaaatttgatcataaatttaaaatgagtgaataaaattgaattaaaaaaacaacacagcaaaacattattcattgaaaaatccggtcgcggcagcaatgagcacgcctaaaaaaatggaagaaaatgaaaaaaatgtttttcaattcatcaaatgctaaatgatttttatttttacccacccaaaacgactccaatcatttgaaccaaaagcacaaaaaatgctttattgccggacactttcatctgttcttttactttaacactcatttccggcaacatgctgacctaagaagagggggaggggaaaaatttaaaatgaattttattgtttaatgaacaagagactaaaacatttttataatcatgaattccggcctcaaaaatcccttggaatttgcgcttttttttgtctatataagcaaaaaatcatttaaacttcaagaaatagcacaataaaattcccgcttaaattgcggaatggtgaacttttagttttaaaattaattttaagaatttacagcagcagccataagtcttaagaaataataaaaaaaacaaacataccgaggggatgtaaatgaacctgaaaaagaaagcgggaaagtaaaaatagtaaaaaaacgtttttttatgggtgccagcatttggggtggaattgttcaaaattattatttcagaactcacattccgct

SEQ ID NO: 2715 - DNA, 3435 bp, Heterodera glycines
  misc_feature (755)..(755): n is a, c, g, or t
ttattttaatgggaaaacggtaaattcataatcataaactcttcaatattttaacaaaagaaaaaatcgatcgcttccaaaaccaatcaatcgccgtcaccgttgttgtcttcctcgtctctcttggcacgatatgacgttttgtatatcaaatctgtaaagttaaaatattaagaataaataaggatagagctaagggtacttatgtttttgttttgacaaaacccaattatactaaataataagtaagaataggaattatatgtaaaaaaatcatgaagttgaaaagctgattttttcagatgacttgaaactttgcaggaaagcatttaatatgtataagggctaacaatctaagaatttaatattcaaaatttttaacaatgaataattaaaaagaaagagtctcttttacaattttgcaggagattagcttatgctaacgattttccttgaaaattttagttaattctgacaacaacgaaatgaataaaaaaatcagattttttactaacaataagtgctttttatttacatataattttcccacgaaaataataagtctcaatcacaattaaagacatcgctgtccattttaagtacaaaaacctcaaattaggttgtttttaaagtgttatttaatgttttattttacaaaaaatagtcatttcattttttatggggatgggatttttgtgaatttgtaaaagttggatttacaagcgcaatgttttatttatgtttttgtttactanattctaaaatttgaagaatgaaaaaaaaatctgaaatatgcactgaaaatgatgttataaaatctcttggaaaaattctgacataacgcaccattttttgctgcggcggtactggtcgacggctgcattgggtccaagtcaatgttttcattgtgctgctgcgaacgcccatggcggatctgacatatttttaacattaaaaataaaagagaaaatatagaaatatttaaataaatatttgaatttagggacaggaacggaactaaataaactcatttagggttttcagagtcgagaaaaccatccatattgtgccaattcgaaccatgaacccggagccgaacaaagtcaaaaacatttttttgtttaccaaaatccaaatttattgcacataatcgctttaattttttaaacaattgactatggcatgaagggaataatcagtcacattgtattaagcattttagcgattttggtaaaaatgtgaattttggtgaaaaatgaattctcgacttttgaaatttgtacaaaaaatctggggtagatgacagacaagtaccaaaattttttaaggaaaaaattgaatttccaaattatataatttaattattgttctcagtgaaaatcttaataatcaacttcaatttaaatagtttttattgaatggactaaaaatttttgttcaaaaaataagtccgtaacaaattttcaccactgccgataaaaatggtaatttaggataaaatttttgctgaaaatttttcaattcaacatttccttggttatttttccagctttttaaactgttttacaaaaagaaaaatttttttttaaacttagagtaatcagcttttgatgaataacttggaaaatttgcttttacatttttactaatcaacttgtaataataaagtatcatgatttctataaaaaattaaaaaacttaagcactttttaaaaattttatttttgtttttaaggccacaaaatgtgcggattgcgatcaaagatacattttgtaaaatgattgattttgtctatgatttttcatcaagtccatgtgttaatatgaattttgaaaaaaaaaattggattttcctattactaacccaaaaaaaaatcaaacttgtaaaaaatttacaaaaatcaatgatatttaaaatgctaaccagctaaaataaatattaaaaatgtcgttttcccatttatttaaatcacctcttcatctgctgctggcttttcttcttcaacattttcaaagcgctgtgcaggcggttcaggttcttcgttttcgtcatcaaccttaaaatcacagcacatttgactagggtccaaaagtctatcattttttgatagcgtggaaaaaaaaattatgtcgttttactgactgaattaaaaaaaacaaagaaaatattaaaatttaaaaattgttttatttttaaatattccaaaatgcaaaaaaaaacagaaataacaacttagtggtggtctttaatgcattttaagaaaatatggaatttgttatccagaaacggggacgtccaaaaaggaattggtcgattatatttgccagaattaatgcccctcatatttttaatttactcaatgtaagcatgttattagactgacctcaggcatgcgccaaactgccagtgcgaaggcccaagctgctcctgcagcaattgccaaaattttaacggcatttccagtcgttgatgaagaagattttcgcttttcttcttcatcttcaaaacaatcgtccattttggcggcactcggagcgacattccactcaggcgctgtaaaattaaaaaatttttaactcaagtcttttaacaaaaattaattgtctttcctcttatttagagcatgaaaaatgtgggtaaaatttttttttttttttttgcgttttttttacctattttgaaattttttttgtcgttttaacccattaccggctgtttttgttgatgttgttggttgtggtgcctgcaacggttgaattggccgcgcaaaaacttaaaagcaaaaaattttctggagtaaaaattttccataacatttgtttacagccccccccccctttttcggtttttaccaaaaaaaggtggatgtggcggcaatgatgataaaagcccgaaggaaaaacattttcaaataaaaaattgggcttttaaaatgcttaaaaaagcaatgacaatttttacataaattgaaatggggcgaaaatggtaaaaagggatataaattgacttttttcaatgaaaataaattataagcgatgtaaatagcatattcagcatttataattacaaaagcatttaatttatttttgaataaatactaaaaagtttttcttatagaaaattccattttcgatttgtttttacattttatgtcaatattaaaaagaaatttttatttgttttttctccaaaaattttaaagaaattttgatacttttttgcaaattttcgaaaagctttcaagaggtcggtatttatgggtgcatttttaattgcattttgctaagaaattatataaaaatgcgaaaatagggattcgaagatttaaaaggagcgataagacgaagattttcgcgcatttctacttgaacgaaggcaggtggtggaaacagaaacataatgcatggggggaagtgcttttgtgacgtaatttg

SEQ ID NO: 2716 - DNA, 6481 bp, Heterodera glycines
atggtttcagattaattttattattttaactcattttattacaaaaagcgaattttttaaatcttgaatttttgttcgaattcaggtctggggttagaaataggacaaaataaatgccatattcgtgatcagcgaccacaaaaactcttagaagtatgttttcaaagtttttaaaagaaaaaattttctataaaaaaagggggtaccatcggtaatataaccataatattgattgggaatgcaaatagctcaacaaaattatccggttttcatgcaaataatattttaaaaattcattgaaaaaactcacagcttcctcctgttgttcgtccatctcattgcctgctgtttcttcgtcgtttttgcgcattttgagcgcaattttgatggcattggcagaaaaaaaggacacgtaaatggtggcgatgacgaaaagcgacagaccaaaattgggattgcaaatggaaaatgcctaaaaaggaaggcaaatgcattaatccatttacgtacataaaaagccaaattatttcaaaatttagagccataatttaaaggaaatttccccactcgggatgattctctcagggactcgattgatgtgactcataccttcctcgctcatctcttttcttgacttccaattcccgacttagcattaaccacttaattaattattctctccatttataaaattagtacaatttacagtagttttttctaagcttttttcatttatgaattccctctgttggtaagaagcacatccaaaaaggcaaaattcgttaggaaatttttagatttttttaaattaccaccccacccctccctccacaaagggtaggaaaatgatgccacacttttggcagcagatggaaggtggcggagccagacaaagaaccaagtgcaaaactgaacatgaagtcggagaaccgatggcgcaaacacttcttcagagcggaaataagcagtgcgagcactgaaaatgtttagaatacatagaaagactaatgatcggggcagtcaaaaatatgcacgaaaaatggccaaaatatgcatataaatatgcaaataaagtcgtgaaatatgcaccaaatatgcagaaagcgtgaaattaggggtgcaaattaataaaaaaaaaaattatccctataaattttatatgctgtttttgcaatgcaagtttaaaattctcaaggttttcggcagtaaagctcgctgttgacccactcgcgcacccattcaaatttgaatttagtttttggcataagctaattttttttgctaagggatttccaaatcggaaaatatttaatgaaaaatggcaaaatatgcaaaaaaattttaaatattataaaaaatgacaaatatgcatgaatagggattccatttttatgtaagaaaaatcgcgaaatatgtaaataaaatgtataaaaaattctaaaaatatgtacaaaaatccccaaatatgtactataatatgtaaataaaatttttttaatgattattttttggaaaaaaattcttggtagtgttaaataggcacaaaatgccataaaaatgatcaaaataggcttagaatcacattttttatatcaaaaattaatcactgagaagcaattttaaaaaacaatgacaactcaccagtgcttgtcagcgcaatgacatattggccgaacggaattggtggcacccaattgtccgttgtctcctgcagaacaataactggcacacttgtgccctcatcgtttgcggcaacaatgcgaaattcgtacatggttgtggtgcctgcaacggttgaattggccgcgcaaaaacttaaaagcaaaaaattttctggagtaaaaatttttccataacatttgtttacagccccccccccctttttcggtttttaccaaaaaaaggtggatgtggcggcaatgatgataaaagcccgaaggaaaaacattttcaaataaaaaattgggcttttaaaatgcttaaaaaagcaatgacaatttttacataaattgaaatggggcgaaaatggtaaaaagggatataaattgacttttttcaatgaaaataaattataagcgatgtaaatagcatattcagcatttataattacaaaagcatttaatttatttttgaataaatactaaaaagtttttcttatagaaaattccattttcgatttgtttttacattttatgtcaatattaaaaagaaatttttatttgttttttctccaaaaattttaaagaaattttgatacttttttccaaattttcgaaaagctttcaagaggtcggtatttatgggtgcatttttaattgcattttggtaagaaatatataaaaatgcgaaaatagggattcgaagatttaaaaggggcgataagacgaagattttcgcgcatttctacttgaacgaaggcaggtggtggaaacagaaacagaatgaatggggggaagtgcttttgtgagggaatttgtcggtatttatgcgcctttctctgcacttgcacagcagcagtacagtatgatgctcattttgaatggcgcgaaatttgaattacggaatgaagagcccattccagacaaattagcactcttaacaaagctcgaacttaacgattaattttatatgtaaacacagacatttgcatattttacgaccactttaattgataaaattttattaaataaaatactaactattttactgtaaattattgaatattttcaactttgaccaataaatatcttttgaattagctaaaaaaattttggaagttggcgactaaattagttttttgccaatattttggcgtttcgccactattcttgacttttcttgctcaattttgctaagaaatattgaaagaaaatgtacctcatttgcactgctgtaagtgaataaaaattatttttgataatttttgctgaaaattatgtcactattttggaattttattttgccactaaaaatccgtgccttagtgattagaagtgaggaatgatctgatctgttatgtaaaagacttgatcaggatattaagttatattaaaaaaaaattttggggttcaggtatgacttttttaaggcaacccacagccgaattttggtttttaatggttaaattcacatttccaagttaattatgttattaaatagaaaccagtttatgaattctgtgccaaatttgtgttttaactttttcttttaagactatggaaaacaatgaaaacattaataatagaatatttttatttaaaaaaataaatcaacagtttttaatatatttttttattttgttcttaaaaatttagaataatctggctttaagagaccaagacccaaaaacatgagactttttcaaaaaattttcttattctctaaaaatcgcttaaaaatcgcttaaaaagaacctattttagtcttttttatgattttttcaattaggaacattatcaatccaaaaatacacaaaacaaaatatttgtaaattttttctcttcgtaaattgaatttttcactgcagcattggtgcgactgtttgcttttattagaattttctacatatcttcaaataaaaaagttattactggggccgtgattttagtgaaaaaatatatttttttgctcaattgattaaagaaaggagttcaaaaaacgcatttctgcattaaaaattttcgattctgatgacatttttcgtcactagaaatcattattttggcgcttcttcactaaaatagtgaaaattcactttgacattttgtcactatttttacactatttcaatttttttttttggaaaaaatttctcaataaaaatgcagtaaaaacgaaaaaaacacccaacttcaattatggaatgaaaattatttttgatcaatttttggacactttttgccactattttgtcattattttggcatttttactcactattttagttaaatacgcataaattttcttaaaataaagaatatcaattttttaagattctgtggaagatggttcagcagttaaaacaggcgaggtttgagaaaatacttgttttaatgagatttgataattgattacaaataaccttttgaaaaataggaaaataaatgaataaataataaatgaaattcatacaatggtaaaatttgatcaaaatttaaaatgagtgaataaaattgaattaaaaaaacaacacagcaaaacattattcattgaaaaatccggtcgcggcagcaatgagcacgcctaaaaaaatggaagaaaatgaaaaaaatgtttttcaattcatcaaatgctaaatgatttttatttttacccacccaaaacgactccaatcatttgaaccaaaagcacaaaaaatgctttattgccggacactttcatctgttcttttactttaacactcatttccggcaacatgctgacctaagaagagggggaggggaaaaatttaaaatgaattttattgtttaatgaacaagagactaaaacatttttataatcatgaattccggcctcaaaaatcccttggaatttgcgcttttttttgtctatataagcaaaaaatcatttaaacttcaagaaatagcacaataaaattcccgcttaaattgcggaatggtgaacttttagttttaaaattaattttaagaatttcacccagcagcccaaagtcttaagaaataatttaaaaaaacaaacataccgcggagatgtaaatgaacctgaaaaagaaagtgggaaagtaaaaatagtaaaaaaacgttttttatgggtgccagcatttggggtggaattgttcaaaattattatttcagaactcacattccgcttcccaacgcatagccgtacttgaccaccgtgtcataaagcagcaggtcaatgagcagcccgcttgaaaacccaatggcacacgtcagggcactaaccaaatgaagcaccaagttcatcttcattgactttccagggcgcactataaggaaaagagtgacaaattaatcgttatttatgaattactcatcacattccttctttgccccgttatttaatattttaaaaaaacattgaatttttcattcagaaaaaccttgcataagaaggtgatcaaattattttttatcatttttcaaaaatcacatggaataaaatgttgcaattaacagtttttttcatcatttttttggcaatttatcaaaattcttaactttaattgggtatttttttgcttacaatttttagcgtttttggaaatgtatttttgagcattattttatgtttattggcactataaattagtattttcgctactcacattttttggatcgcttgcacagcaacgccaccgaaatgctcaggcaggaaagcggtgccctcgccgatgagccgatcaggaatccatcaaacacgttgtggaaaatggtcaaaagctgaaattgaacaaagataatattagaaatcaaaatgaagtggccaaaaatttatatgtttgtgtttttacagtcgttttgatcgtcgaattgtgctcagtttgtccggtacggtcgcgctcatcaaactcaggacgctaaacaagcaataaataattaacaaaaaaaatggcattttcttttctgttgcgtaacacctgctgctgcgggtgttgcgtgttgctgaccaaaccaccaagccacgtcaaaacatctgtcaaaagttgtggaataaaaataaaaatgataattcttttatttgaaaaattattaatatttttaaaattttaatttttgccattgttatttttgttcttttccaaaatagttgtaaaaaaatgaaaggaaattgaaattattagatttctcaaaaattgtatgtgtatgtgttaaacaaaagaaaatcatctttttgagtttgcaaaatttattttattttataatgaaataaattatttctcaaaaacttactgttccaaattcgacggattatgctcaaattattttcggctggcaaagggatggtgggcgcgccgtgctaaattgtgggcaccatttttaaatgcgcaaaaaaattagtcataataaaacataaatcgcataaaattaaatcaattatttttcataattccaatggcccatttccgttagaataattgctaaatgactgaattaaaatacaattttttatttttttgggtgcggttgtattcaggggaaaacacatacaattttggcaatactaccgatgatgccctcccccttttggcagaaatttttacaaagcattgaaaacatgcttctaaaggtttttggggtcgctgatcacgaatatgtgatttatttcggcttatttcgaatcaccggatctgaattggaacaaaaattcgaaaacccaatattttcaaaactcacttttatgctcaaagctctattcataatgaatattttttggtctttcaatggtttcagattaattttattattttacctcattttagaacaaaaagcgaattttt

SEQ ID NO: 2717 - DNA, 3225 bp, Heterodera glycines
  misc_feature (23)..(23): n is a, c, g, or t
  misc_feature (3119)..(3119): n is a, c, g, or t
atttgttgatccagcaacattantgatggttgttcttctggcaaagaaaaggacagcaaattatgcataaaagttgaaaatagatcaaaacgggtagagggggggggggaggggattgggatcacttccatttattttgccacatgcagtggtttcccttcatctgcagtgaatgtgaaccggggttggtatgctaccatcccggtaactaccgtaaacccatcctctgtttacattccagtattaacaacctaaccgagtttttgagggagggcaagactgaaacgacatgtccaaccgagactacagaaacgaccagcagcacaatcatctgtcctccgcctccaccaacgacaattcacagcattctactgttgttcatcacttctctgcttcttttggtctttttcgcgcaggtccaccccccccccccctcccccgtctaatcattaattattttttaaattttttttttcaatttacaggctttcaaaatgggcattgtggcgcggcgtctgctcaaaaaccgggccattcaaaagcagttggaccgtcgacaaaaaagtcggttgaattatgtggaaaaatttaaaaagataatatttttttttaaagatatgaaaacgcttcgccgtcaacaggcggcagctggtcggtcgcccattgttgtgcattcggcgggcattggtttgccaaggaccgagccggttcatcaagtaaaaagttttacacattcttttttgtttattgaaaacactttttttttttagcgccaggaaatctgcacagtgcccgcccatgaagtcatctacgacgtgccttttgatgggcaaagagaggaagaagacgaggactcattctgatggccttttgaatttaatcccataatcatttaactcatttttcatttgccttttaaatttaactcaataatcatttaactttttttcatttggcttttaattacatacttatatggaaaataaaaaggataataaggagaggtttaaaataacgatttattttattgtacacagactatggtaacaaattaggcgaaatgttaggcttggattttacaaaaatttgaattcgtcatgcatatttaattaggaggaatatttgatcatacaaattaggacagatgttaggaccaatatttgaattcgttgtccaattattgcatatttaattcgtatgaatattaaatcatacgaattaggtcaaattcgcggcttggatttgccaaaatttaaattcagcgaccgatttgtacatatttaattatcaaatgcgtggcttgggttgatctaaatttgaattcgtcgtccgatcggtgcatagataattagggaatttttaattttgcatatacatcaaaattttgtcggtattaagtaaagcaaaaattcaaatttaccgacaacactaaacaattaaaatgggtcaagaattgtgattaattagattttttggatataaaaggcagtacgaaggttttccgttcataaaccaaattcataattcccttcaaatattgtttttatgcaaaaataaaatatattttaaattgactcatttgccccccccccaccctgctcttttcgtttcttaaaatttttcacatttactgtttacattttaccatattgcattattccaataaatttaaaaataaaattttgtttagcatttatccatatacatttatttattccaaattttaaaaatgtctacatcggaatcaaaaaatggtaaaaatctcaattcctcccttaacattaacaatctttcacctacagcaccggacgaaggcgactgcgaaatgcccgatgaacgtgttctacacctcgagtgctttgagagcggtgattatgatgtaaataattgttgaaaattccatttgtttccctcaattttaatcatttcagatgatggaattgtacggactggaccgtgctaaagaaatgctgatcgacttgcgcgactatgcagaggcgcacggaatggcatgtaaacatgtgaagatgctgttgtacaaactggacaaaggactgatcaaatggaagggaaccaagccatgaaatggatgatgagtgatcagatattttggtgacaggacgaaggggggatgattgaactcattggtgatggatgtgatttaaaaaaaaataaataaaatttgagaagaaatatttggaaaggaaataattgttacttcccctgatcggtcacacggggttcatttatgagcgcccatctcgccaaaattatcgttataaaatgggcgtggcacctggcccgacttttttgcgtataaatacgggctcaccgggtggcatttttcatttggcgtcccttttcaaattcacaattcctatggcgatcaacatctccgacaaaaaatcgttgtgcaaccaaatcctcggccaaacggacctcaccgtgacctcgagtggtataaccatcagcggtccccgcctctcgacaccccgtttcattccttttgatgaagcgggtcgttgtaggtgttgtaagggaacggagtccgaaattgacactgtgatcacgaaagaaggcatcacgctttggtgcacccgcatagagaagacccaattcattccattcgatgttgtgtatgatttgccagggcattgttttttccgtctgaaaaataagtctcgtgtgttcaacataccctatggcgacataccctcttctgacacgcacaccactaaacgacggacacacaccaatgaccatcagcatgaactgaagcgcaaagcaaaggtagctcttgacttagtggaggccggactaatggcagatgccatgcaggacggcgcacgttggaagaaggcgaaaacagcaatcaatgtgctcggcaacctccttttggcggaatcgctggacaacacttccgctaatgacactccgctgaaaaatgataccgtagacatcaaaaaagaagaagcaaatgtggaggaagaaaaggtgcaggaagagcccaaagaaaaagaggaaaacaaggaggaccttggagacattgacaaaacgctcgatgagttcttcaacagtattaaagcatccacttcaaacatgtagaccatcattgtgtngtaaaaatgttaaacacccaagcattcaacgataaagacattggctttaattaccatttggtcaaattatttcgggcccatcgtcgtcgggaaaactcaatttctg

SEQ ID NO: 2718 - DNA, 3172 bp, Heterodera glycines
cttgcctatagctgccctacaatgctcaacgtgaaattgagcagatggacactgctcagcagaggattgccatcagaagaaaattaaaaaaggacgaagcatatgatgatgattcggaacacaaaaaatacagggttcattacccaccttcacctccccggcttccgctcccgcctcgtgcgaaagcaaaaattgaaccaccaccatcgcgtcctaccgccaagagagagcctaaacaacaaaagccaacaaagtttgaactaaaaccatcaaaatttgactccgatttacgaccaaaagtcgcaccgccgcctcggccgaaaaaagaacctgaattcccgcttgaccctcggccatccacatccaggcaggctggacacttgcctcccccagcacccaaaattataccaaaacctgaaccgacaaagaggcctgtaccataccgtatcccgaaaagagagccaaaaatagttgaacaacagccacagccgctgcaacaaccccttcctgcttctgccgtcgaagaagaaatgcccaccgttcctccgcctaggcgggggaccaaacgccactaccccgtaaatggtgagaatgatggtgaggtgcgcattagaaaacgcgtgaggcaagcgcgaagggtgagagtacagtactcgcccgaactgggcccatcaacttctgcacaaagtgatgaacaacagcaacaacaacaacgtgaactgtttgccattccatcaaatcagctgaccatgactcagcgggtggaacgactgtacatcaaatgcaaccgttacgctgatcgtatgggcgttcgaggaaatacaattaacacagcaaacggcaaaccgttggcgcatagcaatttgcgaatggccctcaagtatataatagaccggagagcgggccgccccaccattaagccacctggagcggccatattggaagagaggcttaggcaagacccaattttgtattcatggacggctccgtcaaagaggccatcccaaagcaaaacaacccggacgccgcagacaatcaagaaggaatttcgcccgaaaaagtggagttgatcaacaccacacttgacaaactgtacaatgacccatcctccccagcagcattcgccggtgttaccgcactgtggaaagaggcgcgaaaaaagttgaaaaatttacggaaaagggatgtgcagcactatttggagggacaccgcacgtacactctgatgcgcccccgcagggtgcactttccaagggcccgaaccgttgcggcggggttcatgaccgatgttcaagtggatttggctgactttcaggcgctttcgcgccacaatcggggtcaccgatacctgctcgttgcggttgacgtgctctcaaaacgcttgtttgttgttccgctgaaaaacaagagagccgaggagatgttggaggcattcaagcaactcatcgaccaaatgcccatggtcccgcatcgcattttttcagacaagggcaccgaattcaagaacagattgctgaaggaattcttcgatgagcaggaaattaagaaacatgagccagtgcattcatctgtcaaggcatccgttgctgagcgggccatccgcaatattaagcagagattgtaccgctattttgcggaaaaggagacgctgaattgggtggatgcagtacagaaaattgtggatggaattaacagcgctccgtctcgtgttcacggaatgcgccccaacgatgtcaacttttcaaatgcgcaaaaggtgtggaagcgactgtacggacaccctgctcttcaaaagcggacgccacgcttccgtaacgaccagtttgtacgcatgagcagagagaaggggcaatttgagaagggatatttgccaaattacggggacgaaatcctggagattgacgaggtgttgaaagcggtgcgcccgattcggtacaaactgagggatgaacacggggagaaattcaagggcagcttctatgagcaggagctggcgcgcgtcagaaaggatgcagagacgagctaccgcatcgagaaggtttacagaaagagaaaactgtcggatgggtccaccgagatgcttgtgaaatttataggatatcccaatcgggaatggattaatgagtctcagcttgtataaaagcatatgtattttttcattttgttgaaaaaataaataatcatgtcgaacagtttctttgtgtttttgcccagcaatgtgacggattatccggacaatcagcccaacaaatttcgtgttcggctcccaaagcctttgcattttaatggcacatgggtgtgcgggctgcacagtatcagttacccttactcatggtcaaccattggcacattggatgcgcagtggattgacattcacttcatcgaccgacacgctttcgatgaggaaaaacagcgggtgatccgagtaccggtacctaaggcatcgcatagcagggttgaacagctcagggactttttggcagtcacattgcgaaaccgtagcggagcaaaactgttgccaacaccccgtgaggtggaagcgaacaggaaccgaacaaagcttcttgattctccaccaccactgaaaagagagaaaagggatgcgtcatcaccgccagtgtttgacgcgggtggaaaacgcctccaggactctcctcctttgtataatataaatgaagacgaacgacttgaggagtcaccgcctccttttgaagaaacaaaaatttcggcgacacctccaccgcctgtcacaacccccgttaagccaacaacagcagtcaaaacgcccgctgctcctgctgtagcaccttccgcaactgcaaaaccaacaacgcagtctacagtaacaaaacaggcaccccaatcaccaaaaccagcaactaagtctactaccgccgcccctgttaagtctacaacagcccctccgccaactgtaaaggcaacaacagcccctccgccaactgtaaaggcaacaacagctcctccgccagctgaaaagacaacaacagcccctccgccaactgtaaagacaacaaccgcccctccgccgccaaagacaacaacacctgtaacacctgaggtacagagaccatctgttaagccgacaatttcggcaccaccagctcagctaatatcgacagctcatgcgacacctccagcttcggtttccgct

SEQ ID NO: 2719 - DNA, 1550 bp, Heterodera glycines
ctcatcggtaagtcccttctttttgggagtttttagttctaaattttggtagttttttggtcttaaatgcttaagcattcatagttctagcataatttccattttaaatttgtattgtaattaattacgtaaaaaacagaccgctcgttggaacaccacagtaatgggctgtttgatgccctcctcgtgcactttcttcagcagttgcattgtgtcgcggaagtgttcgtccgttttgaccaaatcgctgtacgctctctccaaaaaatcgaagtcagtgccaacgcgaaagtacagctcgttcagcgccttttaatttggaaagtaaaacttttgaaaaatcattgatttttactaagatttcgggcctggcccgtggcgattccctctgacccagccaaagtgccaatgcaagtggagctgggcggagggcttttggtggcaaagcaaattttaacaacaaatttctcccatgtcttttagcaacaccatcataagcccatattttctccacatttccaagtaaaatataattttttcgaggcgtcaaaaagataatgagggctattaattggccttgtaaaggtcgttgaaataagctattgcaataatttaattgctagaaattgcccaattaattccttttaatttttcaattaaattatttaattgttttttggccaattttcaccttttgtatggaaagtgcatgctcaaaaggatgtcgtggaaacggcgacgggaaaagtgaaacgggcgcaaacactgacacatcgctactgcaaaaaaagaaagcatttaattttatttatatattaatttatttttattattggtattaattacccaattaccgtttagggctttctttatttctgaaaatcagcgcattattatgtgcccattcaacagcaaattcccgcattgaactcaaatgattctcatccttcaccaatttgtgaacgtaattccttgtcactttgtccacttaaaaatttgtaaaataaatttatttattttaaaattttaaatttaaaaaatgctgcccgaaatgtttatttaattggttaccgttttgtgagtttggttcattgtcttcttcattgtcgtgttccacgggatggccaaaaatgctgaaaaaatttgccaatgctaatgcaaatgagagcaccaacaaattttgtgtaaattttcgattcattttggaggatgtaatttatttggcagaaaatttatgattttttgataggcatatcacatttatatatgcatggcaaatcattatttgttacattatatatttcatttcctgttttgtattattttttgcggacttccgtttgtaatggcataaacaaatcattagaaaatcacgtggtactactgatcgtcattttcgaattattcactttgatttttaatgaaatgtaatcgttttcataaccatgaattagactgtaactgacgcatttttataaaaaaaattaaaaaataattaatatttaaaatccaaaattgtggtgtcattcgatagccctatgtatcctcta

SEQ ID NO: 2720 - DNA, 4034 bp, Heterodera glycines
  misc_feature (50)..(50): n is a, c, g, or t
  misc_feature (59)..(59): n is a, c, g, or t
  misc_feature (100)..(100): n is a, c, g, or t
  misc_feature (114)..(115): n is a, c, g, or t
  misc_feature (3945)..(3945): n is a, c, g, or t
  misc_feature (3953)..(3953): n is a, c, g, or t
  misc_feature (3955)..(3956): n is a, c, g, or t
  misc_feature (3966)..(3966): n is a, c, g, or t
tcattcgatagccctatgtatccctctattagcgtgcaaaatttcgaaanaattcgttnaaggttcaaaaaaagttatgccagaaagaattcaaaaaaanccaaatttttccanncttttgggctcgaactttttttgaacttgacgaaattttttggaattttgcaggctaatagagcatctaaataaagagctttcgaatgataccaacaatgttggatttggttggcaaagaaaaaagttatagtccaaaaacatgtgttcgtacgaaaacggcctggcccccgcatctcgtggtttaatcgtttttagattttttaaaatcttatttgtaatgaaaggggccgggcaaatgggttttatggggtggcgagtgaatcgaggcgcaagtgaagcggctcaaatgtcggtacacctttttcgagaatgacttttataacgcctatttcggcattttgtgccttgtgccggaatcacctattttgtgcttattccagcattttaaaattttaccgctttaaagcgttaatttgcttattttatgcctgtttttggggttcataattgtaatttttcttgccttaaaaaggaggaatccctctttatttcaactgtgaaataattaacttttttatcatttatctattcaattaataagtttcattataacttccagattattgttttgtttttttcccaattatcaattcaaaataaatgtttaacagattattgctaattagttatgctcaggggtgccatcgccaaaactcaaaaacccggcaaaccagttgaaaaacccggcaaaaacccggcaaaaattttcaaaaacccaccaaaaacccggcaaaaacccggcaacttcaaaaacccggcaaggacccccaaaacccggcaaatgccgggttttccaggtaaaatggcacccctggttatgctgtggaaatccttaaatatgtcaaaatattgaagaaattcgtcttcttctcatcattattatcccatgcttaatttaatgaaaaatgacgaaataattcccataaggaaagtgggtctacgtttccttaaatacaaaatggttttagactgaaaattcataaaaattgcattttgattgaaaataactcgtgcactgatggactggaggataaagtaaaaccacgaaactgttaaaagcaatgaaaatcatcatacagacagtttgcacataaaatattaaaaaacaaatacggaaatatgtacaaatatctttgaaatatatcaaaatatgcaaataaaaattttgattatgattttttaggctaacatttcttagaaaagaggtggataagaacaaaaggtcaaaaatacccaatggctttttcgaaattttcatgtgcaattcctgtaattctctaaaattcaaaatttgtaaaaaaaaaaagtaaatgttttccataaatatgtatttatctgtgtttattcccagtgaataataacaagaaatatcaatgaaaataatatttgaatttaatttttaaatttagaattgccaaaacttcaaattaaataacaaataccctttatatgtttatatagacaaaagatttttaattaaaaaaattattattaagttttctaacaaattcgggacaaattatttagtcggatttttagaatttttggttttaaaagttttggtaaaatttttgctaaattttttaaaacaataagatagtagaggacacatagagaggagctatcgctaaagatttcaagattgcttaattataataaagtttgagctaaattatgatttattaatctgaaaataaaataaaaataataaatgaatttaactattactttgatgaacatttttaggttcgccacattgatactttttaggttcaacttagcaccaaaaataattttattggccatttataaaatttggataagaatacttttcaaaaatgaatgcctaaaatatttttgatgaaaaccttttattcagttgtatttgttgttttattcttttattttgaaaggttaaatcataaaaacacataaaaatgcataaaatcgaattatcactgctttaaagaagcgaaagccataaaataaaaagcaaattgaaaatttacatcaattattttttctaaaaatgccactgtttcatcatccaattgttaattatcagaaaagaattggcgagtcgtgcaccgcaaatcccgccgaaatgccgccctcgtccgaagtggccaatttggtcttcagcaaatggccctgctgcacattgtggctcacctgaagaaaacggaattttaaatttaaaaattctaatttttttaaaattgaattttagtagtttcgctaaagcttcatttgcgtaggtttacagtgaaaattggaaattggtagcccaaagcaatactttgaattcgaattatgaatttttttaaaattttcaatgtccaaaaaatctttggcaatgaaaaaccctcaggtacaaaaaaaaaaattatttgaaatttgaattctatccatttagtcaccctatcccaacccaaataatcacctctccggtgcgcatgttgcccatcaaaactccgtacacgcccaactcgctggccattgtgtcaattttcgacactttgtctggttggaccatgatattcttaaaaaattaattatttaaaaaacaaaatgtcaaatatataatatttaattaattttttttgaaattaccctcgttcccagccaaaatgggctgatcagatcaccatgaaggagtgatctgatcaacttggtgttgctacctttatgaccaccccaaaagggagtgcagttggtaaaatggtttgtaactaataataacatttgacaggggatagtgaatggtatcattataaagcccacaaaaaatgctacaagaaatataaaacatatatacacaatatagtcatattgagattttataatcaatttaaatcaaatttggtagaaaattttgagtgttgttaaacatatgaccatgactgtatgtaaaattatcttctaatacgggtttttggtctcggagtagaatctcggtctcgagtctttttatattattttttttctttttaaattaacatacaaaaattgataattaaaattttgttgaaatttttctcaaaaataacgactttgtttgattttaaaaaagggattgaaaagtgatattctttctcaccgttaccgggaaatgcgtgagtggaaaatgcgtcagtgatacaaatatttaaaaaaaagcactgtgcaagtataaaagtaaaattccaaatgaaaatcattttgaatagcgaacccccccccccccccccgcacccgaattcgaacagaaaatcgaaattccaattttcgaaattagcctttttggttaaaaatcaatttaaatacacggaaataaactgaaagcatcaacccatcaataaaagatcatttatgccgcttttaaaccaaaattgcaaattcgaaaatttggactttcgactttttgaacgaattcaggtctgggaaatcggaattgggtgaaatgtataccggatccgtaatcagagtgacctcgaaaacccaatgaacttgtttttatgacattaaaattttcactggcgtattttccgtgagccttcctcactattagaatccatttcagtcctataaaatgatgttctattttctgaaaaaagcaaaagatttcagacaggcttatgtaatcacggaatagggtgtcttcaaaacaaaacttgcaaaaatgcattgaaatttaaattattcaaaatcatttattcaaaacgcgacagatttatgaatgtttaaaaatcaaataaagaaaagaagcgggggattaaatgagtttcgatcgcgcgattaaacatttcaattatcaaaaaaattagcatggttattataacttttttntctggttncnnttagcccaancgttcaatgaatgagctgcaataaatctggcaccttgtttgactattggctggactctagaggtcccc

SEQ ID NO: 2721 - DNA, 5152 bp, Heterodera glycines
cgagaaattttggcgaaaaaatgattttttgaaaaattttcggtttttgggctcaaaaaggctaatttagctgatgggggccgttctaatagaggtttttttgaaaaatgccaaaatatggacataaaatatggaccaaaatgccaaaatatggaaaaatatggaaatatggacataaatcgcgaaatatggaaaaatatggaaaatatggatatagaaatccatcctagaagcttcaaaccaagctaaaaacatgtttttcgtgcgtttcaggccttccacagtccaggaaaaaaatatggatttccatataattcccagccctactgatgacatttccaaggatttgtttaattgctgcagtgtttattagaaataaaaataaaaaaatcatttttaatgtttcaaaatgaaagaaaataataataaataatttattcaatattcaatttatttattcatttagaaatggtgtggcacttgtttttatcatatattgttattgaaaattattgcgcaaacggaaatgaataaaactattctatgatcgatttgaatatgccaaataaattttgggtttccattttttaaataattttctaaaatctccccccattgaggttaaaaaattcctcggagcttcactctatgaaaatataggatatttgttttcactagagacggacgggaccggggcctcgtcagggtttttgccagaataccggaccgagcagacgggctaataaataacagaatccaaatttttaaaaaatgcacaaaaaggacattttttgtacgaaatcttttagccaagtctcactatgagagcaaaactgaaccccaaaatcctaaaaattgatcatttttgataaattctgtaaaaaatttcaactatttttctggataaagtgctaagcataagtatctttgaaaagcaaagcaaaaaaaaagaaagaaaagttttgagttgtaaacagacaaatatttgcaaaaaggtgccacttccggcggcgggtccttcctttccaattttgataatttttgaaaaaatctcggtcttgtacgggactctcgaccctaaaatttgaccgacaccgtgagtcccaaaacggattttagtcccaatgccgcttcaagtccctcaaggtctcgttcatttcaaaatttcaatcttttgttttaaaaaagcttcaaaataaaaaacattattactcataatattttcaataagtttcacaaatttggtgttctgaattcttttgttatcactagggcaaaaaataaaattttcacttaattttttagtattcattggatgttaatttgttggtgccattacttcattttgagcagttgtgccagctggtccccggtcagcttcatgtccacgcacggcaaattgccaagtgatgggcccacttcgatgcgtgacagtgccattggcaaagtgacaactgacttccgtgccgtgtgtcgttggcgttgtaatggcaatggtgctgctgttttgcacgccatttgtttgccatgaccccgtgccaaatttttgccattttgcaccaaattagcccaccaatctccgtcatatttgcatttttcattcccacagagacagggacaagctttggaaagccaccagcgttcacctgttacgaaattacacatataaatgaaatgctaattgaaagacaaaagcgccaaatttggagaaacgcttgtgccattattaattttttttaaataattaaaatgaattccaagatgcaaaaaaaaaaaattgaaaaaagcccccacccccagagacccccaaaaaaaattttccccccaaatttgggcccccaccgcccccaaaagaaaaagggtaaacctttcccaaatccccccttttttttcccccgaaaaataccccggggggaaaaaaaacacccgcggcctttttttcccccctttgtttttttttccccccaaaaaagggttttgcttttcccgggggggggggtaaaaaaaccccacacttttttttgggcgaggttggtaaaagggccccaaatttttttcaccccccccccattttttttttccttcccaaaaaaaaaaaaaaaatattttttttttttttttttggggaaaggaaaaaaaaatttttttttttccaaaaaaaaaaaaaaaaatttttttttattttaaaacccctttttttttccccccgcccccccccaaaaaaaaaaaaagaaaaaaaaaaaaaaaaaaaaaaaaaaaaaaaatattttttttttttttttttttttttcccccgcgcgcgcgcgggttttttaaaaataaaaaaaaaatttatttttttctccccccccgccccccccaaaaaaaaaaaatataaaaaataaaaaaaaaaaaaaaaaaaaaaaaaaaatttttatttttttttttttttttttttttttttttgtgtggggggggggggtgtttttttttctcttttccacaacaaaaaaaaaacaaaaaaaaccccccctctccccacccaaatttaattttctcttttttttgtggggtggggggagaagaaaaaaaaaagaagaaaaaaaagcgtggtttttatatttatttgtggttgttttttattaataatttattttaaacaaaaaaaaccttctctcccggcgcccccccgcccacaaaaccgcgggggggtgtttttgtttataaaaaaacgcgcgggcgggggggggggggggggaatttttttttgtgggggaaaacccctctgggggaaaaaatttaggaaaaagggggggggggaggaggcgggggggggggttcttttttggggagggaaaatttgggggaggccccccaggggcggggtaaaaacaatttaagggttttaattttaaaatataaaaaaaaaaattttgtccccctttttcccttcaaaatttttccaattccgggggagggaaaaagcgaaaaattttccccccctgggaaaggaaaatccttggaatttattgggggccaaacccaatttaatggttttttttccattttaatttaggcccagggaattggccattgtcgggtaccttttgggcaaatccaaaacaatggcccccattgccaatggcaagggtggccatatgctgccctggaaggcgccgagggcgcggaggggcgcgttgggatcggcattgttctacgcgactcgccctatctgttctgatcagtgccctcgcccgatctgttctaaacgactcgccctatctgttctgatcagtgccctcgcccgatctgttctaaactttgttccaaactggttttctgatttgtaaaagtataaagaaaaatatttattcaaatgtccaattcgaaaaaatatgttaaattgtcaccactgatcacttctgccagctaaccttttttaagaaattctttcaaaagttatttcagattttcatcttttcgtgaagattagccaatgtattgttcaggggtggaatgctagcgcgatcaacaattcgtggcatatttttcgcaactgcgacaatttaaactcgcgatttgagtccgcaatccgcggcttttttggaaccaaattatttataaagaaaatttatctaaatgaaaaaatgggttcaaaatcgcaaattggtaatttttgataaaatctattaataaattgtctcaaatttttaaaaattttccggcggcgcctgtcggactgtcggtcaccttatgaaaatgaaaaaaggcttaaagatataaatgtttgaaaagatggaaaactgagcttttaaggcaatttgaatccgcgaccgctgggtttttctgtccgcgtctcgccactgttatttattggtcgtcatccggacgaattatcactttttgctggacggacgaatcgaccgacacccgacggacgaattgtcatagcacctcgacgaaattataattatttataaatatcattcatattcatttcctttttaatttattgaataataaattttaaattaaaaatattttttataattcaatcaatttaattcaatgctaatacaatataaaattgcatatcatagaaacaccatatttgattgtcgtgtgaaaacgtgcaaaaatgtgactctttcaattgcctttgtcaggagaaatgccacattcgaatgccaacgaaacattacacttttttttttattaatttgtgaattattttcttactattcacatctcattctgctctttcggaatgtcgtttagctttgttttgctaattttctgcttgttttatggaggtttgtcatagggatttttaaattaattagtgtttttgttcaattatttgcgcattcatttcttcccagtcgaagtttttgggagtcgaaatggtgggaaatgatctaatgactccttttttaaagattaattaacttggcgaatataaattaaatattttcagttggagaaatgactgatttagcaaaggaaggccaaacgcccaattttgacttttcacaaccgcagccaatggcacaaatggcacaaattgccaatgcaatggcagcgaatggaaacggaaattacggaatgggcaataaattcaacagcgaaggcgaagaaaacatctgtaaaaccagttaattacatagtaaaaatagttgttacttttttagatgaagaaaataatggccaagagaggtaaattaaaacaaaattatactaaaatattaaataaattcataacgatctaagaccatttgataaatcaatggcattttcgaataaaaaacaacaaaaccgtacaaaaagtagacagaggaaaagcaaagaaacggagaagcagcagaaggaacgcttttcgacaaaattgtaaaaaggggggggggaattaaaattgaatttgaatttatgagtgaaaattgatataaaatccaaatttgaaatgattattttattcccatttttgagttttgtttcggccccaaatcaaaagactttttatttgataaaaatattataaaaattaaatggcaaattaatgcaaatttttcgcttcgtccaacagattcactgtgttcattctgttctccatgtttttccagcaaatacccgaatattgtgtcgacaagtaatgaatagggatgttaaaaaatat

SEQ ID NO: 2722 - DNA, 3374 bp, Heterodera glycines
cattattatttatttttaaataattaaaatgaattccaagatgcaaaataataataattgataatagtcctccatcctctagaagtcaccatagaaaagtttctccgcccaaattatggcgctccaacggtcccagacagtaatagtgttaagccattaccgtaatccaccgttatttcttcgccagcaaaaatacgccggagggcaaaaatcaacacggacggcacttgctgtccacgctgatggtattgatcaccagcagtagcagtgctagcgattcggacggcagtggtgatcaaaacagcgcaacagtttggctggcacgaatggttgacaaagcgggccaaattaacttttcgaagcgcatccaactgatattgttggccattctgcaaaaaaagaagaagcaattattgcctttttgtttaggtctgtaacggatggagaaattccatcttttggccaataaaaaaacaaaaaatttttttcgaatttaaattccgataccttgtttgccagatccgccatttcaaaaatgagaccaagattagatttacagccaaataattagagttaaactttttgatttttagccaaattttttgcccggcgagtatcattttgagtcaatttaaaaatttgatcgtcatattttacgtgttcaaacgcgacaattaaatttaaaccaattaaataatcaatgcagagttgaaaacagcaaaattttatgcaggatttgatttttactaccccacgtgaaataaaataaactgtatacgatacatgaggggttggaccgggttttggagttttttaggtcggaatgccggattttccggttttatgccttccaaaccggggcaatagcaactcgtacacaagcaactagtacaaaaatattttataaaataaagcctaagcttaagcctaaacctaggccaaagcctaagcctaggcctagcctaaagctttggcctaggcctaaacctaaaaggcctaacctaagtaattggagttgcctctgtacaacagtgtacgagttgccttttgtgcaagttgtcatgatacctctaaatcacaattgctgttttactgtctgtacggcaggggtggggcacgcacagaaaaatcccgcggtcacggatcgctcgcttaaaaactcaaaattttccaactttttaaacatacatttttttaaacttttttaaaatttccttattataaaaaattaattaaatcccggtgcatataagatttgcgacgggactgaaaaaaggggggagggcggggaaaaatgacctattttgtgatttagagccaatttttttaaagaaaaattaaaggttttgtcagctctgacgaggaaaaattggaattttgaaacgaattttttaagaaaaataatccaagtttcaaaactttttcattaaaattttgaatattcaaaaaagacaatcgcttcaaaaaaatttctttataaaaattttgccgcaaaaaaatgagcggcgcgccgcgcaaaaaaaaaaatcccgcagtcgcggattcaaattgccgcggtcgcggaccgcgcaaaaaaaaatgccgcgaatcgcagtcgcgtcccagccctgctgtacggtaatattctgttatgaaaccatagattacttgaaatcgcgcagcgggacgcacaatcggaacaactttgcatggtatatcctggaacattaaaattaaaattaaaataatatgttatctttaatgaaaaataattaaagaaataattagtgggaaattccgtttctatatatatatttttttaattttataatttaacttcgaaaatcgttagctgaactcataattctcaccacattttcgccattttatatgggcttattttgtctttgttctccgtgttgatcactcgcaatttgttcaattctttgcctttactcaagtcattgtccacgacaaagtcggcagtagtgggaatttcactgaaatttaaataaaaataaaaatattttttttcaatttatagacattagagaaggcagaaaatcatcttcatgtttgacacttgaacaacatccattaattaattggcttaatgttaagcaaaatatttagcaaaaatcttaatttatttgtcattattaacaaaaattttggctaaggcgatgcgggattgcgccgctgtcaagaaaatttgcagattttgttgatattgatttgttgaccgagtttttgtgtcgcagtttgtgtaaaattggtttttttaaattggattattaaaaaaaagagaaaatttctgaggtatggatcattcgttggcgaacataatttcaaaaaaatcagaaaaggataatgattatccgcaagtctgaaaatttttgttcactgacagaatacaattggcatcccggcaattcagaaggtgccgggtcgttcgttactcaaaaccataaaaatgggcgttactcaaaaaaccataaaatgagcatattatttgatataactttgctcaaaagcaaccaaattttcaattcttgaaagcatttaataaccctaaatgttttctattatatgcaaaatttcaaataatttcgttaagttccaagaaagttatgaccaaagtgttcaaaaagtttgttttttgaatttctcaggtcatagcttttttgaaattttgcaggagaatagaatacatttagggctatcgaaaattatcaaattttaaaatttggttcattttgggctaagttatgaatatttttctgtcaaaaaatttcatttgatggtttttgactaacgtcagacatagatagcagggatgggccaaattgaaaataaaaagcgaaatgcgaaaagccaaaatatgcgaaaatgcgaaatgcgaaaagcgaaattttttttttaaattttaccaatagcttgaggttgtgatgaaaaaaaaaatctacattttccggttcgatctttttctcagatagaaaatgacaaattctactcattttgtggttaaaatttcaaaaattaaggtaaaatgaatgtccggcggtgccgataagcgccgccggaaaattttttggaaattgtaataaaatatggtaggaaaagttgcaaaattttcaaaaaatttaccgtttttcaaaaaaataaatcgcaaaaaaggcaaaaaatgcaccaaaaagttcaagataaaagcttcaagccaagttaaaaactcgttttcgtgcatattaggctatagcaagttagcaaaaaaggtaattattagagttgcacgtgaccgggattttgacaaaaaccgggaccgggacttaccgggaccagaaaagtcgggaccgggacctcgattttcgtccgggactgggaccaaccgggaattt

SEQ ID NO: 2723 - DNA, 1855 bp, Heterodera glycines
aataaattaaataaattatttatcattttatttaatttgtacaatttatatgtcccattctcactcacttttgcttctgtcgttggtgatttcgtgagcaaatcaaacagcttaaagcttttaaattcctttattaccactgataaatcaatctgattatttggcacaacaattgccaaatgcaattgatcattatcacttccaattggcacaccgataaatcggaactgaaaatttaaaaaaatttttacttaaattaattttgattcttttttttactttttcctcattcttgtaaatgaattgaccaattagcggcccccaatttgtatggaaatgtgccacattaacaataataatcctagaaaattgtgtcaattaatttttaatgattttttcaacttagtctgatgtggcacaatgtctcccggttgaatcacatcactgacattcccttccgccgttattttgcgcgcaaattcatttattttcttgaaaatattttaaattatgtaccaaaattatttatttaatttttgtaataaaacaaagattttgctactttaagtagtaaattttgatcaggtccagagttaaattttaaaatttcgaataattaggtattttttggactccgatggttcggatcagtgccatagtgaataaatcttgagatatattgttaattttcttaacaaattttccgcaaattacccaacaaaagtgtcaaaagtccgaaaatgctttaaggtgccaaacgcccacatatatattaatttaagcttttttaattggctctaattttaaaggtccccgccatgattataaatataagaataaaaatttgaaatattttaattgtatgcaaaatattattttacatttgccgcctcggttccttgacgaaagttgatcttctcaaaattgttcccataaaatgtgtttgttttcgtgttgaattggtccaaaacatcgaatgaatccgacaaaaacattttactttccattttcagtttaaaaacatcattagaaggaagcaattgaatttcttggagaaattgacggttgttattgtgcattaattgttcagacgaatctaaattatttaatttaatgttactaaatgcaccaaaattaataaatttttgggtacacagtggccgggatttaatcgctttttagtgtctcaactaaattttttgaacatttgcaggctattagggactttcaagcgcttttaaatcctctaagcttatttaatatgaatgacaagtaaaaaagttgcatcatttgtcgccaaaatggctggcgccaaagtgggcggttcccattaaccgggactggtttttttcccaaaaattcgatcccaatcaaaaaatatattaccctcatccaacaacactttgccaatttgagctttcgtattccctcgtgcgccattgtaggcaattgccaagccaatcgcggccaattggggcgcaactaccgtatcctccgttgtagaagtgtatatttcagggtttttgtgaaggtaaatatgtttaaacaagtccatcacaaattccgattgaccaacggctttaaaagcaaaaaaattaattattttatatatattttttaaaaggtcggtcattacgtctcagcacgaagttcgtcgggtacattagcgtgccgtctggcattccgttttgtttcattaacttcaaatcggtcggttgccaatttagctgagtttgatttgcgtattcataaccgcctgcgggatctcgccattgcactgcgttgccggtttgcaaatccaactgcagtccgcgcatctcttgcacacggcccttttggattaaaactaattatt

SEQ ID NO: 2724 - DNA, 3407 bp, Heterodera glycines
aacaattatttttaatgcgtttttaaataaattaaaaaattaatttttttcttcttttttttatcaaacatttggtgccaacagatcaggaagatggtaacttttgtagccacaactgtaaattatttcaaaaattggctttattgataaaaaaaacgaggacagttttaagtttagaaattttttaaatttaattttagggtgggacaaagacgctcaacccacgacatttttggcattttttggattatccccgaccccgacacattaaaccccgactcaaggattgaccttcattttattttaatgaaaatctcgatcccaaaactttactgacatatttttaattaataaaattctccttttctgccaatatgaataaaaattgatgccaaaaaaacgcacttgccactcaaagtgagtgttatgccaacgaacacatcgggtatttgtgaactaaataaattccagcagagtctgttgcgaaattcaatgggaaaagtgaacggaattcctcctccatctaaaataatttatttaactaattttttttattgaaaaaatagaggtatttttttactgaaaaagagataaaaaatgatagtgacccaaaatttttttttaaataaaagaaattttgaaaaaaattctttgggcaaaataaacaaaacaaaaattcccaattctgccaaaatagtggcaaaaaattgagaaaattttgttaaataacaaaaatcacaattttattttaaaaataatgccaattttcaccatttccatcatcgcctggccattcctttatttcgacactaaaaatgccaattttcattttttaattatttcattttttttttatttgcctgctctcgaacacttgtttcatttcgcctttacaattgtaggcaattgttccataataaaaattttctctatattcaactttcacatttatggtacgacaatttttgattgctcccgtaatgcaaccgtccaaaagtacaagaattccttaatggttttatcaatattttaatttagggttgcgtccccgaccccgccccgaccccgaaccccgacttttttgcccatttttcggggttaaccccgaccccgaccccgacgctcccaaccccgacgcaccccgaccccgacccttaaccccgactcggggtcggggttaaatatacacccctaagaatggcatttttgtgggagaaaaagcaaaaaatatatacaaattttgaattttttaaccattttgccaaatttttataaaataaagtaatttgcttttaccaattcatatgcagtagtggcgtaatggttagtgtgttaacactaacacaacttttgtcgtgagttcgatcctggttgacttcttcttttttaattatttttttttgtaattaatagggttttttaaaataaaaatacccataaaaattggtcatcattggcataatttattgacaaattaaacccaattttcctttcgttgaaattaaaaaaatttaattttccttgactaaatcatgaaaagtaaatattttacaaaatataaagagaaattcataattttttggtgaaaactgttagaaaaaagagcttaaaatttaaaattcgcccggcgttgcctatcggcatcgccgaccccccaaaaacctgaaaattttgctcaaaatcaaaaaaatttataattttttggacaaaatctgttacagatccatccaaatttcaaaattttttccggcgctgcctatcggcaccgccggacccctttctcctaaaagtctttagaaacgcgccgcaaaaaaaatgattttaaaaacaaaaaacttttcgggaacaagggtccggcagtgtctataagcgcggccgcgaaaaatttttgaaaattagagaattagaatgcaatttattaactgatttcaccaaaaataaccaattttttcgactttgagccaaatttttttagaaaaaatttgtttttggggcctggcgccggaggaaaaatttgaaattttgactatttttacagattttcactaaaaattgttcattttaaatgccttatcgtttttaataattctatacaaaaataattatgaataaaaagaaataaaaaaatacacaaaattattattatgaataataaaactttaaagcaaaaataatataaaatttttttgactatatggcataaggcaaaaattgaaaaaccccgaccccgaaccatttggtcaaccctgaccccgaccccgacacttccaaccccgacgaccccgaaccccgacttttccaaccccgacggtcgggggcccaaccctaccttaaatttaaggatgaaatattggaaatttgttcaaaaataaacttccaaatttagcatttagattttttagaaaattctattttaatccaaaggtatttttcagttataataaaggaatcggcctaaccgaaaaccaagggtaccagttttctggttttaaaaccttaatcttctcaaaaaattaatttaaatcgcaaaatttggtcgtaaactcattaaaactataataaatcattaacattgaacaataattataaaatttaattagaaatgaataaaaataaatttttcacgagcttttctcaaaaaatcactatttttatatgattattccggtaacaaatgtcctttgtttgtccttgaattttgatcacaaacactaaaaattaggcgaataaatcatcaatttgagtaccatctccgaataagcagcagtcgtttttattttcatgcagatttttgaaattttcatttgctttctgtggcaaaatgtcactgttttggactcggttcattcgtaaaggaaagggtggcacctaacaataaaaaatacaaaatatttaatgaaatttactaattttaaatatgtaataccattgggaagaaacttttagttgccgatgaagacttattttgaccaacaaattccattcgcattggggagggaggcgactaaaaataaaaaagatttttttagttttcgtaattcgatttttatttttttggcaattttatagtttaggtggaacgattaaaaaaatttaaattgaagattcattatccatgggctttttagccggaattccatgggctaaagcaaatgcattactcagggattaattaccatttcgtgaaatgatgatgttgttttcattgaaatttgtgggtccctcaaaacggagtcagccgaagatttggcacttccatatggatcaatggcattttcttaaacatttcgttttattaccttttcagtggcctcacagaaattcgttttcccttaattttttcacttttcgatgaaaacaaaggcaaaattttgggaaatatggacaacattataacagaaatgctc

SEQ ID NO: 2725 - DNA, 923 bp, Heterodera glycines
  misc_feature (916)..(916): n is a, c, g, or t
aaaaaacaaaacgccacgccaacacactcaaaatgaaaaacaaaagtgtcgtaactgtggtcaacgtactaatcaagcgttaaagcccctaaatccaattcaatgcagtaaaatacgtattttttagatttagtttgagttaaaaatgatctacaacatttattggatataagctatttctcagtgattaatcagctctcaaaaaagttgtcagttgaaaaccgcaaaaaaggcagaacttttgaagttttttatttctatctttttttatagttcgaaattttctgtaatttttagtaggctaatagagcctgtgaagagctttcgaatgatatcaagattgtttgattcggaccgctgcgcgcagcgcaaaaaaatccggcggtcgcgcaacgcggattcaaattgtcgcggtcgcgaatcgcggcctcgtcccacccctgttaagtcctaagcagtaaaaaattataaaaatgatttaaaatgctttttgagcgcttttttagtgtggccttgaatccatgctggatttggcacttcaatcccggcactttttctgcctgaaaaagggcaagcgccccgctaattctatttttgctacccattcgattctgactgtttttaagcaattttgagtttgggggtgctagtgcgtttcgtaaaacggccaccatgaaaactaccacctatgcgcgtttcgtaaaacggccaatgggctcgaaacaaaaaatatgtaaaacctaaaattcataacttggctcaagttcaaccaaattaatatttaatggtatcattcaatagctttaattgttctctatcagaatatgattttttaaaattttttacttaagtataaaaaaagttattgtcataaaatttcaaaaaacataaagtcaggaatttttgtccagaactntttttaa

SEQ ID NO: 2726 - DNA, 3410 bp, Heterodera glycines
  misc_feature (43)..(43): n is a, c, g, or t
  misc_feature (99)..(99): n is a, c, g, or t
caaatcggtcggctgcgatttggcaatcattagcttctctttntcggattcatagccgcgcaagttgtcaaaaattcggaaaaaaaacctaaaatttanaaatgaatttttatggaatatagatagctaaaaaaattctttttttttcatgaacttaactcttgtaaatttttaattttataatttcagatatggtgggggggatttctgaaattatttttggcataattcaatttagaaaaacctaaatgaaatgaataaaatattgatagttaaatattttgtttttttggtaaaaaaattctcttttcatgaacttagcttttgtaaattttttaattttcataatttcaagtatagtgggggattatgaataattttgtcaaacttcctacccaaaaccaaagtaaatgttaccttataagcgattaggttcgataatccgaattttgctctgccacaactgtcaaattaacaaattgcatttttcttacaaatttaatccactcactcgccactcaaagtcaactttatgtaattgaaagtgggtggagtgtgggattgcatcagattaggtttttgaactccataacgaaagtgaacggcgaagcgccactcataccgtaatcttcttcatgtttgtagatttgtatactgtaaatttaaaaaagattttatacatacaacgaatattatggataaaatctgttattaattagccgtttaattggttaattataattcgggagatacaaagtatggaaagagagggaaacgagagagtataagatagtgagggaggcgcgtgggtcccccagacgactcaccgcttccgaataaatggggaggacgatttgggaggacggatcccgggccctgggatcgatggttaaatcccccaaattgcctcggtgttaaaagactaatttattctccggataaaatagatgatcgaaatattccatgaacggacgagatgagaaaagtgaattaatcaatcgatggtaaatccgatgactccgacgactaactgatcgctggggaaaggaaaagtgtgaagagaacggaaaaggggcggggatgaaagagataagaaaagcgataatggaaagatggaaagtccggctgctgagggaaatgaaattgttttgagggtgggccaatcccttacaatattttaattttttgtgtgttttgtcattttttacttttaaagaagatttttatgatcaatattttaattgatatttatcgactttcataatatgtttattcttgatttctttaaacactatatttaaaatttatttaaattttattttacctattatctgttcaaaatggtgttgtcctagaggttattatatatatattgaacatattttaatatttatttatgctatttttctgtacataaacttgtattcatttttttaatcttgatgttatgccagcaacgaatcgtttacggaagttctctgttttaatatgtttggtaaagatttaatcttgttgcaggcagttaaatggtattgaacgagccttaacataatttttttaatacaagaaacttatgttaaaaaatgtatgttataattaaattttttattcatcaaaaattttgcctcatttagtttatcttttaataatttttgttttttttaaatatattgatgtttaattttattttctttaccaaaatctttaaatattttgttttctttctttattttaatcttgatgtcttctgacagcaccagtcttgattttggtagtttcctgttttaatatgtttgataaagatttaatctagttgcgggcactttgttggtatttttcgagcctcacataaaattttattatttgtgaaacttatcaatataaattgctgcctcaattttaaatgatgttataattataatttaattttaatattttatttatatgcatatattgtcctatgtatttagtttatcttctttaaaaaatatgttgccatttatatttttaaaattaaacccattaagcttgaatttcaaatttccacgcacttatttgtttttcattgttttaaagattaaattttttcttcacctttaaataaaatcttcataactatttcatgcttccagtctacgtaggttttatatagttatactttgatccaaactcatcaaaggatccaggggccttatgctcgtctcgcggtttagtaaaccacggttaacgcattaaccacggtttcgttaaccgtggttaacgaccgaccttaaccggtatgctcgtctttaaccatggttaagtaaaccatggttaactcaaccgtggttaagagaatttatcttgaaattgaaaaataattaatattaaaaaaatataattaaattattataataattattttttgtttatattatcaatattagcatagattttattaaaaaaccccgaaaagctattaaatcaagaattggttttctaaaaatttttggccataacttttttaaacacagtaatttttttttaattttgcaaattaatagaggattcttggggctatagaatgataccaagaatgtttaatttggatgcttcaagaaaaattttgctgcattaaaattgtcaaattattttttttatggtcgtgtgaactgcaatggagccaaaatttcttggtaatagtgcattacaaacaattacgttgttatgcaacatgctacaaacagcagcaattttgtcaccttttttaaaaagctattttagcggtttgggcgtgttcaaatttttttgatgaaataacactaatccgtcaataatttatatcatagacaaaaataaaagtcagattctttttctgcatgtaaaattaccatagaaaaaatttatttatttattttactatttaaattattaaataaatttacgttaaccacaactcgagttgtggttaagattccttaagaaagattaaaccacggttagatgagcataccggttggaaataaaccacggttaacctgcgttaaccgtggttaaggaggcagtaaaccacggttaactcaaccgtggtttagccttaaccacggttaaaaagggaaggacgagcataccggttaaggatttttaaccacggttaacgccgttaaccgtggtttagctctaaaccgcgagacgagcataaggccccaggcttcaaggagcctgtgttttctttcacctgtattttcgtctgcttttgtaccagggttgttccgggtctgccaaatcccgaaacccgacatttttctcgtcccgaaacctgaatcccgacgatgttgggttgggtttcgggacaaaataagcactggtaagaaaggggtctgggtcaaaattaggtagaaaaagaaattggtggagaaaggagaattttt

SEQ ID NO: 2727 - DNA, 2785 bp, Heterodera glycines
taatttggcattacacatcctgcacatttgcggatgaatttttgtgatagatttttgacagaacaggccttaatgtacagtatccatacataaattattatctaaatttcatgtgccgaaaaattgttttttgcagacttaaatttagcaagcacaaattgttttcaaaattttttgtatggaaccataaaaaaccggtgatgcttaatgttgctgtttgatggtgatgcttcacctgtttttcaccaattttcatcgtcaaatcgtcgtcgggtaagctgctggaaggcgccgggaactgacttaaaaaatgggggaaaaataagaaaaaatggaaaatgaaatcaattagtgatcggaagaatccatcccaaaaatgccttagtaaaaagcgcgtcagtcgcatttagtttttcaaaaatatacatatgaaattctaattgactcaaattaaaaaaatcagttatttcgatcttattattaatcaatcacattttcttttttgtctcccgctttttgagaattcggataacaattgatgaatcattagcaatgttgttgtaattaacttcactgcccttgttcagtgtatgggtctaaatgatttaattgattaatttatgcattttttaagtttgatcatttctttaaacctacactaatgatttgttgtgccccatttgtgtcccaatcccaacggacaatttgtgccaatggctcaaaattcgacggattggaagaagaagcattgccaacgtccgtgatttgcaatgcgtgaaaatcgcttctcataaattcactaaaatatataagtgattaatttatacccaaatttttttttgttttttaaatttttttattattttaaaatttcaaaaaaaatgaaattacagttcagcaaatcggatcatttcccgaaatgaagtctttccagtgaattggccagagaattgaccgatcgcttcttcgtcaacaacaataaattcgtcaaagatttccatttaatttatttcagttgaaaatttaaaaatatttttatttaaatcgcatttttaatagaatttttcggaaaaaacgccaaaaaaggcaccaaaacggaaaaatgccaaaaaaggcatttaaggcatgaaaatcccgaaaaggcaaaaaaaaaggcataataaaagtcaatgtataagcctcaaaacaagtgggaaaatgcctaaaaagtcaagctaattattagggctgtcaattttatgtaaatacatatttttttcctggcttctccatgctcaaaatagcaggaaaacactttcttttttgtgtttgcgaacaaaaaccgggacttttatttacatatttttacatatttcggggtttttatacatatttggtaaatattttggactttttcttacatattttcatttttttaacatattttgaggatttttacggaaatttttggaaatttaaaaaaaaatccaaaatttcggcaaattttttgcacattttttcatattttttttcaaatatttcgagaaattttgaaaatttatagtgaaaaaataccaatgaaaaataccaaaaaaataatttttaaaatactaaaagttcttctaattgtaagactatttaagtaatttttatggcattttgaagcctatttcatactttacgatgattttttcccaaaaaaaaccatttaaaaaaaatttatttacatatttggggttttttgtacatattttgggttttttcttacatatttatgtacatatttggaccactttttgtacatatttttgacagccctactacaaaagtgattttggaaaataaataatttgaaaatttaaaatgaaatttaccaatttaaataattttgttatttaagagtaaataattctatttaaaataaaaacattatcgcttattagacaactattttacttttatttatactttttgggtgagtcagtggtaattggtaatttgggaaatgattgatgcccaagggcaaagaacagcactaagcagtagagatcggaccggtcggtttttttcagtatttttcgattttcggtttttaaccgaaaaaaaccgaccgaccctcttgtccggtctctactaagcagacagactgacccactgctgcagacatctcgcagcccctgagggggaaattgggtgggcttatatatatataatggcaaaattggggatggactttggatgggatggggggtaatgacggtacgacagaaatggatggcaaatgcaacagagcaacagagaggggaatgggatagaatgtcacgataagagtggaaaatgagaaggataggcattattggcttgggattgggggtcgaaggccccctaagaggccgcgaggcggccgaatgagtaccttaagcgcgggaaaattagtaaatgggggagggggggggaggagtaagggcgggggaagcgaatgagtgggccgaaggccccataccagggatggcattccgaggccccaaaaattttcggaaatcggtaccatctctgcccatatgaggcctcgatgtggccgagtgagtaccttaagcgcgggaaaacttaaggcccgcctgtgttgaaagctgcccagcgctttccagggccctggttaactagtaaattaaaaaaatcggcggaattccgtttcccgttattaattgtttaagaaactgataataaaacaattaacaaatttattcataccatcattaattgacttcataatggaaacccgtggctaattgatccccactaattg

SEQ ID NO: 2728 - DNA, 4666 bp, Heterodera glycines
  misc_feature (109)..(110): n is a, c, g, or t
aagtaatggagcaaaaaacggtctattaaacataaaatgcgcttaagaatctcacgagtttcctcctcaaaaactggcgctgttccatttccttcagcgtccattttcnncaccgtcatctcatcatcgttagcatttgaagtaacagacaaaattccctgaaaagaggaaaactttatacggaaaaagatttccaaatctatcataacagtgtcttgttaggtagttttgaggtccctgatcacgaatctgacaaccttttttgacgaatttctaatcccgaacccaaaaaaaagtcaaaattttcaattaaaatttttttttgtattgccggaattggtcaatattttttgacatagtgtccgcttggtgagggggagtaaaagcctaattaaaccacgaatctcttgctacgctattgaaacagttgcgcattctctccctccctcacctctttgccctccagcgatgactcctcaaaggcgtgcaaattggcgttggaatggcaccgggaggacgagccgttgtcactgtccccgccgctgcttttcgacaccgtccgtcgtcgatgcctttgcgcagccttacggtgcacaattacctgaacatctactagattgcattgccaaaattgagtaggaaaaggattcggttaaatgccggagagttttaggcatttaaaatgcctaatcggcgtggtatttcaataaaatgttgggattaaatgttgaaaaagttagaattccgtttctaacacacttcggtggagagttcctcggccggcatcgctgccatcatccatttgttgttggcgtgctgatacgtggccgaaaacaaactgttgtgcatgttttgacgccgttggtaatgatggggctggtcaaaagtgccaccaaacaatccggcatttgccaacagaggcggatgctggtgttcctccagcatcgatggggtgggagtaaacggactccaagtcgtccgccattaccattgaagcggacgaattgacctaaaattgtatacaaaatgactcccaagaaaatggttaattaagggagtgtaagaaattatgtgtgcctgttgcctttgatcatccgcagaaactgtttgactcgccctctcgtcttccccgcactgttcgccttcgtccaacagcagttggtccgcgttcatgccgaactcggccaccatttgttgttcgcccgaggcgattgccacttcgtcgtcggcaaggaggacagaggacgaagcggagggcgaggaagagccaatcttagtgcgtattgacatcggtttaattgtgagggcttcacatttgtcgcaaccttaaagcctttgccggtgggcaacactccgttaaaagagggcgaagagaaaggcacggggagaggcacagcggcggattgaaaggcgaaggctgtcaaatgaaaaacccataaaaaggtcaaataaaatctgtttaatgggtatgggtgcttatgatgggcattcacgactactaagtctcacaaaaaatttgcaaccaatcggatagcttttttgttgctcttttttagtgtagtttcctaattttttggctctgtgggaaaaatggaatatttttagccattttcgccaaattttgggggttttgagacaaaatttttgggaaaaatacaagaatattgggtcgtcggagaaattttggcaaatttgttaagaaaattaggtaaattttaaacaaattagatatttttttctaagaaaatctttttttgatttgggtagagggggcaactgttcccaccctggttactgtctaaacactttttgcaagtagcgtatcatattttatacgattttttaaaatttaaatgcacctccaattgacggagcggttttaatgagaccagcaagagacaacggagacggagtccacgtattcaacaagctaaaaatggataaaagggcaaaggagggtagaaaatggttgcgattagcccacaccaacaaaaagacgataaatgctgacctcgagttggtcggagctgttattttgagcccattaattcgctttaaatgaacacccaaagagttaacgcattcggagtcacggagaaaggcatcgtcggcataaaattgtctttaatttttgcataatatttagaaataaattagccaaatgaaagcacttacttcatctgtcgggtgtccttcacaaacatgcttatgtaatgatccagggaatattcgttgagaacaatgcgaatccatgcctgaatcaaaaatcccacaaaaatcaaaaggaaaatgccaaatgttataacccttgctcggccgatttcagtgtgaatttggttgagcgttgaaatttgcgttttgatgcttcgctgcgtgtatttggagacaaagggccagaaattcttaacatttatttttttgttaaaagtcatttccccaaagtgggcataaatttcaatttatccctcgatttacccaataaattatctttgagacacaattccaattctccattttcttactggggatggccgattcgagtgccgtgaacccttgagaaaaaaagcgtctctgagtccatgtatgaaaacagcttcgatgacagtgcacaatgcttgtgtcagttcactggaaacttacaattagcccaatgcttaatttgattcaaaaagaaccccggaatccgattgtccacaaaatcagcagaagaggaagtcacaagatcaattgtcgtgttcaatttccataggattgaacgttttgatgaatttgaaggatcaatagccccttcattttcaaccgaagtttccatctggaattcagattatttttacgtttaaatcgttagggtttttggggtcggagaatcctactccaatacctatttttcatcacaaatacacaattgtaatttcgtttttagaatgagtaacttttctgagaaaagaaattttggcgctatatgaaaagtgacatattttgaaaattttttcaaaaggggggacccttttgttttgcaaaatttttttgtgatagtcataaaaatgtattctctggggtttttggagaccccgatcacgaatctttcaattattttgatcaattccgatttcctaatctaaatttgaacaaaaaatcataatttgaaaaattaaaaatttcgatttttattcgagttcgggttagggattagaaattagtcaaaatacatgtcagattcgtgattaaaaactttgcaaatactttttcccattttgctgtcccaacccccgccacaccatttgcgtagtaaaatttcatgttttttaaggaaaagtgagtgaatggaagaaaatgggggaggggagagagctttataaattaataaaaatttagaaaatgggaaaccgtacaaatgaaccaataaattcgtataaaagtggttgctgctcttcctctaccttccattattattcattcgccattattttcgtctctctctctctctgactttttctccctgacaatgtcttcaaaaatgattctgtacgtttttcgcatttcttctcaacatttactcttttccatctcattttttttagtctcatcgctgtgccaatgtttgtcggcggttgtgccattcttttgaagtattgggaccgcctcaaaaaaccagcaaaaccacgagaaaatcacaaaaagaaaatgtaaaattaaaatgccaaattcaattttaaatttgttttcaatttaattttaaatttttttcctttttttcagtttcatctccgccgattgttggctttgtgtgttcgatttgctgccgccttcccaacttggcctcggaattgcaatgatcagtcaccgatttggcatttacgtggacgaacacttcaaaacacgcaaatgggcgctgaaatttattcaaattcacagcaaaatcagggagaatggcaccaaggaaatggaaattgtcaagaactatggaaaagaattgccaattccgcaaattcaattgccacgcaaagtcatcggattcgaatgcatcgagattttgtaaaattggcgattatataatagccaacacttcccatcttttttagtttcatcaaccaaaatgtcatcgcttttcttcaccgttttcgccaactcttcgccaaatgtccaattaatttgtccatccacacgaacaatgaccgcattttggacttcattttccacaacatttggccaatgttcggaaaaaacattaatcgcttggaattatccgccgcaactttccaccgtttgcgacatttcgtcccgtcaattctcaatgactgtccatcacttcgcattgtcaaattctgtgacgccgacaatttcttccccgaatttccggccgatgacagtgccatggcgtcgaatggacaaacgatggccaaatggcttttcactgcccttcctgacaatgtgccgaagatgttgaaatgctcgttggacaaagatgctgggaatttggtgcagaaatttgaagccttcaaaacggtgcttacgaattgatttatttgacactttataatctttgggattcatttttcggacataaatcttattaaataaccatttttccatcttttaggcatttgccaatgcgtcttcctctgccaatttcattgtcgtcatttggtttattaattggtctttt

SEQ ID NO: 2729 - DNA, 4717 bp, Heterodera glycines
ccgcgattgcctattcaaaaattcaaatataattgcctttctattaggcttctcgacacaactcccggcgcaagtgatcagcagcagaagtgaatgaaatgaattgttgagaagtgaccgatcaatttgaattatggaattattaaagtgctcataaaaattgttcctttttgttgttgtttgttgttggaatgatcaatttgtgtctgtgtaaatcattagtagggttgcaaccccgacccgaaccccgacatttttggccattttcggggaaaaccccgaccccgaaccccgacgcttccaaccccgaaccccgacccttaaccccgatcggggtcggggttaaatatacactcctaagaacggaatttttgtgggggaaaaagcaaaacatttatacaaaaattgattttttttaaccatcttgacaaatttttatgaaatatagtaaattttgcatatgttttcttatatttttgtggtttagtggttgttgcttcaacactgatagcacttttattatgagttcgagaccggttgactgtttcctttttaatttatttttatatgattaataagattttttaaaccaaaaatacctattaaaatcaatcatccttggcctaatttatagacgtattgaacccaattttattttctttgaataaaaattcaattttttgacaaaatcatgaaaatttacaaaaaaaagaaaaaaataaaaatttaccagaaattcataaatttttggtgaaaatatgttacaaaatagaccttaaatttcaaaattcacccggcgctgcctatcggcatcgccggcgccacaaaaaaacctattttttcttaaaaaaaattggcccaaaatcgaaaaaatctatcattttttggacaaaatctgttaacaggcccatccaaattttcaaaatttttcacggcggcgcctatcggcaccgccgaacccatttctcctaaacgtctttagaaaaagagcgccgcaaaaaaaggaccaaaaaaaagatttatacagattttcgctgaaaattggccattttaaatgccttatgtgtttttaaataattctatacaaaatatttatgataaaaaaataataaaaagcacataaaattattattacgaaatttaaatatttttaagcaaaaattttataaagttttttgactatatggtataaggcaaaaattgaaaaaccccgaccccgaccccgaacgatttgtcaaccccgacaccgaaccccgacgcttccaaccccgacaaccccgaaccccgaattttccaaccccgacgtcggggtcgcaaccctaatttaaagtaacaaaatacctatatataaaaattttaattaaaaaaataatattatgcgttaaagcattttcaaaatttaaatattaaaatttttagaaataaatgatttaaaaaatagattattttatcctattctcaatttataagaacccccaaatacattttattcaattcaatccaataaaaaataattattgtcatattcttcattaaaatatggaatatataataatttaattaaaaattaaattattttatgttaaagcattttcaataatatatttaattttttttagaaatagataattgaaaaaaatagattattttacaaatccaaatttctcaacttaaaagatcccagaaatacattttatcaaactcaatccaataataaataattaattatcatattctttattgacgctctctttctaattgcaatttgctttgaatcgagatcaaagataatcgtacaattaatataattagcaaaaaattcagaatttattggatagtccaacatgaggggtggtatgaattaattgaaatttaaacaattttcatgtatttcatcgaccttacattttttaaatgaccataaaaatgtgacactttaattacttatttgctagtaattctttttcagaaacaaccaattttaatctgcttataattttgaatataacatatattgttaattttatggatttgtaaatcaatatttggtattttgctatattttaaaattattttacaataggataaaaaacatattggaggtcgtagacaaaatataggaatgaacgtatctattgcaagggaatttaaaataatcaataattcttctaaaagtagtacgaatcaatagaaaaataattttaaatatttatttttaaagattaataattttgatataacctattatctatagcgcacaaaagagtaagaaaaatgtgatgaatacaatttttttatatttaaaaatctgattgagggaatatacattttttacttcttttaaaagagtaaaattcaccatcgaaaaataatttaatatggctattttaaattcaaaaaaacataaatattaaaacattaaaatatattttaaaagcaatttaaattaaatcttctattaaaaacattcataaataaaataaaaatgtctgcctataaatcatttttacccatttaaagagatgaaaagcatgtgcatatgattcataaatgaataaatagtttgtctgcaaaataaaataattattatttaatataaagcgtataaaaacttaaacacttaagtgaagataaaaaatttaattttaaataagattaaaaaataaaaatactatttaaaccaatttttaaaagaaaaatttagaaaatgcagcattttgtttttaagtgctaaaaagttgcattaacccgaatttttttttatttggatacaaataaactaatgttatgtgaattgttaaaaattcttgaaacttttgccaaaatttcaccatctttcttttttcggcttcgatcagaaaactcgacggcataataaaaatttgaaactcagacttatgaacagattttcacacatggcacacgatacctgggagacttgaaattttgggacccgatattagggaccaaatgagcagaatgactcatgattagggcagcaaaaaatcccgaaatcccgaaatagttaactaaaatagtgagtaaaaatcccaaaatagtgaagaaatagtgacaaaaagtccaaaatagtgacgaatagtgacataattttcagccaaaaattaaaaaataataatttttattcactatttgcagttgcaaatgagtaggactgggatttttaagaccaaaaaacccaaaatagttacctaaaaaaatttttaaaattaaaaatttttgccaagaaagtaaatttttgagaaaattttttttcatttcataggagtatattttgaataatttgttgctttgatacctttaaacactcaattcttttgtttatttgctgcgattcttttaaaagaggtttattaagttctaaattataattcttattttactatctttatttaatttaataatatttggatttatttaatatttatttatttaatgttgtatctttgtaattaaatcatggatttccacagcatcattgtatgatactctttgagttttgtgcctgtgattaattggttgtttattaataaaaaataaattaattttgttttttttaatattgtaataactttattattcaaaattttatctactattatattatatttcgtttaatgtaaagtaacgaaaacgtttttcggaattttaaattaattttattaagaaaaattgttcaaaatttcaaaaattttcaaccttttcctccttcattgtataattaacttttaaatgtttacaacgctcggagtccccaatcccccgaattagtgtcggggggtcgggggcaaaaagtcggaggtcggggacctcgggggacgacatgtcgggggtcgggtcggggaatagatccaaaaaacgtctcgggtcgggtcgggggccggggggctcggggtcggggctgaaccctagttaatataaaatgattaatatttttggattaaaacaagcatttcttttaaattcttttctatttcatgcgaatacgctccacattgaactcattttgactgtttctttatgaattaaaagtttcattaacataaaatagatacattttgtcttcataaaatatttggggatttactttattttatgtaagaatattttttgttaattttttattttttatatgtcagttttttatatttttaacgttttcaattcgaatttaaatccattttttgtttattaaatatagcattttatttattcaaattggaattaacttaagttcaagcatttaaattttttatattttattaagttgtcaatgaatttttttgttttttaaataaaactaatacattttcttttggattttatttttaattaagtgtcgaataactgatttttttaatgatttccaatttccttctcccaaagcagattaacttaatattttattgactaaatattttcatatgttattaggaatattaaaatgtttaaaaatttttagttaaaaaatgtaaatatgattattaaatttttttacttttaaaaataatattattatgaaagcatctttttatataagaaaattcgcgaaatatgtaaataaaatatgtatgtaaaaaaatgcaaaaatatatatgagatatcagataaatatttaaattacgtaaaaaaccataataattctctcattaaactagggagatttttcattaattaattaactaaatattttagtgaa

SEQ ID NO: 2730 - DNA, 1865 bp, Heterodera glycines
ttttttcttaagaaattcatataaaaaacagagaaaaatgacaatgacagtcattttttcttcaaatattattattggctaacaatttcaggcaaatgccatgcaaatgcttttcattctttgcttttgagcacctccatattattgcttctctaaaattccaattgttctttcatttattttttcacacacaaaatcaaaaaccaaaactaatccatttaaattgaccagttgtacagtttttttctcttgaatttttataaagaaatgattgatttctttcaatgattttaatcagttttactaagctaatttaaatccaccgagaaccatcttaataatttgccgcgacaaaatgtcagacaatggaaatgaagcggaggacgaaatggcacaagcaatgtaaaattaaattaaaatgccaattttcaatttcaaattttgttttccttttcttcagtttcatcgccgccgactgttggctttcggtgttcgattggctctctccgcgtcaacttggcctcgaaattgcactgatcaaccaccaatttaacatctacgtagacgaacacttcaaaacgcggcgctgggcgctgaaatccatagaaattttgcgaaaaattggagaaaatggcacaaaggagatgaaaatagtcaattacgctggagaagaagtgccaattccgcaaaagccgttgccaaagagagtcgtcggattcaaagccatttcaatagggtaaaatggatgaattaattgttttcaaatgtaaacgatttcgatcatttcattttcacagatacatcgaccaaaatgtcatcgtgtttctccgccgttttcgtccgcttttcgccaaatgtcaaatcaatttgtccatcgatacgacgaattatcgcattttggacttaatttggtgcaacatttggccaatgttcggaaaaaacattcatggcattgaattgtccgccacatttttccgccatttgcgatattttgcgccgtcaattctcaacgaatgtccatctcttggcattgtctctttctatgctgaggatatgttccccgaatttccgcccgccgatgaaaatgccgcggcatcggatggacaagcggtggccaaatggcttttcacaccgcttcaaaacaatgtgccaaaggtgttgaaatgccagttgacgatggatggtgggaattggtcatcgagaattgcagcatttaaagtggtacttactaataatttgtttatttggcacttggcggtctttgggatttgttgataaattttttaacattttaggcatttgccaatgcttcatcgcccgtcaatttcatcgtttccatttggtttcgttcgtcttttgcttcatccgttgtgccatttgtgctgaccaacgaattgactcgtgaacaattggcattggaaaggattaacaatagccatcgttttctgctgatccgttgtccaattgtacgaaatgcgagccaatggacaaaatgggagaaggaagcatttaattggcgaatttatgatcagcggaacagaattaacattgaaatttttaatgaggatgacatcggcgattggtcagcgaagaatttttcaaatttattttttgcattttcaatttttaggcttatcgacgaaactcccgacccgagtgatctgcagtagaagtggatgaatgtattgttgagaagtgatcgatcaaattatggaattattaaagtgctcataaaaattgttctttttttttgttgttggaatgatcactttggatttgtgttatgccattaggacaatttctgtataaaacttcacaaattgcattatcattaattttatattgttccctggcattattctttc

SEQ ID NO: 2731 - DNA, 4058 bp, Heterodera glycines
  misc_feature (22)..(22): n is a, c, g, or t
  misc_feature (60)..(60): n is a, c, g, or t
  misc_feature (109)..(109): n is a, c, g, or t
  misc_feature (3799)..(3800): n is a, c, g, or t
  misc_feature (3806)..(3807): n is a, c, g, or t
  misc_feature (3812)..(3812): n is a, c, g, or t
  misc_feature (3817)..(3817): n is a, c, g, or t
  misc_feature (3827)..(3827): n is a, c, g, or t
  misc_feature (3834)..(3835): n is a, c, g, or t
  misc_feature (3837)..(3837): n is a, c, g, or t
  misc_feature (3840)..(3840): n is a, c, g, or t
  misc_feature (3849)..(3849): n is a, c, g, or t
  misc_feature (3851)..(3853): n is a, c, g, or t
  misc_feature (3859)..(3859): n is a, c, g, or t
  misc_feature (3870)..(3870): n is a, c, g, or t
  misc_feature (3872)..(3872): n is a, c, g, or t
  misc_feature (3876)..(3878): n is a, c, g, or t
  misc_feature (3880)..(3880): n is a, c, g, or t
  misc_feature (3882)..(3882): n is a, c, g, or t
  misc_feature (3886)..(3886): n is a, c, g, or t
  misc_feature (3889)..(3890): n is a, c, g, or t
  misc_feature (3907)..(3907): n is a, c, g, or t
  misc_feature (3909)..(3910): n is a, c, g, or t
  misc_feature (3916)..(3917): n is a, c, g, or t
  misc_feature (3924)..(3924): n is a, c, g, or t
  misc_feature (3927)..(3929): n is a, c, g, or t
  misc_feature (3931)..(3932): n is a, c, g, or t
  misc_feature (3943)..(3944): n is a, c, g, or t
  misc_feature (3952)..(3952): n is a, c, g, or t
  misc_feature (3957)..(3961): n is a, c, g, or t
  misc_feature (3964)..(3964): n is a, c, g, or t
  misc_feature (3971)..(3971): n is a, c, g, or t
  misc_feature (3985)..(3985): n is a, c, g, or t
  misc_feature (3995)..(3995): n is a, c, g, or t
gggcaaagggtgtctattcacntcgagcgaaatgtgaggccgggtggaaaagtcgatgcnaactcgggtctttccattctttttcattacggccaaaatcggtgctgcncaatggctgactcatcggtttgatggctccaatctgcaaaagccggtccaactcttcgttgacggcattgagggcgccgtgtgggacgggtcgtgccttgcagaatgttgggtgagcatcgggtttgagaatcaaatgggccttggctttggtgcaatgacctaatccggggccaaaaacttcagaaaaatcagtttggagggcctttgtgagcgattccaaatccgaaattttgtgcgttggctgaggaatggccatggcgttgatttctgctggggctggttgagcttttgggtggatgtcggggtgcatgatttcacgcgggatgacttccaaagcctcaatccagggcagtccgaaaagatcgtaattgatttcggaactaacgtatgccacaagctttttgggtgcttgattgggttggcaaacggtgcagacaaattttccttcgacgttgaatggaacttcattacagttccgcgtttcaatgtcgggtttgtcgagttttggagaacccagctttttccacgttttgagtgtgagaatggtggcctgagcaccagtgtcgatgttcatcaaaatcttaattccattgatgatgaacgtgagtcgccaccagcggcctgctgcggttccaattcccatgcagtgggatttgacaacgacagtgtggacggatcgctctctgcgatttttcgcttggttggagctgcgtcggcatgcctttgcaatgtgcccttgtccttggcatttatggcatgtggcttccttgaatcggcaatccgtacgccaatgatccgattctccacatgagccgcacggatgagttggtgatccgcggcttgccttgccgtaattggtgtttggtggacgcgcgggttgcccctttgcattgttggccctcttgggttgttgcggtgttttgcctttcgggtccctccactgttgtggccgggtgtgaatggcatgggttgcaacaggaggatttgccaaagtgagtgcgctgtccttcaccagctgaatggtccttaattcctcttcaatttgcttgagcgtgacttgcgtgccgtttttctgtgcttcttcgagcatttttaggcacttttggcgcaaatcgtggtgctcgtcgcgtagtgcaatcacgaggatgatgcacttaagttgctccttcgtcaagctgaggtcggcattttcacaagcggcgttgatgtgtgccaccaaggatgtgatgtcttggctcggcttttgtcgaatttgaaagcattcgaagcggcggacgaaaagtgagcgggtttcggcgaacaaatccttgagctttgtcagcgattcgccccatttaacctggtccggttgggacgggctaatgctgtctctgtatttgttgtattcgtcgtcccccaatttgccaagaagaagccgaactttggtctgttcggggagttcctttccgtcctcttcgatgagcactccaaatcgcttaaaccaccggtcaaatgtgttgccgcattccgaatcgtagtggaatttggtgatccggttgtccaaggagctggccagagtcgcgtgtgccagtgaggatgaggccgcgtttgcaggtgccgcatttccggcaaatcgtgcaaaaactgcgtcaagcacttgctgcagttgggtggcgtccattggctttgactcgtccgatgatcagcaattaaccacgcagagtggctcctcacccgcctagggactattggatgtcgaaattgaagaaaaccgcgtcttgcggaacctcacccgcctagggtctattggtttttgtcgaatttaaccgctaaatttagcggacctcacccgtcttgggactattggttttgttgaggttgggttgcagttcggtgtgtcttcgaatgggtgaagcacggctgctgactgcgccaatgttgtgtctcaactttggacacacaataaaataataaacacaatttatgtcggaggtcaaatgcagtacaaaatgtaaaatagcaaaatgaatggagaaggaaccatgtggggaaggagggagtgcttaaataaacaaaatgaataagggggagggattgacacgtcacaacattaatcaataatcgatgcgcgccaaattcaaattctttaacactccaacacctcccttctttaagctgaaccctcaggggtttggcgagaagcggatcggcgctttccgttggcgttgcgatcgacgcggggccaaaggaggactcggagatcgtcgctttgcctgagtccgtcgaattggtgccggttgcggaggaggctcgcggatcggcgatgggtcccggtcttgctcttcttgagcctggggtgggatccttaccgtatcattaccgtcctcttcaagaggataacggtgacgcaattggtttgcgtgccgatgtacggctcttccgagtgccggaacgtggacacgatacgtcggggatttttccaatcgttcgatgatggtcccattaagccaaaatcgttttccacgattaaagttcaaaagcaaaacgggatcttttggcaaaaactcaaccgattttgatccgtggtgttgatcaaattgacgggccatttttcgcgcataatcagcttgtgatttgcggattttggctgggtcgatgacttcggcttgttcttccttcggatggacgagagacagctgagttcgaagccttcgaccgaagaacaattgatcgggcgaaagtccgttgagtgccgaattcggggttgtcctgtaggcgagaagcatcttttctgcccaaaattttccatctttggcgcatttcttcatggcccttttgaacgtatcaacgaatctctccgcttggccattggattgcgggtgatacggcggggtgaaggtatgtttgatgccaaactcgctgcaaaattccttaaattctgcggcatggaattgagtgccattgtctgacacgatttcttctggaaatccgaggcggtagacaatggatcggaggacttggagcgttgctggtgtcgaaattcggtccattctgtatacttccggccattttgaaaatgagtcgatcaaaatcaaataggagtggccatctgaacagggaccggcgaaatcaatgtgaatgcgttggaatggtcgtgagcaagacgtccatggagcgagcggtgctttgggtggactcttttgggcgctctggcaatcttcgcattgcctgaccatacgctcgatttccaagtccaatcctggccagtacacgtgctgacgggcgagggctttcatgcgcacaattccggggtgtgccatgtgtagagccttgatgatgcgttcacgaagttgggtcggaacgatcactcgctttccgtagagcaaaactccatcaatctctaaaatttcctttcgcttaggaaaataaggtgagatatcggggtcggtgcacttttgaggccagccgtttttggtgtgatcagaaatttttcggaggacttcgtcttttggcgtccattctgaaatttctgctttcgtgatcggcaattgatcagttgcagtttggaggatggtgttgatgtagcaatctgtctctgtgcagatatttgctatcaaaatgtcttcttccggccggggataattggcgattaagcgggacagtacatcggcttgtccaaaggatgacgtgttgatgtactttatgtcgnnttcgtnnttggncctgntccgtgcccngcgctgnngncgncttgccgcntnnntcggtnttccctttttngngccnnntntngccngcnntggcttgtggtccttgngnngcgtgnntttcctnccnnntnnccttcggtggnntttctggnccgcnnnnncgngggcccntgcttcctttaggntttggctgtngtttttctgtgcgtcgttgcgtatctaatggcggttcaatgactttttccgatttgtccgtaa

SEQ ID NO: 2732 - DNA, 2846 bp, Heterodera glycines
tggacatgatcagtgcccagcgttgaagacgactcgccgcataaatcggtattccctttttggagccaaatatagccagcaatggcttgtggtccgtgagaagcgtgaatttcctaccaaataacattcggtggaatttatggaccgcaaaaacgagggccaatgcttccttttcgatttggctgtagtttttctgtgcgtcgttgagtgtgcatgacgcgtgttcaatgactttttccgatttgtccggaaaaatgtggctgattgtggtgccaattccgtcttttgaggcgtctgcagccacgacgattggaagaaacgggtcgaaatgggtgagcaaaaggtccgacagcatgatttctttggcctttttgaaggcagtttgctgttcgtcggtccattcccatttcacgtcctttcgcagaagctggtccagtggttcgcggatttcgcgcatggactttataaaccttccataataattcaatgcgcctaggaatgagcgaagtgtgctcaagtcatgtggtggcggcatttggcgaattacttctgatcgtccggggtcggggcgaattcctttcgcagagatgacgtggccgagaaatagcaattcgggctggaggaatttgcacttttccaattggattttaaggccaaattcctggattcgtttgaagagtttgtaaagggaacaaacgtgctcttcaagcgttttggaggcgattatgccgtcgtcgaggtaggcaaacgcgcctgggatgcctgagacgatttggtccatcaaatgttggaaaatagacggcgcagatttgacgccaaatgggaggcgctggcattggaagaggccacggtgggtgtttattccacaaaggtgtttggattcctcatccaattccatctgcaaatacgcgtctcggaggtcgagattggagaaatagacggagccgctgatggccgtgtaaatgtcttcaggccggggcaaagggtgtctattcaactcgagcgaattgttgaggccggtggaaaagtcgatgcaaactcgggtctttccattctttttcattacggccaaaatcggtgctgcccaatggctgaactcaatcggtttgatggctccaatctgcaaaaggcggtccaactcttcgttgacgcattgagggcgccgtgtgggacgggtcgtgccttgcagaatgttgggtgagcatcgggtttgagaatcaaatgggccttggctttggtgcaatggcctaatccggggccaaaaacatccgaaaaatcagcctggagtgcctttgtgagcgattccaaatccaaaattttgtgggttggctgaggaatggccatggcgttgatttctgctggggctggttgagcttttgggtggatgtcggggtgcatgatttcacgcgggatgacttccaaagcctcaatccagggcagtccgaaaagatcgtaattgatttcggaactgacgtatgccacaagctttttgggtgcttgattgggttggcaaacggtgcagacaaattttccttcgacgttgaatggaacttcattacagttccgcgtttcaatgtcgggtttgtcgagttttggagaacccagctttttccacgttttgagtgtgagaatggtggcctgagcaccagtgtcgatgttcatcaaaatcttaattccattgatgatgaacgtgagtcgccaccagcggcctgctgcggttccaattcccatgcagtgggatttgacaacgacagtgtggacggatcgctctctgcgatttttcgcttggttggagctgcgtcggcatgcctttgcaatgtgcccttgtccttggcatttatggcatgtggcgtccttgaatcggcaatccgtacgccaatgatccgattctccacatgagccgcacggatgagttggtgatccgcggcttgccttgccgtaattggtgtttggtggacgcgcgggttgctccttggcattgttggtcctcttgggttgttgcggtggtttgccttttgggtccctccactgttgtggccgggtgtgaatggcatgcgttgcaacaggaggtgaagccaatgtgagtgcgctgtcctttaccaattggatggtccttaattcctcttcaatttgcttgagcgtgacttgcgtgccgtttttctgtgcttcttcgagcatttttaggcacttttggcgcaaatcgtggtgctcgtcgcgtagtgtaatcacgaggatgatgcactttagctgctcctttttcaagctgaggtcggcattttcacaagcggcgttgatgtgtgccaccaaggatgtgatgtcttggctcggcttttgtcgaatttgaaagcattcgaagcggcggacgaaaagtgagcgggtttcggcgaacaaatccttgagctttgtcagcgattcgccccatttaacctggtccggttgggacgggctaatgctgtctctgtatttgttgtattcgtcgtcccccaatttgccaagaataagccgaactttggtctgttcggggagttcctttccgtcctcttcgatgagcactccaaatcgcttaaaccaccggtcaaatgtgttgccgcattccgaatcgtactggaatttggtgatccggttgtccaaggagctggccagagtcgcgtgtgccagtgaggatgaggccatgtttgcaggtgccgcatttccggcaaatcgtgcaaaaactgcgtcaagcacttgctacagttgggtggcgtccattggctttgactcgtccgatgatcagcaattaaccacgcagagtggctcctcacccgcctagagactattggatgtcgaaattgaagaaaaccgcgtct

SEQ ID NO: 2733 - DNA, 8949 bp, Heterodera glycines
tgtacgacgcgtccaaccccacccaaactaaataaataataggcaaacattaacaactatgataccgtatcgggtgttcaataagccaacggctacaaacttctctgaaaaagcaattccaatcaatcagaactctctcagacaatcgagtgatctgtatttgtgtgtgaattgggagaccttaataggttattacagccttattttgcattaagctcaacttagtgcccaacaatatcccaagagtagcccctttctaagttggaaatgggaattctcgaaaaaggatccggcacggatcgacatcttttgtcctttgtgagttgggcatcgccattggaagccatcagtaggaaaacgtcaagcatgtcaaataaaggttttaaggaatatgcatttggaaattaatactttaaatttatatttgaaggtaaaatgcaaaaaaatgggccatttggagcaacacaatcaaacagcaaaacatatcaaaaattgtgatcgttttttgtcgtcaaaacaaaagcaaccattgatcagtcaaccgtttgttgttgataaatttgctgctgaattgtgttcaatgctgctttcagcgaatattcctctttttaaagtgaatacatatattcattttttaacaatttaactttatttaaggtaaataatccttcattcaaggcttttttggagaaatattgtggaagatccatcccacaccatgaaaccctcagaagcaattatgtgaaaaattgttttgaaggggtaaaatttgaaattttttgattgaccaatttttttcctttaggttttgtcaaaaatcaaggacgacattggcgaaaatggattcgtttggtgttcggttgatgaaacgacagacagaaatggacgctgtatggctaatttgcttattagacttctgaatgaacgttggaacgcgccgcatctgatttcggtgaagccactgttggacgaaaatggtgacccaaaagttgatcatcaaacggttgctcgttttgtggacgagggtttgggtgtgttagacatattaatgttttgattttatttattttagcggatttgctatctacaggagcaaagaaaaatcggcttctttttatggtgacggacggcgctgaatacatgaagaaggcggctcggaatctgcgtgttttctatcccaacatggtgcattttacttgcctcgctcatggactgcatcgaatcgctgaagagatccgcaatcagtttaaagacgtcgacgaattaatttcttctaccaaaatggtgtttcgcaaagcaccgtcacgtgttgctttctacagaaagaaattacctacagttcctctggttcccaaacccatttatcacacgatggggcacttggcttgatgccgtcaacttttactctcacaatttcgaagacattaatgaagtgaatgaattggtttaattaatttttttttaaagtttcaggtcgttgattcatttgaccctgaggaggcccagtgtattgccaaatctcagagatgcttttcgatgacaacagtgccccttgacattgcctacattgcggccaattttggttctctccccggagcaattactcgtttggagaaggaggggcttacgatacacgaatgtgccaacattctggtgtgaagtccgcgaagctgtcttttcgtcaacggggagaaattggagcgaaaatccgtcggaaattcgatagcgtcatcgcaaaaaaccccgggatttgatacaatttgcgatattggaaaaattctttctggtcaaaaatcaatttcggtatgccccccaatctgatttcactttacaaatacgctcccttgacttcatgtgatgttgaacgatcattttcaatttacaaatctattttgactgacaatcgctcacgtctatcgtccgaaaatcttgaaatgttacttatttgcaatgtgaatctcaataatgatttggcataatattttttgctttttgaataaaattttgtcattttacacccctaaatttgaggatttttagtgcctattttccattttttagtgcctattttggggattttttagagcctaaagcctacctattttggcggtttttagtgcctataaattgcatccctatttattatatgctgtttggatcttaatacaaacattcgaataattagatttttaagtcaaaaatccgtcctaataaatggaaattcagagaatctatctttgaaaatccaatttttatttatcaaccttaagaaactaatttaaattaatgaattttaaaattattactataattttaatgcacattttttgtttttcctttgaaatgtcgacgagtaaaggtagaatcaggcatataaaaataaaagtttcaaaatttaataatattttgaagaattgaattgttggatgggctattcaatggtcggtccgccgttcggcgacgacgacgaatttggcccactgtttgagatgaattgcaccggcgaaggtgtgaaatgcatcagcacaaattgcatttttggtatttttaatttcaataaaaacgacttgacaatttattatgattaggaattaaaaattggaaacaaaataaatggaagcccaaaaatattacaaaacatcccagtcgatttaagattatcaaaacttacaaaaatgggctggatttcgctttcacatcattcaccttttggccctttcacttttcatcttttattttgagtgaaaggcaacgatattatatttctatgaatggcattttgtggagaatggcaaaaatattattgaaaaattgaaagtcataaattgcaggcaattttggcataaggcaaaaattaatttgattttcatttaaaaaaaaagctttacccacaaaacactgaaattcatttgtttttggatcatattataatatcaacaccaaagttataaaataaataatgttgctgaaaaaaatttcacctttaaccgttcgccattttcatatttttgggcgatttctcctttcactttttattttcgatttggctcattcctagcctaaaataccaaggccctcggaaaacactgagcggggccctgtcctggccgggctctattaattaataattataatgccatcactggcaaatagacaacaagcacagcggcaccgcgctgcgttaccacagttgcagccgtgacgagatgctatggtgccgagcgcaccaattgcactgcgagaaaatgttcaacggaacggtgtccgaatgtgcgaattgtgccgaaaatctgtgcaatgccgaaaatgcaaatttggcattttcagataaaacggtggtcggcacagcgatcggaggtgggacaatgttagggagggggtggaattgatcgcaaaatgatcggagttatttttgaaaacattttaatttttcagttttatttcttctcggcactttgttttactgccttctgaggaacagaaaaacttggcaaattcacacgttgatccttttgttctgttccaccattttaaaactctgaattttgtccaacaatttgttaattcgaattaaattttgcattgtaaattaagttgatttttggcgcatttcgcacttattccttttattttaaattttttaactttttctttaacactaattgaacccttttgctccactaattacccatttttcaactttcattgctcaccacccagcgaattcattgcttctttctttgggatgataaatgtgtgctgattgattcgctcggatgaatgaatgtccgcctttggttggtcagtttttgagttgatccattgacctgcttctgtcgccgatgggttgcttaaaagggcacaatgccatcaaaagtgcacactttgtaaaatgcgaaaattattcaacataaattttaataatttaaataaaatagaaattaaaaaaagaagaaatgccgcttttttctaaagaaagtataaatatttcatattttttagagaattctacttaatcaaatgcttaacgcgcaaaaaaaatttgcaatttttgtttttctttttgagttttcatgtaatttccttacggcaaataatgtgaacaaagttggcgaaggaaaacaacagcaacaacagaacgcatatgtgtcagtagatttgtctaaaatggcatcaattaaattattaaaaataaaaaaatatataaaataataggttttttattttaaaaaataatgaaagatctaaaaataaattaaataagtttgacatattttaagcactgcgccaattggcgggcgtcaaagggcgtatgggtaaatgaattttcatattttattataatattaatcatggtaaactcattacagctcagttatccaacaacaaactcttagctcatcaagctcagctgccaatgataataaacaaattttcatcggagtgcctacgcctccgccagtgccaccgattccgtacggttacggtagtaaagggtaaattctttttaattgacttaattaaatcagtccaaagcaatattataaaaatttagcatttcgcaaaatcaaactgccaacgatgcaccatcaaatagcaaacaaatttaccttggtgtgccgacggcgccgccggtgccgcgcgtgccggtacagcacgatgaccgtagtaaaaggtttttgtggggtttttaaattgtttatgacataggattttagtatttctcaacaacaaaatgccgcaattgacaatgagcagtcaaatggtggtaacaataaacaaattttcatcggtgtgcctacgcctccgtcagttccgcgtgttccggtaccgtacggttacggtaataaagggtaatttttttaattggcttaatttaatcagtccaaatcaatattagacatttagtatttcgcaaaatcaaactgccaacgatgcaccatcaaatagcaaacaaatttaccttggtgtgcctacgcctccgccggtgccgcgcgtgccgtactcaaaccagcagagagcagtggccagagggtcattaaactctatttttaaattcatggaatgccctttttcgatctagagttgccctgaggccccagcaaagtgtcaattacgcgccgacgcctccgcctattccgccaatccccgcaattccgtattacccttaccatcaggcaaaacggagatccatttccgagaacgacgaacccttttcgatgagcaatggaccgcaagtaatgaatgagaaggaataaaattttaaatctaaatgtttttgtttaattttgttcattaattttaattattttcagcgaattttcccccgcggcggcaacaacaaatacgtctacgttcttcataatcaaaaagatgctttgttgcgttaagaaattgcgcttaattatgtatttatcaaagaatttttaattatttttagtttagtaaatcttttttaattggccacacataattatgaaattatttttttaaattaaattttaaatgctctttgacctctaattgattgattggctaatgagtcgcataaacaaattcacttaatttgatgggttcgaaatgatggataaaatatccgatgaatggacagttgtcgttcatttttactcatttactgctgaattccaatcgccaattgttcatttttctcattttttttgtcaataatttacctcaaacgtgttcaagtactctttaaattttaaaccttaaaatcccaatattaaagcctttgatccgaaagaatatttctctttccatttttaaagcattaacaatttaatcccaaaatcctttaaaatttagtcaatttttttaaaattccgccctctaaactctgaaagaattcatgaaacattaataaacaattgaaaataaattttatttttctttgttaaaactagggttcctccccgaccctcatggagagaacagtcggggatcgggcaggaaatcacccagaaaaagaatggatccatttaaataattttcaccaaaaaattgatattctatttttgattttttggttgcttaagaaaaaaaaagaaaactaaatttaatattcacggtggcaagtcattttttttaaagcaaatttgtggtaaataataaatttaaaagcaaaaagacaattcttttgtgccaatgccctcctccgattacgcggacaatgaggcggacgatcgaatcaaagcgccgccgagtgaacgctttctgaactattcgctgtttcacaattactctccgtacggaatgcgttcgttggcctacgattatgccaaatacgcggagcggaccaaatggccggtgaagaatccgtgcggcaccatccaattcgaggacgagccgcgcacgccgcgctttcaattttggagtccgttgacggcacgatacgagtgcagttacacacagaacgtatgaggaggacgaaagcagaggatatgagcggactgattgatcacttaccgatcagtatgaattgattataagacaaaaaaaaagacaaaaaaaacagacaaaattaaaatggcttattgaagacgcatgaaaatttagtttttggcatcttttttattcgatttgatgaagcctgcccatgtttttgacaaggttttgtaagcgttttaaactgaatgagtcaagagaaaaagtacaatatttgaaaccaaacaaaaaaatttttcaatatgaagggattttaattaaaaagaaaaaaaatattatcgacgcccgtgagattcgaactcacgcggggaaaccccattggattagcagtccaacgccttaaccactcggccagagcgtcatgtcaagctaatgcttttttttttatttcaatattcattttatctagaaattttctccattttttttattttaaagtttacaaaatgaatgcaattataatattataacttttataaaattgctttatcataaataaataaattagaaaagagaaatataaattgagaaattctttttttaatgttttgaaaaattatttatttatattcgattttttatctgtaaattcacaattatcatttaattaattttgctttcgttagatcattcccggattcgcatcataatccaatacagaaaaccgacgaaacatcccgtggaggacaaaacagcgaaaacaattgcaataattaatccggtggaggccaaaaactggaatttggctgcttgttgctaaaaaatgtttgataatcaacaaccaattgtgactcaataaaataaatgttttgaaaaaagattatttgactaattttgcccgccgtgcctctccttccaattcgttaaaattcagtgaatcattcccattgcgttgcaccacagattgggatgtgcaaacgatcattaaaaagaggcaaatgatttgaaaaacggatgggacagaaaacatttctgtaatttatagaaattctattcaaaaaaaggtttaactgattaattaagaacaattaatgaaaagcacaaaaaaatgtatacaaataaaaagtgatggcgggataaattccaagaacgacagaaatgcgcggggggcggtggcggcgatgggatggattaagcagcaacggacgacgcgtcgataaggaaggatggaaatgcgatgggatgggatgaacagcggaaaaacgagttgggcggaacaacaaaaagaaaaataataatggacggagagaagggacgaatttggacaagaaatgccaacaaaaccatcataataaaaaataataattagagactaattaaaactttaatggacaaaaacaatgacaaagcaatggaaacggtggcagacgaaaagttgttgattagtttgattaataatccaatgcaatttatttactctctctctctcatacaaatttaattacccatccgaaaattcattgtgacaattgacaattattttgggtcgacaattaagaaacgtacaaaaaacttcacaaaaataagagaaatttcttcagtgtaatcaattaaattacaaaaattttgctcatttgtcctattaattacaaataaatttggttccaattccgatcagtcgtcccttctccgcttttcctcctctttgtcgtgtcccgtgtcgatgggccttttctcgagataaagactacacgtcttttggtccccgtccatgcaacagtaataagagggcaacacgtcgtgccaccaatggttccacaacagtgagccgcggtcagcggtgccggcaccttctgacaattttaaaatttattaattaccactaaatatttatgattttaatcagagatattctgtaaaaatggataaagtggaagggtccggaaaacggcccgatcttggtcaattaaaattaaattgtttagtatttctaagaatagaaatagcgaggagtccaggttcaatggccagccctaaggctgtttggctgatcagtcagtgcccacccgttccatcggtgatcagttgcccgtttctgtagcagcactgctgtccgcccgggtcgtcccccgtacgggcccattgccaaacggaggcccaaaagttggcggaagagcgaaagcatcggtcggcgcccgggtggtgcacgtgtggtggcgatttgtcctcggagaaggtgccgttgcgcttcgcctgctgctcagtgggcggacagcggggcaggcggaggtgggcaacgccgcggtcggaggcgaaccattgccggcacttcgctgcccttttgtcggctgtgttgtaaaccgttttgatcacattggtggagactgaagtggtgaaaagaaaatggatactttgctcaattctcagccaaatttgctcataatgagcatggctaatggaaaacataatttaatttggtgcgcatctctttttgaaatgttcattgaccccagggttttaggttacccttaacttttttcatca

SEQ ID NO: 2734 - DNA, 954 bp, Heterodera glycines
  misc_feature (40)..(40): n is a, c, g, or t
  misc_feature (943)..(943): n is a, c, g, or t
catttttcattttaatataataattattttttgggttaantttcagttcagcaaattacaagtctaaatttgatgatgttttgggttgatggcattttgggtatgaccatttaaatttcatgtagttctcatatttttttgaacaaaaaaggacgaaatatttcaatttcaaggttttgattttaagaaattttttttactaaaatgttttatttaaaattttccattttccggccgagaccatagaatgtgattttcaagtagattgcttaccgagaaaataaataaaaacaaaaatttttctttcaaataaaataacttttcagttaattaaaaatttatttaattttaccaaacttttcagcctttggcaaaaatgaaaattgatgagctgaacaaaaaatgaaaagcagcagcacgatcactttgtgggcagacataatgaaaaaaaattattgtctaaaaaagtagggatgtaagggcgaggaaaggaatccgcggtattccgaggttcgatcccggattttgaaaagcatcccggtcccggtagggagggcaactgggaaccatgaaaaacaagcactggtaagaattggggtccgagagaaaaacagtgaaaaatatttgaaagaaatgtacatttaatttttcgctaattactaaatttctttttagttggtttttactttatagctttttttaacaaataaccccaacaaaggaatgtgaaaacattttgagtttaattcttttttgttttttgttaatctggatttgaaagaattggcaagaaggcctataccccaataaatttttaattctttttttgtccaaaaaaccttgaaaattttattcccttttcgaactttttgaaaatttttcaaaaggtcggccatttggatgcatttttattgcatttttggtaagaaatttttaatgccgnaattaggggca

SEQ ID NO: 2735 - DNA, 6160 bp, Heterodera glycines
cggtctgcccaatggtcaattggtgaggctaacgtccattaactggctaccgccttgatggattagtcacacgtgaaccccctcaacgcaaccttgccattgaatacatggggtgcttttatcatggtaaaaaaaaaggtcgcccttttcaaccgaacaaaaaaaatgcttaaaggttgccccaagtgttacgctaacgacagacaacaaaaattggcaggtggaaggacagccgaagacctgtatgaacgaaccaagaggcggctatttgaactgcagaatcagcatggctttgagctggaagttgtctggggatgcgaaatgaagcagcgtctgcgtgctgatccagaatttcgccgggtgtacaatgactcattcgttccaagaccgcttgatccaagagaggatgcactacgaggtggacgcactgaaccgtttatccttcagtacacttgcagtccagacgaagagataattctcattgacattgtaaaaaaaaagttaggagaaacaaaaaatattttttcattgttaaaggtgagcttatatccatatgtgatgaaggcattctcgtttccggttggtaacccacgcgttctcacgcgagagacacttctatgcgcaccgacatcaccgcttccctggtgttctgtcgacgcgaacacattcaaagggctgttgtttgttcgtgttctgcccccagatcccgctgtacacccgctaaaagttcctttgcttccctatcgaactaccgacgggcgcctaacttttccgctttgtgcacgctgtgctgacaaccgacaacaacgggcatgcaaacacattgatgcgtcaagggcatgggtttccgcgtaattttatgaaattaatccatgtcaatttactttttttgtcccggtgtttagatacacccatgttgaattgaacaaagcactggagcttggctataaagttattgatttatttgaggtaaaaataacgtatcgtttattagactaaactttaaaaaaaaaaggtatggcattatgaagaatgggataaccaactgtttcgtgactatatgaacacctttgtgggtcttaaagttcaagcaagcggttggccatccggttgtgataccgatgaacagcgcagagcctatgtagatgaatttaggcgggttgaaggcattcagttggaccacaacaaaatttcaaacaaccctggacttcggatggttgcggtaaaaaaaatacagaattacaatttttaaacttaaaaaaaaacacacacacagaaaattcttgcaaactccctctggggaaaacttgcgcaacgagtcggtggaacggaagttcgttatacccgaactccagctgagtttcatgcactgctcgagaatcgcaacatcgacattattgactttcatcacgtctctcaccatatggacagagtggtagtgaggaaaaaggctgaatttgcaaaagcaccgtcaaccaactgcttaccaattgcaatttttgtcacttcatatgctcgtctacacctttatgactatatggaacaagtgctgcgtcttggtcataagctcctttattgcggtgagccaaaaaaaaaaaattttttttttcacctttattgacctattattcaagataccgattcaatttattacgtgacacgcagcggtagacagcaggtgcctgaaggtgaagcgctgggacagatgaagagggaacattgctcgaggcgaatatacgaatttgtgtccggtggtccaaagaattatggttttcgccattgtgatcgcataaatggagaggatgagcgtgctgaattgaaagtccgaagttttcgtctctcatattctgcgcagcaactgctcaacttcgagtccatgaagcgcattgttttggaacattacaacattgatggacaaatgttaacacatttttctctcacataataatccagaaaaaatacaataaaattctattccacagagatgatgtgctggacatggaaggtgttcatgttgtcccgggaagcaacgcgtcgataagaatcgaatttccacaaattggccgaactccatgttcggatctgtacacctacgacgctcacaaagactaccaacctcattatgtgaaggggcgcattcgccccagcatggaaactgtaccattcggatttcgtgaagcacaaacggttcaagaacaagctgaacatcaccaacgacagctgaatgattttgataacaacttattaattgttaaccttcccggatgctcaaattggaatcaataaaaaaaaaaaaatgtaacacatagtagaagaagaagaagaaacttgcaagcgtttgtcatacagaaagaaattaataatttacaatatctaagaacaatcgcaaggcatgagacagatgttcctgctttttggatcctgtaaaaatgatttttccagaatgataggctaaacatgtgaccaaagcgtgatgattgtctacaacaatcttacaacgcatagcgggaaaaattgtgggatcatattggatgttacgaaatctgtgtgggtccagtgttggtataaaattcaacagaggcaaacgatggggtaatgtgaatgaaccaactatgtttgtcacacgtatctcatggagttctaactgagagcccaaagcatgctgcacccttcttctgattttttgcgcctcgcgtaccgctctgtttggacaagggacacccgttaacaccgcacgggctgatcgaaatagaagacacgcaagagtgcgttgttgaggcagacgcagtcgtataatgattgcatggaatcgttggggatcgtactccgagttgaatccgttttgagcaattttcaaaaactctgtgtttgtgaagggcgtccgctgtagttgaaatgtcactgtacaattttgaatagttaacatttattttttttaatctgacattaaaaaacgacaatatttgaattaaaaaaaacacccgttcatcatgcatcatcatcatcatcacatcactaaatcatggttctttaacaacaacaacactaagacactcaagcgggaacagagagctatgatcaccaccaccaaattgaagaacacatggcagttgggggtaagccagctttataccatgctttacatagtagtagacgcgcacctaaagtgtattgtacacatagattggttaaatttaaataaatcaaagacaaaccgtaatgccaagataaccgcgcatagcatatgcagtttgagctggatgaattgtcagttcgttgcaatggacgcgaatgtttttccaggcagggcgcagatgattggtgcgtaaatgaagattggaacgcaacatttccgaaatttctctacgtttgctcagcgtctgcagcagaacgtgaagctcattcattgaacatttgtagtgtttgcagagaaaatcaatcaacggcacactcttctgcttttcattgcaactgcacttggtttgtggttgcgggtgctttggcaactcaatgttgtctaaatttaaaaaactgtttttaatgtctaaaaataactaaataaacctttcacttgttccagttccatttgatcattttgcaattccctcgcccgctcctcctcctcctcgatgattttaagccaactcatttgtccttcctgaaaatttattttatttttttactaatatagttttatttataaacttttttcataaaaaaaaaatacctgtgttgctttatcttcttcttcatttcctgttgtcatcttttgttccgggtacgcattgtggagccaatcggtcgcaagaatcgcgtccatttgtttaatagttaagagattattattattattatttctgtaaagctttattgtgtatatataatattttttaaacatggataatataagataaaccgttttgcaaaaaaaaaaaatggcagacaattttcaaaaatttgatgaaaaacacttacaactcagacacccgtttacgctgacaatctcagggagcacggggagtggaaaatcggaatgggtgctacgaatgctgaggaatgtgaatgcgctagtttcggaacccatctcggagattttctactgttatggggagttgaatccaaatataatacagcttcagaaaagtggacacatcggcggttgtagggttattgtacatgctggaagcccaaccgaagagcaggttaatcggcgcgcaaaagagtgtgatggaaaactgttgatggtgttggatgatctcatggttggattgggccaacaatttcttgacactgtgttcacccggggatcgcacaattggggggtcagcgttgtgttggtcactcaacatttgttcgcaaaagaactgcgggttgcgcgcaacaactcccactatttggtgctgatgcgtaacccggcaggcgcgctccaagtgcggacgctcgcctctcagctatttccaacgaaaagcaactatttcacggaagcataccgggatgcaactgaaaagcaatttggctacctactaatcgacatgcaccccgagagtccggaattgttgcgcctgaaaacgaatatatatggagagcagggtggtcttcccccattggtttatgttgcaaaatgaagcatgtcaaaagaagaaaaagactaacagataaacatactatgaatgttagcccgctgatgttgaaaaatgctgacttcttacaccactttcgctcaaaatatcgctcaaaaagcagacagcgcaaaatgatagagaacgctttggatgagcagttgctctgttttgtggagatgggtttcaatgtgttgaagggtcgtgttccgttagggaagcgacaaattcaacggttggatgcattgaagcaccagttgaggcgcttagcacgcgcacgttgcgcaaaaaccgcgcgcagagtactattattgaatcgtcaagaccaacaacaacaacaacaccaaaccggtgctggctttccggtggtagccagtatgctgacaagcattctcttaccaatgttaatggacaaattactgccaaaaactaattgataaatagataaaaaataaatatataaaagcgaaacagctaagagagcactcgtttaattaaacatttagaagagcgcaaaaaatgcgtcacgcaatgcgaatgtttctcgtcccggaggacgtctttcagtcggtatttgttcaaccccaagcagcaacagcagcagcagacggtgccgacggtacaccaattgggcttttgcgctcacgcatccaacaaattgagcgtagcagggagctgaacgaagagcagaaggccgcgcaataccatcaggaattcaaacggctcaacaaactggtgcgcgagcaggaggagcagccgatcaatgttcgacttcagcacgaaaaggagagagaaaaaaatgcagcaacgccgccgccgccgccgccgcaaacgatcgatcattcaacgccaaaaagattggagaaaaacattgtaccatcagcgtttgggttgaggaggcaaagacaccactacacacaaaaggcgggggcattatcaaatcgcagacctgcccaaaaacaacaaagaaaagcagcagcagcagcagcagaaacaccaaacagcagtggaaatggagaaacggaaaaagaagagggtgatgtagatgatggggaacagtgggacgacgcacaatcatcatcgtccacggtgtcaacaggtggtgccgcaccaaaaagagtgctcagagcaagagatggggaagcaggaaaaggaggaggaggaggagaaacggctgatcgccttcaaccaaaacacaactaccagatgacccaaaaatgcactgatcacacacattcgaaaaaaggggcacagtctgggagtcagtgatcagggaaaggttttgcgcgcagatgggtccgagtttaaaacgagcaacgtggaggcaattgtcagccattttgtgaacagggacaagcgaaacgaaattcaaaggcgcgcctgtgggctacaaggaatttgctgaaaaaggttagagaggatccgttgctaaaaaaatatttgtttcccgaaaagcctctacaatttggcaaaggcctgactgacttttaggcatggaaaagggacataaaaaagaagtgccaaacggggaagagggaaaa

SEQ ID NO: 2736 - DNA, 798 bp, Heterodera glycines
ttattttcgaacgcacttttatgtacccgaaaactgattctgtaaaacaacaagcttaaatttgtcattgtaagtttttgaaccggcttaaaactcgaaaaatttggcatttctaacttttttaaatgaacagatcctgaatttttggcgaaaatctgaaaatccggactccaataattgcctcaaaataatcactaaaccggatttttccaaaaatcaccggttccgttttccgagtccggtaaaaaccgggcccggctcggtctctactaatgatgatcaaacctaatcctgaatttaagcctaaaaaaacaattaaattttgtgccatttatgcgtttgtcttggttttgccttttctttatatttgaaggattattgctttttccccattttaacagacattcccttcgcttctcccttttcgttcccttctgagccgtcgtcgtcttcgaccagtaacagcagcagcaacgagaacaaccaaagcaacgaaatcaccgccagtggcggcgctctttccgaggctccggcgatcgatggtttttaattttcaaaaaaccccaaaattttaattaatttcattcctcttttttgatgagcttgactacgaaattggcaccaaagtgttcgtccatcgtgcgcttggcaaagtgttatatgtccaaccggcggccgacgacattcggcaaacgacgggtgccattggtcggtttggagaggaattattggcggggtccataaaaaccagaaaaaaatcttcggagggatgaacccgccgaagacttttttttgccc

SEQ ID NO: 2737 - DNA, 2050 bp, Heterodera glycines
  misc_feature (11)..(11): n is a, c, g, or t
  misc_feature (1956)..(1956): n is a, c, g, or t
  misc_feature (1969)..(1969): n is a, c, g, or t
  misc_feature (2012)..(2012): n is a, c, g, or t
aaaaaattttntttgaattttttttctaaatgagaatctttctgaaagacgaatttttttcaaattttcaaaaaattcaaaatgttcataaaattattagaaatattttttgaattttaaaaaactaaaaaaaatcattttaatttcggtttaacggaaagttctaataaaaatgaatagagtccctaattctgttcggtttaacggcatttcaattttcttaattttttgaagggattgccaatgacatggagtgtttcccgtgccgcgtgtgctgttcgccggaccaaccccagcgcgtgttcctcacccgggcggggctggagaaacacgcggcggagcagcacccgcaaaagctggacgaactcagcggcatggcccagcacattcaggtggaggggacggaccgtttaattttcctttcaatttcttcaaaaagtaaaaatttttagtgccaaaattgtttttggcaacaccgtttacctcaatttgcgattttagtatttttttattcgacgcattttttggaacagttcattctctccaaaaaaaaattggtataaaaaattttaagaaaataaaaaattttttaagttttttcaaaatttcgcgtttttatttcctccccacgctttgtggcttcttaaaaagttcattttcagaatgtgtgggccaatcgacgatggcaccagcaccgcggccatggcggaggagcgacgatggcaccgccaccgctatttgccgtccccagcacaacgccggtggtgggcgactgttacgaaacgatggcgaatggcactggcggcgcactgccgccatcagagaattgcgacacggtcactcaccaggtcagcagaaaggcacgaaaaattgatacatttgcctggcgagagcgtggccagtggaaatctccgccaattaaatttttcacggcgttccaaatgggcgatttgggcgaaaatttgttcaaagggcaattttttttctaaagaaaattttggggtcgaagttaaagaaggttttcgaatccccctccaaatttttttccatttactggcctgagtggcgaattttttcatttaaatttcaaaataaaattggcaattttaaatccaattttatcggattgctccgaattttttcatttaaattcaaatttacaaatacaaatttggaaatttgtctaattgtaaggaatgcgcccattgcaacgcgctgttcgacacgcgctgcggtggccaccaaatgcgcgaccatttagcactgcaccagcagctacataatgaggaccaaattagtgccgaattttggcacggcacagcggcggtaagagaaagagagagactaattaacggacggattcgaaaaccatttagtgtttaattgcatttagtgtgtgcaaccagcagccgaagcaccgagtcaatgccaccaccaattggctcccaatgttgtccatgccgatgccgttgatccaagtctaagtgaccaccctggccatgatggcattgccaatgaccgttcccttcgcccgcggcgccgtccacgccaatgcctcccgcgtcgttacatgtgccattggtgcgcgcgaatgtttgacggaattgcgcagctgaacgcgcacaagcagcgcgcccaccgcggcattggcatggcagcggtgccgaagacggcgacggtgggggacgacagcgacgaagacggacagcaaagtggggacgaacgggtgcggaacagcggcgagagtggtggatgcgattttgctggcaccgcggaaccatctccacctccaccagcggcaggttgccaaagagttcgggaaattaatgaaagcaaataagtattttgggaaaacgggaaattttagccattttgagacaaaatttttgcaaaaaatatttaaaaaattggccatcagtggaaataaatttagaaagttttcatcaaaatcgttanataaattgagtanagttctaaaaaacacttttctaaacaattttttaatggctgancatgagtggtgtcagtggtgctgaccggagcaggttta

SEQ ID NO: 2738 - DNA, 3014 bp, Heterodera glycines
  misc_feature (38)..(38): n is a, c, g, or t
agagagagactaattaacggacggattcgaaaaccatntagtgtttaattgcatttagtgggtgcaaccagcagccgaagcaccgagtcaatgccaccaccaattggcccccaatgttgtccatgccgatgccgttgatccaagtctaagtaaccgcactggccatgatggcattgccaatgaccgttcccttcgcccgcggcgccgtccacgccaatgcctcccgcgtcgttacatgtgccattggtgcgcgcgaatgtttgacggaattgcgcagctgaacgcgcacaagcagcgcgcccacagtggcattggcatggcagcggtgccgaagacggcgacggtgggagacaacagcgacgaagacgaacagcaaagtggggacgaacgggtgcggaacagcggcgagagtggtggaggcgattttgctggcaccacgggaccatctccacctccaccagcggcaggttgccaaagagttcgggaaattaatgaaagcaaataagtattttgggaaaacgggaaatttagccattttgagacaaaatttttgcagaaaatatttaaaaaattggccatcagtggaaataaatttagaaagttttcatcaaaatcgttaaataaattgagtaaagttctaaaaaacacttttctaaacaatttttgaatggctgacaatgagtggtgtcagtggtgctggctgaccggagcaggtttaccaccactggaaaaatttttataagtaggtaactttaaaaaaatcagagtttttttaaattttgacgaattactaagtttttcaaagtatcataatccgattctcggctttatcattaacaccaatttgtgaatcgttttccgtcaaattggccaaattgtttcccctcccctcccattgctcagattttgtcgctccaatgcgccccattccctcagcctttgagcgtcgcgcgcggctgtcgtcttcgtccattggcatcgatgcgcccgcaaagttcgctatttcccgatttttgtggcttataaattttttcgtttcatggtccaatgccaactgtgcggcttggtcatggtccgtccgtcgctgctcgtccggcacatggcccgggttcatcaacggcacgccaacttcgacgcccatgtaacgcgggacactcacaattcagtcaaggggacaccggatttttacaactttttaaaaatttcttacttacaattagagtattttaaaaatttctctgacctagaaattttttaagaaaaaaactttaggaaaattttttataaaaaaatttcaagaaaaaaatttttaatttagtcagcgaatcttaggaaatttttgagaaaaacttagtaactcatcataaaattttgaaaatgttgttcccccatttcacacccaatcttcgtcaggtggtctatccgctttggccctccgtgcccccgttgcgctacgccgtcgacgaacatggccagctgagttggatgtgttgcgagcacaaattcgtggacaagtccgttagtaaggcccacgtctgaagggccaccacgattttaagaggatgggacgctaatttagagcaatttttttcatcaatttccgtcggatttaagacaacaatttttttcttccaagtttaaatttttaaatgaccatttccaacagaatttcaaaattttgactcaatttgccaacaaatttactcgaaaattatttttgatacaataaggcatccaaatattctggtctctccctgggagagctctcaaggtcgggttcatttatttttgtttttgacccaaatttttttgaatgtgtagtttttctttaatgatttgctgtccaattttcccaaaatgaccatttagggctgcactgcttcgtcaccgcgcgactgtacattacagcaacggaacacaaacaacagaaatgaccaatgcaatggaacaacgatgaggggagtggggaaatacttttttttgttgctatttttagaagaaatttttgtaagaattgtttatttcataattatagcacataaaaattggtttttaattgtttgaagtccaacgagagtctcggctctgtgggatgttttctcttccactctcctcgtctgtctgttcgtctgtcaccactcccttgcatttctctttcgctctgcttccactgtcttcctcctctgctgctgctgctgctattacttcgttttctctctcttctttcgctgtctgtgcctcctctccctctcgcgttgttttgtctgcggtgtcttcttcctctctttctctgtccccgttgttgccgtacactctgtccacaattttaccagaaaaataaatctcttaaaaatgaaaattttcttaaaaattcatctccaagatttaattaatttctttatttcttgataaaaatttttattttaaaaattatatatctcaataatgatttgatttaattttgttacttttttttataaattttgtcatttaatatctcctaaattcatgcattttaattttacattttaaataccaaaaatcttaaccttattcgttaattcactatatggtatttttattcactattttattaatttatgtaaatgaatttggaatattaattattaacttatttttatgttatttccatgctaagcgttcggcattgttcacgtcggcattgttcatttttcgaattatttgttatatatacgtcagggctcccatcgtccatcctccgtttccaaggacgggtatgccgatttgcaaggacatagcggggaaaattcatgaaattcaatgacatttaaaatttttattatatgcaatgcaaaatggttaatatttattcaaatggcttgtatttttcaccggaattgtttttttccaacatttttttgttttcacttatcattttcttcatttacgacgacttttttctgctttaaaaacgctttttttgtggcgcgctttttccaaaaattttgtgggacagaggggggggggggggg

SEQ ID NO: 2739 - DNA, 2443 bp, Heterodera glycines
tagagcccggcgcgggacgggatcccgcgcgggattttgcgggatcccagtccgcaatcccgcattttttggaaaatgcgagatttgcgggattaatcccgcgggatcccgtcccgcaaagaattttgagttccaatcccgcaggggatccgcaaatttgattttttgtgcgggattatgcgggattttattgatttttttgaaaatttttctaagacagaatgccaaatatttttaaataaattaaataataaatttaattaaagttaactcatttttcatcgcaaatttcattcaaaatttgtgaaatttccccggcggcacctatcggcaccgccggataggcttttcttaataatcctgtagaaattgagtcaaaaactgggtcatttggtcaattttagacaaaatctgttaccaaatcgcattaaatttcataaaatttctcgcagatgtcgataggcaccaggtatggcacggaaagacttccgatttccgacatttttggggtaggaattccgacttccgaaatttttgatgaaaagtcggaaatttttttaatttttcttttcaaaaaactagcaagttttgtacaatttctgttaataaattgaactgaaatttttaaaaatttcccggcggcgcctatcggcaccgccggaccctaaaaatccctatttttcttgcaaaatttgctcaaaatcgcaaaattttgtaattttttggacaaaatttgttaacaaaattttcccggcggcgcctatcggcaccgccggaccctcctccaagttcccaaaaagtttttgaaaaaatcgcgctgtataaaacgtgtaaaaatagtcactccttttcccaaaaatgttctaaaataatgaaaaatgacaaaaaaaaatttgataaaatattgaataattttttcaagcgtatactaaaaacatttgtgaaataccttttacttggttaagaattaaaaaatttagcctattaaaatatttagaaattttttattatattgtatattttttgaaaaatttccgatttccgacgtttttggggtcggaattccgatttccgacttccgaaaatttttggggcctcggaatgccatccctgatagggaccgccggaccctctgttcctagttttttgaaaaattgcaccgcaaaaaagtgggtttgaaaagaaaaaaatagtcaatttatgaaccgttaataatttgatttccgatcaactttttaccgtcggatccaatcgaaaaatcttagtcgacccatcaaccccttttaatgcatcccgccagcccttaaaaatttatttttcagcattttttgatttttggaaattttttgaatttaattgaaattttttcgaattttccaaaatcccgcaatcccgcgcgggatcccgcaaattttaaatgcgggatttgcgggattaatcccgcgggatcccgtcccgcaaagaattttcagtaccaatcccgcagcgggatccgcaaatttgaaatttccgggctctaactgggatcgacccatttccatgctgccgtttccataccgccatttccataccgccgtttccacaccagccatttccataccggccgtttccatgccaccgtttccataccgccatttccatactaatttgtaaggtgtttaggccatttccataccaaaaatttttcgaaaattttcaggtaaaattcaataaatagataggggtttttcaactgtttgatgcttaatatgaattataaattcaatggattctcttatcaacgttatagattggaaaatggaagcaattctaacaaaaaggaaccgtaccaagcttcaacacaacggccattcatacatttttcacaagccgagtgccgatggtgaagttcgcttttgggcctgtgaacaccatcacgcaaaagacatcacttgcaaagggcgccttcacactaacctcagcaacaacgttttgcgtgaagttggaaaccaccagtgtgaaccaagtgcagctcgaatggaagcacaacgagtgatcactggaatcaaacgccgggcggaacaaacaatggaaccaccagcgacaattcgctcattggcactccagaatgtggccacgccagtccttgcgcaactccctacgaagaatgcgatcaaaaaagttttttctcttttttttttgttatgagatttttgtgcttaggtaatcaagcgtgtacgccatggaataaacgcacccccgccaattccaaacacgctcacagacttaatcatcccagacatacaaaatgtattcgcgtacggacgaacagagcgagcaatttttgttagccgattcgggtgtttaccaagaaaacgggagggaacagaggtaatatacatgcgcactttttaattatttaaagtgcaatttagaatactgatatttggacgtgaatcgaatg

SEQ ID NO: 2740 - DNA, 2893 bp, Heterodera glycines
ttttaccgtcggatccaatcgaaaaatcttagtcgacccatcaaccccttttaatgcatcccgccagcccttaaaaatttatttttcagcattttttgatttttggaaattttttgaatttaattgaaattttttcgaattttccaaaatcccgcaatcctgcgcgggatcccgcaaattttaaatgcgggatttgcgggattgcgggatttgcgggattactcccgcgggatcccgtcccgcaaagaattttcagtaccaatcccgcagcgggatccgcaaatttgaaatttccgggctctaattaaaactaaacaaaattcaaaaataaaacggaagcaaaacgaatgcttgtcattagcagatacaaaataagtacgattgcataaacaaaaacttttcattttttaattcattattacatttatgtttgttcattacaaaattttgtctatttactaacatattagtagtataaggcacctttaatccggccccaaaatccccccccccttcccttaccaaaatccccccccttcccttaagtagtagtatatagcgtcaaaagcgagcgggttccgagcgggtgtttaccgcacaaacccgtgcctatgtgaggggtggaaccttttgaagatgccgccaagagccaaaacctatgggaggggtgcagccccttgaagttgccgcccgctcacatactgagcctatgggaggggtgcatccctttgatgttgccgccttgtggattttaatttacccaaatccgtgcgggtgtttttttcacccgcgccgcgcagcgccgcgggaaggtcatcaatcatccacctgtcacaatgtgacaggtgaagaaaattcaatttttcttttgcaaatttaaatctttttgatcccaaaccttttgggccggttttattttctcaaatcctgagattttttatgatgggtttttcggatcctgaaattgaaaattctttttgaaaattagccaaaaccgtgcggtttttatcacctctcccctccctccccgcccgtccggcgatgcgatgccgccgccgcgaaaagtaatcgataatggaatttggaagaagtgcaaattaattgatattggcagcaaataatttcgattatgaattggacaataaaattactatttaaatccaatttaaaagtaaaatcaaagaatgaataaataaattaaaaaactttttcaaaagtaggtcacctgtcaaccaaaaattgattgatgggtttttatttctcttccattatttccgggttccgagcgagtgtttcgcgcacaaacccttacctatgggaggggtgcagctctttgaagttgccgccccggacattttcccgcacaatcccaagcctataggggggtgcgtgccaaccgaaacctatgggctgtttctttgaagtctgccgccttgtggattttaattcccccaaatccacgcgggtgttttttcactccgcgccgcgcagcgccgcgggaaggtcatcaatcatccgtctgtcaccaaagtgacaggtggaggaaattcaattcttgcaaattaattccaaatctttttgctcgcacgcaaactttttgggcggttttattttatgaaatcctgagattttttatcaagattttttatcctgaaattaaactattttttaaaatttgctaaaaccgtgcggtttttgcatatcttcccttcgccgcgcagcgccgtcatcaatcatgcacctgtcactaaagtgacaagtaattttcaaaaattcatttttttattttgcaaatttaattccaattcttatttatttattttgaattttaatcaattatttgatcccccgttttccaattctcaattatttttgccacctccccagagcccctaaacctcgcgggtttctcgctgatgtttcccgcacaatcccaagcctatgggaggggcacacaaacttttgaagatgccgccctaaaattccatttccccgaatccgagcgggcgtttaccgcacaaaccggtgtctatgtgaagcgtcaaacttttgaagatgccaccaagatgcaaaacctattggggcaaaccgaaaacatattagattccctttgaagttgccgcccacataaattcgatttccccaaatccgtgcggttgctttttttgcacatccctccccgcgccgctgcgcagcgacgcggaaggtaatcaatcatccacctgccaccagagtgacagggggaggaaatttgaattcgttaaaaaggtgcttttttaaagtacccaaaaccgtgcgggtttttgcatttcctccccgccccgacgatgaggcacaatgcaggcgtcgcgcaaattaaatcgataatgaaattgtagaagtgcaaatttaattggtaatgcagcaaataatgccgataaataaattaatgaactggacaataaaattaattatccaaatccaatttaaaaacaaaatcgaaaaagaataaataaatatgatgaaaaaaaacttttccaaaagtaggtcatctgtcaataaaatatgattaatgatttttagcaatatgggccaaaaattttttaaaaatctttgattgataggctttccgtttttgaaacgatttcgcaatatggacccatttttgaaatgattaatgagttttatccttttccagcacaatatgcaagtgacagacccaaaaccgagcgggtaccggaatggcccctccaaaatccaaaacctattgaaggggtattttcctttgaagttaccgcccgcctgtcgctgttttttgaatgctgttcattaaaatttaataatacgtgtttaaaattccaaatcctagaaaaagagcgaaagtgttcttactgacataaagataaagaaatta

SEQ ID NO: 2741 - DNA, 3749 bp, Heterodera glycines
tttattctgttgcatctgctttaagagtttttttaaatttatggtttcaatgaccgtagagataaaagcgcaaattgccatcactgagcttgtaaaaagatcgtggagtggaggataatgccaaggaattttgcggacaaagtctgaacgaaaaaggcctgcttatcattggcgattagccttttgactgacagagtcaaagtgaaattttgagatttgattacggcaaaatgagaaaggaaatgtttacaatttacagacgaaagaatttatattgttaattaatgagatattcaaattttattatgcttttatatttaattcatcagttttaaatgcttttgctcaataaatttatttcggtgaaattcacacaatttattcagttaaactttgcttctatcaattttctttctattttttaagcttcaagcaaaagaaaagagtaaaaacgatttggaacactaaaaactaacggacaaatgagtcaaaagagtccgaactttggacctaaaaaaatgtttgacacgtcattaaattcccgcattttaacctcccaatcagccactttttcattacacttttatacttagagattaaaaaacaaatatggatttttatttaataatattagctaattggtcccatgggagtttggggcgggggttcaaaaattaaaaaaatggtaaatgattaattaaggtggtaaaaactcagaaagcacgccaaacccattcggagatgtgctttttcgcatttttccccatgaatctgttcaatttgccaatggaattgagcattagttcagccgaagcatttggcatttacacgccctttttcaattaaaactttgttttcctttaaatgcataattaatttctctttttttttacaaatccgctttttcctttcattgtctttgtcgcatttcgtgaaggaaaggcgtgggcagcgaacgaaccaataaacgccgtgggaaaaactgggaaactgacgaaatttactaacagattttataaaaaattaaaatttacacaattaaaaatttatgtccaacagtcgaagcatctcaaaataaggacaaatgacaacacattcaagggacattccgtccaaagaatattcattgaacagtaaacgttcttccattttggtcctaattaaaaaaatattttataagtaaaaattctgatcaaatttaaaaggtgaaataaaagaagtaaaaggtgccaaaatgtaacttatcacttgtaattgtttcattggattgcataagtcttctctaattatcactttttcgtccctttttcctccgtttccgtcgtaacttttgccatcctccgcttttcctccccctcccccccccttaggcttcgtcctttacttttcttcgtttttgcttataatcccttcgctctgaaaaataaacaatggacaaaaggcacaaaaagtgccgccaaagcccaccaaaacccaaatgttgttaacgcgcgtgtcattcgcctcccatttttggcgtgaccatttgtttctctcctttttattattcatttctccgccggtccctggcaaaattaaaatgcgaggaaaggcgtgcaaatggtccaaatgttcccataaaatccgtcctccccttttgttcgcatcccttcgcccgtccattcgtccgctgctgcactcttacgattagtgccaaacattccctctacacaatgctttatctcaaatccttatccccccttgagaccaaatgcgcagcatttgctggttgatctgccctaccaaattgacttttttttgtacttcactaatcagacaaacgaacaatatttatttaacagctgagaaaaatataattaaattcggcagattatccttttttccatttttagaataccgaaaagactatcccttagggttaaaggaactgaaaatccgaaagttttcttgactaagagataggttcttgagaagccttcccttttatggcacagtacccgagtatcaccaacgtttgtgtcaaggaactgtttgtcttggccattcgtccgttcgaatttcgcttcttcccattcccttggcctttgccaatggcttctcatctgtctgtcactgttcttacgtcaataattgctctttttgttcttcttctggcactccacggaactgctcccaatcagctcaaaattggagagaatggactttttgaggaatatttgcggtgagtggcggtacaattgaactttgaaaatgccattgaatttctaagcttttccatgttaagacaattggacaaacgaagtccgttgaaaaaatcggacggacttagcgattttgtcggctctctcaacggcgccgcgcgacttcgctacggcaaacgaagcgacggattaacggccgaagaaatcgagcaaattctttcgcttaatcggtaatagtgaagctgcagtccccgttttctaaaaacggtgcttttcttatcaccttcaaaatgattatttggttttaatttccgtatttcccagcattcgtcccgaaaaagagtgaaatttagcaagacaaacatttccaagtcgaagacaaaattggaaaatgaacttaaaatccataagggacatttggaataatttaatatactttcacaaaaattttaaaggtaaaatattcctgaaatatgggggatttataaaatatttaaaaatgaaaaaatattttttaattcatttattcgttcgttaatttactataaaaatttaaatttacatgcttttactatttgccatagaaagtggcacttttcgatgctttccatggaatcgtgtccaattattctgatcacattattgtttttggagtcataagctcaaaataaagatttttcttgtgaaataattaaacaaataaagctaatcggttgaattttacagatggaaaatgccaaaaagagttgccaattatgcagaagcattgcccatcggtttgctcgaccaactgaacggagcggaaaggttgcggtaatgagcggcgaaagtcacaccaaaaaatgccaatgaaaatttagatttgggcgaaaatgatttgttttgatgtgtcggctcttcaacgtcgaccacttcagccaaataattaataacccatgcagtgacaaaaataatattgacgaacatttaaatgattatcacgagaaatttatggcatggcactaaagtccgttaagaaaagatgacaaacttaggtaataaagtttagtcaaagacagtttggtgcttttatgcccatataatcaccattttattgcttaaaatttgcagccttagttgatcaattgaacaggcacaagggcatatgacagatgattgagacgaggggggggggggttcgagacaaaacttcatttgacggtccaaaatttctccaataacgacctttttttgctttacttttgacatcatttttttgcgaccgatgctgataagggaaaagtcgaaatttttattgtgatttgtaattagtagagctcggcctggacctggatttttcctggatgcaggtccaggtcaaatatgaaaaaatcaagacccaggcgaaaaaacgaaacttgtaggttttgctactccccccccccatacaaatgtcatgattccgacaaggaaagcacttttctagggtaattttaggcgctgatcacgaatatgacttgacaactgaaaaatctgtgattttatcaatgatttccatcatgcgatttt

SEQ ID NO: 2742 - DNA, 2655 bp, Heterodera glycines
  misc_feature (2568)..(2568): n is a, c, g, or t
  misc_feature (2624)..(2624): n is a, c, g, or t
aaatcattccggggaaaaatagaattgtggaaaattttctttttatttttttgtttgaatttttgtgtacttggatttcacaaatttcccccgttatgtacttggaaattggcatgcctgtacttggaaagtgacttggtacgatccgagccctgtatatatatatttaaaaaaaaccagtaacatgtctaaaacccaaaaaagtgccctgagggccgcggagaggccagccagtagagagcatgcgaagacgggggcatatcagtaaaaatttgttgggctataacttttgatagagacatagtagaaccctgaaacaagtaccattcgagactcgttacttatttttaaaaatcatagatttttgcaattttgaagtcagaatattgatcagcgcctaaaactaccctagaaaagtgctttcctttgctgagatcataacatttttatggggggtagcaaaacctacaagtaccgaaaaaacctggatttcctggacaacattttagaatttgttatttcaagtgactgatgtttttttcaaattttcaaaaaagtgattaaattgatttaaaaacacatttagatctttttagatgttcctatgcaattaaatttttggctttttaaaacaaattttaaaaaatccaggtccaggcctgggttcaggtctcgaggagcctggattttcttcatgaagtccaggtccgggcttttttcaaaataccgagttctagtaattagatgcgtttttttcctaatcaggcatcaaaacatatcttctttattaggcggagggaaaggggcagaaatttatggcccatttgttcaaaattataatttatcattcactctaacaaaaacaatgacaattttcacccgctaattgtaaggtatttttatcctattgtaagtcatcactaggagagagtcaaccacggaagcctaataattgggccgagaatgaggagaaacaattaaaaaacattccccggtgtgccccaaaggatcatcgtaaatggctcttccataaactgcttgaaattctgaagccaaacggcgcccactgcaccgtccaccactcggtgatcacagctcaaagttactttcagcgaagtgactgcgcggaaactgaaaacaaaagttatttaaaatctgaatactctgaactgttcgaaaaacaccgttcgtttgaatccgatttgtcttcctcttccatagggacgagcattcgacgcgcagcgccaattgccaaaatgcaggactgaggtgggtttatgatggccgtaaaatggtcgacacttccaaacattcccaagttagacacggtgaatgttcctccctgaaaaccgaaagtaacggagttggacaatgaaggtacaacttgaaattcatgcggctgcaatttgccttcacgcgctttcgctgccaatgcgtgcacttcgttgctgattgtcgcaacgcccttaaaattggcgatggaaatggagcaatccgttgcttggattaccttagtgtgtgcgtcgaaaatgatcggagtgatcagaccgacgtcggtgctaaccgcaaccgaaacatccaccgaactgtgctgccgaacgaaagagcccataaaggaggaattagcctcgggaacacgcaaacaggcgagtgcggacgcctttataataaagtcgttgatggacaatttcgaaggcattttttctcctttctttttggcctctctctccaacaaaatgttcaatttctttctgactctgaaaaagaaacgaaaacaataaacgacgaaacaaccaacttactcaagcaatttgtcaatttgcatttcagaagtgaggtaataatgtggaatcgtcgactttgcctcactaagacgcttcgcaattgttttgcgcatgttcgaaagcggaatatcgatgaacgaagaagcggagctttgagtcccacggctcggaaattccccttcagcctttgataaatcggcagccaaaatccgcccactagggccagagccagaaaacgactgaaattgagctgattataacatattaaatttgaattttttaaaatgctttaaaataaaactaatgtaaattaatctctccacattaccccataaaatagcggttttaccgcctatgatcgtttgacttgggcatttaaccaccttcctatagatcgggttcattttacccaccgaaaggtcaattcccttttcatcagctaatttcttggcatatggagaagccttgacacggctttggtctgacatcacattctgaggcgatggctgtgactgttcgggttgtgccgtggggagtgtcttttgcgtgagtttggtcgtttccggggtccctttggcttcgattgtttctggcacactttcctcgcctttgaagtctttgaaagcgttaacatcttcttgtttctcaacaattatgcataagagctaaaatggaaataaattgataatttgctctgaattgtcgtaaaaataacctttccaatgggcacatccttcgtcccttcaggaataatgatttttgccagatagccttcctccggcgnttcaaacccatcgtcgccttgtccgtctcatctcacaagcaaatcacctcgctganttggtcaccttccttcttttgcatgatatga

SEQ ID NO: 2743 - DNA, 1108 bp, Heterodera glycines
tttgccatgatatgattgtacccgattccattgttggactgagggcgggcaatggcactttgatatgagttgggtaggtaccttaaacaacaagactggcaagtgaacatttttagtgtaattgcgagcccctctttccataattattttttcgagaaccgccgtttagcaacccatttattcgaacccaaagttgaaaatctgcggtgtccatgtccgtgctcatggccatgcgcagcgagaacattgtactgagcgacattagttgacttgcaccgaatcacatcgataagcacaacatttgtaatttcattaggcagtgctttgaccgcagcaaatttttgttgctgaagtaaaaccgatgcgagcgataaattccgcaaggaaaaggaatttaaattacggaaattgcaaagcatttctgaatgaaaataattaattgcaattatattaaaatagaccaaaataaaaaaggatccaggaataatagtaccaattgtgggccctctttttaaatcgacccaaaatttctgatttgaatgtaatattacccgaacccagcaacttttttgggcagacttatcttttgtccgaaagataagagatatattggggaatatctgtatttagccaaaccttgaaaaatacatgtacatctaaccgctcatgttaattaaaaataataatttttgaaaaatgtaggttgaaaatgggctgatcatttacgcacaaaaaatgtttagtggtagtggcacaagagatttttgttctttagttacattatgccaaattaaatttttaaaaaatccgctgacccacaaaaaaatttgcaaaccaaaatgaccccaccccttggtggtttttaataaaattcaaagatgtgtaccacattgcaactagaaccaaaacttctatagtctcattgaattcgattggatgcctaaagtgcaataagaccaatttcggcaatcctaaagtatgggggtttctatttaaaaaaaattttttttttcattgaactcaaaattggtatttggggcttttcgagggcgctgaccacgaatctaaagtcggatttgcccaattccgaacacccgacctgaattcg

SEQ ID NO: 2744 - DNA, 3544 bp, Heterodera glycines
  misc_feature (24)..(24): n is a, c, g, or t
  misc_feature (3426)..(3426): n is a, c, g, or t
tgattataaatttttcgaaatcanaaatatttcaatccgacttcaaaaagatttcctcgctggaatcgttcgtaatggtcattctatctcagccgtcatgttcttgttgcatattgtcgctaccaaattgtccgaagtatggaaattattcttatcattatcttgtattttttggatcggttactttgcatgtttttttctatttagactcgtttcactttccttggtctgctggctgtcctttcatggccggccttattcttcgtacattatgaacagattcacaaccgagattatctgatcagtcgcttagcactttctgcctttacactgctcatcagcacagcacttctctttttaccaaaaaagccgaaacgcaagaaaagaccgaacactttttacaggttaacgaaccaagacgcgccaataatctggtcataatttagtgccttttccgttgccagcactcctctctcgcaacgttcacgttttactcgggactcatctgttacagattttgtacttgataattcaaaaagaatgatggattttgaggacgatgaccaatcgctttcttcaaaatattctacgaaaatcggaacttcaaatggaatcagaaataggtcgtttttggacaagtcgaatttactgtccaagtccgcgtaagttgaattcattttccatacaatcccatagaactcggatttctgttttccatcagctacttgattctttcaataaattttaaaaatttgggtaaaaagccatgtttaggtgtagaaccatttagatatggaaaaagatattgctagtaaaaattgaagttcgaatttttagtttatgctttttgatttaattatttgtcagacagccaaacggtttttaacccaataccccgccaggcgcgtacgggttttacggactctgtaactctgttttttgggctgacaaggatttcacgggctggtttttattcccttagccgaaccccgtgttgtttccaaccccatagcctatgtatgtggaaaattccgatagtcatgtcgaatttacaccattctaaacatgcctttaccgccaacaaatgttaaaatttaaaaaaaaagtacgtgatgaaaaatgcaaaatccaagcgtgagttcgcattaaccttagaaaaagttataaagtaaaaaaatattttctcttttttaccgtcggattgattttatttcagtttcaaaaagtcttccgcgccttcccttcgttctttttccgtttgttcttctaccgttccttcgcattcttttggctggcgtgaaaaaagagaggaaactccgttaaaagaagtaaatcagctcatcgaccaactgatgttgtacagcaccgacgaagaaacggcagagaatgaattggacgacgaagcgattggaaggcaaagagaaatggccattggaacggcagcgaaaaacgaaggcaaaacgatgctgagcactcgagcgatttcgccaggaaggcagtgccgacacggcaaacagcagggaccattcgcatcgctcactttcaacccggccgtgcgtaaagtatgtcaccaaaacaatactttttagacttaaattcccttctcagattgccgctggccatgccttcccttttgaaggcggtttatttggctcaaaggctgtgtcactctcaagggcgggttcttcgtgctcctcactttcgatttccaacaacagttcttcaccatttcgtcatctttgatcaaagttatgacccttttttttgctgttatactgattgacctgcaaaagctttcttttattgtattcaaatatcattttaacaacatattataacaagaatctgtagtcttcaatagagcccggaattttgaaagtaccgggaccgggcttcgacaaatgacttagagatttttacattcatattaagtaatttcaccaaaaaagctttattggattaaattttgaatattttaggtggattttatgtatctttttaacttaaatgctcctaaaatttattttttataccattttcttttaaaaatcaattaaaatgttataaatgtgaattttggcagggagtttattaattttcactttattacttcaaaagagtcattcaatatgacaaatatatttatttgagaatgaggtttggcaatggagtgatactgtcatccggcaattcgtcaatctcaatggcattgctagaccgatttgtcgttgaaatagaaagcactttttccgaacggttttgatcgacaaatgattgtacgtggtttgaacagaagtcatcccaatcattggtgtcgggaagctctataaaagcaaatattcaaacggagcatatcatatacagcctaggcccagaatttgagaagcttaaatcaaatactaaaaattcatgtttaggtgggcatttaagagggtagtttttctagccatatggagaaaaggtcaataaaagaatgaatggatggaggatagaagtacaatttactaaaaatctttgatggacaaatttaaaaatgaacatgaaactggtcatttttcgagaccatcacattacgaaatttgataagaaatgatgttgtaatttaaaaaaattaccctttatcagtcgttcaatatattcagcatttggcgagttttgttgcgatagtaatagccgattcgccagttggtaaaagaagctgcgctttgcgatcaccgtcattcggtcgccactcaattcatcggcagttaaagtcgcaaaggaatcctcctccattggaattgcttgacgaattaacgcaggaatattaaagtcctaaaagggcgtaattttataaacttaacaatgctaatgcacaaccaaagatttgaatttgacatcagaatgtatcatgaaaatttattcttattaattgttctccaactatatgcgggtttattggtaaccaaaacaccgtctgagctgaattggagtgtaatttgcgaagcatgcaagtcacacaaaatcggcggaagtgcaacatttggttggttatttacttcgcttatttgttagaattcaaagtaaatgaattaaaccgtcaacttactcttataatgaaatcaatcaaaggtttctgttcgcccgtactcgagtaaagaatgtggagaatgagtgtaatcagttgagcattgaaaattgaacgggtgggcttcactttgaccgactcgaagaattggcgcaaaggatcggaaggaacggagaaagcgcgcaacagttcaaaatgagtaggcagaaaattggtgttggtcagattgaggagcaattgcatgcacccgcagagttgatcaccgagaaaagcctcggaacccttctaaaagaaaacattgtaacgggaaagaaattgaaaacgtccaatttgggtcatgcattaattagagcttctanaagcctaaacggtgaaaaaggtagataatgttcaaggacacttcgtaaaagcgaaatgtcgtacgccccctttttgaaaagatataatcgccgttttagtcagtagtttttagctaca

SEQ ID NO: 2745 - DNA, 1187 bp, Heterodera glycines
tagaagcatattttgctgagcatttttccattttttcctccaaaatgccatatgtgaattttttgggtgaattttccggcaattttcggctaatatttttcagatcaaccaataattgcgtgtccttcaaaagatttcgccgatttttaaatgtttcattatatttttcaattacggcgcccaactcttcttttgatctgcctaccaaaagttctgtcagcacgtcaatgtccacttgtgcacctcgacctgttctcgtaattaagtgacaaataaaatcgggaattcggtgtcagttaccggggattaggggtaatgggtcataaggctgaggttaatgagttgtaagactagggcttaattagttataaggctcgggttaatgaagtatgagccagagttaattagctataagataatgaggtgagtctggggttaatgggattataatagcaggagttcatgagttataaaactagatttaatgaggtatgagcccagggttaatgaattataagactaggggttaatgagttataaaattgagagttaatgagttataagactagggttaatgaggtctgtgagcccagggttaagatataagactaaggctcaatgagttaaagactggggttcgtgatgtatgggccccgggttaatgagttataagactgagagttaatgagttataagattatgattaatgaggtatgggcccagggttaatgacatgtaagactaagggttaaagagttataaatattttaccggaagggtttaatgtgtggtgtattaattcggcaattagctgtgcccggggcttcaacatgccctcaaacattttggcattttcgttgtacatgttgtaaatgaggccagtgaacaaattggcacctttcttcagcctgaccaactctgcattgccggaccagaaaattttgttcaaacactcctcataattgcttgatttgacctgcgggcgggtggggtcatgaaaaatcaaacggattggatattattagttaaaataaaaataattaattatttttttattatttttttcatagaaaatattaaagattaagtttttatgtgttttgctacctaaaaatcgctatcaaacaatttttgtttacctatttttctacctatttcggatttgtgtacctatttaatactatttt

SEQ ID NO: 2746 - DNA, 1916 bp, Heterodera glycines
ttcagtgatttatcaattattttattttaaattaataaggcaccagtagagcgccctaatcagtgatttatcaattgggcactaattgagcatttttattgtataaaagccccattcagtgatttatcaattattttattttaaattaataaggcaccagtagagcgccctaatcagtgatttatcaaatgggcacttcgaaaaaattcatgaaaaataaatatcaaaataaattttagttaaaatttaatgctagttaattttttcggccttcaaaaaaaacatgaaaattttgaaaactttttccattattttttttaatttacccaaatatccatccataaccgggctctgttaggtaccatgtgatttcgtcagtaagggatttcgtccgtgataataattatttttttacaaaaacttttaatatttcataaaataaataatctaattattattaacttaaatatgtagactcaaaataaaattctttgctcgattaccaacctataattcggccggttacttgcatatattaattaattgtatttgtgcctagtctttgctacttttatctcctgtatattgttaatttctagatggtctctagccattatcattctatattaacctcggaatttcacttctaaatttcttactattaattttgtctttccgcattttgagtttgttgattgccttgtcatgttttctgcctgcaaatcgaagccacattaaaagcgtaaatcagaatgagttcgacaggacaacaatttgagcatacttgcagagggtttgcaaattgtgacccattagaatattaatgagcctattcttattaggattcggaccccgtgggcgggggtggcttttcgcgggggcgggggatggcgggggtcagagtcgcgagggcggggacgggggcacgaaaatttcgcccccgcggggacgggggcgggggtttgatttgaattaactccaaaaaatctcacaaaaattaattttttatgaatgatgtgatggctccacattcctttagtcaatgtatagcctcaattcaattccttttggcataaattacacagattttgtctaaagaattaccaaattttagagatttttggctaatttttaagaaaaaataggtttttggggggccggaggtgccgataggccgcctggcgaattttgaaatttaagctcgatttctaacagaagtttacaaaaaaaaataagatttttacgataactttttgttttttaatatattaaattatcatgatttactcaacaaaattggaactcagatttgtaacatattttcttgtggcacatttttccaaaaaaaaaaacttggtgaatgtgcgagcgtagaggtccggcggtgccgataggcgccgccgggaaatttttttgaaaactgatggatctgttaatagattttgtccaaaaaatgataggtttttgcaatttttagagaatttttttaataagatttacgaatttttgggccatacgatgccgataggcagcgccaggcgaattttaaaattaaaaaaaataaattaaaaaagaaaccgtcaacctgaatcgactcacgacagaaagtaatgtcacggttgattcactaaccactacacaacactacacatcaatgaccaataataaaattaactttaattcataaaaaatttgtcaaaatggttaaaaaaaatcaaaattgtataaattttttgcattttatccatgaatatgtcattcttaggggtgtattttcacccccgcgcccccgcgggggcgaaggtccgcgggggcggggatgcgggggtcagagtcacgggggcgggggcgggggtgagcccccaaaacctgtcccgcccccggggacgggggcggggggcggggtcccgacccta

SEQ ID NO: 2747 - DNA, 3702 bp, Heterodera glycines
  misc_feature (3637)..(3637): n is a, c, g, or t
  misc_feature (3641)..(3641): n is a, c, g, or t
  misc_feature (3657)..(3657): n is a, c, g, or t
  misc_feature (3662)..(3662): n is a, c, g, or t
acgcttaaacttatttcataacaaagaaccctaccgacggccaaaggcatcagatggacaggaagagccagcagaagtgcaaccaaaataatggcatttgtagaaggcaaaaacattttaatagacatgaaaatatataatacgactggaatatttttagggttctaaatttgaggaatcttgcgaacccagtaataaatcaatgccaatttcggcatcacccttgattttttcattattatttaataattttgtttatgcactttgatacgagcttatttaacatctaaggcttgttttacgtgaatcgactttcacacctcgcccacttgtaaaattaatttttccttggtcaattttttagggcttcatttatgcactgtcaattcatcgtaatttcacggggagtaaagaaatccaatggaaaagcaatcaataaattattgaataataaactcatatatattatataagactgttaacgcttgattaaccgaatctaaataggaacccggcattttttgaaaaaacgaagaccgggcgggggtcacaagttaaacgctcaaaaatggagcaaaaaatgaacaaaaaattgccagaatataattcgatagcaaaccaattaatgtttttgaaaaacttcataagaaaaaaatttcaataactaaaatattctttaaatttggacgggggtgagccccaaaaacctgtcccgcccccggggacgggggcgggggcggggtccgaaccctatttttgactaacgtcatagaaccgttttaattagagaacgaattttgtggcatatgccttttttctgcgtacaagtttcgatttattaagcataaaaacacatttccacttggtttgaagcttctactttgacttttattatgctttaatgccttttttggcatttttccgaaaaacgcttaacaaagatacaataaaaaagaaaaatatatccctaagaaatgacccgaaaaaatttcagaaaatacatccctaagaattgaaaaattttctcaaaaattgatcgccaaaatttaattttttgtgccttttaatgcctttttttcaattttttggtgccctattatagtgcctttttcgtgatttttggtgcctttttttcgttctctagttataatcagggctgtcaaaaatatgataatgcatattttttttcctggattctaggtagtctaattagtaggaaaaacactttcttttggtatttgcgtataaaaaacgggacttttatttgcatatatttgcatatttcgggtttttatgcatattttggggtttttctgcatattccatgcatattttgccattttttttttacatgttttcagattttttgcatattttgcctttttccgtcaaatattttctgatttgaatcccttatgaaaaaaaaatttgattatgccaaaaattaaatccaaatctgaatggatgcgcgagtgggtcaacagtgggcttcactgccgaaaaccttaagaaatttttgatttacaattacaaaaacaaccgataaaatttatggggaataaaattttttaattgatttgcatatttggtgcatattttgcgatttttgcgcatatttggtgcgtatttcacgactttatttgcatatttatgcgcatattttggacattttttgtgaatatttttgacagccctggttataatataaaatccgccgccacctttggcgtttcgtctaaaattcgccaccacgtaaaattactttcctgcaaaacattgttgaatttattgttgctacttaacaatattggtttcttgattgtgtgcttttattgttaaataacttaccagggctgccaagtgtccttatttgtaagatttgtccttatttggaggggccagctcttagaaattaaaaatgtccttttttctaagatttgtccttattttggcacgacctccttgaatttgccctttgtgtcgtctgcaacgatgatattaatctcctttccattgggaaagctgccatttctcatcatcaaaaaactgaaaaaatcagaaaacggcaaaagcagcaaaccgatcgattccgttgcaggaatttttgccaaatacttcggccccatcaactgaagatcgaaaaattcttgccgcggagggtaaggcattcaaaatcaacaaaaaaaaaaaattcctctctcacaatgagcctgggcttatcacaccgcgcagcactcccattctttcaattccgttgattgtgtgtcttcttctggactgttccgaacaatttttccggattcggcaattgcgaaaaaattcagttgtgctcgtataaaaacagcaaaaattttgacaggtagaagaattaaaatagatttctttcaggttaaacaaccaaattagattttattttattaatttcagcaggaaaaaacattttaccggaacttttgtcagaaatggagaaattccgatcaaaaatcgaatccagaaggagggagcgcttttttggtgctgaccttggcttagctaaagtcgaacagcatgcaagaaagtcattggaggaacaatttctggttttaagttgacgtccgccctgattaaacttattttttaggcattttacacgaccgttttggaatatttggacaagtggtttcgtgttgatcggttctctgagaaattgcgttgggtctcactgatgtcggacaaaatcccacaaaatgacgcgttggatttggccagacaaaaagccccggatctaacaaataatctctttgacgatgttagcgaagctaaccaaattctaaattcaatcccaaaggacgaattacagatgctcaacccagagcaaaagtggatgaagctatttgaagccgatttaccgcacttgtacaagttggtcagcattgtactttccgttccggtatcaaatgcatttgtcgagagttttttccctttgcggctcacaatggactgatgttcgaaattcgttaaaagtcgaaaccgtgaaggcgctggtccagacgaaaataaattttgatctcacttgcccagaaatgtatcagatgctcatttccaatcacaaactgagggatcagatcggtggatgggaaaaatactttgaatgacacttttttgaaaaaatattattttcaataataaaaccgttgtaattgtgcaaattggttgtattttgcttttataaaagccaataatgctttttaactattttataaggtaaaaatcaattttttcaaaaaatcttatttttgggggcaacatcttagttttagcctcgtttgtccttattttgaaaaaaaaacttggcagccctgcctataactgtttcacatttatgaaaatcccctgccgattttacgatacgccctatggttaggattcaaattaaaatatttttcatttttttaaatcaaaagtcacaaaataaaaataaaaaatcacagaattgacattgaagcatattccttcttccacattttaaaagttcgacttggaactcccaatttcttagcaattttttcgtcactaattcttggattttcttctttcataagaaatattgctttatctttgttattttgtcatcattagaatatttattacatgctanatanactaattattaagcanaatanatattctcttacttttttgatattttgttatcaattcttt

SEQ ID NO: 2748 - DNA, 4516 bp, Heterodera glycines
  misc_feature (15)..(15): n is a, c, g, or t
atggaaaccgccctnaatgatcaacaaaaaatagaaacaatcgaaaaatttgatgcaattaaagaaaagttgagagaaaaaggaaaataccaaaacaaagaaagaaacaaaattgaggaaaaaattggaaaattattaggcacaaatcgccaaaaaatatacaaatggaaaaaagaattaaatttaaataaaaataaaattttttatgggcagaaaaagaaagaatttattgaacgatttgctgaatttaaaagtttatatggccaaggcaaacagaaagcaaatattccaatgatgacaaattgaaaaagaagaagcaatatttcaagatcaaagaaataaatccaaaaataagcgatgaaaaaattgcaaagaaattggaaattgggtattcaactttgcaaaaatggaagaaagctttattttcgaattgaatttgctttgatgctgtttaattattaatttaattattaatatgattttacatttaattggctttctattcgaatttcgtcaaattttgattgaaccttgcatgattaatttttaaaactaaataaaaatagcataccgaaattaatataatcaaaatgtttttattatttggaatttgcttcaattgcggatacgtaatttgggcaaagatggaaaatggaataattcacttcaattaaagacgaatgattcattctagtttcatttaaattcttttcatgacttcatttgaaatgaaataaattaaatattcttttgacaaattttagtaaagatggcggctcagcaattaaaattgccctatgttttattcctaaaattatggaattaatctggcgcaggcgacatcaagtttgggcaccgggaagtttgggcactatgatattaattgaaaatttaaaaactaaaaaaaactaaattgcgctgtgacttcatcctaaagtaaccaatctgtgcttaaaaatttatgtttacttcaaaattaaaaaatttaaataaggaaagcgggtaatcttattatttaggcaattcttacactgtttaaacgtaggattagacggatactagtttctgtttaggtttagacctgaatacccggcttatttggacctgaaaatatcaagacacgtctatttctattcaattaaaatatattcgttaaataactttcgttccgaacttaattaaaattactatttttaaattagacggttgcattttttagacattaaaaaatgttatttttaaatccttaatctggtgcccaaacttcccggcgcctaaattcctagtgccctaacttccctgtgccaaaacttccccccgcgccgtgacccagtgggttggactcggttactgtagcccagtcgtgggtccaagttacccactagtgctattcgagaccaaaaatttcccgtggttcgagaccgagacttgaccccgagaccgagactcgagaccaagacccaaaaaacccgagatccgtgactttttttcaaaaaattttctagttcgcttaaaattcgtttaaaacttctataaatttaaaaaatcaattttttgagacttttcctaacaaatttttgctttttttttgatttgatcattgacagctctttttatgatttttgtttaaaaactgctcattaattatgcaaattttaaaaatttttggataaaaattaaagttcataaatttgtgacgaattttcataaagaattttcaagaattccatatattcttcgaaaattcatctagtttgggttcaaattctattaaaaaatttgtctatttaaaattttttttttttttaaatttttttttgtctttgaagtttttcaaaaatattatgtttttatttgctaacgaaactatttctgttttaataatgtaattgcaaactgtaattaattaattttttatcatttaataaaaactaatagctcttcatttatctaacggtgccatatttttaaactacacaaatattcactaatcaaattttgcaccaaaataagcattaaaattaaatttaagcaattaaaaatacacaaaatataatcactcaatcaatcaatcatcatttgattcggcgtgcaattgtccatctctttcaactaattgaaaaacgtgtatgacaatttcattcgatagtttattttttgttgtgacaaaaagcagccgactcattacactaaatttatttcgaaattatttaatttaatttttatttaaataaaaatgtattatttttgataacgtatattgtttttagagcacttgactaagattttgtgaacattaaatctttattttcaaaatttaaatgaaaaaattatgtttacaatgattcttacaaattaataaaagtgattttctttaattttaaattaaatttccataaatgataaaacctcttatttatcttcatattaaaattagaaatttattgaattattaaattttgattaattttaaaacacaattagtgaaattttttctcatttaaaattaaaattatattccgctatattttaaaaccaactattgaagtatgatatgaacatcattattgtcattcaaatccaattcatttggtggaaagcaatgaaatgcatttgaaagcattgttttcatttttaacattttctttttcacttttttctctgcccgattttttggttcgcccattttgaccagtcgatggtcagccaaattgatgccaaacaaaatcattacgttgaaaaagttcacattaatttttggcattatgtccttccatttttgttgtaaattcgaaattcgtacattgaagacatttttttgttcaaaaaagtcaataaattgtttattttcaatgggcttacaccaatttttatggccaagaattttccattttcgtttcaatattttttcgccaacttgttctgtgaggtaaacaagaaatcggtccgctatttgaattgaaaatttcactaaaaaattattgaaatttaaaaaattttcgtaaattagcaaataagtcaaaatttaatattaatttacattgtttccaatcgtttttcattgtttcttccaaaaattcgcttgtaaattggttgaacatttttaaataattaattccatgcacattttcacgcttattagtgtgcttcaaatccgcaacaaattttgggctataaaattgttcctcattttccgacgaattttcttcaacaatctctgatttcaaatttgttttaattgcttttggcatttgaggttcataattttttcgaatttgaccaccaatttttttgttggtgttggcaacaatgggtttttgtggcgtttcgtcaatttcaaaattttccggactataaaatttgtcctcactttctgtcgatgaatttggtgatacaattgaattttttgttttgtctggcattgtattttttgtcccatttttcaaaacatttttatttgcttgaatatattcagttttatgttccataactgattcatttggatttgcaaatttattaagaccgcgtttagttgccgtttgttgaacaggttgcagaatctaatttaactaattaattaaattaatccaattaatttaggaaaattacaaataaaaatgaattaaaatttaaatattaataatttgtacatctatttttataaattaatattccgaaatttgtcataatattcaaattctttcaaattaaaattattttaatattaaaatttatttattaaatttattaaaaatttaaatgaaataaacagtattaattgcatttaccaatcctttgctcgacatgtctattccttttacaggttcaacaaattgttgataacacttgtcctgggtgttcttcaaaatttccaagtacgccacttggaacatgccactaaactttgtcttgctaatgcttgcccggtttggcaaagcgttaaatttttccaaaatttttagcatatccgtgccaacatggagcccaattattcggctcacagctttgaaggaaatgaatttattaataaaattcaattttaatcaattaaatatttaaatgtataaaataatagaaattttcaaatgtgtatttaaaaaattgaaattgaaattgtttttaaaatgacttattttcttggcacgaaataaaattaaaatgaaaaaagattattttctttataaagaaatattttaaaaaaagaataaaaactaattgtgaatttgtagaataattataccatcaaaattcctcttcaaattagcttcatttaatgttttagctaaatacacatattctgagtcggtctccaaaagcccagaaatttcaagcagattccgaatttttccaaaattagctcttgccatattttctttcagtgctcgtgtttcagcatttttttgctccaacgttttttgtttgttatttttaaatatactaaatagaataaaaatcaattttttaattatttcagagagtccaaccaaaaatcaaacccttttaattccattcttga

SEQ ID NO: 2749 - DNA, 4759 bp, Heterodera glycines
cggtaccaatagactcagctcagcgagctgagtctaatggtaccgcgtatgcacggtttcgtcgaattttcgacaaatgccaaaagtttcattttttgaaaaattcagtggtcacgaaattgactttcgtttgaacggttctgcgtgtatactgcaccgttttactcagctcagcgagctgaatctaatagtaccgcccgcacacatacggttttgtcgacttttgggcaaatttttgttgtttttgtgccaaaaagggcctccaatttaaattgctttttgcataaaaaccaattcgggccgttttttagggtctttgcttttttttttgcaatcatatattctaacattttcagcaactgcgcaacaatgtttgggcgtttccctcttttgaccatgctcaactcggcctcaaattggcacagatttcgcccagttttgaacatttggtcgacaaacatttcggtggcaaaaaggtgaattgttttttagtgtttttttaaaaggattttgtgccaaaagggtgcctccaatttcaaagaatttttgcctaaaaaccaaattcggttttttggtgtaaaaacactcttttttagtgtttttgcttcttttttttgagattttgtattcttatattcttgacattttcagcaaccgctcaacaatgtttgatggacatttcccctcttttgaacatgctcatctcgacctcaaattggcactgctttcgctccgtttcgatgcgctggtgtgcaaatttttcaaggacaaaaagcggattgttgcgcaagtttcatttttttcaaataagccggtcaaacctttctaagctcgaaaattatagattgaattcgagttcaaaaatagaaaaatggaaacatttttccttgaattgaagaaaatttttatttatgaaattgtatatttcaaacaagaaatcattattgtaattttttaaaaaaatgataccatttccatcccaaaattttccaaacttaaaaaattctctcaggcaatctctgtgtttggccggttaaaatctttaaaattcatcaatttgaccatgaatagaataaaataaccaaaaatttttagatgcccatatatacaaaattatggcaaggtgtacactaagcaaatagttttactaacccaaatctgaggttagttaggaattaagtttcgtacactttggcacgcataagcccctaaatagaatttaagaagtctttactcttgacagaaatttaaatttgtacttaaaattattttacaaagaataccgaagtcaattgtaaagatttctgtccttattcccttttgagattcacattttttatttgtttccaaatcttgtcggtctgctttgcgaccatgatgagatttgtgcacatgccggtctgcattgcgaccatggcaaatatcggtctgcttagcgaccatgatatttagtgcacacgccggtctgctttgcgaccatggcgaggctggtccgctttgcgaccatagccaatagtgtcggtctgctttgcgaccatgacacagtgccggtctgcttagcgaccatggcaacatatcggtctgcttagcgaccatgatatttaatgcacacgccggtctgctcagcgaccatggcgaggctgtccgatttgcgactatagttcgctgacggaacctgctccttctgggagatgtgtgttccagacttggttcagttctttttccccatcgttaccggccaacatcctgggcgaaactggtcccgcactttgccaagaccagtggactggtgagaggtgacgttaggataaacaactgacccgttttccaaataactggaacctgctcctccgggagacgtgtgttcaggccaacaaattggaacctgctcctccgggagatgtgtgttcaggtaaataaattggaacctgctcctccgtgagatgtgtgttcagaccataaattggaacctgctccttcgggagatgtgtgttcaggcttgtatctatctgcactcgctgccctttggcaaaatgggacatgtgagcgtcctgcctgatagatttcggcagcgacatcactgtgacactggacaagagatgatcattattttacgcaatcctacacattatttgcttgataaatgtttatttttgtgtgcaataattggtcaatttttctactataccttttgccacattcgtattatcccattaattttgtttttcagatgccttctaagcaagaaatgctaaagaagagaaagaaagaagagcacctgcggcggacggagaaatctgttagtccaggtcgctcacctatcccaaattgccctcctaagggcaatccaaactgttcgattttggacaacccattgagtgcagatgggaatggggcggcatcgcccaggggctttaacaccccaaatttaagtgctttgcaattgagcacgccggcttcttcaattggaagcaaaagacgggctagacccccgaaagccggagatgaggcaatcacggcttcgcaaaataatgtgtcttcagttgacacacaatttacatcggccactcaaaatattgaaacgccgttcagcaaaaaatggaaggtcgacgatgttaaccgacccagctctgctattgaagaaattgcttcaacgcctattttcacgcaaagaagccgtggagggcggccggccaagaaaagacgcggcccaggcaggagcaaagctaatgattccatgagcgagagctcgtcaatggaccagagctctgaagctaccacatcagttgcccttttgccaactgtgcctgaaaagataaacttcagcacagtgcaaattaatttcgctacatcgcgaaattttacctgtaaaatttggaaatgggcagcaatcggcctttacgaacgtgatggcgaaacaccgattgccccaagatctggcccaagatacattgagacctgttggaatgatatgacccagtttctcaatgacggctttgctgccacatacttggcatacttggcaaccatatcacaacgaaaagtggtcgttgttgacccaatggtatggagcaatggcctggacagagtcatgccttacaaaaatatgacatttgggtacgaccctaatgttccggcagaagttatacttttgccagtacatttccctggacattggactctcattgtccatgatgtgcaatttggcactcattttgccgattctttgcctactacatatggcaggttggatccgcaactgacggataaaattaaaaatatcatttcggatattttgccgtcagcagtgttggcagggattgttgatgtcgaaaatctgacggtccaacacgatggtaatagttgtgggtacttcgtgtgcctgtatgctgagtcatggcttatgaacaatcgcacatttgttctgcctgatttatccatcaattatgaaaaaaagcgcattttatggcacattaacgagctgtatggctctgataatgtgccatatcatccaagggaaggggtgccaactccttgcccaattgtctatcggcatacggatgaagcgcagtcgacatccaaggccgctgagctaatggaagttgatgaacatgaagatataatgatcatcgaaccacagacaagtggacaggcagttgatgcaattctcacccaagttcaagtggccggtgaaaaccaagctgacacgcttggtttggtgtcggagtcttgcatcccgcaagagccaattgcgcaggctgatgatgtaattttcatcagacctaagacgccaccaaggcgatcaatgcgcgttcaaaaaaggctttcagcttctgttagccgttcgccttcaccggcgccgaaacgccccccgccagcaaattcgctgggagtggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaccatttgctgccggaagggaagagttgtgctgccaatgcttaacccgcatcctgatgagctcaaagagctgattgtggggaataagcaatcccgtgaagggaaagaatttgtgcgacacatgtcgcgttataacaacctgttccaatttgctagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgcatcatcctgctgcgcaagcatataagcaggcgcgtgagcagctcactgagcttctccaacaacaaactccggaagagcttcgcttcttccgcatgactttgttgaatgagcgcagggcccccacaaggtctgaaagacccaaaattgcacccacaccaaataatcacccctttctacgggtggaagggatgttcggctattcatgcggaaccccactggtgctcctcccacccaaaggaatttgggtagaagaacaaaaaaggggcaattaaaagaaa

SEQ ID NO: 2750 - DNA, 3986 bp, Heterodera glycines
atctaaagatgaagaaaagaaagaagaaagaataacccatcgttgaagcattgaaaaatagaattgaacaaattcccgaagaagaaaaaacaaaaggaaaaacaagaagcgaaatattaaaagaaaaaattggggctagtaaaccgatagaagaagaaaaaacagaaggaaaaacaagaggtgaaatattaaaagaaaaaattggggctagtaaaccaatagaagaagaaattgaaggtgtgaaaacacgtggagaatcattaaaggatttaattgtttcaaaacaaattgaaacagtcttatttaaatatttgaaggagcggcggaaattttcaattgattttaatgaccaaagaattgactttattgaattgtcggctcaactcggctacattctcggattcgaagacccgacaaaaattctgagtggagctatagcaaagtattattgtgacttgaagggtggtatagacagcctttgtgtgtacattaatggaatcactgagaatgtaatagtaggggaccaactcgcttcacttttgcgaattgttgtcgttgaaggaaaatttggagacgtgattgagaagatttataacacaccaatgtacattaaggtggcagtaaaggaaattaatgagattgaaattgaaattaggactagggagggaaggcttattccattccaatggggtacaacattacttgtattagcatttaaaaaatctattgtattttagtatttaaatattcattttcacattatagtatatattaataattgaataaatatggtgcatcaaatatttgatccaaactcagttagttttgatgattttgttgtagtagagcagattggctcgggagaagcctttaattattttcgcgggatacctccataccaacgaggatatggaagacagcgaggtggaggagtaggagatgtgttgaggtttttatggagagcacttttaccaaaattaaaatctgctggtacattattgggtagagaggcattagacactggaacacgtgtattggatacaatagagaaagctgaaacaccaaacaaacaagcaataattaatgaagtaaagaagggaatggataatgtactcgaaaaaggtggggttgggcgtcaattcggaacgggaagaaaaaagagtattaaaaggaaaagaattattggaaaaactatacctaagacagtaataaagaagagaaaaagatcagacgtatttggaaaattattttaaaatggtcttcaagaaaattggcaaggaatcggtaaattctataacttcagctttgtcaatatttacccttccaccaactaatgtgtcagtgagtagttcttcagtgcgggaatatttaccgctcaatcctttaacggacattccttttcattttaaaattcaccctaccgctagtttctttgatttgaacaaatgttacatcttaaccgaaatgtcaattaaaaagctggattctgacaccaataaatatgttaatttgaaagtgaatgagcaagcggcaacaattaatatgattggtgcgacttggataaagaatttaaaaatcactgtgcagggacgtgagatttatgactctaactcactttatgcttataaagcatacttggatgccgaactttcttattccaaaaacgtaaaggagtcagacctgcaggcgagcgggtattatgtggacagtgagaatcaggacggcacggatattactcagcagggttttgatctgagaagaaaattgttttcacaaagtcaaactgcacaatttattacaaaattggatgcagatatttttaatcaggacagatatatggtgaatggagttgagattgatatacaacttacccctaatgacaatgagtttatggtaatggcagcggccgacgataaatatagaatagaaattaccgcttgtaaattatatgttaaaactcttgaagttgttgatggtcttgcattagacatacagaaaaaacttgaaagcaaagaagcaaaatatgcccatagaaaaactttgatcaaatccacatttataagcgagaatcgaactgaatacaatggaacgctatttacgggtcaattacctaaacgagtcattctcggaatggtggagaacgctgcatacgtaggcaaccaaaagaaaagcccatttaattttaaaccatttgatattcgatccgtcacattgatagcaaacgggaaacaatggcccgcagcgccatttgagcttaatttcagtaaaaacttatatacccgggcattccacgaaatgaatgaggcattaggtatggccagttcaacagacagtaacggaatttctcttgagaagtatagaaagggttggacaatttttgcgtttaatatgactaatagcatggaggacaacgagggtattgatcttattacagaagggacgactaccgtgtgcattcaatttagatcacctgtcccatcgggtgggatcaccttaatagccatgagtgaaatggactctattttgatattggataaaaatcgaacagtaatgactgatacaaccatttaatgtatttaaagtgatttattatttattatttataattttttaaaatgtttattttgtttgttttatttttaataaatttttcttcgagttataatagccctattctttaccctgaacgatccagggacagcgaaatgactgacatttattataaaatagcctcctttgaccattcctacttgaataaaattaatcaatctgaattattctcaatgattgatgaaattgttgaaaattttcaactttgtaatgtagaagaaacgaggtcattatcgagatgggtatactgtatgctactagttttgctatggatagcaattgttatgacaggaatttttctctattttaattccttgattcgaaatttatgtaagcttatgcatatatgtagagacggaaatggacacaacgacgataaatcggattctagcgggaaacacaaagaccagagaacactacttgggatgcttcccttgcgacaaactcccaaacataatcaacaagtacccttcaacattcgtggcgaataatgacccatcgaataaggaaggaacgcattggatagcaatgttcatcgttgacgataggaccgtctactattttgatagttttggtaggaaaccgaacagatgtatcagccagtttttacggaattatgaaaaagtgatttcgaataagccagctattcagtcagtgtttagtgagaattgcggctactattgcatttattttgttcattttatgtgctcatttggaggaagaaattatgagagtaattttgaaaaaatgagaaaaaagttgataggagaagataatccagatttgtttgtcgtgaattttgttaaaaaactgataaaaagtatttaaggaatttttcattaactcatttataaaaatggaccgtttagacacaataattgcttctcttctgaattgtcccgcacgtaacttgtgcgaccgcttaaatcacccggatgagatacaaaaagtagaaaaatacctcaaaggaaaaactctacagacaacatacaaaaatcaactagatgaatacaaagattttgagtacggtggaattacaaaagaatgtgcccgtaagcagatggcatacaatgggtttaaaaatgtgaccgtcgaccagcacttttatgtacggcaccgcatttgtcttcgctacgctaataacccatgtgtgatcgaaaaacacaagaatggcaatgaacgattctacccacttgaacttgtaagagtgaaggacaaaaacgatatttatttagggcaaaatttccctaaaccaataccttcaatttgtaatgataatgattttattgatgatcaaccttgttatcattggtgaatttcaatatttgaaattacataataatgaataaaatttgttaaatacagaatctatttct

SEQ ID NO: 2751 - DNA, 1930 bp, Heterodera glycines
ttttatttatttttaaccataaattaattttaattttaattttgaattaatttgaattttatttcaactttaattataataattcatttaactaaaattttaaatttatcacaatcgggctctcaaatagcccctgcgggcgctcaagtggtagcatacctacactcaatagaatttgagttacctctgaccaacagctagtgctttctattgtcaccagcgggcgctcaaatggtccctgcgtgcgctcaaatggcaggcgcgagcgctcagatgtcctggcgtcccttcccttccccaaagggtatgacagctgacccctccctttgcctccctttcccttctctaataggatttggctttgggttttatccttcagatgttttttcaatttttacctcttctgggattggatatatttattataggtgttttttaaggtttaaatctggtactgaaatgtccctttcaactgggactgaaatggcggggttgaaatacaaccccgaaaatctgcatgggtaactactaacaaaaatccaataaaaacgaaaaatacacccctaagaatcgacattaaattttcagaaaaatattttttcgtaaatgtttatttaaatatttctgtatttttaaacaaatatttgtcccagcccaaatgatcagcggtcattcattcgatttatttaccaattgaggtttttcttcataaaatgcatttgatcactgatgaattatgttcatttcttcttccactaatcaccactgtttttgttcttttgtccgtcactcatttttcagaagaagccccttttgtgatgctttgtcccgcttcttcttccacttcttccggtggcggagacaatggccttaattaagcacaatttgaactatttaaacaaaattaaatgccattttttaattgctcacccaatggatttaatgccataagaaagccaaatgaacacattgttgcaattgttgtcccaatttccgtctttccaatcaaccgccgctgtctccccaataattttgcatcgtttcattatccaaatgttgtccaattcatttgctttggtcaatgtcagcttttcctttgtccattcgtttaccaattcaaatggcaccattggcattgacggcacatgaacagaaaaatgaatttggtaattgacggaagaaatggcattggcacggagaaaatgctaaacaatttgattggaaaacaaaaatcacaaaaatgttgggccacacctccttgaaattgttgatccaatcgaagttcgtttgtttgttgtaatctacgcaacgcaatcgcttgggttggccatcttttctcggagagtgcaaccatttggacaacgcttggccagcagaaattgttgcatttggcacatcaaaatcatcaccaatcgcagcgggcaacaaatcataggaattgattgaattcaatttgttgagatcagtgagaattgtcggtgaaatttgacgaagcaaattgtccaaatgatcaccacggaaaaagcccaaacagcgaatgtttgtcgaaaaaattggccataattcacgaacaaaaacatcccaaaaccttcctgatgtcataccatcaggagtgaatattaaattatatgctgatgatgttaaaatctatatttgttataaagcaagaacagaaacggaaattatgcataaagcattgcataatttattcgaatgggcaaataaatggcaaataaaagtttcaattcaaaaaacttttgtactttatttgggttcaaaaaacccaaaagaaacttataaattttatgggaatacaataaatgctgtggatacaattagggatttaggagtaaacattgataacaaattacaattttccgatcatgttaatcatataacaaggaatgcgtatttacgtatgcgttccttg

SEQ ID NO: 2752 - DNA, 4091 bp, Heterodera glycines
ccttttcattggatttttgtttgtttagaattcatcctacgcatttcgcagttcagtgtcaaaggcgacaaaaacgtcaaattgcgatgtgagccttttaaacggattgaaaatgatggccaatttgtgtccgcttttccgttcgcattaaattttcattcattaagttgcgtttcgcatttatgacatggacagagacggtttcatctccaacggcgaactgttccaagtccgttcatttgtctttctttttggcattttcacttaggtgctcaaaatgatggtgggcaacaatttgaaagacacgcaacttcagcaaatcgtcgataaaaccattcttttccatgacaaggacggggatgggaaaatatccttcgaggagttttgtgacgtgagttggggtgacgtgcaaaacggtcgttgttttctgagctttgcggtgttttaccgctttgattggtctgaccaaccgagccgactttggcctttctcctgacttacttttgcactttggccatttggtcaccgttttgtctctttctctttaccaaatcatccaattttacaggtagtggaggggacagaagttcacaaaaaaatgtaatactttttctgcttaatgctacgcaattcattttcacttttcagggtcctagaaaacatttgaaagaaatgtaatcctttaaattatttgtttccgttttgttttactaatttgttctcccctaatttattaacactccgtttttcctttgttttgttttccctccctttgtgtttgttttaaatgcttcgtcttttttccgtttcccgttaacatttccccattttcaggtcgttggtaatttggacgttcacgagaagatggtggtaaagccgtaaaaaaatgaattctccaaaaatgagctgaaaagtgttgtcagagtcaatttagctgtttttttaaaaatttaagacaataaaagtcaaaattattaccaaaaaacttctgacaacatattaaccgaatgagtggatgccgtgtcatttcattctttccacatccctttttctattattgttcggctgggaatttaagtgaagcaaagtttcaatgattctttaaaaaattacttttcattagagctcgacattttgaaaaatgcctggacctggacctggattccatgttggacctggacctggatttcctggacaaaaatccaggtccaggaaaaatccaggctcatcgtgacctggatccaggcctggacctggattttttgaaactaattttaaaaatcaaaaaaaggtttaagaaaatcaattaattgcttataaatagggctggaatttttatgtgctaaaaatcctgaaatatgtaataaaatatgtgctaaaaaacccaaaatatgtgttaaaaaccaaaaaaaggcctaaatatgtgttaaaaatgcaaaaataggagctaaaaattggaaaaaccaatggtatttttgcataaaaattccaaaaaactcattctttatcatttttgcccgcacaattgcaaataaaaaacatttggaggtgtttgagggtaaaattagtccttttttgataaattgtttttaaagataatttttccatcagttgagtaagtgccagcaagaaacttcgatatccagtaacgaattaatgaagaattcgattttcggtacacgaaataaataaagaaaattttgaaagagcctataaatatggcaagaaagttgatttttagggggtgcattttttaattttttgtgtttttcttagatatttttttcaaaaatgccaaaatatgtgcaaaatatggccaaaccccgaaatatgtgcgatatgtttttatgtgcgaaaacgccaaaatatgtgtttttataagtcgctctaaatcaaaaattgttcggagaaaatgctatttttgggcttctctcgccataattaagccgcaaaaaaaatatgttaaaacataaaaatcccagccctaattatacgaaaaacaacattcacttagtgatgtttaactttttttctgcatgttaaatccaccccaaattttgaatatcgatagagaaaaaaaaatctacatagtgtaatacagccattttatactttatacactttttcatgagatatgttaagatttgtaataaaaaattattttgtgattcaatggccaaattaaagcgaaatataaaaagagaggcggtgaaacagcggtggcaaaagcaagaggagagaaaagcgcagacggccaaggcgatacaagctcgcctggccaagaaaagtgagttaagtgatttttaactcaaacatctttttttaatttcagacgctccacagccaaacctcgacgaacaaatgtcacaacaggacgaagcagggccgtcaaattctgctgcatccgccgaagaagcgatggagcctccgccaccaactccaggaccagtgccaacgccagaaatggacgaggaaattttggaatttggcttttcgctgccatcgacatctgtcacaccaatcggcgattgtctccaggtgatttggacggattggagacggcagtcgaccagttcaaggcatttctcgatcaacaaccaatggtgcaaacacttctttcaaaaaagacaaaggcccatttgctgcttcaccactttgttccatttgcgcgccaacaccgatttttggggcttttggatgagcaggatggggccatatcatttttgggggctcaattttaaatgttgtgatttttcaggagatgaggcactgcattccgtgtggtggcgacttgagcaactttggaaaacgatgccggacggtgtacaaatgcgccaacagctggagcatcatttcgtcccgaattggctgctggacaccgggagatttgacgaattgaagctggtgagttaacggaagggaatttaacatttatccaactaattaagcgtgaggaggaacgacgggagcaagcggaggaagacaacgaatgaagaaagtgatcaagaagctgacgtcgatgtcgttgactgatcgaggatttatggtttttattttcattacaagcggtagataaaatttttaaaaatttgaaacaattttaaaatcattttggtcatttttccttttatttattcattaaaatcatcaaaatacagctatacatgcaccgggaatcgaacctgggacccccattttggtgactttctcacagaccactgagacaggtatttaaatcttttttggtattggagctgatttctgggatggtggacagcaattttgaaacccggaaataccaaattttcaaaattctgtaatcaattttaatggcaccgcctgccgagaaaaagcaaaaacttttgtccgccgttgaaaatcagcagcaatcgtcgtcgtcgggttcttttgtatgccccctccctttttgaaaaaaaaaattcaaaattttttttctcggaaagactcatttaggggtttttagggtcggaatatcagattctgataactatttctacgcaattcgacccccaaatcttgattggaacaaaaaatcgaattttatggcagtggttactggcacggatagaattgagaaaaatccaaccaatcattataaagtacattgcagcaaaataaattagggcaaataaatatcacaccagtcaaaatgggttcagtattgcaatggtataagacgtgaaatataaagtaaacctcatttatttcaaaagattatatgtaaaataatatcacaaagctcgatgctttaataatagtatgattgtaaatgtttgtgtaaagaaacaataatatttatttaaaaaataaatatatttatatcaattctaaaatgcgttattcgattgtagaagcttctgcaaaaaacgagagatttgcgtccatatcatcacaagtaagcataaatattgtttaaatgctataaaaattagtttataaaaaggcaaatttaaaacttacggtaaacaaccaagaataattcaaatatttttttacttagatattaatatatttaaaaaatcgcttgaagcgtggctataaaaaccaaattaattaaacggaaaacaatt

SEQ ID NO: 2753 - DNA, 2299 bp, Heterodera glycines
cctctcttttttgagactcgttcagttttgccattcaatcaattctctccctctgatttcggcatcgaatcggtgatgttagaaatcaccaaaattcccgaccgaaatttttgtttagattttaactgcaattttggttggcttttccgacttcggcagttttttgccgctcctccaaaatggcctcgttcagaaattgatgtgaggcggaggacaggcgacagtcgggcgttttgttcagtgccacgaattcgccaagccaaccgacgagcgaatcgcgcagaaacactttccctcctccattctttgacatttggaaaaccaattagtgattggggcaataaatataaaactattctaagtgtaccaccatttctcgaacaaataattttaaaatgaaccgatcaatggttgtgatctatcagcaaattcaccccacccaaccaataatcaattttaaggcagtctcgattgtaatttggtaattatatatattctaaagtggagatgattttgtttatttatcttccaaaaaaataccaatgagagaaaatctggtataaagcggagaagaaagggaatacattctttaaaattaaaagaaaacagaacaactcaatattgggggagcaataataagcaaacgaagaaggggggaaaacaaaacggaggaaatgcactcaaataaaggataaagctcagacgaaacatacaaaaaaccaaatcaccataaaaagcgctaattgtccatatccacgcccgtcggtgggcccccttcagtcagtgctgctcctcctcctcgtctgtgtccgtcaaaaattcgtccccatctccagaggaagaggattcgtcaaagtcgtcctcatcctcgtcgtcttcctcctcgtcatcgtcttccgtcgttgtctccccagcaacactcgaatcgtcttcatcctcttcctcggcggaagatgccttggccctgagattctgttgttcagcagcggcggcactcgacgtgcccttcttcacaagttcgtcagttcgctccttctcatcaacttcgctgctgctactgctgctgctcttgtcactgtccgtcagcacatctttaaaggaaaacaatttaataatgacacatatttacaacattcaaaaccattttgaaattggcccgatgggaaaagctccgcttcagacggcatgtcaactgtggcaccgtttttgcggcaatagtcgatcatcctgtaaaagaataaaaaaataatttattgttagggaaaatgatatttcaacacgaactccttccaagacgaatccctcatcatcactttggcatttccgacgatgatcaaaagctcttccgcacgagtgattattgtgttgaaacgctaagttttgaaattaacaccagcttttagaatttgtaaacaccttgtccgacatcagaaatccgatcgcctccttttcgttgttccgaacagtgctgacaatgatcacccgacgctgggaaccctggtaacgctccacggtgtccacagtcactcccttgtgttcggtgctgagtttatgccgcagccgacggacctaaaagtgaaccaaaagtactgaaatgatggcacttttacaaatttaaacgacgattggggtagaataattcacactcacttggtagttgtagggtgtgacgactccgatttctgatggtttgacatgcaattcagtgcatacccttttgacgtagtcaaggataatgtcctgctctgctcggttagagtacgagtgcccgtccatttccctctcttcaggttcattggcgtgatgccaaagaatgggaaaaccctgaaatttcccactctctaattatataaattagaaaatatgactatgttttgttaaggatttttgggatgggttgaatgaatatcgtattttggctctttttacatattctatgtgtcctattaggtagtatgcaattgttaaacaagtactgagacgacctgcttcggtaatgccttccacgtggcgagtgggtctcgcggttgcgcatcctcggggacgtacatttggttggcgtagaaaagacgagacggcacatcgatgatgctggcatgggaacggtaattggcgcgcagcatggtaacaatacgcctgaaagagaaataaaaaccaaatatttgagtgacaaaaatgtgtttaaagtctacttacgggtcatctttgtaattcgggttggactcgtagcgttcgatcagcgaggaactaatgccaatcttcttgaaatagtcaaccatttcaacggggcccaactgac

SEQ ID NO: 2754 - DNA, 6727 bp, Heterodera glycines
  misc_feature (6641)..(6641): n is a, c, g, or t
aaatgaaatggggattaagcatcaatggtcaaacggagaccgaccgattggcaccaaagtgtcgagttcagaagcctgcccagcctcgtcgatgattatatgactgaaaaagcaaattgtgaatgagtcaatcaattttgtaattgccacaattttaaaggccgatacctgaactgctgtttcattccgcccaacgcaagataagtagaacagagcaaagttgagacaataatccggtagttcatcaattctttggccggtggaatcccaaattggtccaccatttcagtgtttggccttagaagtggaagaattgaaagtcaaaggacaataaaaggcacctgacaaatgcaatgtccctgagtgcgtcattcagctccgaagttggatgagtcagtgcatacatactgcaaaatgagcaaaatagtcattcagaatttattaaaactgaccgaaacactttgctcgtgtcaattcctgccacatggatcaattcgtgagcaaacaagtcggcagccgtgttggaaggagtacagacgagaattctgccagtgtcaaattgcgtcaccatcaaacgacacgcctccaccagagtcgttgtcttcccggtacctaacgcattgggaagaggtaattattcatttcatatatcaaatcgtgtgtttgtttgcccctccctttctcacctggaggtccatgcaaaacgaacgggagaatgttgtcgttctcgctactgatgcggaattctatcgcattggcaattgccttaataaacatttttttactaaatgataaacaatttgaccatatcctaaacgattgttatttgaactcacaacaattgcctgtcgctgttcggtattgaagcgatccgacataaattgacattttgaaatagccaaatcgcgcaactccacatactgttcaacggtgagctgaaagaattgggttaatttgtatccgagttaaatgaacattttattcaggttgataagaaaactaccttttcgtccaccggaggcgggaagatcaagaatctgtagggccgctggttgtcctgcagctcgttcataatatgatttctcgagttgtagacgaattgggacggcaaaaagcgaaccatgtactgaaaaagtaatgagtaaattgaatgaacatcaaatgttaataactcacattcccttccggcatcgttcgaaagaatggcagaaaatggatggtctgcttcttctcgtcagtggaaatcacacgcccctaaaaataaacaaattgtttattggttaataacttccaaaataaagtgccctgttgctgttgaccttgtaatatgggtcatagtattgcatattctgacgcgactgctgctgttcgtatggctccagaatgatcaccggggacgctttgatgtcattgctgttccgctcgcagtagtcaatgctcagctgaacgccgtaaacggaggcgccggtgcgcgaacgcgagcacagcttcaccgtgtgcggtcccgtcttgttatcctcgctggtaatctgcaaaattggtgttaattgcgcagaaatagaataatgaaaaatctttaaattgtaagtaattgttatttacctggtcgttaagcatcaacaagcgattgtaagccttctgtttcttggcatatgcaagcagtccgggcggttccttctggttgagatactcgagaatttcctgcaaaaattaaattatgattgtcttaatttagagagttctcctcaagtaaaaacaagcaaaacattgtagaccagacaaaacttgcatttgcttcatccatgagatgagctgcaacgcgattcgcattgaagcgcgagtggatgagtccatggtcagcgtcggaccagggaacgcttgatttgaagaaaaattaaaacgaccaaatttctgggttattttaataagaatcaaggatttaccattgtttttatacgttttttttattaatttgcaagggaaattttgattaaacaataattgaaagggaaaaatatcggactaataatttaagaattatggacaaaccaaccgcggcaaaggaataatttccaaccctccgtgaacagttcggcgtgatcccatcgtttatgggcacaattttaaagaggcaaatggcaaatcagttaaatgaatacaaaagctaaataatgtgttaaaataacagctaattgacctttgtgcaagtcattcttgctctttttttgctaaaaaaaccgacttataaatgtaatggatttgaagagaaagggtaacactggagattggaaaaaaataaataataatatcgattctgttggacggggatactgaaccacctttgcatataagggaagatctaatggaaccaaaaaaacagaggagaaccagtgatattgaaagagggacttctctaaattcagaatgcagggtggtgctgccccttttgctgatggataggctaaacaaaggaattcaaatggtgtacccattcagtttaaatgtttttgtccaatctccaatctaatagtttgttgacgctcttctccacagcccccccccccccatcggcccaaaaacccataaacaaatataaatcagatttatccaacagatacatcttcattttcataaagataaagtaaaaacgagccattaaggtcacacatacctatgtataaattgaatatttgattaggaaactgtaaatttaaaattaaggaaaataaagaaacatgaaaaatcacgcaccaccaaaaaggacaccacccccgtgttactccaaatggcaaatgcaaatggattacctaagtttagttgtgatgatgaaatcgaaaacaaatcgatatcgagtaatagaacaaaaagccaaagtatttaatttttctttcaaattcaaatttatatgcttttttaaatgcgagagctggatgtggcggcgatctcagtctcgatggcattctctgtgttgtacgacgctttttttgtcgagcatcaaccaattaaattctttatgatgtgattatgtgactaaatgattgcaaaaatcgcaactccggccaggctgattttgttttttgaaaaaacacaagcttaggtaagttttccgtccgctgatcgtctacatacatttccgttggcaccacaatttaatttttgaactgcttaaattgtcacaatatttttgtgtccattttattattcgtcctcatcatttgtatttgttataacatattctctacgtacgactacgaaaatgtccaaagataatcaacggagcatcagcaaccatttgccatcatctcctcatttgcctcacttatgcaattcaatttcttatcagcaaaagtcggccacctgagcaccaaatgaatgaacagcggcgctgttgagggccgagcgggcggtgagggcaatggttttccatccatcgaagtgttcctttagcattcattggcctttcttcctcagctcatttccatcaaacttttgatctcctccctctctctctcacttatcctttcatcagttgggacggattttagcgccaaggggcggcgaccccacaaagggactcgttcttttattttgttgactcaaactttagtggtgaatgtttgaactttgtctccgctcaattactttcctcccgatgaactttctccgtttatttgtgaagccaagacgattaattatgcctaattctgtgtaaaatttgaaatatttttaaagaccctattttactgagttaaaaataatggcgtccaagcaccaaatgattgcgacgccgatggaatatatgtacaatttggatgccgacaaagtgttagagcgatttggaaagtatggaaagtatcaggtaggtacatggaatttcggtgaatattaattttaaaattgaaaacgagaaaatattgttttaatcgggtttctttctttttttgtatcacttttccaagttccaattctgttatttgtaaattcgatctctgatttttttcagatgatcgtctatctgatggctgcactgaacttcttcatcttctcttacaaaaccacagtgatttcactgatagctgagccccaaccgaactgcactttacacgcaaatgttgtgcatttttttaatttctgaactgttaaaaattcattttgatttttatacttttaaaatgcaaatttctctaccatttaaggattcttcactttcgctcaatgattctcgtcactacgtaacattagcaactgattttggcattggctgtgaggacaaacatttgctggagcatgccaacggtgcttttatgctcggtaaatgccaaatcggcaaagtgattattttgtttaaatcattaacacgattttttccttttcgcaatttctctttttccggtttccattttctcattttattttaaaattccattgttttctgccccttctctctttgccaggtaactttctgttcaccgctttggccacttattcggccgaccgtttcggccgtcgtcccattttccttctctccctttggtccatcgtcgttctgagcgtcgcctgtgcctttgccccttcctacgaatggtttctgttcttccgcttcttttccggcgcttttggagctgtaatttttgaaatttgtcttactaaaaccagagttttgcaaaaatgttgacaaaaaaactgacaatttaaaaaattgaaaaataaatttatttgtgtgttcgatgttttcagtccatcactgtggttggctttgtgctcaccgtggaaagtgtcgccgcgtcttttcgctctgtccaagtcaatcattttttttttaatttattcatttttaaatttacatttatttgtcaggttttggtcaattcgctgatttgggtggccggcattctctcagttggcgttttgcaccttttcattttcaattggcgccttttgtacctttgcgtagtcgcgcccggactcttttccgtcgtttatttttggcttttcccgggtcaatttccattcattccatccaattttatgcaaattcttacttttttcagagtcaatccattggttaatagcaaatggaaaaacaaagggagtgaaacggtgggcatttttaaattattttttcaaaaattatacggtaatttattggcgaaatgtctctcttctgttacagttatatcagtcgtgcttcacgtgtcaacaacgtgactttgaacctgcactcgtgccaatcggacattgtggcgccggaccaaacgccgccccatccgtcgaatgcgccccgggcgaaacgcaactttttggatctcttccgaatgccgacactgctgctccatttgtcgctgaactgctacattttgtcagtaatttggcaacccattcatatgatttatattatttttatttgtgtcaaaattggaccaaattttggaattttctctgccttttcagcattgtgttgaactttgtctattgggtactcacgctatacagtgtgaagttgcacgagcagagaatgatcggatttttcctctccgcggtggtcgaagtgcccgcgggcattttggccatgcttttgcttttctgttgtggccgagtgagtggcgctgttgatgagatgatctacaataaatcaattaatttgtttgaatttcagcgaactgtcaccgtcgtggcactgtttggtcaaacggtgtctttgggtctgaccattttggtgccacgtctgttaatcgcacattttttatttatttttactaatttcccaatttttagaaggtagcacctcgaatttgctgctttctctggtcgccaaagtgttcaacggtgtttcttgggcttccgagccgttgctgcttagtgaaatggcacccacaacagtgcgcaacatggtacggttgttgttgttgttgttgttgttttagtcgtcaaaaaataatttgatttattattttttttaaaagatgtatggaattgtggccacagtgggcgaaattggctctgtgttcgccccttatttggatagaattgtgagtgggaaatttataaacaaataatcaaattagctttcgaatttatgataattattcaagttgttatttttaaagaaatcaacaacattttacaccttttcattgctcctttccctgtcagggtgacgaaaatatgcaaaagattgtggtcaccgccatgtccgtgctggccattctgttcgcgttggtcgcgcccgagacgagcggtcgcgctctgccgcaggacttggcggactttgacgggggtccatgcgtcgcttttctgtgccgcacactgaaacggtggcgcagtgggggcgacacgaaaaaacggaggagaaaaagcaacgcgctggtggaggaggggagcagcggcgaacggacagcgctggccgaagaggcggcggcggaggacggaggtgacgaagacggagcagtaccagcagcagaacaacggcaaaggcagcagacaaacagcaacaacaatgacgacaatgccagccgaacggggcaagcgattgttggggatgaagccgtcgtcgtagacaacaaccgcacacccaaccgaaaatggtaccaagtgagccaacagcagacaccgcggcgaatcattgagctgctgtgttcttnccatgttcggaattcactgctggtgctgacccggtctcactcacttccccccccccatcccattttatttgtgatcatttttcttt

SEQ ID NO: 2755 - DNA, 2350 bp, Heterodera glycines
ccccccccccatcccatttaattgtgatcattttcctttcgctgtgtggttgtgaggcaaaactttgattttttgactaattaaattataaccactttttattgcatatcaaattgaataaaaaaatatatatagttgcatattcgtcgactgtttatctcctccaatagcttgggtcgttcctattaattaaacacacttggttttttgcaactccttatattattatcccacttttatttcttgtttattttctccaaaatgacttggacttgtttttatgttaaaactacaaaaatggcgtttcattgatcattcattgttcaaatgggttgttctgtctgctgctgttcaacgacggcccatccatttgctgaagagactgtccaagctgaagcccccgccgccgcttttgtggccgcgtgaggaggaagagctgcccaagcgcgaggagggccaatccgtgccactggcggttacgcggctgcgcgtccgtccgtccggcgactgccacgacgttgtccgcgatcgtcccccgctgccgaacaaaccgccccagtcgtcgtcactggtgccgaaacggctccgacttccacctgctgtcgaaggaagggacagggaaatgcatccgcggaacatttcattccgtggaagtggggattagtcggacagttccgttgatcagtcaccacccgcctcacatattggactttgaccgggttatcatccgccggtggcaaaatgccaaaaaagcccaccaataaagcccggaaatttcggatttgcggatcccgctgcgggattgtaactcaaaatttttcgggacgggatcccgcgggattaatcaggtattttccaaaaaatgcaggattgcggaatgggatcccgcaaaatcccgccgggatctacccaccactgcctccaaagctgctgcccctgccgctgcttccgaatccgccgaaactgctcccgcttccccaaccgccacttccgaacgagccgctgcccgtgcttccgccgcccgtcgtcgtcgttggccttctgccgccactggtccccgccgcggacgacggcgttcgtcccccgccgcccgaccctccgtaaatggcttggatgcgtctgatgtcgtccgacttcagcgtttgcggaatgtaattgccgttgtcgtccaccgactcctggtagaacggggccatgatcgcgttctccactttggagtgctccaggcccaatgtgtgcccaatttcgtgcaccgccacagggaacaaatcggtgtaaccgctttagggggtaattagtggaaatggtggttatgtaattaaatactaatgaattcgttgtttgattcataatacaacttggcaattttccgcgcatcctccggccccagcgcccatcgttcatcatcgtcaaagtgcaacttcccatccgttggcattgtggcatgtgccaaaacgccgcctcaatttttgcgcatttaaaatatattcgtgaaacgacagagaaatgaccgccgatcactgatcggaagaaagcaacatcattgtctgtgtgcgcttttctcacttcgtccgtcgaatggccacgggtcgccgtgacttcgcgcggcgaactgcacattaatgtcggcttggccttgtgtctcctgggcaaatttaatttcaaattaaaaaaattaaaattatgccttcatttgtcagttaaaaaaatattcacctgaaaacgcactggaatcacttgagaccaagtgtcataggcacgtttgatggcatcccttcaaaatttaatttaaatatttcgtggttttttaaattaaatattttaatttcattttagtgggaatgatttatcaattaaatgcccattgcatttgcctgatccgcgactgaggaagttgtggggagaaattgttgattttgaaggttaccaaattcttgttccattttggaccgcctgaaaaacaaccaaaaaataattccgattagtgcgtcgctactcatcaatcattaattattgactgattgattcccttcctaaaattgtctccgatcacttctgatcacctcctggccccacaatcatttgtgcgtcttgcatgccgcacctcggctgtgccatctttttcttagttttgatgtccaatttgcccgtctctggctatgtgcgggatgaaataaaaaattattatttattttttgtctgaaattggcacccaaatgggcgaaggattgaaaagctttgatcgccttcctcaaaaatgctaattttaatttgcattttcacatcttttgttttaattttaatttttctttggtcctccggttccgccccccttctttgcaattttccc

SEQ ID NO: 2756 - DNA, 1765 bp, Heterodera glycines
aaatgcaaaaaagcagagaaaagagacaaaaattggcaacagaaaaggacaaaagggaatgccgtgatttgtgatgccacatttaggctaaaaatgtttcggtaaattctttaaaatttaacgaataggcaaatattgcccggggaaacggtgaaaatcaatggcaatgccatgccccgcgggggtgttaaaaaaaattgaccaaagggtttaaaaagagggaaaaaaccaaagaaattgggaggaagttaattagtatttcattcagaaaataataataaaaaaaggatgagtgaattttttgaacacaattcactgatgacggaaagaggcggggaagaactcgtcgagaagactcgccaaattgggcgagaagtgattgatggaccacaaaggccgacacggactttcgatcgaatcaaatgagggggggaggactgatcgaaattgggcacaaatcatttgtatgaatgagcactctgatcagtgtcaacactgatcagtgatcacaagaacagcacatttccatcgacggatcaccaaaacacttttcaccgatcggccataaaaaaatcagtcgccgaccgttcgttttcactttataaattttgtcgcccctccgctgccaaagtttgtccataatgaaagtgaactcgtttttgtcggcgagtcaattgatttgatttctcaagaaactatttattccttcctcttttaatacaaatcaaaaatatttatttggaaaaaacaaaacaatttgccaaaaagaaaaattggggcaaaaaaaaaacaaagtgagtaagaggaaaggttttttgaggtcaaacggagatcgaaataaaagttaatccaaaaaagtgatcggatattccgatcaggcacaaaaaagtgtgattttgtagtcgcaacaatttgccctttctgctgatcatttgatcattcgccatgcgccactttctcacaattgtggacgctgaaaaaattgtccaaacgccgcagcgcctcgggcaacggaaccgcgcgcgtcagccgttgccgaatccatccgggcaaactggcggcaattgtgtcgcgcgcgtaccgctcgtccagcagcacaatgccggcgaagtcgacacggtggcgaatggcacgcccgatggcctggttgatggcctgctggcacaactgctcgtagaagcgcgtgcccgcgccaggcccaatgtgctggtccaaatactgggcaaaaaatgggggcaaatttggtcagaaaatttatgctattattagcataagaatttgtaagaaacaaaaggtgccaaatttatataaatattttaaaacatgaaaaaaggaattaaaataaacggtgaaaaatgatcaattgtaattataaatttgatcaaaatcaacaaataacggtttaaatcataaaactcacccgaattcgttctgacaattcggccgagtttctgttcgcgtacggaagtccgaccatcagcacacaacggcccaactcatcggagaagttgatgccttgaaatcataattatatatataaaaaatatccaaaacttcataaatttacaaattccccccccaccccccgctgccgtaaaaaaccgaaccctcgctgagttttccgccgaccaccgcgaaaaggacggcaccctcgcgggaacgtgcggactcacaaaatgcgggccaaatctgctgctgtgagggtttcaaaaacaaattaatatggttcgactgtttttccatttttgaatttagttcccttttt

SEQ ID NO: 2757 - DNA, 4207 bp, Heterodera glycines
atttccgaattgataaaatgtcggattttttatgttttctgaattttttgccataaatttattattttttttatctactttcaaccttttcacagctcttttatttcagtttaattctttttcaattttccgcactttcgcaaatgctaaaatggaagcgcacagtgttggtcagcaatttattattctgcagccaaattcgtcgataattttttcaattagtttttcgtacagtttctctcacaaaattcaaatccagttctgcgatatggaaatgaggagatgaacgtaatagctatttcaagcttaaagcggactatggctccggcatcatcatcatcatcaacatcagcagcagcttcagaaaccaaaaaacgaaaattggttcggaagaagaccggggtataattaatgtcaaaaatataaatgcaaaagaataattgaaaagttttaagaagtgaccgctcttgcactggcggcgttcacacagatcaaaatgcgcttggcggaggacattgagggccagggaaatgcgcagccgaaagcttgaagaaggtgcagccgcgataacggacgagcagatggaaacgatgcgccaacaaatggagcaaaaattccgtcaaaatctgctggaagccgagcagtggattgatcacaaatgggcgacgatgctgaacaaagaacaacaaaggactcagcgaattgcggcacaaagtgcgacggtgattggccaactgatgagtaagcgagtgacagagaggggagaagaaaaggaaaatacgagagagacagaggaaaaaagttgataataagtgatcggtgcaattggtgcctagagaaaggccaagtgttattcggagttaggggatgcggacatgtgtttagctgtccaccatgctctattgcgataatggccgttgaccaaccaaaatgtctgatttgtttccataaattaactgatttggaatacttaggatcataaatgtgtaccggatatttgatctggatcctaagtatttataatatttgtactactataattgtactcctgcagtaatacctcatccttaacacttttttcattgcgtacagtaatcgttaatgttttcatttttctaatttcattaaccaataaaaatttgccacatctatttgatcacacaacaacccatagaaaatgaaatttgcctgaacaattttgtaatttggtttactgaaggtaaataaaaaataaaaaatgtgaaaatgcataaaaataaatgtgaaaattaaaaaaatttttgtgccattttttgttgttgttcgccatctgcttcctccgccttttcctccttttttctaatcttcattcagtccttctcgcactttgaacgcttcaaacaatgcatttgcctgaatttttaaatatttttggttaggcttatcaacacaaagaaatgaggaaatgtgtgagagagagagaaatgagaagcaaaaaactatagggggaccaacacaagggaaggcctgcctaccgcttttcacagctccgaaataagcattgaagggggggccaacacgagggaaggcctgcccatcaacactcagactttatgaaatgtgagagagacagagagtgagagagagaaatgagaaagaccaatccacctttgccctttgcgctggtgtgaagtcgacagaagatgagaacacaaatggcaattgttgctcgaccacttgcggaccattttgctgctgctgacgcactaattaataaaaatttcaaaaaatttaaatttagaaaaattttttattacattgatgaaaaagtgggcgagcattaagccgttgttgtagaaatggcgccaccggtcgttccacaattgcatggagcgtagagtcgatggtagagtcaatgtcgtggaagtgcgtcagctcaagggcatcgcttttcgttgataaacaccctcttgcccttgataatctgaaaatttaaaaattaaatcgaaatttaaattgaaattttaaatgtaaaaattcaaaaaaaatttataccaagaaaatccacatacagacacagatgtgtcgtgccaccggacaccacttcatcagtcgccaataccgaacggagctcgtattggtcatccggctggttgggttccgggcggcgtggacggaccttatcggcgttttgccattaggaatgcggattgatgggggcgacggctgtaaaaaaaagaaaaaatttttggaagatatgataaaaataattaaaacaatttttataataatttaaaaagacaatgaaaggttaatatttttaattatttaaatgctatgaaattcaaactttttattaaaacttgccagttttttgttgaatttgtttttgtccctttttttgtcgtgcaatttcttcggcggaaagtgacgacaacgacggttgacggacatttgctgctgttgatgatgatgagcagccggcattttgagtggcgacgacttttgctgctgttgttgtcgatgaagtcttggccttctgtcgggcggcgactttgactgttgttgttgaagttgtgccatttggttcgacgacgacttcggcatttgatggtggcattggcaacggcagaccttcttcattttatggtggtatttgtggcggcgcttaaattgccaaaaaaaatttaataaaggaaatgtaatgaatttataattaaatttaaaatttattaaattttaaaatcaaactcacgatttgcaagtggccctcttctgaagcccatttgcctttttgccagcaccgtgtcctccgctgcttcacgtcgttgtgcactgcgcgtaacaattggttttaatagttcagcaaatgtctggaaaaaaaaaataaataattattttttgaaaatctcaggattttattttactctttttggtggcatgatgcgacgacaattgggcaggccgacaatttctattaccaattaaagtttaaaatctaaatttaaattaaaattgtttttttttaatttggaaaaaaataagttgataaaaatggttgggtttacatattttactttttgttcattaatttcccttttccattcctcgttccaatccattctacacacatttctgcctccattccctttatccatattgattttgcctggggtcaattggggggagggggggggggcattctgctgcagacgctcataaatattttattaattttgcgtaattcaaaattagacttttttttgtattaccaaaattaaagttgaaaaaattttggcggtaaaaaaaatcggggtccgtttggtgtgaaaaccagggaccgtcgaccccctccccttaacctaaaagagaaaaaaaaatgcaatttatattaagaatttttaaaaagtctattaattttatttcatgctataaactaaaaaatatcaaaaaatataaaggattcaccaaacaattagaaattatacttaactaaaaacaaataataaaaaaaggaaatatgaaatgcaaataaattttataaaattgactagtatacataatccagctaaaattggttctttcagttaagtattgaaatgctaaaaaggaaaccaaaaaacttcaacaaaaatacaaatttaattgttcttgtattttttattaataatttattcttgttttaaatattaaaggatttacttggaatttacattatcctttcatcgtcatattaattatattttttgtttattttttattttaatattacataaaataatgcagcatcgctatatttattttttatgcaaaatatagaaaaattatgcttagtttatttaataggtgctggcaactttagtggagaaaaatcttaaaatagttagctaaatattaatgcaaaaacgcgaataaatataaaataatgacaaagtctatagaagtgaataaaatgagacaaaaaatgaactaaaaacagtcaaagattaaagtccttttaggagttcactttattgcattgttattttcaaaaagtaaaattatggcaaaaaagttaaaacgccaaaatggtgggcggtcactaataaagtgataaaacccaattttttattgatgaatagtaaagctaaatcgaaatattttcgcgctaaaaatatgtttttcgtgtatatttcgttccaacaggcgcaaaaaatactcaaatcaaaaaatcagctagccctattaa

SEQ ID NO: 2758 - DNA, 3848 bp, Heterodera glycines
  misc_feature (3718)..(3718): n is a, c, g, or t
aaaaaaataaaaaaaaaaaaaggggggagttatataaaaaaaaaaaaaatttttttttaaagaaaaaaattttttttttttttttttgggcggggggggattttttttcaaaaaaaaattttttttggaaccggggggggcccccgcccagcccgtttttcccccaccgccacaaaatttttggaaaacccttttttttattttttttgcccaatttttttcccataattttaaatccccaaaaccaaaaagtaaagtaaaattatttggaaaaaatttgccttttcgattttttttcaaaataggttgggaaaattttttcttcctttaattaaatgaaaattaaaaaaatacccataaagaacttttttgccgatatttccattaatttaaaaataggaacatgataacaggactggggaataattttttgattttcatcatattttccccttgaattgctcagcagatcttcattttttaaatccctatttcattaatccaattgttttcccctaattttattatatttactcttatacagtaccaaaaatccatatataaaaatttttgtatagatcaacaaaaaattttgaaacttacccagttatttaaatagttattttttatgatttgcgatgattttgattacatattatattaagatttatatgctttttttactattatggacctttcatatttatttcttttaatctgagatattataacatttaacaaaaattgctaattttttaaattattttaaattcgatcttccaaataaaatttgttgaaaatatgctccttataaattggctccttttatttttaagattatttttaaacagtagcttgtaatttttatatgctttaattaatttaacattttttttatattttaaatttttaaaataatattgtactttgataagctttttacaatttttgcattaaagtatttatttaataatatttttctcatattatgaataaaattgattccttcaatattatgctagaatgagtgaacaggcggtcgaaaagatattttcatgttttttcatacatcaatatattatattaaaattgaatttaagatgattttggtcagattgttacattatatagaaatttcccgaacgacttaattaatttatttaacactaataaaattttattaaaatcgtatatagtgctataagacgcatattttattaattatttttctcaattaacgaatattttaaatttttaattttcatgaagaatttcgtttaatatctcttgtattccttttttttactaacttaaaactaggcgtcaaggtagatggctgggcaattgatggggtcggctggtaggccacacgaggggtagaagtgtgaggtgtgcaccgtcgcggttgttagtgcagtagcagctcaggcgcagatgcgtgtctggatgttcgtgcagcagcagctaccgatagatgcaatgaatttaaaaaatgccgagcctagccgtttatatttttgttccaccaagttttgtagagctcgagctgctacgaagcgagtcccgctccataaaatactcaaaaaattattaagcaaaaagcgaaaattacattttaaaatgttgggtgctttccaaaaaccgggattttcaaaaaaattttgctggtgcgaattttttccacacgtgccattttgtagagaatcgatagggctttcgaatgataccgatcccgaacggatcgtttcgggattcgcttgctgccaaatcgtgtaagcttttgggcatgctttttaatgggggggggtaatcgtaattttttaattatttttaaattgctttagaaattttttataatttatttttatttgtttcccacttatttgggtctatttttatttactttaattaatataattgttttttaaattattttttattttttcgccaattttccatttaattatttttatgcagcttttataacacaaatcagaaaaattctgattattcggatcacgactgaataattagaagtattgctggtagtttccgcaacgtttcaggattgttccttaaccggatttattcatgtgcaaaacagtaccggaagcataactggagttaaaatttaagaattagtcaaaaaccgaattagcctcctgaaaaaagttgcaaaaacttgaaaatgttaaaactttaaggttcggaaacccatttaaaatttttctttgtcccccgcaacaatattttggtcaactgcataattatatttattgcttaaattttgtaaatttaatttttgtttaaaatttatttttgagaatatttactatttttaaaatattttcgaaattatttttaaagtttaaaatatggaacaaaagtttaatcaaaatgaacctaaaacaacgaatgcagaaaaaataaaggtattttgttaaaaaaaaataaaattgaatcaattatgattttaattttataaaaattaataaatattattaattaatttgtgcttttaaatattttgtaaggttgcaacagaaatggctgtgaacattgagcgaaatttgaaagaagtgcaagaggaaatagtgaaaatgcaaaataggtactcttacaataattaattaaatttattttaattataatgtgcaaaatttgtgcagaaaaagacgattttgcgagttgctcgaaatgaatgaggtgaaaagtgcaatttttgcattataaaataattgaaaagaaataaatttagagaaaatcttcgataaaaagtgatgaaagtgaggaaaataaatcctgtgtttttttaattaattaattaaatttatcgagcaaaccaaaggcacattagtgctcttatatggcgccaaaaagaaacaaacaaataaaaagtgtcaaattaaaaatacaaaatgatgtaataaatgtgaaataaaaataaatcaaatgttaaattcacaggtgattattttaatgtaattgtggcacagaaatttcctactctaactcattgcttttagtaaacccctgaattcctttgccttattaatttgcaccgctaccactggaaggttattccagctttttactattctattgaaaaaattattttgagttttggccgtgtggcgctttacccgtaaaagtaaaggcctcctgagcctttctgagaaaaagaaacttttcccagcatcgaggctggtgaaccctttgattattttaaaagctgttgttaaatcattgatttttcttctttcttccaatttgtgtatgattttaagtctttccatatattttttgtacacaaatccacattttcgaaaagcttttcttgtgaaaaatttttgtacccgttcaattttgtctatatctttttttaaattagggttccaaacttcggtagcgtattctaattgaggtcgtacaaaagttttataagctgctgttagagtctttatttccctggtttttaagactctcaaaatctgaaagcttctaagatatgcgtttcgtataattttgcttatgtgttctgaaaaattaagtttcgagtgcattataattccaaagtcacgaacattatccgattctgaaatcttttttgagttaataaaatattcttttttaatattatttttccctaaatataaaacaaaacatttttcagttgaaatttctaacccatttatttttgaccatttttcaaagcctncattgctttatccaactgattcgaatggccatcatttttcgtgggcataatataatttaacatcatcggcatacatttttatgccaactgatgccgcttcatttgtataaaaggacggcagatcatttat

SEQ ID NO: 2759 - DNA, 1013 bp, Heterodera glycines
tttttgactattttgtcaaattaattaaacattgacaataagggcgaaaaataatttatttgtttatttaagcagcatcaaacccggcaaatggtttccatatgctgaagaatccattagtaataacatagcaatttttttgcaaatttaatgtttatttttattatttattaaatcaaaagtatttttattaaattttttgttgaaattttgtctatcgacttgtttgaacaccgcacatttcgcaatggtagcagtgaaattgcttgtatggaatgtggcaaaaagtaggtgtaattaataaaaaaagatttgagttttcgggtttatttggcgtgtgttttataggcgacacggcgtgttttcataaataaattatcatataacggaatttttatgtgatagaaatcttgaactatatattaaattatgtgctaaaaaacatgggcaaaatgtgccaaacttcgaaatatgtacaaaatgtttttatgtgaaaaaacgccaaaatatttttgttttaattttataagcgctcaaaatcaaattttgttcgaagaaaacgctattattttttcttgttaaattaaaatatatttttaaatttttaatcataaacctttttaagaaaaaatttgtttagtctataaataaatcttgatgagttaaaatatgcctaaaatgtttgcttttataaatattaaaaaaactttttcatcagattttcgccaacagaggaaaatgcgatgggctggcacattgtcaatgctcacgacaaatacgcggttaaactgctcaagaaacaactcgaaaaacagtgaaatgagacggcaaacaggcccgtaaccagggcgagggcagttgcccccccctggaaatgaaaaattgaattttttccagttcgaatttataagttttaaccaaatgctttaaaaattaaaaaaaaaacatttcccggctgtacctatcggaaccgcttgatccccagtttgcctttctattttaaagtttaactg

SEQ ID NO: 2760 - DNA, 2306 bp, Heterodera glycines
gctgatcccccagtttgcctttctatttaaagttaactgcaaagatggcaaacaaataattactttgttatgtgaaaagcggctacaaatctttgatcattgttgtctggcgctgaatttttcatataagacttgagaatttttttttggccggaagtgaaaaaaaacttttcggttgtctatccctaaattttgttatctggttaagagcctgtgcacaaatattgcatattgattaagcagagttcatgaaaacactattaaaatttgttgaataacactaaaatttattgttgataaaaattcaaaattaaaaagtatgttattattaaagctataaaaaaaattagtacataaaatcaattaagttagtagctaaatatttttacaaaatttgtaataagtaatttcatttatttctgtaattttgtggcctttcttagataattttgcttcctaaatcttttcattaattaataaacaaatgaaatgatttaacttttttagcattattttggtgtttattattgctttacaaaaaataatgaattaactaatgattcattttatttttatctgtttgtgtgaatgaatacaaggaacaatcaattaacgcgaataatcaattgacgaaaaccttttacaattgttaaacctcaacaaaataattaattaaaacaaacgtttattttatttcatattttaccgaaaaatcattgattaatgacaaaataataacaactcaaaaaatgatggaaattttatcattagaaaagtgaatgtcatatttgcaaaattttattacagtttcttatagatttttatttacatattcttttaataaacaaaatgtataatttcgcagctgaaatttgtgagaaaatctgaaaaaaagtatagagagaaaaaaaccatcttttttaccattcattactcattatcaaaaattaaaaaaagaaaaaataacgaaaaaaaaatggaaaaaaaaataactttacataatattttttgactgaaaataaatttgaaataaatctttttgtttttaattaagatttagatattataaacaaattttttgttttaataatttctacaaaaaatttttttaataagtaaataataaaaaatatgttataaaacctcaaaattattttaattaataagcaataaatctatgtaaattaataaattcttgcttatctcctccgtccttcattgatcgcttgaaatcagccccaactgtcagcatccgagtcaatatcctgaattttttataattttttttactgataagatttttttcattgcttaaaatatcccttggctaacttaattgcaaaaaaagtatgctggtgtaaactaaaggttaattaattgctttttgaacaccgattttaatcgattgtctaatattgccagaaaataattatttaatctatttcttaatttgaaaaaaagcttttgtaaaataaattttaattattttaatgatttcaccatcatttagaaatgattttttggcaattgttaggcctttttattgttttattctgcttcttttgctccttctttgttgtcagttcactttgcgcaaatatgtcagaattggccaccaaaatgaagagaatagcaaaaaaagggacgaaaaaatgaggaaaacattgagatgcgtgttgtcataaacggaagaaatgaggggaaggtcgagaacaaagaaaagggggacgaagaaaagccgaaacagagtgccgaagatggaaaaaatggctttgaggaggtgagatattttaaaacttttaaactacttaaaataattttttttaatgcaattaattaacctttagtttacaccagcatactttttttgcaattaagttagccaagggatattttaagcaatgaaaaaaatcttatcagtaaaaaaaattataaaaaattcaggatattgactcggatgctgacagttggggctgatttcaagcgatcaatgaaggacggaggagataagcaagaatttattaatttacatagatttattgcttattaattaaaataattttgaggttttataacatattttttattatttacttattaaaaaaattttttgtagaaattattaaaacaaaaaatttgtttataatatctaaatcttaattaaaaacaaaaagatttatttcaaatttattttcagtcaaaaaatattatgtaaagttatttttttttccattttttttttcgttattttttctttttttaattattgataatgagtaatgaatggtaaaaaagaatggtttttt

SEQ ID NO: 2761 - DNA, 2157 bp, Heterodera glycines
cgctttttcaaaagaattccggaccagtgatccttttccccgagggctactgcaccaacaattccatggtgttgatgttccggcgtgcggtgtttcaggacgatgttacggtgtacccggtcgccatacggtaggtttatgaccggattctgtttttgtaagcctatcattcatgtaatttgtgctcaatttaaggcaagaggcccgattcggagatgcgtactggagtgaggacaatttcatgcactacctgttcagggtgatgacctcgtgggcaattgtgtacaatgtgcactatttgggtgtgttttggggtgtcgcaaatgaaaattttctaaacttatttattttagctttattgcagtttacccgaccattaaataattagacaatgacaaattaatgtactattacgttttctaggataatcctaattagatatcttggtatcattccatagccccaagaatcccaatattaatgtatgtaatttggatgctttagaaaaaaatgatgcattaaaattgtcaaagattttatggttggtcgtgtgaactgcattagagcctttattattcaatttaagcatctaatatttatttgtttaaagctcctcaacatcgacgaccgaatgaaaatgccacggaatttgcggcacgggttcagcgactgatcgccactcgggtgggcgtccgtccgattgcttacgatgggggcggaatttggtgggtgttcgtttatctgtctgacatgaatagtcatgcataatttgcatttggtcgctttcaggtacaaaccgaccgaccgacaaaaggcacacgtcgaatggcaaaagcgctgcgcgagcaatttggaggaactgttgagcacggaagtggtgtcaacaacgggcactgaagaggaggagggcgaggcgaaggaggtgaatttgcggatggggtgggaatggaagacatttcaatttgttttttattttattggtcgtcaaattcaatgccatttagaagacggggcaggatggacacctttccaagggcgtagcaagaatttttggccgattttttaaacagatttccctaaaaatggcgattttttggtcgaattttattgcttttaagggaatattgattcaggcggtgcctatagatgccgccggggggaacttttgagttttttttgatgaaatttcttacaattaacaaaatggtataccattttttttaattttcccattttcattaaaaattttcatttttcggtttcggagaggttccccgttcccccccccccctcgctacgcctttgaacctttcatttaattgaatctttcaataccgaatggattaattcatttttaaaattccggtcgttccatttcaagcaactgattgttcggtcaatttcctcggatgggaccgaagaggggggaacttttgtcgctgaaccgtccaaacatgatgaagaacagctgcaacatgagcaacaaaaaagtgccactgctgctgctgtgactcaaaagcggagggaggaacgccgtcgtcggatgagtcaaagcgtcgagtccgttgtggacgacgtggtcggcgcagcagttggcgaagacagcgacgagatggacttgatcggctgaccgaccaaacacacagatccgattggaatgaggacgacaaatgattatgatgatgataatgcttttgctggatcatgattatgttctaacacatttattcttggcaaggcgcctgctctgatggacattcttttgtcagtataattttttgatgtagtaactgacttctcgagaagtgaaaataaatgcgtttcccaattttctgctaattatttcgtgatttttaattaaacactgcctaatgattggcatcgttctcgagaattgccaatcgtattgtgttgactacccgcacatatgcacactgtaatgtactgtattgttttgtatcgtataattacttaattttgttctcacccaattgtgtatcaaaatactctctctttctctgctcattttattattgttcatctgttggaagtttaaaaattgccgaaataaaataaagcatttttgatgctttttcttcctccacccactgcaatttgtatttccattagcaaatgaatgggtcgaaaaacattaat

SEQ ID NO: 2762 - DNA, 1906 bp, Heterodera glycines
tccccgatttcagacgctccaaagcgatcgaccgtttcctggccaagtcggactccgccaaaaagcagcggtcggacaaagcgcacgtcgactcggtgttcttccggcgactgttgcgcattctccgaattctcatcccgagccctttctccatggaagtgcgtccgttcattttagacgattttaaatagcacttttgggtaggaaattggttactaaattcggaatttcactattttctttttaaactgctaaaactggttaaaaacactcacacaagttattttaattggtccataaatgaatattaattggctttcgagtttagcagacccaaactaattggatattaaaatacattaaacaaaagaatccattactaaattaattaatccccccccccctttagctcctttttatggtggcaattgctctcagtttgatgctgcgcacttacgccgacgtttggatgtgcaaaatgattttttaattattatttttttcaatttcttttcaatttcaggattcaaacgtccacaaaaatagaggcgtaagttttccctttttttaaatttatttttaccattttttgtaaaacacatttaaattttcagtgccatcatttcgcggcataagcctcgtttttggaggtcgcttaccgactatttgttgtgtatgccgctcgtttcggtgatcaactcatttttgaaggtcattttcaataatttgttgtaatttcctacgaattttcagtccaaattttcgcaaattcccatttttaattacaataatttcccgttcagctgagtctttgcgagttgaaattgcgcttccgcgagcggctgacccaccacttttacgcgcagtatttggacgggttcaccttctacaaaatgaccaatttggacaatcgaattgccaacgcggaccaactgctgacgcaggacgtggaccgcttctgcgagggcattgtcgagctgtactccaacctgtccaaagtgacttttcactttaaaattatgggtttttaccacaaattcccataaatttgcaaaaaatgtccccattcggcgcacttcgaaaggttgccggaagaccatttcttcgttattagccgaattaaggagaactcaaaaatcaagtttttcgaacattttttgctttgatttttgtacatgaacgaaggactattaatttttgccggttattacattttgtcaggcgctttagaaaacaataccaggaatgtttgagaaagaaaaaattatggtccaaaaattcatccggtgatgttttggctgtagatgtttgtcctgttttaaaattctacaaatttaaaatttattttcttttttgctttcatttctcactttgcccccgttgaattcccccccccccccaattttcagcccttcgtcgatgttttgctttacgtcagtcgcatcggcgcttccatcggttggcaggcgcccattcagctgttcgtctatttgctcttctccggcacggcactcacttatctgcggaggcccattgtttgtttgttcattggcatttatttttaaatttcattttcaaatgttaaaaaaccgtcgtaattttgacaaattttcaataaataaacccaaatccccccccccccccaagggccgtatgacagtgatggaacaacaattggagggcgactaccgtttcgtcaactcgcgactgattgtcaacagtgaagagattgcattttatcaggcacgccgttcaattccaaaatgaaataaatgccaattcatttaagggcaatgagcgcgaacgcgtttctgtgctgaacgccttccaacggatggtgggaaattacaaatggaaaaacatttatttcaatccttaaattcgagatttctggattctttttttc

SEQ ID NO: 2763 - DNA, 1406 bp, Heterodera glycines
  misc_feature (20)..(20): n is a, c, g, or t
tgtccaggtcgaattttgtncgaattgtttccctataaagtttaattgatgtgccattattcataggccctacttcaacgaacaaaatgagggaatgatgcgcaaggacaaaacggaactgatgcaggtgagtggagaaagtttaggagagaaatttaaaaaagaaaataaaatcgcatctttttggcatttcgtccccaatttttttccatttccacgtccaatttgaggcttattacaccaccggccgtatgatggtgaagctggcggatgcgctgggccgcctggcgttggccgggcgcgagatgacgcggttggccggcttcaccgcccgagttgaccaactgatgcacgtcctggccgaccttgagcagggtgaggagtgtggacgcacaatttgacacttcaaatgacttggggacacattttatttcgttcttaaaaaggcgggggaaaagtatttttaaaatgtgaaaattttcagttttacgttattttttgagcaaaaattgtccttgtcgtttcagagcaatggaattttgaaaatgtttttgaaaggttttaataattttttgttttattttttaggcaaataccaaaggacgatgctctcaattaacgcggattcaaagaatgtggccaatggaaacggaggcctcgtcgtcattgaacagcagcagaaactgaacaatggtaatcatctatgataaatgtatgccaaaatgattactttttcaattttaagtgaaattcgttttaaaaattctattttttatataaaaaaacaaaaataaaaacatggtggcaggaaaaaggagcgaaaataaattaggcctgttaaatttttccaagcgacgccaacaaaattattccatatttttttttaattttgccagaagtgcacaaaattgttcactttctgacgggaaatttattttttctgaaaaatgtacaatttgaaaaatttgtaatggccgaatagcaaaaaacccttcggattcccccccccccccctccgaatttttatattaggggccttcccgaaatgtttttcccactcgcccatcactcacactcagatgaccagcacagcaacagcacaaccgcaccgtcgtcccctccggcactgttgttctcctcctcctccaactcgtcctcctcctgctccctgtcctccttccgccccggctccggccatgtccttgtccaagacaatttgatccgtttccaacaagttccgctggtgacgcccaacggcgacgtgctcatccgctcgttggactttgaggtgccatccggcaccaatgtgctcgtctgcggaccgaacggatgcggcaaaagttcactcttccgggtggtacgtcggaatatttttgatggatggaatacgattggggggggggggg

SEQ ID NO: 2764 - DNA, 2820 bp, Heterodera glycines
  misc_feature (2802)..(2803): n is a, c, g, or t
aaaatttcattcattttttctcttccattttcatgttcctgcttggcgaactgtggcccctgtggggcggcacaatgatcttaccggccaagggcaagctgttctatgtcccccaagtgaattaacccaacataaatttgtcagcattctttttattaaatttgtttttcagcgtccctacatgaccatcggctccctgagggatcaggcaatttgccacgggattggctttttgaatttactgccattgtcaggtcatttacccggaccgtccggcggacatgcgtcgccgtgggttcaccgacagtgcgctggaggcactgcttgaccaagtgcagttgcgcaacattttggagcgcgaggggggctgggagggccaacaggactggatggacgtgctgagcgggggcgaaaagcaacgcattgcggttagtggagcaccacctaaaccagacattgttttttcgttcgctttaatctcctcccttctctcgtgtctgcagatggcccgcctgttctaccacagtccgcagttcgccattttggacgagtgcacttccgccgtgtcggccgacgttgaggacgccatctaccgacgatgccatgagttgggcatcactttgttcaccgtttcccatcgcaaatcgctgtggaagtgagtcaagtgttattgggtttattgaaattcacaaatttggaaacaattcgtactcaattcaacgacttacacataaattactccgaaaatgagactctgcaatataattctccaactacgaaaatttgtgcagaggacaaaattttgtcacctgcattttttagaaaaacttaacggaaatttttcaagaaaaaatctttaaaaaatttttctatgaaaattcaaaaaaattcagctccgagattttgggtgcatccgaaaaaaatttgaagctttgactgtcggtttctctgattagaattctccaaattaggacaaatcttcagaataaggaaacatcttcaaattctctcattgttttttattacaattttatttattttatttgctttattttccccgccccttaaggcaccatgacttctctctgcacatggacggccggggccactacgattttaagcggatcgaccacgacaacccggcggagcagttcggctcatgatttttggatgcaattattaaatccattggcattttgcccaacaaacaaatcatagtcaaattccttcggtggattttgtgcccttccttttgccttttttgttattattttcacttttcttttgccattttcaaattccttttttatatgacgctaattcacttaaagtaataatcgaaagtaaatgtttattatccaattaaagcgagagagacaaaactcattagaccaattaattaatttaaaagtctcgggggttttttttggtctcgagcagcacaagtatttaattgggttttttaaaagttaaaagcatttgcggtgcacaatggaggggccgtgcttggcataatcgtcccgcgttatccacggcgttggcacagttttcaccttttaaaatggcacttttgagaaggtcgaaaagacaaaatttaagacaaatgcgcagaattttaaaagaatctgaaagtatttatttttgaaaatccgttggaaatttttgtaaaaatttatccgttttcagtccatttgggttttgaacacttcgttggcggtgcacatcagcatgtaattttgggagacggagtgcgtcccctgggggttcgtagcgacgacctttggacccaattaaattataattaaatttctttctttaaatcaccttgtaaatgccttgatcttgctgatttggagactaaatttaaaatatattagtgatattaaacgaaaaatgattagcattcaaaagcgaataataaattgctttatttatttttattacgttcggaaaaagttttacaaaactattctttttttcatttattttcaattttatttcttcaatttaaatgaaacagcaattgctcattaattgactaattaggtaattaagtgggtgcctttttccatttgcttttctgtcattactcactttgatggtcagtgtgcacaagtacttgcccacttgcttcttcactttgctgacgaagcgatcgcccgccaattctttgtccttcaaaaaccatttgaccgtcggctcggggttcgcgttgcaaatgcactcgaacagcaccgaactgacaaacgacaaacaaaatttaaaaataaaaaatatgtaatatttaaattattttaaatttctaagatggagcacccgttgggtttgttgatgatggagggagcacgctcaaaaaacgggggacacaccatttttggggaattttggaaatgagctaaacacaattaagaaaaaattaatgaatgaatttttattttcacaaattaattcaaatataataaattgtacccaacaaataattttaaaccaataaattaattaatttcccaattaaaatgctttttctccgcccgataataacacaaatcgcgattttcatttcaatttattccgtcgccagcacttttctcgctttactttttgctttgctccgttcgtttgtttgtgccgttcttttgacccgggccaacagctgctttttcttttcattttcggcttttccttgtgccctttggccaattttgttccgttccgtctgatcgatttccgccaccgcaatttcggggccattcttttggcccaaaaaatcttgtgaagagagatttgagctgattgaaagcnngtggagacaaataaacg

SEQ ID NO: 2765 - DNA, 2555 bp, Heterodera glycines
  misc_feature (78)..(78): n is a, c, g, or t
  misc_feature (103)..(103): n is a, c, g, or t
  misc_feature (141)..(141): n is a, c, g, or t
gagctgattgaaagcgtggagacaataacgttgagggaatgaatgtttttgatttccggaaacaaaaaactaaattgnctgagaagtgacagagggcaaaaanccggaacaccaaaaaacaaaaaattcaccaacccaaanaactgtggtagaaaatttgggtttttgtcgaattttcaaataaacgaagaaaaaataaatttataacaaaaaaaaaaaactaaaaaatgacaataaaagcattaaattttctctttgtgtttttttatcttcgcatgtaaaattcgatggccgttgaaaaggcggcaaatccggcggcgcccagcaaagcgggctgaaggccggcacggaatcccaacattccgccaacgatggcacccgaaagagtgcctaaaaagggggagaaaccgaattttaagagtggaattttttgattttttctccaattcccaccatttctccagtcgctttttgcgcgtgtcgtctccaaaatgcattcagtgccagcaaaaagtaaaccgatggaggcaaagtttcgcgagtaacggcccacccgcgtcttcatttcggtccacgtctcgcgcaatgacagctgaaaatggaaaaatggaggatgaaaagtaaacattgaaaatcaaataaaaaatagtaatctactttaaaaaagtggaaatattgtaaatgccaacataccggcttggtcgggtctttgctgatcgcataacttgggtccacgctgacagtaaacaggccgaacagaacgccgatgccggcacctaacgcacacgcaaccaccgatttgaaggcacaattttcctgtaaaaggggaggggagaattaaaaaaatttaatttaatgaaattgccggacaaccataacggaggccatcacgcgctcctcgcgactcatcggaggcaatgcaaaattggactgaaaaggggacagacaagtagatgcattttaataaatgatgtgttgacaaatgataggggcttctctcgagagtctcgaggaattttgagaacggcaaaatggaaaataaaaatttgaagggcaaaggaattgggaaacacctgaacaactctggcgatgcgcaactgaacgtcctcatcaacgccgttggcaactgtacggaaaagtggaataaattggagtgattattcccggcccactctttcgccatgggcgcgtccgcgagccgatcatttcgtcgatttggcgaacaaaagcggacggagtgtacacaaaaggaggctgctgggaaaggaaagtgaaatgataaacagaaaatcaaagggaaaatgccaagaactaatggccaatcccgtcactcaaagtgccaaaagtataatccccaatgaatccgcccattctgttggcccacctgctgctgttcttgctggtgcccttcctccgattggccttgctcatccctccgaaaagggttggggaaaagccgactgagccgatcaatggagcttgaaggatcaatgcgaaaagtttccattcactttcaatggcagattatttgaaaaatttaaaaaaatgaatttaagtatcaccaaaattaaaatgattgggtaaataatgaacagaaaattttaacaaaaaaaacaaagtatacagaaaaaaataaacaaacggagtctaaaaaaatatgcaaaagtgacacttttcgggggaatgagatcccaaaaaatactttaaatggcagaaaagagcgaaaaagtgccaccacaaatgacaaaaaacaaagtgccaatcagtgcatggaataggggacgtaaatgcggcgccgaaacagcgaacggaagggtttttccgcgtcgtcgggcaacggaccgatggaaaagagacgcttcacctgccaaggaacaaaaaattagttcaaatgaaaagcaatggtatgtatttgttgaaaatgaaagaccatgggatttaaaatggacaaaataaaattttgtggattaaaaatttataaattataaaaattaataaacgctttaacgggtacttaattagaaatttatttaaaattgaatttgtacatacttttgggctgcgcagcaaaagcgtttccaataagccggtggtgagcacacaacaccaatagagggagaaaatctaaaaaaaagaaaaaatggttatgtttttggaattttttatttttttatcttaccactggcgaatcggacaacattttgacactgccaataatcagtgcgaccaatgcgacgtcaaagcaagcggccaacactttgtaattgctcgacgtcgacatgaacatccaccggttggcctttaacaaattgggaaggacatgaattaggggagtaattagtaaattggcaaatgaaagggtcattattaaagggaaaagtcaaagaaaatggcgaaagaaataaaaaattttttttttgcaatttgtgtctgtgtcaattagaagggactaataaaatgattactgcctaaatgttggattaattaacgcctaattacacaaagtggtataaaaaagcgctgtgtaaatcaccgacactcacccaaacgttggt

SEQ ID NO: 2766 - DNA, 4682 bp, Heterodera glycines
gtcaaggaagtaccaaatatacaacagacttttcagaaacaccgaactctgtataaaattctttaaggtccaagtgaacagaaaagtcttagggggaggggaagttgagtttttgcgacaaatgaaaaatctagcagttccaccgtgtcggcagacacgccgccaggaaaagtattcaaaatttttagcgaaaatctgcctaaacaattagcgagttttttaaagcagtataaaaagcccgtacggtcataaatagaataacggactttgaaaaccttttaatcgctaattaatagtaaatttctctgagtcagaattatgaattataattttgctaattgaatggcaattcgttttccgatgctctcacctcgtacacctgcttgcgcaccaagtggaccatcatcagacgttgagacgtcagtttttcggtgagaattctcaccggaacggtggccaatcggagaccgaccgcgagcaaaagaacggaggaggacggaccgagcagagagacggaagacaaaactgaacagggacaaatcaaatgaaaagtgggggaaatggcgaacaaaggtcatttgatggcacaaatattaattgggcataattatggatttttcttgacattttgaaaatttggatacgcttaaaaacttttgatgtatttttttccaaaaaaaatgtcccttaaattagtctaaattatagtttttcgaaaattaaaatcaaaaaacttcgttacatttaaacgtttccgtaaatccttcggccaaataactgttggacataacgacgacaaaattgtcggcattccctttcaaaagtgaagaaatgccatgcttttgttgtgaatgaaaatgaacgggtcgaagaaaacatttacggcaaaggaaggaaaatgagagcggattggacatgatggaatggactaatgaaaatcttaaaaaacaaattaatatttatggggaaaagtaaggaattacgacccccaaatttactcagaagaatcacgatttatagcattttggcaacccggaattgtgaggaaacgcaatttttaaaggatttaaaatagcgctttttgttttatttcttatggcgaaatgttatttcatttaaataaattcaaatcaaaaatttttacattaacgaaaaatttgttcaaaatgctcttacaattagcaattttctagataaaattagcttttcaatttaagtttttaattttggttatttcttttatattcaaaacattgttttaagcgactcagcgcataaaacactttaaacctaaaataaatggaaaaaattcgcaaattcggcagagatttgcaaaatgaagtcgctaaggaccttttgacggagcaattacttcagaagaacattaaaacggtgtacgggaagagtttgagcaaagaaatggccaaggaaatttgcttggaactcaccaaacggtacaaagagaaaacggacgaagcgatggaagaactttacgagaaggaagaggtccaagtttaagtcattttacacaaaatcacattggcatagtttaggtgctcaatatgacggccaaattggaaatgttccgccaaaaaagtcggacgaaaccgcccaaaaagatcggcagaaagtcgtgcgaatggacggcgccggagacggacaatccgggaaaagcgatttacgcagtcactcgccctttgctggtggaacacaaggagaaactcaccaaactgagggaccagctgaaggcgcaaattgaggtaggcgaaaatgagcggtttttttttgtcaaaacaatgaaagttattagaaattggtgccatcccgcgggaaagttttttttttttttgatgaattgcgagattggtaaaagacaaaacgttcaatgcctaaaaatgcaggaatgttcaaaaaatgttctttagactgatactttttgggtaaaattgacaattcaagcagtttttcttattcaaattaaaaaacaattcttaaggccgcgaatcggcccgccaatagcgaccattatatggccgtctaatttattttgcctatttttgggaaatggactctccagtcccgagtctgtaacccgactcattgtcagagttgttgccgcggcctaaaattgcaataagctccaatctcacagcggggggaaccctgtctcccataaacaaaatattaaaaaaatatttctttaggccaatgaaagggaattgatggaagaagattaaacagcgacagaacatattcaaaattctgatgctaattatgatgatgacggtctctctctcttctcagcaattcctttgtctctgagtgacaaaatatttattttatgtcgccaattttaatgctttatctctcttttttgtttttcgtgaataaagtgcgaattgacaaaaagagcttcattctttgtctgactaatggacaacttacaatcagctgggaaaaaattaaaaattttttccaataagttttaatttttagtaaataaaaatccgcaaaaatgcccacatacatagaactcagagttatagaactgtctaaattagtgaattttcaaaatgtgattaatttaaacatgggaaatttttatgttttggctgggacaaaacgccataaaaaaattggccaagttttccgtaaaagtcaaaaatggccaaatgtgctccattacaaaatttggggcaaaaacttcacatacagttaagttcacttaatttaaaaattgagaatttattgggataagcaaaattaataatttgaaattggaaattgaaaagatcgctcaatttttaaattggtggcatcgttaatgatgttgccattttatgtatttagtcgtgctgtttggatgtcgtgttcagcacacttttgtgcaaatgcgcctccaaacggacgaaaaagtcgaacagcgaatttgggacgaaagtgagcaaaagggagaacaacagctcaacctgaaaaaagcaattaaaacaaaattgagaggaattttaattagttatttaatgatttattaatttatgctcctaaaatctctgtcattattttggtgaatcgaaattttgaaaaaatagattaataatagctacctatattaaaaacaaatatatatgtaaaataaaatgtgcaaaaatgaaaaaatatgcttagaaatttatgcaaaataatttttaaaataaaattattcccaaaaattggcacaaattgaaaacaatgtttaattcgaggtcaacataattaaattgttgatcaattggtcctgtgccaaatccaaaaatatgcctccaaaatggtggtggtgcccaatttcatgttcaattttccgtgtcaaaaatttcaaatttccgtgccaatgccattccgttattcccccccccctttttaatggcccacctgaatttggtgggacaaacatccgctcgtctccggcacgaggccaaccgtttggatggcttgacgcgcaaattccgttgggctggcggccaaaagggaagaaaggccgtcacgggacgaacgctgagtcagtttggtggccacgaccattggacacaccgtttggatggcaatgcccggacaatcggaggcgaattccttgcgcaagatttcggacaaatggacaatgaagctctgaagaaggggcacggggatggcatttgtaggggaattggcaaaatgggagtggcattttataggacaatggcattttagaaaaaaaaaaaaaatgaaatttggctattcgcgagaatgggaaaggagcggaaacggacggcctcgagaattataaaaaataatttcggtgccattgccagaaattggagtggtgtcgagaacatgacggaaatgggacattatttgaattctcgagaatgggagaaatgtccgggatttcggcatggaaaagcccccccccccctcccccctctcttccaaaattgcctttgtagaggaatagacggcgtactggtaccatttcatatacgccgaggcggacgaaatgtttatgacagcaccgcgacggcgtttgaccatttgtcggaggacaaaagaggacaaaacggtaacgggcaaagtgttgacaatctgtggcggaaataattggtgaaatatgagaattgatcaatcaaaaaatgattaaatatattccaataatcaatgatcacccaattaccgtcctttcggacaacaatttggtcgacttttcgtcaaatcgttccgggttaatccatttgggttgccccatgccgaccattgttcactgaaacgccaattttcaagtgtttctggtccattttccattaaccaccattaatagttggaaaaagaatttaatttttcgaccaaaaaatggtcaaaattattaataattttccacacaaaatgataatcttttaatttctttttttctcacccaaaatgccgaatgttcaagtcactgatggcaccaaaaatgtgccgttcgttagtccgccgggttggcgttggtgaagtcgaattgtatcgtccgcgagctgcacttcgccccgctgtccgctggtggccgaatactgcttcgagctcggtggccaccgcctccgatttgtgggccgagcgcgagatcggcgcctggttgaagccgcgcggggccgacaccgcggcgtaggctttgccgaatgccgttcggtggcgcc

SEQ ID NO: 2767 - DNA, 2392 bp, Heterodera glycines
taggttttttgaaggttttgatttttttttggtttccgccaatggtttgagttccgaggccccgaaaatgggtcagaaattgttgaattttgccccatgacacccgaaaaccctctacttttagaatcttgtgctttgatgttcgaatttgcttttgttttcgtactttggcgtgtctgtgtgatttgtgatgaccacgaacccccccccccccagaaacattgtcccgtctccattttcttgactccttttttggcgctgaattcctccctgtacccattgaatccatgacatgacattttcgcagtccaatccccaccatcccctctttttcccaccaatcacatgccaatgtttgtttaggcacttctacgttgttggcatcggcttcatcccctgccttgccaccatcgtcttcacacacgtgttttacggtatgtttggttttttaaatgtacaaaatttactgggaattctgtttttcataaacatttttgggggaatttacgtccaattttttgtgtcagcggtgaaatttttttttaaaatttgcataaaatttaatcccatttcaatttcgttttgtatatgttttccaatgtttttaggcccctgcgagttgaccgaatacccaaccgatgggccgccgccgcgctattggcaatttgagcggacaccgctcagacaggcgtacacgtggctgaccggcaaatcaggtttcagaaaaaatcgcgcaaaataaatgagtgaatcggccgcaacaaacaaagtggggctctttgaatttttttttcaaacaaggaggggggagggatggcaaatttgcaacaaaaaaaaaaaaaaaatcgttcgtggtggatgccgtatgggggggggggggggggattgtcatgatccgcatattcgcagaatacatcctacaggtacaacccgggaggctattgacaaataatttgcgattcatctgcgattcctttcgaatcgtttcgatttgtcttatatttaccttttgtctgcttctacaattttattcttattttatctaattatagcctactttcgtctcactttgttcagaatttggctgtcggtgaccccgtgggttccaaagcggcgattcattcggaactccgtgccaaattaggtggtcattacgttgtgctgtgttcacaggtaagcatttatttgccaaattattttaatttaatttttatttttctcaggcgccggcactttcattcgccgccgattcgattacgcatttttgcctcgagggacataatgtatggaaacaaaataaaattaacggacatttccaaatttgcgttttttaggctttgggttgtgccgtttttaaattgtgaaagaaaagatggcctggctttaaattacagcgaataatctcttggaatgctcaaatgttaactcattcattctcacgtcacttcactttcattctgtgaattggcgacacttttgtgatttatatacaacagatattttatttacaaatttataaatattgaattttatttttgtatttttgaatatttttaattcaaaaactgatggatttaccaaattgaaaatgagtaattgaattcctaaccttaaactataattagcaaagtttttcaaacttttcaaaagaaacattccatcgattgatcggacgaatgattaaactgttaaacagtgattaagcgagtgattaaacaattgataaacgaatgattaaatgccttttcattaagcgtggtccctcttttcctccttttagcatttgcaatagcaattgacgtcaaatggcctgcacactccgccggtgtacccctgctccttaagtcgtccgtttgtgcagtgaatgtggcagagaaagctcaggacgaattcgcatccgtggccaaacccgaaattactcggggggtcgtcgtgtcgacaactgttgggggggggacgggaaggagaagtgccaaaagagacaaatcagaggaaaagatggagtgccaaaagagaaaggtggaaatcaggggaaggagaagtgccaatagcgacaaactaaaagggagagtaggagtgccaaaaagagacaagggggaagcccaaaggggaagagtgatctctgaacaaataaatattccaacaactcacactctctccacggagccatttgcgacggcatccgactgatgcgtttccaaaattaaaaagagcaaaaaaagaaaaagaaaaacaatttgcttatttatacacggcataagttctttggatggaatgtggcgggggttgggaaggattggagaagaatgatcaatgcaggcaaagaattggatgggataaatgagagatacagcgcaacaaagacgaagatagcgaagggagcgattgatgg

SEQ ID NO: 2768 - DNA, 5701 bp, Heterodera glycines
ttggcagactacctcagccttcaggtcgacccgattcattcaatcggaaattggcaatgtcaattggggacacaatgtgagaggaggggaggtggaggggggaagggagaaggggaagggagtgccgaggaagggaagagattcaaaaggggaagcaaacggaagggaagggaagaagcgcggatggatggaggaaaagcggaagaaaattattcacccatggttcaggaaaacggcaattggaccggcattttgggcattctacagcagggaatggccgacaccatctgcactctctacccgtctctcgctctgcccaactctctgcccactctgatttcccccctcccctctttcagtttctcccaacaaaaggcgcttttcttcaatttttcccatcccgtcactggcgtattctccccccccccctaatggtcgctaattgccttttaaggtgcgcgatatgtacatcgcaaagcccaaacggaagagcttttcgctggtcctttggaatgcctttttgccctacgagcccaaactgtggcttctgctgctcatttcgctgacccttcagtgcggcttggcctcgttggtttgcaacatcgaattccgtctcaattttcgctcttcctattcacccctcgaggcattttggatttgtttttctaattaatttttgttaaagaaattgtggcattatttgcgtctccaaatccaccaagtcaccgaattccaaacgcccttccacctccaatccggtgactgttgccttttggccattgactttgccattggccattttccccaggcaatttggccttcctcttctacgccctgatccaggccactctgttcactcagttgtacaccgccgttctcctttcggctttgatccgcggtcagaacccaaacccatgggactcttacaaggaaatgattcatttggtgcgcgacggcacttactcttttgtcatggacaaacatcacctgaacaaggacaacaggtactgctcgaagaccaaagggtacagcgacggattggggagagaaatgcaccacagagtcaaatcggcacttgacgaaacgttcatttcgcacagcttctacgaaaccctttcttattacaacaatctgagccaactgcgaaatttagcggatgccatcaaacacaacccgatcattgtagtgcaaaatgtcagtcaatcgttggactttgtcgagaagtaagtcaaaatgccgagtcacttttcgcccattcccccccccctggcagaggaggatttattctgccgaccaaacagcacagtttggcctatcagctgagcaaagaacgatgcgacttcttttattttgaggacggtgagaaatgccatcggcgaataaggccattccttcccatgcgcagataacagccaaagctccactttttttctgttctcacggcacagcaaattcctgcgcgaatggaatagggccattcagaacaatcaggcatttatcaggcgaacttacgagaaagtgagcagcccaaacattggccaaaaggcattagtcagtgacccacccaatcactgggacgagggggtggcggttggtccacccaattaacgaagcaaattgggtacctggagaatggggttggcccatccaattaattaagcaaacgcttcccttccctgccagtacttcttcaacagcttcaacactggaaatgtgccgcaatgcaaacggacgatggccgaaattggcaacaagcagtacgagcagatggaatggttcagcggcaacagcgacgcggcaaaagacgcgtcactttcactcggtaggaattgttccgccctctgcgaaagagggcacttacaaattaggtcgaattggcggacaaagaaaaaattccagaaaatcattttttgctgtctaattggtgctgggacgttagtcaaaaaccatcaaatgaataatttttgacagaaaattattcataatttcgtctaaaatagatcaaattttataatataaatatttttcgatagccctaagtgttttctattatcctgcaaaattagaaaaaaattctttaagtttaaaaaaagttatgacctgagaagctcaaaaacccaagtttttttgaacatttttagtcataactttcttgaatcttaacgaaactttttggaattttgtaggctaatagaaagcacttagtgctatttaatgatatcaagaattaaaaatttagatgcttttgaacaaagttatatcaaaaaatattttcatttgatggtttttgactaacgtcatagcaccgtctaattggccctttcttctgttttttatcagacattgtgtccaccttcggtatttttctgatcgttttgattggcttttcaattgctctgcttgcatttgtctgcgaacttttggtggacgcaaaagcgcgccgcttccatcgaaaatggcacattcgccgtgctttggttttcaccgctactaaccccacccatttgatggcaatcgcgcggcaaatgaacgaaaaacggaagcgaatgggacacgttgttcgtttacccccccccccccccccaattcagtgttttggttatctttgaattcatttttcaaggactcgcaagcatcaaccgaaacgcccccgtcatttctaagagagggtaattaaggaatttaattacaatttgggatactaatacactaattaatgcttgtatattttgggtgcccctcaaatggcgaagagttggtggcagagaaaaacaaggcagcaaaaatcggacggacgatcgaatgcgatcattgcggcattgacttttgcggcgatttcgtcgttgcaaatggacgaagaagaggaagagaaaggcgaacaaaaatcagaagggatgagaaaaagaaaaacgaacggagccgaaaagcaaatcgaatggaaaagtacggaattttgagagggaaaagcaaatcggaaggatgggaacggaagagatcgacgcgtcatggaatttttagaatagcaacgcatttcttcatcattttatcttttttaaaatttcataaactgttcaaaaaacaaacaaaacaactgccgcccatgggaatgtgcttttgcagttgttttttcgcttttcctgctgatgactcatccgtccgtccgttttcacttccgtccgtttcacttccattcactcatcccttcgcttctttcttcgtcatcgctctgttcgacttcgtccgtccctttgccattcatttccatttaaatcattccgtcgccccatcaaataaaataaaataaatatttcacaataaaacacacaaatcaaaatgttcttcctttgccctcccattgttcttcttccattggcccttttctgcgtcgcttcccatggcttaacaaatcattcgaaagcatttggaaatgaaagcgaatcgaatagaacggacttttttggcactgaacccatggaaattccccgtcataaaagtgccgacggattcgacccaatggtggacgacgtattcgctttgctttctgctggagaagagggggaagaggagggaaatgggacgaaggtgggaattacggtggaggaggaggaggaagaggaagagcagcaggtgagagacccctgacaggcttcgtgcctttgtgctcctgctgatcaccccttcgtccagctgcttctccgttgtgccgatcagctgtcgccctttgtgccgcttttgctcgtgccgccccattaccatcgctgggacttcagttgccattttcaaggcaatttggcgttttgtttttgttgatttatttttaataggcaatcagtccgaaaagcccgccgatctttccccaaacaatgccaatgaaaatgccgacctcttcttgaaaatgtcaaagccgtgccgctccagccaagtgccgcttacttaaggaacgcactcaaattgttcttttcagtcatttcgcgatgccatcacttccgaacctaactgtcacctttttgttggttttgtcgaccatttccactcattccccacaaacactttggtcacaaaactcaacggaaaaactatgaacggaaaagaagcggtggttcggttggtatgtggtgaggagatgaagcagttcaatgaaagcaatgtgaaggagaacggactcaaaaaaacgagcggggatgaggaaacggtcagaattaatggaccgaggggaggggcaattagaaaattatttatctctgtgggggagagggccggggaaggcaaagcttgtgacatcataatcattttgtaacccattgtcccaatcaccacccccctaatcacatatgacataaccaattgttgccttgggggcggtccctttaatccagctcttttccccttccccacttctccacacaatcagtctctgactgcgaatcgggagaggcggtccatccaattgtataatactcttgaataaatgattgttaacaacacctctaccaaattgggaatgttaatggacccgcctggacccacagtattcacttgtattgtaacccgacccttttcagttcctgaagactttggtggttgttgagaagacttggcttcccggttgcttggctgtttttttcgactcgcgaactttggaccttcagctggacgaaattgccaaattattgtggaaagacggacagccgaaattggggacatcgaacggaaagaacaaatgggcggcatcaaaagtgagcagagaatggaggactgcgaaaaatgattaattaaacttctcatcttagtttgtgtgtggggagaacgaacgcaaaacattttatgaggagctgagaaaaatgaaaggccgaaacgagaaaatgggaaaaatattaatcattgaggacggggaaagtgaggtgggcatcgggggagacggatgatcagaaatgggaagatgggtgatcagaatatgggaagacgagtgatcagaaatgggaagatgggtgatcagaatatgggaagacgagtgatcagaaatgggaagatgggtgatcagaatatgggaagacgagtgatcagaaatgggaagatgggtgatcagaataagggaagacgagtgatcagaatatgggagatgaaccgtcaatgcacggagagggaggggggaggagagggggggggggtacggtaccccaccttccctaccaacccaaatcttggcacggacctcccctgcttatttgtaaggtcagaaatgttctcctgaagaagagtgacgaggagctgtactgctcggaacaggtaatttgcctcaccaatggtcattttggatttatttttccaaggccgagaagggattctttcaacgcctttgggacggattgtttggataaaacgggacgggaggaagagactgaaggaagaagaggaagatggaggaagagaagtgaggagaaagaagaagatggaggggggaggaagagactgaaggaagaagaggaagatggaggaagagaagtgaggagaaagaagaagatggaggaggaggaagagactgaaggaagaagagcagggggaggaagagacggaaggagaaagagggatgaacacggaaatgattgattgacccataaacaaaaaaagtctttccattcaaattatgtgttttttatgaatagaaacattgacaactttacaaattggacttggtaattaa

SEQ ID NO: 2769 - DNA, 4825 bp, Heterodera glycines
aagtttttggacgagccgagagggcctttaggtcggcatgttcgacagtacctttccgctatgagttaatcaaacgtgaaatgttgcggcaactagaggagaccgatgcacgcgaatggaatgcatttgatcagttgatgtcaggcattcggcgaaaaaatggagaagatttggatgatttggctgatcgcgtaattactttagtcagacgtgcctaccccggattaactgaccatctcgttgatgactatgcaataaagcatttgatcagaacctttgaaagctctgagttagctttaagtttggaaatgggcagaaggccgggaatgacattcgatcaatttgtggggatggctgcgcgcgccgaggcaacgcagaaagcaacgcgtcgcattgcatcaaataatgcttatggaaaaacgaattttggagcaactctaacacggcaaggtcctgaaccgaaaaccaattttcaacattccactggaaaccgtccaaaatgtttttactgtgaaaaagagggtcatattgcgcgaaattgtttccggcgtcaggcggaagaaggcaatcagaatcataattcgcaacaaaatcataatgtgacgggttcaaataaaaccccgttgtccttgtacccaagccaaagtcccgcttataaacccgaaccgaacaacgcaaatccgcaacgcccacaaaatacgcaatcacgaaattttctcaggcaaaattacttagtggaacaaaaagacttaaatcatgagtcagcggatatcaaatgtgctggagtgatcagcaacgattctaagatgttggaatttttccaaaaattttggaaacaaaacgatgagaattttgagccaaattcaaacgaaacttcgttagttgggaaaataatagcgatcacggtcacaatttttgatcaggaagctccgtctatgatggacagtggagcccaaatttcactagtgcaagcgatcttcctcaaagagctgttcgaaaaacaaaattttggaaaggaaaagatgattatttttcctaaaacgagaaatgtcgttgacgttaacggcaagcgcgtcgaatgctacggcataatttctcttccagtcgctcgtagagactgcgagcctattaacattcaattccatataacggatgctcccattggattaccaattctcctcggaacaaatgctttgggcccccttggtttcaaaattcttgattccaaacatggcgagcttatcgaatttgagcttgctagtgaaaaatctgattctgttcgcttaattcacactataatgctcgagccatattctacaaagttggtcgaactttctgtttcaaagtcctttgatcagaaaaatgttttaattgcgtcatccggcgtaataaacgatgtgaaagttgaatcatcagtggacagagtgagaaatggcaaagtgttcgcttcgattacaaatttttcgctaaattcgataattttgaaagagaatgaaagggttgccatagtggaaactgtcgatgaaattgctaatgccgaagactgcttaaccaattcatggctatttgataactttcaacaaaaaatcgactcggaatgcagaaatactaatttctcagaatggaccccaaggatcggtgcccttgacagtgataaagcaaagacacttgaaaaagtgttactggaatctaaggatatttttgcttttaatgacaatgaattgacccaaacggaaatgataaagcatcacattgacacaggagaagagagtcctgtcaaaaagcgaatgagacctgttccttacgcttaccgagaaaaagtggctacaatgatccaagattatttgggccggggaataattcgtccttcgctttcaccttggtctagtccgattgttattgtaccaaaaaaggatgggtcgttaagattctgtgtcgattacagaggtttgaatgcaattaccaagaaagattgctttccattgccaaatattgagcgaacactgctaatgcttgggggtcggaaatttttctccactttggactttatttctggttattggcagattaaaatggacgatgagtcaaccgaaaaaacagcttttgttactgaatttgggttgcatgagttcaccgtcatgccatttggcttatgtaatgcggtagcaactttccaacgcttcatgtcccatttatttggcgataaattaaatgatttcgtttttgtttatatcgacgatgttcttgtggcatcagaaacgttcgaacaacatttagagcacttaaagtttgtttttgagcacataaaggaggctgggctaaaattaaaagtggcgaagtgccaattctgcaccgaggaactccaatttttgggccatgttttaactcgcaacggaataaaaatggacaatgacaaaataaaaccgattttggacatgccaacgccaaaaacaaagaaggaactccattcatttttgggattcatgacctattataggaaattcatttattcattcggttctatggctgcaccactatttaagctgttaaaaaaggacgtaccgtttaaaatggataacgccgaaatggctgcgatttcaaaattgaaagggaaaattctgagtgatgttgttctttattttcccgattttaaagctgctatggaagacccgacacgaaaatttttgattatgacggacgcaagtaagaccggaatatcagctgttctttgccagcctgatcaacaaaatcggattcgaccaatatatttcgcatcaagacaatgtaataaacacgaatcgcgatactgtcccacagaattagaggctttagccgtcagattcggcgtaaaaaaattcgcacaatacattataatgattccgacaagagtattaacagaccacaaagcattaattcctatgttcaaaagtaaaaacgagaccggtaatgcgcgcgtcgacaaatggataatggaattaagctcccggtttattttggaaattgaatataatcccggcaaaacaaacataatcgcggatgttctttctcgttcgggcgcattaaaaccgaatgaaacagcagaagataaaactgtgattggacaaatagccattggaaatgaaccggactgtgttggaaacgaggcggaaataaatgaatggattgccgcgacaaaagaaagcgaatttggtcatatctatgaatttctgcaaaaacggaaattgcctgaagatcctcgggattctcagcgaattttggacacaatccaaaaattcacagtgctgaatggattgctgtattttcacgaatccaattctggaaatctccgtctttttgttccaaaaaaatttcgtacggacttaatagaagaaagacatgagggtaaatgcgcggggcacttaagtgggaaaaaaatatttggacaattagctgaaaattatttttggccaaatatgcgagctgattgtgttaatgcggcgttaaaatgcaggatttgtgctcatacgaggagtccacggtcaaacgtcccacaattaaaaccagtaattacatcagaaccatttgaactggtctgtatggacatactttccattggaatgtcagagagagggaacaaatatgtgcttgtaatggtggatcattttactaaatacctgataacagcagcaattcccgacaaaagcgtcgaaaccgtcgctaaagcatttattcagcaacttatccttattttcggttcccccaaaaggattcattcagacaaaggtactgagtttgtaaacaagacatttgaagaaatcacaaaaattctccgagttgaaagaagcatgactgcggggtacgatccaaatgcaaatggacacgcagaaagggctaaccaaaccattttaaatatgctcaaaaggtccacagaatcaaactggtcatgggacgatcgcctgccatttgtaactttcgcttacaatattgccccatcagaaactactgggttttcaccttttatcttactttttggacgaccggttaaatttccttcggcaaatggtgtgaattttccagttaatccgctctatacagtggatgaagagtcatatttgcaacttttccgtgaaaatttgcagcaaattttaatgaatgccaaagtcaacgcagataaagcacgggaaaaaatggaaaattggtttaattcacagccaaaagtcactgcaaacaagtacaaaaagggcgagcgcgttatggttctttttcctggtgccaatcaaagagtagcacataaaaagctaaaatggaacatttttggcccctacgaaatcatggaaatatctacgtcttcagcaaaagtcgttccggtggataaaaagtctgctgaacagatttctgtgccagtggaacgactaatacacgtcccagagggaataccaaacatttcaacagttccacgtggaaaaaatgcttacaaaaatttgttgaatgcgatgaccatcttgaaacttttggaactaaatgatgttgaggggtttgggaaggaaaatttggttgaaaatcggataaattcatcagggacgatgaataattcagggggagtcgaggaaatggacaccagcagggcggaaacacaaataaagtggacaaatttttgtgatggcactggagaacacattctctgcaaaaaactgatcgcagcagatttggaccctgtgttggacaagcagagtggcgtgggacagatgatagtgacaactccactacaaggactgatcacaatttttgttttgcgatcaaacatcgcaatggcggcgagcaaagaactgctcaaggtcctgctgaa

SEQ ID NO: 2770 - DNA, 1767 bp, Heterodera glycines
  misc_feature (35)..(35): n is a, c, g, or t
  misc_feature (103)..(103): n is a, c, g, or t
  misc_feature (1593)..(1593): n is a, c, g, or t
  misc_feature (1625)..(1625): n is a, c, g, or t
tttgaattctgacccggattttcgaactgatcaantacgtagaagaacggggagattcagtccgatcgggctgtgcccgggagcagatgaggtggaattgatntggcaccactggacaaacaactgtacaattgtgcatgacgcattgaaggcgacaggctacggacagatcaaattggatgcgccgatcgcagtttccgagttgccggaggcagaccgaattgtgtggcaaaaagtgtttgatggtgggagttgggccctggaaaaagtgcgcgctgctgtcatccatggcaagacaactttggtgcaacagccacgtgttatcattggcgattcgagtggagcacaactgtgtggggaaagcgccaaccaaatagccgcacattttattgggaccacgaatggaagccttggcgatgtcatcagagctctggacaaggccattctgacgactaaagtggtgtcagcgctgattattttgggacgtgatgcactggtacgaggagagacgatggcacaaatcgtgggtgaatgtgaacgaattcgggctctctgttctcgatttgcgcatgttcgttttatttggataccgccaccatacgttcgggaacagcacgcgcaatacaatgatctgctgccatcgttggaaagtgtggccggggactggtttttggcattcaccgagcacgggcgtagtctggttgaactgtggaggttcggcgacacattcgacatgtcgcgggtgcgagcagacggaaaaatgttgcccgaaggtctgaagtgtctccgtgcctggatctttacccaaattcctcaatttcctgatgataattcccttggaattagccgtccatcacgttctgtttcctcttctgtctctactcaattgtcggaattgtcaatcactcgttctcatactcattctcgagatgttcgtgttcacccgtaccctattcgccaatcatttcacaattctcgcgggcgcagagatgggagagtctttgagaatcgtcgtcgtcactgagccatgtgccttggaccaccaccaatcggatttctaattctctttatttctgtctctcatcccaattaattgcttagacgagggaccgtcttctcataaagggtcggggtgtgatatcatttttggacttcattaattatttaatttattatgtttgttttggcgttccgattattcaaattgaccttaaataatttgttttggttattcgtgtctttaattcgttttgcataaagcataattttatcgtttcgatttattttgagacagggcaagcacctttgactgatcaacaaatttaaattgatcgaattgctttcgttgccttcgcttgccaatttggaaaataaagccaaagcataattgttcaaaaagtgtaacttggcgctcctggacgaccaaggtctggctcagtgacattttcattaaatggggataaacgcggtcataaaattgcttgaaaaccgacggttgaagaaatttgaaaaaagccctcgtgttggcgcattttgttgatttgattttgtcctcgtgtgggactttacaacttctgctcgacaattgtttanaagtactcgtgttgtactgagcctagatttanaggcatacaataaactcgtgttgtttgaaacagttaaatttctctcgtgcttgggaaaaagtgatgttcattccacgctcacctccattgactcgccaacgtgcacgaaatatccagcagcagcaacaaaacgaacaccaaa

SEQ ID NO: 2771 - DNA, 1733 bp, Heterodera glycines
ttttcctcaaaaacgaaaaaattttacccctaataattataaagttttaatcagctttgagccattagctatatttagtagagaatccttgaaaaattttgcttaacttattccaacaaaaattaagatttccctggcgattggactatcaattcctttttgcatgtttcataaattttgacaaaaaaaaatctcaaatttttataaatcatgaacgagcatacgaaatatgcaaaggaatccccaaaagtaccaaaataattaaataaaattttttattatgattttttggggaaaaaaagttctaaagcgtgaatacgtccttaaatgcaaaaaaataacatataattcggcatagaatgttttgaaaaattgatttttaattcctcgtgaaatggaccttgttctaaaaaaataaaagaagatttgaaaatgttggcaattttaattgcaacaaataacaagtaatttttaaaaaataataattatcacctgtgaggccttctgttcgtgtaggatctgtaggataacaagtcgtttggcttgagacgcccacttgaacccaaatattgttgtgtttttcattaatccactcccactgtcaccctaaaagtaaaaattattttaattttttttaaatttattacagtttcgattatgctcggcccaggctgaacacaaatgatttggtcatgctcattatcattagaagaattatcatcatcatcagcaattgaaagtctttttgctaaaccaatgttttaatttatttattttttgcttttcaatttaaattacatttgattgatgcactttgacaattctctggtgcactgattttcatttgaccgtacatcaattgtttgcttgggcctggcttactgtcattcgaacaatatggtgaagtacggccccaaccagcaacaacaaaggttgactgatcattggtgcctgaaaatataagcaaaatatttttaattttaaaaaagtatttaaaattatttggcaaccatattccattaaacaaatgggacgagcatttgctgtgaatgcaagtgggttcttcaactaaaattttattgtattaaattacattttatattgtgtatataaagaattcataaagaaaatgaaaaaactaaaaaaaaaccaacttttgcggactgaactatcaaaaaattaaaaaatgttttttaaattataaaagtttttcccattagattttcctgagttaagccgaatagaaaccagaaaaattcatataaatattttccttaaaattaatcgtgtcctaaaacactttataatgtttttatctgctttctcatgattaatttgaaaaaatgcttaaaaaccccaaaataataattgacaaacgaatttttttattcccataattacaattttctggtttttacagaacttaaaattcctaaacatccaggaaattgtcttgttgctctttaaggaattaaattagaagacgaattaataaagcaagcataaaaaacgaattcaaaattcgtctttttttatcattttaatccgcttttcctcactattagcgatttatttgaatttttacttcaattattgccatgtcatatgcattcggttttataatgacgtttttatctgctttagcatcattaatttgattgcgttgcgcgtcggtgcccttttgggtgcaatttaacggccgcaacgcccctgagttgttgctgttgtttcaa

SEQ ID NO: 2772 - DNA, 7055 bp, Heterodera glycines
  misc_feature (7004)..(7004): n is a, c, g, or t
tctcactgatcaatttgaccattctcttttgatcgcccttcattccccattttcattgatcaaattggccaagtcttctccaatttgtctctgaacggccccattaatcccgaactcttcccttggtcaattctcccccatttgttcaaaaatgcccctttaactactgatcaattacatttccctaattgtccattgagtaatagcattgatcgtgccttcccccatttttccttgatcatttttgcgtgcatttcttttgataacttccattttccctatttctgtttgatcaatttgccccaatcttttgatcagtggccatccccgcccattttcactgattaaatggcacatacttttgatcagtgccattcctccatttttttcctgttcctgaaattgcgcgcaattcttctaattagtcgcatcgtttccccatttcttctgatcagctatctctccctcattttcctttaagcaaattgcgatttttgatcagtaccatttttctttcatcaaattgcgcgcaattcttctgaaaaatcgcatcctaccccattcccattgatcaatctcatcccccctcatttttcatttatcaatttgctccaatttcctctgatcagtcacacctcccatgttcctttgatcaaattgtcccaaatttattctgatcggattttttttttcggccatttcttttgttcgacttccccattttcagtgatcaacaaacattctcttttgatcagtaccatttttctttcatcaaattgcgcgcaattcttctgaaaaatcgcatcctaccccattcccattgatcaatctcatcccccctcatttttcatttatcaatttgctccaatttcctctgatcagtcacacctcccatgttcctttgatcaaattgtcccaaatttattctgatcggatttttttttttcggccatttcttttgttcgacttccccattttcagtgatcaacaaacattctcttttgatcagtgccatccctccccaattttcttttgattaatgccacttcttttgatcggttcccctcattttcagtgatcaaatggtgcgcatttcggttgatcagtcccccaccccctccattttctttggtcatggcctcattcattttgatcaatcttccttactgccatttcttttaatcagtgacatccctcacccattttcactgatcaatttggccattttatctgatcagtcccatctctccccattttcattggtcaaattggccaagtcttccccagttcgcctctgaacggctccatttttcctcaattttttttcccttggccaattctccctcgtttcactttgacctcatctactctggtcaacacttttcttcactttatggtcaattcgcccctctttaattctggtcaacttatctctttcaattctgatcaaacccctttccccatttccctcttatttctcaaaacatttccccttgttaattactgatcagtcccattttccctcattttcattgatcaatgccccattttttattctctcctgatcaagttgcgcattctctgatcaatgccattccccatttcgtttaacaaattgcgcacattcttttgatcagtgccaccccccatttctcattgatcaaattgtgcgcaattcttgccaattttctctgatcaaatttgtctaattcttctgatcacccaattccctcattttcattgatcaattgcccatttcttttgatcaggttggcccaaatttatttttatcggattttttttgggccacttcttttgatcaagttggcctttgtacccaccctgaggggttcacatattatctcacatttacgcgttatttttatgcgtttttgatcaatgccattcattcttctcttttctttgaccaatttgttccaaattttctgatcaatcccatccttccctcatttgatcaaatttggacattttatttgatcagttccttcatttccccattttcctttgatcaaaaggccaagtcttccccaatcgcctttgaacgaccccattaatccgggatttttcactctaccaattcttcttttattttggtctcttctatttctgttcaacaccatccctcatttcttgtcaacccatctctttcatttctggtcaaccccctttccccatttccctctcatctctcaaaatatttccttttaattaccgatcagttccattttccccatttattttggtcaacttgccccaatcatttcgatcagtgccattccccccatttattgatcaaatggcacaaatttagtttgggtcaatgccattcatcatttttctcaaattgcgcgcaattcttctgagcagcgtatcccttcctctttgatcagtgccattctctcccccattttcttttgatcaattgtccctcattgattaatttcatttattttgatcagttccaccccattttatttgaccaatcagtcccaattaatttgatcaggcccctccctctaattttcaattgattaaattgtgcaaatttcttttaatcagcgccacctcctccgtttttgtgttcgaattgcgcttttccttttgatcagttcccacatttttttgatcttagtgcgaacatttcttttggtcaatgccattctccattttattgtttgatcaaaattgcgcgcaatccttctaattatttacatccattcccaaatttatttaagatcagtccaaccctgaggggcccacaaatggtacctttcggtcaatcagtgccatccctttttctgatcaaatggcgcacattctcttttgatcagtgccatttccccattcttctcttcatcaaattgccccaaattattttggtcaatcgtcttttggctatttcttttgatcagtgtcacccctccccatttatattgatcaattgacgcatatttcggctgatcagtcccatcgccatctttgatcaaattgtgcaaatttatttgatctgtcccattttccccatttctatttgatcatttgtaccatttttcattgctcaaattgcgcacatttcttttgatcagtgccacgtctccccatctttcattgatcaggtacattgatcagtgccatttccccttttgatcaattggcacatattatctgttgatcagtgccattcctcaatttaattggcacatactatcttttgatcaataccattccccaatttttctttgatcattaggcacacattctcttttgatcagtgccattctccttttagtcaattggcacacatttttttttgatgctcctcttacccatgccaattgtcaatcatgagtctatcgtgtatggcctctccattcattcattagtcaacaaacattcattcaattacgcattaattcattcatacatgtagaaaagcacgcatgttcactcatgcttgccacattcattcacttattcatgccatgtgctttcatagagtcatgtgttcataaattattcatccattatttatatatgtgttaatattataaaatggtccaaaataagtttatctcattcagatgagaaccaaaaatctgccttctaagctttccaatcccgaagttttaacaagtgatgagagttcagcaagttttgaaagccctgcggggaccatttatgaatcattcgaggcgttgagcattgatagctcaaaagtagcttcaaacctcgaggggtacactaatgttggggctgaaatcgttattgaagggactgaatccaatgaaaaccctgcggggtccggatatgaagaagtgagaatcgaatgtagtagcgtcatcattgcctgcaagaagtcgcctaagtcaaagccaaatgttgaaaattcggataatttcatgagtctgtttgaaaatttggaattgacggattctgaaaaattagctaatcaatgggaaattgataaaatattagcggacaccgcaccatcgctagctggttcatcgcaaattgagagctcagtcatagggtttgtgtgcatctcacaccccatattgtgggcattggtacaaccggacattttgggtgaacagaatgagttattggatcgaaaacatttaaatttggaattcgatcaattgatttttcaaagtacaccaagttatgtaacggctattacactaaatccaaacaataactggccacatttcacccaaatttcattgaattggaacaagcaatccctattgggaacccggatcaaaacatcagatctgaggcaattaacttctcctcctaagatgggaccatcagtgaatcaaattgtcccttcgagttgttgtggaataattagggaggtgatacaaaacaaaatcacctcccaaatcatcgccattgatgtctttttatatggggaagaaaataatcaacgcttcttcacacaccaaatcgattcaagtgttaatttgatggaattagaagaaggcacacgggttcaaactacgggattttgggccaaaacttcagcaattgaatggcaaacttcgagtgatggaattcgcgattggtggactgagcagatctatgtcggaacaaacttaaaaatatttggcgctgatgaaggcgaagacaatcatcaatggctccaaaatgaacaatttctattgtcataccgttacctgtgtgccgccatggatttgcaacaatcaccaaaacggagatgaattaagtaaaactttttgttttcctcccttttcggttcaatggcattctttggtcccttttgtttcctttctcggtttttaaggcaattcctttttgttgccattttacttcataattatttaattagttaattagttgggtaatttcatttttgccccctatcatttaagcactttatttccttttttgcactcacaagttttttttatttcacccctccttaacttccggtgttcacaccgtttacgctgtgatacaatcagtaggaacactttctcaccacattacggtattaatggatttccgctatttttttctcacaaagcgatttttacattagttccgataaaggaattattgtaacacgggaacgacagccacgcccattatcgggggcctttaatctaagcacttcacattcattcattcattcttccattcatttgatttactgttctccactttagatactcttgcacaatcccactgctacttctcatctcacatttgctctcattatgtttcctttctctggtgggggtccacctaatcaaagcgcggcggcgtcaagcaatgcgcagacagaccctgaggggctctccaaagatttgcctgagttatcagtggttgataaactgatgtttgctggaaagattctaagcacgccagcacgtttgtctgatgagaacaaactccatatggacttaattaggactgaggatggtgtcaatcgcatgacacgtcaccttaacaggaagataaatcaaaccaatagggacttgactgaactcaaggatgatactcaaaccctgataactcaagtaaatactctcgcaaatagttatggtacagtccaagtgttgcaaaaacctaaccaggcaccaaaattcaataaccctcctatcttaaattatgcgactccctctccactcaagaatcagaacaatagctttagcaatgctaatgcttcggttcttgaagccatacctctcaacaacagtgaggaagattcccaagatgaagaatttcaattaaatccttcgggattccatcacattaacatgctttttgctcaaactagtcactctttcacattcacaattttctctggaacctcaccattagaattcgatcgttgggcaagaaagttcactgacttgcttgactgcaatggcagaaagtgggataaatctgaaaagttggcacgtcttaaggcatgccttgatggcagggctggacgtaactgattttcagttacggccatccgtaatccgtcattacggcgattttttcagttacggccatccgtaatccgtcatgacgggggtcaaaaaaggccgtaatttggcgtaatccgtaatacgtaatccgtaattttcaaaaaaaaatttttttttttttaatcacaaatcattcaattgagaaaccggttaaaagtaaattgtgatgaagaaacaaaagttttgcaagattttctggtaataaactctttctcaaatcatctgaaatcaggccggccgttgagaaaagcctctcactttctgaacttgttgcaggtggggaaagaaatttcagtacaacatcaccaatcattggccatttttgtgaattgacttcccagtataatgatggatcggccctggatttgatttttggatcccgcaaatattcatttacttcaacttcggctttttgtcttgtctccaaggcagatggactgggggatgttgccttaaattaattattatgaggggtatataaagtttatttacagtatccattatttgctcaaattctgcgtccttttcaaaacgagaaaaaatatccccagccgaacttgaaccactgcagtctcttacgtcaatttgtaaatcaatttcctaaaaaaattaagttacaaaaatagaaaaaataaaatcacatcagtctttgcgtggtaactctcaacttcacttatcaaccagtctttgtactgattcagccgactgctgtcaaggtaaatggtcttgaagcgtgggtccaaaatagtggcaagaactaagtttttttgttcttcagcttgtttaagccgcaattcgatggcgttcgcaattgttttcttaatatttgaaaaacgattgtccttgtcctcacgtagaccgaaagaaattgcctaaattttttaataaataggaaaaaaaattaacgctaactttaaaaagtggaatgataattgagcatgaagaacttctgttttgtaaaagaatggttgcctcgtnaatgggagaaagtacgcttttaattgatgacaaaagcagccaatcatcagc

SEQ ID NO: 2773 - DNA, 1903 bp, Heterodera glycines
cttgatggtgaacctagacgaatctttgacaatttaattcctgcccacaaagcaacttcttcggaagccattcaaaaaatcaaggaaaatctggacacaccacaaaataaagaacttacctatcaggcactaagcctgtgtaaacaaatggaaggagaatctgtagatgattttagtgcacgactaattcctttgattgaggccactacggcagaccttacggctagtgctagtgaggaggtactctgtcgagcatttttggaaaaattgagtccaaatctcaaatttctcacccgaaccttgagtggacccgtaagaagggacttcaaaatattgagaatgaatgcacgcgaagcagagatgatgcatagagagattccaaattctattccagtccctcttttcccaatttcggaacagcacaatccgagattcaataatactgaaccaccgaactaccaagaaggcaactttagaagatggggtcccacttgctctaacagggagcctataggtcccggacagaggaaccggaacaactgggataacaatgcccaaacctcgagaggctcttttaaaagaaacatttggcaactttcatgaggattaattggttggatagctaagtttaaagcacacttccattttctcacaccttaatcacaccatattttaagtatgtggaccaaccttgagaagccacatcaacttgaaaaatgccaacagaaattgatcacttccggaattaatgataaattgttaaaaaaacaataagtcccgcgggactatttattgctttatctctcttttatcagttctgaggaactttaacacatcttaattttatttaaatataaaagctaagtctttgcaatttttggaacagactttcatattactcacacacttctgtctaagccctgcggagctaattaatgaataaaaaagcagtgagaattgataactcaaagccaaaatgctcaaaaaaatatttttttttaaattaaagtagtgaaggattgatacatgaatcccgtgggatttaagtctttggatcagggacgatccgttgatatgaaggggaggtatagtcatacggtcacgcttggtcaaatcactccgtggtatggaactcggactcaacaccgcgaaatatatccaaatctaaacttcagtcgtttggacgcgaaaccagggttcccatcgtccatccttcgtttccaaggacgggtatgccgatttgcaaggacatagtggggaaaattcatgaaattcaaggacatttaaaatttttattatatgcaatgcaaaatggttaatatttattcaaatggcttgtatttttcaccggaatggattttttccaacatttttttgttttcacttatcattttcttcatttacgacgacttttttctgctttaaaaacgctttttttgtggcgcgctttttccaaaaattttgtgggacagaggggaggggggggggggggtccggcggtgccgacaggcgccgccggggaaaaattttgaaaatttgaatgcaatttgttaacagattttcaccaaaaactgcctaatttttgcgattttaagccatgcaacgacttttttttttgtccaaaaatgaccaaaatttgcgatttttggctaattttttaagaaaaatagtgactagtgacttaatgccataaaatttcaaaaattctcaaaaattacatttttaaatgacataatgccataatttaatcaaaatatcgttgaaaattacaaagatttctcaaatttctttgaattttttaaaaacttttctaaatgttcattttcaaggacgtccttggcatccaaggacattttttattttcaagaaagagggcccaatttcaaggacgtccttgccattc

SEQ ID NO: 2774 - DNA, 2945 bp, Heterodera glycines
ttaattaaattctatttttattattttcacgtttttttttctcctatttttagacattctcatccagctgtgctaccagaaatgcgaacaatcggacaccggcaactattccattcgcattgtgaacgacttcggctcggattcggtggacttgcgcctggaggtggtcgatcgccctgcaccgcccgaagggtcattgaaggtgctgaacattgggaatatttttgtaaacagaaaatgctatgagagtgacatatttgtaaaacaattaggagtggatttttttgttttttttagaaatcaatttttaacggagtattttcgtttttctgtattttatttttattcctcgcttaaaacaggtgttatgatgcatatttttgaatattttataaaaattttttaccaaatatattttttttttgttttttctcaagaatttcgcttctgctgatcatgttccagacaaagcatccacattcaaaaattttttttaaattgatcatttttttctttgtaaaatgttggtttaaattgtccccttattcaaaacgaaacttttaaatatttaatgtattacaaaatcatgaacaggagcgaactacgtccggtagcggaaggcgacgcgttggcagcaccgcggcggcccggcaggcacaggcggcagcagcggcttgcgctgcggacgaagaagcaccgaacgaggaggggcgacaggacgtggcggtggtgacaaaaaagatggcaattttggtaaaaaaaatttctaatttattggatatatttttcggggtaaacgcaattgcgaacttttcatcaaaatataatatttttgaccttttttatttatttttccttaatgcatcaaggaatttttgttttctttattttattttttatattatttaaaataaaaaaaatcattcatttcaaaccgatttaaagcatacatgcgaatgcgtcgggcgtaaatattagtgtgtttttttggcatgatgatcaattaataattttccaataattctaatcaggatttttattgaattgtgaaaaatttcgcagaattcgaatgcgaatatttattttatgttatttataaataaaataattatgtttttaatgctttaattaacttcaaaattaaagagaaatttttttaaattattaaattaatatttttaattaatcaatatattacagaatttaaattgcaaatatctttttatttatattttttaaataatgatttttttaatatatttatcataaattgaataaaaaacagtataatttaattgttttattgatttgtgcaaaaaaattgaagtcaacctggcttgagtcagataaattgaattttttctaattgaaatttggagaacaaaatttttctaaaaaaataaaatataaatttcgtcaaaataccactaatttaataaattcgtaaaattaaggcacttcggcgcgccaatgatgagcatgaaactgaatcatcagctgttgatgaagacgaatatgtggtcgaaagcgatgatgacattccggcggttgaggtgggaataaatttgaaagggagggaggggggtcaaaacgaaaactttgcaagagagggggtggctctttttttcgtgcttttttcatggaaaaactttatgactcttattcctgtctattttctattttttgtgcctaataacccaatctatattcatgataattttcatgagtcaagactctcgagcatcacacaaaaacattcatgagtctcgacaaaagaatagagagttgagacgaattttttagcatcgcagcagtgtggacatgcgtcgtgaatcattggctgaaatcctggacctgggcacatccggcacaccggcacggattgggtgagccaaaatacagcttccagcagaaaatctggcaccgaattttggaatggtgccaaaaaaatcggtgccaaattttgcatcactaattttcttttaaatttgactaaaatttttcaatttacaaaaatttggcaccgaattttggaatggtgccaaaaaaaatcggtgctaaatttgtatttaacaaattttcttttaaacttactgaaatttcaaaaaaaaaaaaaatttcagtgcctcgttgttccctggaaagcgtgaagaacgatgggtcgacccattaccagaaaagctgcaatttcagcagcagaagaacaaaattgccgagctgaaatgcaaatactcgcgcgccaatgccaaaggtgaaaagccatgggatttcaatgcttttattaaaattaaatttgaaaaataaatcatttttcattatttaaacaactgataaaatcataatcaattacttttttcatcaataaaatacgaaaaaaaataaatgagaaaattcaggatatattcaaatctaatcaaattctaaaaaaaataaatttttaaaaatttcttaaatttaatgccaaaatgtttttgtttcagtgcattggtacaagggccgcaaggagctgttctcggactgtcttaagtacaaaattctgatcgacaagcagtccatcacgctgatcatcaacaacccggacccggacgacagcggcaagtactcatgcgaagcgaacggagttccgaccaattcatttatcactgtggagggtatgttttggacgggcggacaaaaaaaagcagttaaacattttccacggacatttttggtttttaattaaaaaatttacttttttatctaattaatactttcattttatttaaaatatatatatttttttcaattgtgtatatatttataatataaaatttataaaaatgttttaattttttttaaataattatttcatattaaagaaaataaattattgcttttttttcaaattagataattatatttttcacgataattttatatagaatatgttttattaaaagaatgca

SEQ ID NO: 2775 - DNA, 3110 bp, Heterodera glycines
  misc_feature (2878)..(2878): n is a, c, g, or t
cttggagtaaaatttaagaatatagagtgcttttttatcttcctcaacaaaaaaaaatgcaatttttagtaaaaaaacaaacaaaatattttacactttttcagcccaaagcaggcgagccgcccaccgaagtgcctcaagaacgatgggtggacccattgccagaaaagttgcaatttcagcagcaggagaataaatttgccgagctcaaatgcaaatactcgcgcgccaatgccaaaggtgattattaaaattaaatttgaaaaattgatcatttttcattatttaaacgactgataaaatcataatcaattacttttttcaatttcaataaaacaccaaaaaataaatgataaaattaaggatatcttcaaatctatttttaggataataaaaatatattaatttttaaaaaaataaattttaaaaatttcttaaatttaatgccaaaatatttcttttcagtgcgctggtataagggccgcaaggagctgttctcggacggtctcaagtacaaaattctgatcgacaagcagtccatcacgctgatcatcaacaacccggacccggacgacagcggcaagtacaaatgcgaagcgaacggagttccgaccaattcatttgtcactgtggagggtatgttttggacgggcggacaaaaaaaagcagttaaacattttccacggacatttttggtttttaatttaaaaaatttacttttttatctaattaatactttcattttatttaaaatatatatatttttttcaattgtgtatatatttataatataaaatttataaaaatgttttaattttttttaaataattatttcatattaaagaaaataaattattgctttttttcaaattagataattatatttttcacataattttatatagaatatgttttattaaaagaatgcattttgtttcagactcaacagaccaacaaccattgtcctacaccgcccgtcgcagcgagtcgcgcagaccgaaaagtgccagaaaggaagccgcagcattgacccccttggacgccatgcagtggttggttaaacaaaaaaaaacgaaaaaaaagtttaattcatttattttattttttagttgcagcagccatttgacgccgccacatcccaaaaacacggtgagcaaattcgggtttttaatttttttttttttttttgtttttttttcaataattccttggtcatagtaaagtttgttccgcaccctttttcgaaaattttttccattggttttcatgtcgttgatcacgaatccggcctccttttcgaccaaatccgaatcccggacccgaattcgaaccaaagtcggaaattgattcttcacaaatgctcctttagtgtccaaaatcgattcaaatacatgaaatggccacgattccctattttctattcaattcagtgcatttggatcgatttggacaataaggatgtattttggtaaaaaaattttgactttggttcgaattcgagtccggggtacgaaattaaattatttctattttctaaagaacctgggcacattcggcacatcggcaccagaccaaccattatcctccaccgcccgtcgccacgagccgcgcagaccgattgacatggcggcggttgaggtgggaaaaatttgaggccggagtgggtggggccaaatgttgcttctcaccactttttttctgtgttttttaaaattttttttggggggtttggcgagatccgatggtgccaatagtgaaattttgaaaatttgaattttgggcttaatttttttattacataaaacccagaaattgaaatttttgctctttgttgaaataatgagttaatattttccaattttttaggtgcgctgcgcggacgaaccgctgctggccaacgcgccattcaatgtgccagggcggccctacccaccggattcactgtacaccacctacaactcaatcatgctccattgggcaccaccgttgcgggacggaggcacgccgatcactgaatacgagctggagaaacgcgagcatggcaccaagctgtgggagaaggccgacaccaatgccgaccccaaagccaacaccaaaaagcagtgggagaaggacgcatttgccaatgtgccggacacacgattcaaggtgggggaaaacaggagccgttcgtcccctccctctcgtttcatcccccccccctcgccgtaaattttttttttaatttacaattagaaatttaaacaaaatcagaaaattttttataagacgtttcagcaattttttgcaaaaacagaaaatcgttagtttttcaaaaaaaccaaaagaaattttttttggtattttcttataaaaaatttttaaaatttcttgtaaatttcaaggtttgaaattttttttttcaaaagtttttccgggggtaaatgatacttgaaatttgtctaaaaaccactaaaaaattggtatcactgaaggtgaccagcgtcaaacggcagcaaatctacgagttccgcgtggctgcagtgaacgcggcgggccgaggcgagtggagcaagaactctgtgccaattgctgccacatggtccccctgtaagccgttgatcaccatgggaccgttggcatgcgacatgactgtgctggtgggtgaacaggccaagctgctggtgccctacgcagcgaattcttcacggccgaaattcgtttggagcaagaatggcaaaccgatggatccgcgtgacgacccacgcgttaaggaggaaaaaagcggtaagtgagcgcgcaatcctggcacttaacagggtggaggcgcagagccatacaataaaaaaagggaggggggttaaccaaaatttttgctaaaatggtctggaaagagggnggtcgacagggtgatccgccattttcggtttaattcgccgtttgcatcctatttcaaatgtttccattaagccacccatatacatagaaacgatgttggtattaatatatgaaccggaacaatcccggacaaaaattcttgatctgtgaaaaccagggaggtggtttctagtcgaattagagcccttcgtccagaaaaaaatatggttggaaaaaaaattgtttaaaaaaaa

SEQ ID NO: 2776 - DNA, 1825 bp, Heterodera glycines
ggggggggggggggtaaggcggccgattttgcgagatggtccgagccttgaatttgacgacctttcaaacagatttttttgcggtgcgctttttttaaaaaatagttaacgatattttcactaaaaactgccgaattgcgattctttagcaaggcgatggctttttttgtttttaaaaaacgttttttttcgctgtacaatttcttaaacaactttttttttgcaatttgttagaagattttgtctaaaaaaatgggcaaattttaaaattttggctaaatgctctttttaaattatttttaattaaattttatttttttatattcacgtttttttctcccatttttagacattctcatccagctgtgctaccagaaatgcgaacaatcggacaccggcacctattccattcgcattgtgaacgacttgggctcggattcggtggacttgcgcctggaggtggtcgatcgccctgcaccgcccgaagggtcattgaaggtgctgaacattgggaatatttttgtaaacagaaaatgctatgagagtgacatatttgtaaaacaattaggagtggatttttttgttttttttagaaatcaatttttaacggagtattttcgtttttctgtattttcttttttacaaaatattcttttaaatatttaatgtataaaaaatcatgaacaggagcggaccgcgtctagtagcggaaggcgacgcgttggcagtacagcggcggatcggtcggcacaggcggcagcagcggcttgcgctgcggatgaagaggcaacgggcaaggtggacacggacgaggtggagcgacagaacatggcggcggtgacaaaaaggatggcaaatttggtaaaaaaaaaatttctaaattattggatatgcttcaaattttttttattattgattacattatttataaataaaaaaataaatgttggtaaagaattgtggtcccaaatttaatttttgggctcaaaatcagtttccgaagggtgttgatgtgtttctaaactcggatttacccaattccggtaaagcttcaaattaagttttgcgccaaagattcgtgatcaataccttcgaaaccccacagaaattgattgctgagcccaagaaaactcaattttgggaccacaattctttacttttgcccaaaaatttaatattttctatttttgagtttaatttttgttttttttaagacggcccaaagtgaggacgagcggcgagtgcgaactgcgtccggtggtggaaggcgacggtgtgacgacagcggcgcggcggcggatcggtcggcggcacaggcggcagcagcggcttgcgcattgaaggtgcaaaacattgggaatatttttgaaaattacgagagaggcatatttgtaaaacaattaggaatggattttttgaattttttttttgaaatcaatttttaacggagtatttttgtttttgctgtattttcttttttacaaaatatttttataaaaaattgatttaaaatggttaaaaacatttttgtaaatattttatttatgaaataaattgtacaaaaatttacatataaaatagaaattttaatttactcgctttgggtttccaggccaagctgaaaaaacgtgacgacatgagcattagggcgttaaaacgacgaagtgtgcgctcggtagaatcaacttcatttgaaaaaggtaaatattaaaaaaaacggaaaaacttaaattaaattaaaataattactttgaattttatttaaagcgaaaagggtgcgagcgtttgagttacaaaaaaaacagtgcaccccaaaactccgccg

SEQ ID NO: 2777 - DNA, 2754 bp, Heterodera glycines
  misc_feature (71)..(71): n is a, c, g, or t
aaaatttagaaatttttcttagaaaattcgaagagtaaaatattttcaaagaattttccagctattttttngaaaaaacagcttttcatcattaagttttaaataacgtaaaaatgcaatgtcacactgcaaaatttttaaattatcgcgcaatggttccattaatttttcagaattcgatgaacttcgagaactctgcgaccaggaagcagtcgtgtcttgggacgacttcgagaattcggcggggtaattgatggattttattttttagaatacaaaattataaaaattaaacattttggtcaagggtgaaaaaattacaaaaaaaaaaaaattttggtgaagaaagaaaaaatggctaaaagagtgattgcgttaaaaaatatattttatcgcgtttttgataacgaatttctgaattttaaaagataaattcgaaaaatgccgaaatttactaattattgacaaaaccctcaaaaatattatagattcgatttcgccgaatggaccaaaattggcgagggggcatttggcgaaatctttaaaggaccccttgatggcgcttgcattgtgctgaaggtgttttgttttaatgattagctctttttcaaatgtttttcaaggtcatcccatttgctgccaacgaggagcattgttcgaagctcgtcaatggcgactacctgaagccagcaaaattcatcttcaacgagctgctcatcaccaaagagcttgcaaagctatccgagaacaccggcattggcgtcacgccaacattcacacaattgctcatgagcaaaatcgtcagaggtagttttttaatggagagacatttaaaatgcacataaaatggtgtaaaaaatgtttggaaaactccaattgctaaaactcatatttccgtttaggctgttttccgcccgaattgctgaccgcctgggatgccttcaagaagagaaagcctgaattggcggagaatgaacgaccggacacttatgccgatgaaggacttcatttcatagtcatcggtctttcctatggcggaaaagacctggaggcgtatacggtagctttcaaaaaaaatgaaaaaaaatgttttcgcagatcaaaaatggccgagaatgttactccatcttccaccaaatcgccttgtccatcgcgatcgccgaagacgtgctcaaactagagcaccgggatctccacgccgggaacattctcgtggaggagtgctcggtcgatgaaaaaattcggtaagtagcaaaaccgatacactgggaaataatgcttattttaaaggtataagtaccttggaaaacaaatcgctgtccgttcaaatggggtgcgtgcctccattatcgactattcaatatcgcgcatagaaaaaagtaagcattaaaatttttctcattaattgtgttttcacaaaaccagaaggcgttgtgttcttcgctgatctcagcgaagaaacgggacttttcgagcaaaatggtgtcagcaaaggtggcgactaccaatacgacgtctacaggatgatgaaggcggcggtcaagttgagagaaacgatttttttacataaaaaattttttttagcgaaaattgggccaaattctggccccaaacaaatgtcctctggatggggtacgcggcaaagaagctgtttaacaaccgcttcatcagagcgaagagaaaacaagcgattgaagaacttttttcaaattttgaaaacaaatttgaaacaattcaccatttgcttgcccatcctgattttttgtctgtgttcacggcacatcaatcagcgacctacaggaagaagatcacgaaaaccggtaaccaattttttacattcccatttttcctgaatttaaaaattccaccaactttgggtgtgttttgttattttcagccaagtttcatcccatttatgagaacttctcttctccaaatagttactcagtttttgtttgttctttagccctttaattcatggagtgcgcgctgttctcaaccggacgcgaccaaaccaacttgcgcgggtggacagcaacggcagcagaaacaatacgacaagaggcaacggcgtggcatccgaagcaatgggttagttttaatgacatccaatgtgtgaatcataattatgttgtttgtaagaaaaaatgtttaccatccaaaatttcccaactcaaaatgccccaatttttcacaatttttaattggttggtttttacagaacaggacaaattttcaccactaaaagttttccaaaaagacgctgaaaatttataaaatttttttttcttatgatatcttataaaaacttttctcggattctttttcctgaaagaattcatagtttgcaaagttataagcgtgagtagcggagcggtctgtggttcacgctgtcgtgggtgtgtcgatcccgccagactcgactctattaactagcatttacatgaaaaataaatgtatcatatgaataatataaaaaattgcctaaaataaaataaatttaaattattaccacattgaacaaacaaatattaaaatgatctgtttgcatctgtcttgaatactcgaaaaaattttcgttttacacagctatttttaacttttctgccatatttataatgataactaaaattgaaatggaccaagttttaaaaataactggtttcaacaagggaattacaatattaaaacaatatataaaatatgttataaaatttacagaatcgataaacaaattcaaatatttaaataaaa

SEQ ID NO: 2778 - DNA, 5415 bp, Heterodera glycines
gattttcccttgtaaaatagaagagccgatctcgagttagaaaatacactttcaaaaaacaaaatagaattcgatagatgtggtcaaaatactggcctatgcaaaatttcaagaaaattggtcaataggaaaaattttttttcaaggacaacaaaatcaaatgtattacaaaattttagcataaaaatggcactgatgttgaggcagctctggaggcgcgtctttcatctgccaaggacaatctgatcagatttggcgacgaaatctacataaagctgagcggcgaccatggccagagttgtatgaagattaccgtctcattcagccaggctgctcggtcaaattctccatcaaacaatttcgtgctctgacaaaagaatcggcaaaaaagaatggagagaaaaaatggataattattttcacattaaaaaaaaattaaaaataaataaaaattgaaaaaaaaataaaatttttggtcaaagaaattttagaggttattttggatgaaaatctttaagtagtcactacaatgtacgattttctgttttatttttcgaaaaaaccattatcattattaagtccgtttcagggcgaaaaattttaacaaatttatgcattttaaaaacaacaaaattcaaaatgcacaaattaacatctcaaaacaaagttgaaatttgtaaaaattcctatttcatttgtaagtttacatttattcttctccaaattgtttcttccatttgtcaatggtccgtcgattaattttcaatatttttgcaattttctcggcactaatttttggattttctctttttatttgccaatacattttcactttttccattttttctttctccgtcattctttcacccattccaaattgtttcttccatttttgaattgttccataacttactccaattttcttacaaatttcttcataattttgactccattcttttgtcgaatattttcttcctttttgcttatattcatttttcattgcattaaatttttgaacaatttcaattttttgttcatccgttttcaatttgcattggtatttgtatattcttaattctttgatccattggtaaattatctttcgatttgtgcccaattttttcaaaattttatcattaattttattccattcttttgttgaatattttctctctttttgtttgattttttctttaattttgttgaatttttgaacaatttctctttttttctgttcattttctttttcttcccatttttccccaaatatttcttcaaatgttttttgttccaattttttcttttccgctacaatttcaatttgagcaattaaaaatacaattaaaattgaaaataggcataatttcattgttgacaatttttctttttcttaaaaattaaaatttatattttattcgatatgaaaaaaagaaataaataataataaaaatatttctcaaaaatgaatttttctctttcttataaatttacattaatggtaaaatattgacaggatcactatatccattaaattgtaaagtgaatttttctctctactgaatgatcgaaattaataattttataataataataatataaataaaaactgtttcaccattaattaaaattcaactagagaccggacaagagggtcggtcggtcggtttcggtataaaaaccgaaaaaaaccgaaaaattttcggtaggtcggtttcggttaaaaaaccgaaaaaaaaccgaaaccgaaaaaaaccgatgaataattttcggtatatcgtttcggttttttttgaatttttatttttgtaatacattttatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttaagaaaatttaaatttattttctttctctctcttcgctttctctgtcctctctcttctctctctctcacgtcctctcacctctctctctctctctctctcacgactctaattttttctcactttctcttttactctctcttctctctctctgctttctctttttatctctttatctctctgctttctctctcttcgctttctctgccctctctcttctctctctctctgctctttatctctctctttccttctctttcccttctctctctcacgtcctctcacctctgtctctctctcacggttctctaatttcttctcagaatttcttcattctgtcccctctcttgcttcttttttcatctctctatagttttcctcttattctcattcctgcacccatcataaatagggcatccaaaaatatggatataaaatcgcgaaatatggccataaaatatgggccaaaaatcgcaaaatatggacataaaatggcaaaaatctcaaaatatggaaataaatggcaaaaatgtcaaaatatggacataaatttttcaaaattgaatgtaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttaagaaaatttaaatttattcaatattctcaagaaattttggcaaaaaaatgattttttgaaaaatttttcgggttttgggctcaaaaaggctaatttagctgctagggcccgttctaatagaggttttttggaaaaatcccagaatatggataaaaatgccaaaatatggaaaaatatggaaatatggacataaatcgcgaaatatggaaaaatatggaaaatatggatatagaaatccttcctagaagcttcaaaccaaactaaaaacatgtttttcgtgcgtttcagacctcccacagtccaggaaaaaaatatggatttccatataattggactccctaatcataaacataaacaaactcgcacgcattcagccctgcgtgacaaccgcacgcgttactcattctaacggtgctatgtcgttatataaaaaccctcaaaaagggcgttatataaaaaaccgtcaaaaagggcgttatataaaaaaccatcaaatcttattgttaccgtattaatttagaaaaaacaatcgtgccaataaaataaaacctatataaaataataaagcattttttaaaaagaaacctttttattgaaaattcacacatagaaatactttctgtatacacactaacaattttataaattatttattattatcaataacaattattattattttttaattttttaaattctattttattcaaccaattttcatatacaaatattatttaacctatttttaatgaaatttttatttaaatttattcgcctttctcaagggctaacgagaaaaaatagcaatcaacaagcattcagtgaaacaggcaattccatttttgacagataaaataaaaatatttcaatttgtcccgatcgagtgtggcgtctttttgttccttttaaatctgaaaggaaggctgatttatgtggttttttatcagttctttcataccaaaaaaacaaatctcatccaaatttggcatggaccacatttcaccaatttttcgaaacaaaaattcattgttaaagttttccaaatcaattgaaatttcgcggtcgccaaacgaaaattattttgtgacaaaatcaaaaatgcaaagaaaaatatttttaatttagccattttataaaaatataatttttaagaaaaattaacccttttataattgtcaagccaatgcacaatcacatgaaagcacaaaattagaaaaattgatcactttatcgcaaaaacccattaagaacaatttaaagaattcacattatcaaagaaaccctaaaaaatcttgctgcagcaaattttgcaaaatttgttcagtttatcagcgaaaaccattaaacgaacaatttaaagagaaagcatttgatcaataattttttggaaaatttgctcaatttttaattaatttcttgaggattgattatagcttcaatccatgcatttccattaatatgaataataaaaaatataaatctagcgaataatttttttttagatgacgtaacatttacataaatccaataattgattacatttaatgtcaatattgtataaaaaatatttatttaaaatgatttattattttatataggttttattttattggcacgattgttttttctaaattaatacggtaataataagatttgatggttttttatataacgccctttttgagggttttttatataacgcccaattttgatgaaatgtcttacaatttgattgatttgacggttttttatataacgcccaaaacacaaggaaaaatcaataaaaacacaaaaaaaaccatttgagggttttttatataacgccctttttgagggtttttatataacgactcagcaccattctaaccctcccacccgcgccgacagagaaacaaacactgcactctctccactacccatcctttctctattaatctccaattatattttttaattttctgtttcttttcctctataaaaacaaaacaccattttaggcgcaaattcaaaagggcaaaaagtgggcggagctgcgcctcacttaatatatagtaagggattttgactggtaattgaatgaatgccaaaagttggagagcccttgaagagctgcatcggaagcgagtgccgccgttgctgtacgctcaacggttgctgtgcaatagaatttgttaaaaccaggctcacgaacgaatcgatcgatgccttaatcactagggctgctaattttatgtaaatacattttttttttggcttctccatgctctaattagtagaaaaaacactttctttttttgtgtttgctaacaaaagttgggactttttagtacatagttctcaatttttccgtacatacttatttttttgacatattttgggattttttaagaaaaatttaaaagtttttttaaaaatgtacacctaaaaatcggttttttttcaaaaatcatatatcaaaaattaatttttaaaatactaaaatgtgattcaaaagactattttggtcctttttatggcattttgtgattagttcactttttatgaagaatttttttcaaaaaaatgaacatttaaaaatttttatttacatattttagtacatatttgggggtttttgtatatattttagcattttttatacatattttatttacataat

SEQ ID NO: 2779 - DNA, 3579 bp, Heterodera glycines
ataggcatggatcattttttgctattttgagccaattttatgaaaaaataaattttggggccccgcagagcagataccgtattttctctaattatcacccatggaggtattatttttcaacctcctcggaaagggcgggatgattagagactggtagataaatggagactggtggattatttttaaatctcctcataaaggggggggggaataattggagactggggatgaaagagactgggtgataattagagacaccggggaggggggaaaattgaaattttgaccattttcaaacagattttcactgaaaaatgacgatttttaggtcaaattttgaaatttgggggccggaagtgccgtgccgggaaaaatgttaattttcaatcagtcataaatgtacagaaaatggagaaattaattagttaattacttaataaacgatttaagcataaggaataaaaagtcacatgcagaaaaacaacatatgctatttttcaggatttatctattatatacatatggattaccatatatacattattttctatatatttagacgtttgggcactttttcgtacataattcgcaattttggggtcattttttaagaaaatttttctacaaaatttcacaattttttagttttcttaacagttttaaagttttaaaatttaaccaaattttatttattaaaagatttacttctacaccataatttttaaaatattgatttttacgtgtgtatgaaatatttgattcttcatttaaaaaatctaaaagaaaatataaatttatagagatcggtattttgaaaaaagcctggacctggattccattttggacctggacctggacaaaaatccaggaaaatccaggtccaggaaaaatccaggctcctcgagacctggatccaggcctggacctggattttttgaaatttgttttaaaaggcaaacaaatgcttgaaaaaatcaattatttgctagaagcatctaaaaatatctaattaatagtaataatgtgtttttaaatttatttaatctgtttttgaaaacttgaaaaaacatcggtcacttgaaaaaataaattctaaaatttcgtccaggaaaatccaggttttttcctgttttgcctggacctggatttcctggacaaaaatccaggaaaatccaggtccaggaaaaatccaggctcctcgagacctggatccaggcctggacctggattttttgaaatttgttttaaaaggcaaacaaatgcttgaaaaaatcaattatttgctagaagcatctaaaaatatctaattaatagtaataatgtgtttttaaatttatttaatctgtttttgaaaacttgaaaaaacatcggtcacttgaaaaaataaattctaaaatttcgtccaggaaaatccaggttttttcctgttttgcctggacctggatttcctggacaaaaatccaggaaaatccaggtccaggaaaaatccaggttgtcgaaaaatggcctggacctctggacctggatccagaaaaaatccaggcctggatccaggtccaggccgatctctataaatttatattaaatcttcaatttaaaaagaaatagtttttgagaaattaaaagagaaacaactcttggaggggaattgatccaatgcaaaaaaaggaacagaaccaagaacacaaccaacttgaccacgcatgtgatatttgaacacaaatgcaatttaattttaccaaaaaccaatttctaagggcgtttaaaagtctcgtctcgaaaatcgagaccaagaccaaaaaacccaagacttttctcgaatcgagcctcgaaaccgagactctcgagcagcactatcaaatagcactaatactttggaatcgtgtaaactcataggatgggaatatttaaatgcattattgagactaattaaattataatatgagattaatcatctttcaaggtgttctgtaattggtcctttgctctgacaaaagaatcggcaaaaaagaatggagagaaaaaaatggataattattttcacattaaaaaaaaattaaaaataaataaaaattgaaaaaaaaataaaatttttggtcaaagaaattttagaggttattttggatgaaaatctttaagtagtcactacaatgtacgattttctgttttatttttcgaaaaaaccattatcattattaagtccgtttcagggcgaaaaattttaacaaatttatgcattttaaaaacaacaaaattcaaaatgcacaaattaacatctcaaaacaaagttgaaatttgtaaaaattcctatttcatttgtaagtttacatttattcttccccaaagcgtttcttccatttgtcaatggtccgtcgattaattttcaatatttttgcaattttctcggcactaatttttggattttctctttttatttgccaatacattttcactttttccattttttctttctccgtcattctttcacccattccaaattgtttcttccatttttgaattgttccataacttactccaattttctttccaatttcttcataattttgactccattcttttgtcgaatattttcttcctttttgcttatattcatttttcattgcattaaatttttgaacaatttcaattttttgttcatccgttttcaatttgcattggtatttgtatattcttaattctttgatccattggtaaattatctttcgatttgtgcccaattttttcaaaattttatcattaattttattccattcttttgttgaatattttctctctttttgtttgattttttctttaattttgttgaatttttgaacaatttctccttttttctgttcattttctttttcttcccatttttccccaaatatttcttcaaatgttttttgttccaattttttcttttccgctacaatttcaatttgagcaattaaaaatacaattaaaattgaaaataggcataatttcattgttgacaatttttctttttcttaaaaattaaaatttatattttattcgatatgaaaaaaagaaataaataataataaaaatatttctcaaaaatgaatttttctcttccttataaatttacattaatggtaaaatattgacaggatcactatatccattaaattgtaaagtgaatttttctctctactgaatgatcgaaattaataattttataataataataatataaataaaaactgtttcaccattaattaaaattctaattttaactagagaccggacaagagggtcggtcggtcggtttcggtataaaaaccgaaaaactcaaaaaattttcggtaggtcggtttcggttaaaaaaccgaaaaaaaaccgaaacctaaaaaaaccgaagaaaaattttcggtatatcgtttcggtttcggtttttttttaaatttttatattttttcgcaaaaaagcaataaaccattcttattaacagtaaaatgtttttaatatttatattgaatttttggaagatttgattcaaaaaaaccacaatttcggcctttaaaaaaccaaaaattatgcacatttaataaaacg

SEQ ID NO: 2780 - DNA, 2090 bp, Heterodera glycines
aatacactttcaaaaaacaaaatagaattcgatagatgtggtcaaaatactggcctatgcaaaatttcaagaaaattggtcaataggaaaaattttttttcaaggacaacaaaatcaaatgtattacaaaattttagcataaaaatggcactgatgttgaggcagctctggaggcgcgtctttcatctgccaaggacaatctgatcagatttggcgacgaaatctacataaagctgagcggcgaccatggccagagttgtatgaagattaccgtctcattcagccaggctgctcggtcaaattctccatcaaacaatttcgtgctctgacaaaagaatcggcaaaaaagaatggagagaaaaaatggataattattttcacattaaaaaaaaattaaaaataaataaaaattgaaaaaaaataaaatttttggtcaaagaaattttagaggttattttggatgaaaatctttaagtagtcactacaatgtacgattttctgttttatttttcgaaaaaaccattatcattattaagtccgtttcagggcgaaaaattttaacaaatttatgcattttaaaaacaacaaaattcaaaatgcacaaattaacatctcaaaacaaagttgaaatttgtaaaaattcctatttcatttgtaagtttacatttattcttccccaaagcgtttcttccatttgtcaatggtccgtcgattaattttcaatatttttgcaattttctcggcactaatttttggattttctctttttatttgccatgctgagtcgatctacaaaaaaactcagtgaataattaaataattaattttaattatatagaacgtgtcactgaattaattataattaaatttattttataccattatatttcaagataaatttaaaaagaacaaataaaaatttgtcatttttgttctaattttttgcataaatatcttttgtcatttatggcaaaaaatgaaaaaaaagggtaaacaaaaggaatggcatgaaatttcatactaaaattgaaaaaagaataaaataaaatggaatggcttgaaatcctaggagcaaaaattgcattcgatgagaatgaaatgttgaataaaacaaaaaaaacatttttcaactttgacttcaagttttgaagcaccgggatttgaagtgtttggaattgaatcatcaagctttgaagcatcattttttgatgcatcatctttttttgtatgcgcggaaacaacaattagcttatgcatgtaacggtttaatgtacaaaaacttatcttaatatctttttgttgcatttgttcatgaagtttttttaatgttttaatttctttattttgatagcttttgacgagttctatagcttcatgattttttataaattcttcaaaaccagaattagtagtaaccgaatactcaaatagagataagaaaaaaataaaaattttattcatttttctaggttagaataatattataaatatatattttttaaataaaattcaatgtatattaattttgcagttacaggcagcgaaaattatttaatattgagtgttattgatttgacacatgaattttgtgaagcgcataatataatacaaaattattattattcactgagatttgttgtggatcgcccacactgagtttttttgtggatcgacctagcaccatttatttcttaccattttatacaaataaaaatgtttaaccctgctcctgttatttcattaatcatttgcctcttttcattttcaaatggaaattcatcggtgagtttcactttaattgtttatttaaatccattttaattagattgatgatgatatgctaattgcttttatgaaaggccaacaaggaacaataattagtgaatatacaactcaaaaatatgaggcacaccttggcattttgtattttttgaaaaagaattggcaatgcgaaaatatccttcaaaattttggtgaatttgaacgggaagaatgcccaaaatatggaaaatatttgaacattttgtacgaatatttgctcaaagagtacgccggaattccaacagttaagccgaaatttgtgcataaaa

SEQ ID NO: 2781 - DNA, 3467 bp, Heterodera glycines
ttagggtccgttactatgttcatcgctccctaaatatggtaccattggacttctctcaccgagaggaatagaaggtataaaaaaaatttcaattaatcgaggctgtcagtattcttgactttttcctttgcttcattcacattatttagctttaccgatcctttgatgataccaccaattgctttgcaacatgtttacgccaccgctaatatggtcacacaagcaaatgtcgatcagagtttgtgaatacatttttttactatttctatttcaaataaaaaggaatatgaatacgaagcaaggaaatagatactgttaattttattttttaaataaattcggaacagtaaattcttttttttgaagatgtccaccctcttcattgcaggtaacaaattggacttggaccgtcttccgcccgggtgggaagtccgtctcaccgaagatggttcttaccgatattacgtcgatcgtatgagtttacactgtcctttttaaaaaaatattgcgttaaatagacaacaacgggcgaacccattggatccatccctttgcgcccgaagttttgaagccaaattggacaaaaatatttgacactgttcatggcgttgtttattataagtgttttgcattctcaatccttatgttaatattccatatttagtcatgttgatcaacggtcccaatttgaccatcctggatttatcaatggggcatttttaccaacaattcacggttcgtcttctttccaatcgctgttagaaaatgaacaggaacaaaattgcaacaaagacgacagagaggccgacgaggaatccgatttccttggagaggaagaccttaatctgatcaacaatgaaggtgccttttgattatccatcgaataatcgtattttcattcattctcaaaatttgtttaagatgttccggagtggctcaaattgtattcccaagctccctttaactctgatcacatgctcaatgtaaatgaattaatcctaataataatttaattgtttttttagttcaacttgttcaaattgaaccaattggaggcatatgatcgtaagccaacaaattacagttttttgtttatatacaaattgaaattgcaattcaggaatgatcatgagattgtataaacaggtaaagatccaaactgaataactttaaaatgtcctttttaggatgtgattaacactgtcgtcaaatacgaaggtccaatgtcggagattgacaatgaactcatgcaacgtcataatttaacataattgagatttaaattgtccccactttttatttcgctcaaaaattgcttatatttttagaattgctgcccaactaatatgatatgtatttttgaacctaattttcttgcctttttgttttgtaacacaattactgaaagaaataaaccggtttgatacgactacccataggatttatcattatataagagaattatacaaataataggactaaattgagagtattcttaataatctcatgtttattgttacattaaacacagaatgttcgtctcccaatcatttgccaaaagacagtctgatcttctccctcattaatcctcccttgtttagaattgactgctgttccgtcttcttcacattttctctttgcttctccagttcgatccgttcttcctcgtacctccgctttgattccagcatttccaagcgttcgtcgttctaaaataaaaatatccaataaacacgttttaaccaaaaatgcgaagttaggaatttcgactttttgttcgaattcgggtccgggattggccgaaaaggatgccggattcgttcgtgatcagctacttcaaaaacccaggaagcttgtttttgatattaaaatttttgaaaattttttttaatgaaaaggggggggggagaataaagcacagtattatccgttttgctaattggaaggtgtaattgagtacctatacaaatagtagacataccaatttcctttcggccttttccaattccttgatcttcgtctccaacgctctctccatcgcattgcagcgttcctgagactccttctaaatgtttattcggttccaaatatgcttttctatggttttacaacagttggcttgggctgtgcttacctccctccgatgaatgttttccatttcctcctttagctcggcttctatttgctgtctcagccgtttctccatttcgatctgattattttttcatttttatgggggggggcttttcaactttgtgaaacctttgcggattttacgcgttcgtgtacaatttcctcaatgtcactgattttggacgatacctgaaaagccgttaatgagtgatctctaaattttattactattctgaatataaatcatttgaacagcgatcaatcgctgcaatgccattaccatcgcttagcgtttatggccattttctgttctgtccagacggtgcccgcccgctatggtttaaacactcaataaatcattaattgatgtgcgttttacacagaacagtgccattccaaaacgggctggcccacctgttcgtttattttcgattgtaaccattccactgcccgcttgtcaagacgcgccatattcacatttccactgccaagttccaccgccacgtcggatggggcataaattctggctgagtctgcagcggaatcccgatgccgcgaagaggagcgagacctcaaaaaaggatatttggacagtcattagaagggatattccagaatgaaatgaaatgcttcattgtacataccgatctcttcgcctatctttatgagacgaacgcgacgccttttgacgcttttcgctgcttcggtcacgcgaacgtttccggttggagcgatgcgaacggtcgcggttagtattaggagttgtagaacgagaatggggcattgcgctaaacaaaattaattttaaggcaggtggagcaaaaaaagtgtaaattacaaattgacaaattaaatttttcgttaaaaaattcctatttccagacggatttccgttaaaattgacaggatcgggaatcctttttcccgttcgctttttctttattcccgtttccgtaaattttttaccgggctctattttaataaaaataaattggcattttgtttcatataattctgttggtggttgagctgacactaatgattggatcagcccatttaagttctcaattcgtttcacttcattcactttagcattcacattcgtccttttcaaaatcttcttctctcagtattcttattattaaatttttttgtactgtcgatggtaggccccttttgaatttttttttttgttttcaaaagacatcctagggttttcggggtcgttgatcacgaatccggcatctatttcgatcaatttcgaaccccggacctgaattcgaacaaaagttggaaaattcaaattttttgaactttgcatttttagttcaaaa

SEQ ID NO: 2782 - DNA, 6179 bp, Heterodera glycines
attatccgtcagggaattaattaattgaccctaaattttgatggttctggattagaacaaaaacccactcagaaatttgctttcttttttaaaaaacatctattccatctataaaaatcctcatttctcttcattggttattgcttttccattaagtttcgttggcggtgtgcaaagcaggcgctgtgcacaaaggccttcccttatacaaacacatcgctgagttggctggaacgcggaaggttagcgtaaacgaccggtacacaatgtgccttacaattatcactgcatctttagttgattttgcctgtgccggctttcaacatgattaacggtggatcgcatgctggcaacaaattggccatgcaggagtttatggtgctgcccactggagcgaaaacattcaaagaggccatgcaaattgggtccgaaatttaccaccatttgaagaaggcatgcattttaatattgttgagtgattctaagacaatgtctattttaggtcatcaaagaacgctatggattggatgcaacttcagtcggagatgagggaggatttgcgccgaacatccaaaacaacagagagggattggatctgctcaaagaagcgttcgccgcatctggacaccaggacaaggttaatacaactttttgaagtatacaatttatcctttaaggtcattattggtatggatgttgcggcaagcgaattctataaagagggaaaatatgacttggacttcaaaaagtggaactgtttttttttgcgttgtaaaattcattttaagtccgaacactgataaagcgcagtggctgaccggagaacagctcgccgatatgtacaagtccttcatcaacgactatcccgttgtgtccattgaagatgccttcgaccaagacgactgggaaaattggagcaagttgcaggctgccatagacattcaacttgtcggcgacgatttgacagtcaccaacccgaaacggattcagaaggcggtgcagaagaaggcatgcaactgcttgttgcttaaggttagcctgaagtcatttaacttaatttgacaaaatattggttgaggtcaaccaaattggcacggtcactgagtcaatcgaagcttcaaaactggcacgaaaaagcggatggggagttatggtgagagggtggggatattacaccaatggaatgaaatatcactttaggtttctcaccgttctggcgaaacggaagacaccttcattgctgatttggttgttggactcgccactggacaagtgagtgaacacattcattaaaaataatggtgttttctagatcaagactggcgcgccgtgccgttctgagcgtttggccaaatacaatcgtattatgcgcattgaggaggaattgggcactgacgctgtctacgccgggaaaagtttccgtagcccgcaaaactaagagcgtgtggaaacgaagaaaaataggactgttcgttgactattcgctggatgtttagtttcctgacattgattatttgttttcgaaaagtcacttgaatgctatgagtatattatttaattaaactgaataaaagttatttctctttcgtcaaaaccatgcaattaattaaaacttgggtaaagttaccccgaattgttaacaaaatcaacaaattgtggtaaatgttaattgctgaactttttctaaagataatgaaatttacaagggctcaaataatttgtttgaattattctggagccatttatacgatgttggtaagttaattcttgcagcgacctctttttgctgttcttttagacgataagtggggtcgcaactttcaacctttatttcacatgccccgatctttatggtgattgttattggacttccattttcgccctattgattctgttccaaatatgtgtcaatttgtttttgtttcattattatctcaaaaggaatcaggtacaaaacctctaacctaccaaaatccctggacaaattcacaaaattcaggtacaattttggaccgccaaaagcagttggttgtttgatcatcagaatttcgagaaaaacacgaacaaagcgctgaatgggaatttcattgacgacacttctctcgcaaacattgagcaaaaatggacaaagagccaacaaaaagggaacaaccgcactcactccattggaaactttgaacagttcacggtttgtattattttgttcctgtatttctataaaaatggatagatttgtgagaatgggacttatgtcgacttgaggggcgaattccacggggaaaactccgcggatggcaactcacagctcaccaaatactgctacgagtgcaaaagggtgctctttttagtccattgtttgttccttcggtacgtcccttttccttctatcttcagacaactcctggtcgctgtcagcactgtccgttgtgcaacatttgcgtgctccgcaaagaccaccactgttttttgctcggcggctgcgccggtttggccaatcaggtcgttttcccctgacccgttggtcataggaatgttgatcgtatcattttacagcgctatttcattgtcttccttttttgggcctcaattggcgctgtctatggctcctctttcaacttttcttacgtactgtatttatttgctaatccccttgaaaaatcggacatttccagctgagaaagcatgcctccccgtgtttcccttttggatggatttgttatttgggaccggtaattttgtgggtttcgcttttttcaccgttttgtctttgggtcgcgttgtgccgctggttttttggctacgactcgctgttcaatgcccttctctctgtgatgttctcaatttcggccgcttcttcgttcgctgcctttggatttttcgttttccaagtcggatctctaataataaccctcgtaacttccgtttttgtccagatgatttacacattgaatggctacacaatgcacgatttccatcgcgcgggtctcaggagaatggagagtgacggcgagttgtttagaacggtttatttttcaggtaacccttttgtcattcaggcgaagatttccgagagcgtcttgccctggtgttcggtaggagatggtggctcaatttcatctttccccaattctggctgcccaaccaaatgaatgagaaaattgccaaaaacattttcctgaatacctcaaaggatctttgaaccgtaaatgcaaagctgaacaaatgttttaaagaataaagcacaaaaaaagaaaccgttattgtattgtatataaaagaaacaatggatgcaaaaagttgaagttgattgtccaaatctcagacaaacaattttttattttgcttaaattttgaattgcatctattgtttcgaaagccaaactacatcaagtgatctcgctgttttttgaaacaacaataaaaaagatcctctaatccgactatcaataagaacaaagaaaacggaaaaaaggcaaactaggcccgtattgggttttaaattcagtgtttcagacatggcagcaaaagaatacatcagaaatgataatatgaataagagaaaaacaaatccaaacaaagaaaaggggaaagcaatgagaatttgggggtggggagggcaagaaatgttcagttaggaagggattcctaaacaatttttgtactcggtcaatgctattaatggagcattctggaaaggcatgggggataagaagtgaaaatgcatttacatttatttacaaaatcagcacattcgtcccgtcatagttctccgatgttctacgtgtctgaggatgggtctccttcataacccccgtcgctgtctcggcgttgccgtgaaatcattctcgacgattgttcagacggtccaccagactcatcgccggaacaagacgaatcggaggggaaataggccgttaacttgcgcggtttgttgacgttggattgggagacatcaatggacgaagaatgggcaaaactgtgcgacggtgtttctgcaaatgttggtttgttcaaactgtgagcagaacgacgacggaaagaagaggaaacactttcggagttggcattgtccgtcccaatgctgctgatgcccgtggtgtgtcgtctgctcgtggcgttattttgtttgttggaccgtggcgttccgttgtttgtcgtttttgtgggcgaatttgcggtgtttgttttccttctgctacaattcatttgttacatataattgtttccaaaaacaactcacctgacattatatcgtccatcgtcggaagaaattccggacaccgctacggaagtattagtggatgaaatgccagaatctttttcaatgtgccgcaccgatttgtcggtgtctacaattttctgttttaatagtattttttttaagtcgtaattactgtctatttttttttcattgtcagttaaggcatttcctgagctctcctcaatctcaacagaattcgtcgcctaaaagtgaatgatttttttcttattctaagttgttttccattttacattttgaacatcattgtaatagttggccaatatcaattcttgttgaacactttcgttgtgcatattttcatacatatcattgaacatttcatccatcagccaatgcttaaatgaaaataaataaataaactaataacaacaaaagttcacttcgctgtgtgtgtctttgacgcgactcgcagtgaattggtattgacacgaaatgtttggagtgcacagcaaattttgatcttctatttgactaagcaaaaagtcgagaaatttctgcagtcggtcgagaataaggtcgccttttttaagtttcaaaagccactcattaagcctaaatgaatgggacaatccgactttcacattattcacaccaagattattttaaaacttacattcgcatcacatagaccacatagtcgagggaacgcaaaaatgggtcggcaatacgaaggccgaactcgacggcacgaaaagttctggcataacgaaacagctgagccggcagagaagcacaagtgatcggctctttgagtgcttaaaagattttgagtggtaaggacttcaaatggtgcgtattcctacttttatgaagtatttctgggaagagagcggtggtcatgtcagtgctcaggcgttgctccaaccgcgccatgcaaacgccacattccgagtccaaccgtttcctcctcttcggagtggtcgcacttgcagtcgcttgttggatgttgaaataacttcgactaaaattaaaataaaaaataaatacaaaatataaataaataattatattttatttattaataccttcgtttcaattcgtcattcataagcgaattgaatttttgtgtgctcaaaattagacatttcgtacagggcgtaattgctttaaaaatcagaacaacaaattgtagtaataaaagaagactggcaattttaatcttacaagatgttgttagaaaacgcaatgcgtcggtaaaaccctgaagacatatcttagaacagatttcttgggaaggtggcacaaagcaagaacagaatctggaagtgaaggtcaaatgacatgaaagagtgattatgagggggggggggaagttaattgtaatttaacttcacatttacctgtagaaattctcattgttaaaacggatagaccttaattaagtgcaaaattatagaaaataactttgggaaaagccaagctcacgtgttgtaatagacaaagccaagaatgctggcgctggcatggtccaatgggcaaatgtcggactctgtggaaaagctttaggggtaaagaaaggggaagggcgggcggggagcacttagtgctataatatactagctagagtccgagcagcatcgctatcacaacttcgagattatgttctagaattatgttagttactcagttaatatccagggaggggataatcccgaactccgaccacaatatttcaaaattctcggaccatgtatcagttacatgcgttgatgaggacatttctagtagctaagcaatcgatatccagggacgttgctagtctccgaacctctgaccataaaatttcaaaaatatcgccccatggatccattgtaaatgcgctgatctatctgctgtgatgtgagcggttaatttagaaagcccattacatgagagtgatcagtcagaatcaatctat

SEQ ID NO: 2783 - DNA, 1579 bp, Heterodera glycines
taaaaaaattttcgtttattaaaaaatataatttattttttaactttttttactgagtcgtttattataatctttcctcagaattttatattttcagcacaaaaatcaaagaatggcattgattagacaaatcaatttacgaagagaaaaaaaggcttcatattttttcgctgctccaaaaaatatttgtaaaaatagttcacgtaggataaagaaaccttgaccatccacatttcaaattaaggtaggattgagaaaatgcgtaattgaaattcgaaaaaaaacaaaaatttaattggaaaaagccccagaaaattattttttatagtatcggtctcggaaaatttcgctctcgagcaccatttttatccataccctaagggcagcacacacgccagcgtgataaatgcacaagaaacctaaattgggcaagaattaaaaaaacaggatggaaagcgcttaccacatccgcacagtgacaaattggcattcgaaaaccaattattccgaaagttcattttctgggtttgctgcttaaaacaaacaaaaattcacaatgcgttagctcagcaaaaacaaaaagaaagatcgttggattgctttcatttaccacgagataaggaaagaatttccgctatgaaccactttaagcctatattttatttgatgagaaattgggatgagaaaaatgatcgacgaaagaaacgatgcgaagtgtgggcggagggggggggggaggggaatgaatcggtgataagcacaaatggacggatggatgggcaccctccgcccaacacgggtaacccttcgcgataaaacgacacgtgagcacatttaaggccaacaacagcagagcgggaagaaataaacccgattgtttatatgaggtaaaagggacaagaaacaaataaaggaaagaaaagacagcggacggatgacaaagcatcagaaattaaatacataaaagtatatgtaataatcacataagtgggggaagaggaaggagagagtgatcagaactcagtgcatttgtaatcgaaagaggcgtcgatggacggaggctcgaagcgtccgaacagatcggcgagcaacagacgccgttcatcttggaaggtgcccacaatttcggccagtttatgacgccttgttaaattctttggaacagtctaagggaaaaccaattttggaatgtttccggtaatgcctaaccattccgtcgtacgcttcttcaagaaagaacagaaactgtttgtcatgttcagattgtccgtctctgataacaattcaatgaaatttcgaaagtcacccgtatttctcacctgctgaaaagtctgccttccctcacagaaatcatccaattgtcgtaatcgaatctcgaaaaatactccaaaaacccgtaaacgagctcaccaattgttcggttgttgctgggtattgctgatagggaatgaattttgagaattaaatcctaaaaatagggtcaatagtagttcgtacaatgggcagtttgtacaacgtttcaattgcggatttcatacaaaaaacattcttatttagtaaaaaagaaagacaggctaac

SEQ ID NO: 2784 - DNA, 2602 bp, Heterodera glycines
gtaatgagagaaacggagtgatcgctatcattcttgttactaatgtgcaatttaaggccgacatgtaatcatatgctgactatagacgtgtacaatagggtatttaaggagaggccattcctgactaatttttgatttgctatatgctagattttgaccagaattaatcgtaaagttaaataatttaattccaactatgtattttgaaataatattttttaatttaattacagcgaatcccgactttcaaatgtctttaagcccttaccaaatgaaatctgcaaaacgaaaaaatcttaaaaatgatcaaagtttgcccgtttttgttcaagtcgacgacatttcatcatcggttgatcttggaaatgacgggataaatcctgaacaggtgggaaatgcgtgaatcgaatgcatgagaaaaagctgcttttctttacaataagctaaaaataattaattctgatttcctcagcattctaacacgaactcaatggagagtaactcgaaggaaattgaaatgcgtgaacatttggaggaaattgaaagccaaacgacaaggcggtaattaatggattttgtttgaaaaaaaaatctcttttgtccacattaaaaaaagtcaataggcgcatctgatcatttgctgggttaacaaaacgcataaaaatgcaacaaaaaaaaaattctcgtgtgttttgggttttttgaaattcattttttcaaattcaagtgaaggaattcttgaagggagcagctcttttcctccccgccggttacctccccgagaaattttaaaaaattttttttattaacttagaaaattttcaagaaaaaagcttagaaagtttttaataaggaaattctatgaaaaaaaaattttttgagaaaattcagcgcttttttggaaaattttttaaaaatcttagtttaaccacaaaaatttttgtttagaattttcctatgaaaaaactttctaagatttttattcaaaaatttctaatttagtattttttaaagaaatttctcgggggggggggaacgatgcggggggggggggaaacgtagtgcacccttcttgaaggggtaacataggcaaaacagaaaatatcagttatattttttctttaaagctttgggtaaacagtgattttgaattaagaatgagatcttcgggcgtacgtgcccgccgccgtgccgcacatccaccgctacgccctccaccaccgtcgccacgccctccaccaccgtcgccacggcctccaccaccgtcgccacgcccaccacccccgccccagaagagccatggacatggcaatggcacgtattggtgctgttggtgacggtggtgatcgccgccgccgcacttggtggtaagaaaatttactattttggttaaatattttatggtaaaatttaacttttcagtgggtttgtggtgtcggtatcgccggtcgcggacggggcctgacgacgtggagtcgcaggcgcctgttgcggtaatcataatttttacaaaaattcttttagaaaaattcttttttgggtgggtaataaaaatgtggggttgaaaacaaaaaatgctaaaaaaagttgctttatttttttttttatttattgtcaataaagaaaaagtcctcaaaagggaaaaatccgcttacattgaggacaaaacattaattaaaatgccctcaagaaagcgcataaacaattaaaaacgagatcgccgccaaaaaataaaatataatgtgaaatcaataaaaaataaaaataatgaccaaatcactttttgtttaatgaattaataattcgacttttatttttccggtcaatcttacagaaatgaaatagttttaattttatttttaaattgatttaatggtcttccagggtctggttttgatcacgtgccgcccgggacaaaaaacaatggggattgaacggatggtggttggacccctgcccctggatcacattcgttgtttaaaaaaatgggtgaaatgtatgattttttaagcgggggcaggggtctggacccccgcccccggggccttatactactgtcaacaaacattttttggcactttacaattactaccctgataataatgtctaattatttcaggcccttgtcgattcaattgttatttctcccccaactgacagtctgcaaattttcaatagccctgacgttcaagcgatgactcgaaaacaatagtacgtgaccagtaaaccaaaaaaataataaaaaatcgaaaatttcgatgtttttttcttgtcaattaattttttctaaaaaaaaatcatttgaaaatccacttacattggacagttacactggcgtattgcctcgttgcccagcgttcggcgaatgctttgacaattgggacgcaattttgcaaacacttggccaagaattggaaacactgatcagccgtgccaataacattgaggacaccggtgaatttaaaaaaacacctggtaattaaaaatgaaagtgcattaattccaggcatttcgtcggagtatgacgacactttcgttgagatggaaaataaaattgctgaagtgaaaacacgcatggaacgcataaacacaacaaaagtaa

SEQ ID NO: 2785 - DNA, 1067 bp, Heterodera glycines
  misc_feature (1057)..(1057): n is a, c, g, or t
aaattcatgcgatactttcgcgagacgggcatcaaaatgcgtcgaggagtattttttaggaattttctattttgggacacatccttttcaatcgttttgtttttgcagtgcctactcaatagttttccgtgggaagtgtatcatttggctgaaatgcttgccagggggggggacgtagtgcacccttcttgaaggggtaacataggcaaaacagaaaatatcagttatattttttctttaaagctttgggtaaacagtgattttgttttgggtggtctatacaccaaaacaaatctgatacactgtatatttttcagctgaataactaagatttcagaattaaattttgaatccgaaaattttgtaaaaaatccaatttcttttctgattagaataccacaaccgcccccacaagtttttgatttccttgatgaaaaaatataattgtaatgatcttttacccaagggcaaaaattgatttcttccccgtctttggtccaagtctcagtaattaaaaggatgtcaattttttcggtttctaaaataagtgctatttcatcgattttattcattattgaccttatgtttactagacagcatttaacattccctttattttttattaaaaaatttggataattaattttttggtaaaaattttttactgaccggaaaaatttttgtacctttgtgtaataattatgggtaatttgaagtgatttggttggacaatttaaaaattttttcgaatatggtcaatgtcctgtctcagcacgacctattggcataaatcacccaatcaccgttgtccgcctgccttttcttcccgcattcttcgatcagtttccgcctctccgacagttggtccttggtcatgctttcgcggacgcggacattgtggagaccattcaatgcttgcacctttccgcgcatgcggatgacgtgccgcgctgcatgtttgctcgggaattccatcttgagggggcgcggtcgagcatccattcgtttgccgacacggaagacaattggtgcctgatcaacgttacctccccgaganaatttaaaaa

SEQ ID NO: 2786 - DNA, 967 bp, Heterodera glycines
ccccccccccccaccccgaaattttggtgaaaaattgcaaaaaaattcctgtttgtttgctctccggtgccgtgttttgaaaatctttaagtctgaaaataataatgagggaaagtgtactgaacgggaacaccccaaaacgtcgccggacaaaaaaaaatttcggaattcccgaaaaaaaaacttgaaattattttaattttcttggttttaacaaaaaaattttttgattttttctagtttttttcgtattaggctaggtaactaaatttttgatgatttttttttgatttttaaaaaatttatttatttttgttgtaaaatatttcctcctttaaacaggaagagatggaacaacttcgtcgacagatggaccacctgcaaaagcaaattggcaatctgaatgagagtgcacaacaaattgtacagttggccaacaatttgacggcggaacgggcgcacaaaattcgacggggcgacaacatcaaggtgaaaatgattttccagaagcttgaaaataaagcttgaccctttcataaattaaatggtgctctatgtttcctcccccaggcccgtaaccaaaaaaaaaattcgggaggggcaaccgaagagacttttttttgggttaataattttttctctagtgatatttcaaaaataccagtgccaagagagcataaagcagggatttgtagccgtttttcaccaaaaaagggactaattttggttctagtcagttttatgagtcccatgccatattatgcgtcccatcaaatattatgcgtcccatgaatgaatccttagtttcttaggccataactttttgttacttgatccaatacctatattcttggtatcaatcgaaagataaaagtctcgggattttatcaatgcaagaaaaaataaaaacaggcatgaaaaaggaaaattacaatgagaaaatatgaaattcaacttttcaaagtat

SEQ ID NO: 2787 - DNA, 3170 bp, Heterodera glycines
taacttttttcagaagtaattagattaaattttatttctataatttcaagtccactatttaatctatttatctttaaaatttcaaaaatttcattttataacacccttgacatgaatagatattccaaagatttctctattattctgctaaatttcaaagaattttatcgaatttcaaaaaagttagggacaaaattagtaagtttaaatttttcgaattcttttagttaaattttttataaatttttgagtcggttttcgaatgatattatttttgttgagttatctcaacaaaaataaaaaaatgtaacattaccaaaataatttatttttaattaaagaaagaacaaaatatgaaaataatttgatttttaaaacccaattataatctagaattattcgatggtctgaaattcattaatattaatttttattcttatttcgcgcacagaaataccttttgtacttttggcttacaacggaatatatcgaattgtgaatatccaaatcacttaaaccacttttatctttcaaaatttaaatagcaaatcgaccacgctttatcattaattattttcattaagttttagcacttgcatttcgtacttctttattattatagtcatataaataagattaaaatgattaatttttgtttattttaattttaaaaatttgaaaacgttgaaaattaaaaagaatatttattaatatttaaaagaaataaaagaattaaatacaagaaaatatattaaatatgcatagcacttataaaataggaggaaatactattggacccaaacgaataaaatcccttgagattaaaagaggaaaaaagctaaaagatatttacattataaatttgatattgaatataacttaaaataaaaggttattaattcaagacaaaaagagtttttcttttataaatcaaatattgtttcttcttacaaacaattataaacaaatattattaatagaacaacagcttattaaaacaaacttaattttatttttgtatagaaatgtttagggtataatgaattatacaagattatattgcaataaatttgaaatttaaataaatacaatcgcacgagttgggcctagttttttcttgtgcacaagaaatatgacttcaatttgaaataaatttctagactttattcattataaatttaaatgattataaatataatattattctataaataaaattacgtcaaaagaaattaattattaaatatgaaaatctaaagaattattagtacctaataaaaccttttgttaactgaaagaagaagaagctcaataaaaatcaataaatgtaattatttaaaaaattaaattcattttcaattttgtttttatctaaaattcttaaatttagaaaattattattttttaaatttgaaggctctccaaaatccctaattaaggtgtaatatgctaataatttttttaaaaatttcgatgagggccggcagtgccgttaggcgccgacggaaaaatttttgaaacttagactagagtgcatttttataacataacttatccataaaatttagcaaattttgcaattttagccattgttttaataaatttaggaattttgggtacggcggcgctgacaaacgcagccgggatatttcggaatttgttacaattttaaacgattttgcacctaaaagaaatttttttgttattttcggcttaaaaaatttaattggttttgtttttagttgttcaaatagcttctaaatataaagtaaaagaagatggttggcggtttaataactgttgttggctgctctagcagaaaatttacaatttcttttgctgtcgtttttctcatggttggtggttatttgaccaggtcaaataactatggttaaaccagggctcccagattaaaattttcaaaagcctcatttttacaaattttttctaagcttaaaacgttcaaatattacatgtattttcaatttattgttagaaataagcattttatgaaattctaagcatgaaaaatcgaagttgatttttttttgcggcggtttttccaaaaacttttgaggtacagggggaatccggcggtgccgatagacgctgccggggaaaaaattaagaattttgaccatatttttagcagattttcattgaaaatgaattttcggaaaaattgattattttctgatttttatgaaacatttaacaaaattttttgcaaaatttggatgagattttcgttttgatgctctattaaaaacccaaattattaactgagaaaaatgctagatgactaacaatatagcacagcactttatctccttggcattttggcaattttgggggtaaaaacccttaaaattgtacaaacttaaaattttttagggtttgaactagtttccggattttgagttttgcctttagaacccctgactaattaagttctcatgagagcaaatcaaaaactgaaaatatcatacccaaaatataaaaaatattttgggcatttacaaaccaaaacgaattaatctgaaaaaatttattttttattttttatttatttttatgtgttataatggtccaaataacgtatagactcttaaatataatatgctaaatattgcaatgaatttaaattattctttaaaaaattaaatttattttttccccaaccaaaaattttgttcatcaacaaggatgatccagagctaggccctgttcagtgttcacagggccctgcaatctattaaccttaattaagaaaattttaaacaatttttcatcataataatttataattttttaaacgagtataagaaaagaagaattactcatttttattattgggttgaaaattaaatattaaaaaaaatcatacaaaaaggacacttctaattaaaactaaacaaacatattaaaaacgctctacaatattggaataaaaataacaatcgtcagcacggtgaaaattacaataagaaagaagtaaatctgaaaattttaattaattaaatcaaaataaaaatcataggaaattatgaaaaatatactaagcaaaatgaatttttataagttttcattatgaaaaactggagatttagttgtatatcattttgtcataaaagaacaattttatagagatatcggaaaaaatgacaaca

SEQ ID NO: 2788 - DNA, 5819 bp, Heterodera glycines
  misc_feature (4406)..(4406): n is a, c, g, or t
  misc_feature (4422)..(4422): n is a, c, g, or t
  misc_feature (4446)..(4446): n is a, c, g, or t
catccctactcataattattaaagtttaaatattgtaggctaattatatatttattaatccctctgggctaaaaagtattaaattgtaagcgagaataacagccgcgggagccatgagttattatgacccctccgggctctcttatttactcaatctataattgaactaaatatttttggcatacagcaaatattcgttaaataattttaaaaagaaaatattcaattaatgcaaattagttcaaatgtcgaaaaaatttaaatatataatattttatttcaataataaaattagagaatatgttttatcaataatataccatttttactgttgattgattaaaaataaaatgacaaaaaaaaaactacaaaaaatttttaaaaaatgacgaatgcacaatgataaataatttgtcgctttttaatttagtttttttgtttgaaatttaatgcttaatcaagtttttattcagtcaaataataccatatttttttaattttgacacttatgatatttaaatgcatttacattcaatataattaatttaaatgaaaaacaaatactgactcataaataaaaaaaataatttatttaaattaaatttgttcattaataaaagaacaattgtttaaaaattttaattaattatagtaaaaaattacgaaaacttcaatgaaatcaaagtaaaaatttaaaagcctataatttttaccggattaataaaatcctaataaatttgttagaaaatagacaactttacacacatgaaaaattaccaagagatttaaataaatttagatattttagctaattaaaataatattcattcaatctaaactgaaataaaatatttatctcttcatcaaatttccccttcccctttttagccgtgagattaaagagcaaaaaagagataattaatattcaataaactaatttgactattaattaaataaagaaaagtatgaaataaataattattcaattaatcatatttataaataatcattaaagcaaaccattaattcttttgatattttgtatttaaattaaaactatttattactaaagaaaaattaaaataattgctataaagtaaaaataaatgatctaataaaataaaatagagacacttgaagagaataaattttgcagaaaattttcaatttttgaaaattacttttacgaaaaaaaatctgatcggaatttgtatttcatttgagaccggaaacaaattaatttatttttatggaaagtcgatataaaagaaagcaaaataattaaacataaatgtaaaaaggcaaaagaaacaatttaagaaacgaaagttttttttcgatggtattttcgcaggcctggttataaatttggtcgtattcttgcttttttgcctcattaaggcgatatagtgcataatttacccttgtattcatgtttttattttcctgccctcctttattcctttgcttacttttagtaattctgttttatttgcacttgaattttgtggcaaaatcgtttgcttcacttgtaaaattggaatttccgttgacggtactttttgtctatttgtttaggaatttcagttatagttggtttagttgttgtaggaattttgaccgattttgttgggggtggtgttgtacttttcattatgcctacagtagttttggttttctttgttgtgctcgttactgtagctggggtagttgtggtaacttttgccggattcaattttttaaattcagttccctttgctttatacacttgttgagtttttaattttgtttcccttttgtgatttttttaattcaccggaaaaatttaactcaatttacaggtgtaaccgtccaatgatttaaatatttccgtttgctcaactttgtgtgaaaaattccacctgcacaattgtcctgtgtgtccttgtcgcaattcctccggcgatttgtgtccaccaattcacgacttcgaccagcgcagtagcagcgacgggaacaattcaacgctttctcggcacaaacagctttcgatgagttgcagcaaaacttcgcagtacacggcaatgaatgtttgaacggtttattgagagtaatgtgatatcggccgataataagctaattaattgcttaattgcttcaatgctttttcatttcttttaattgttccaattttgttatttttcgtgatgacccgggaagatttttcttattctttgctcattaattactcgctgatctctgctttccctcgaaatttgcccaggcgaccccttgtaatcaccagtcggcgcctgacttatatcacaggaaaattatattaaaaaatagaaaaattaaaaaaactaaaaaaaaatgaaaaaagtcaaaaaataaaaaagaaaaataaaaaaaccaaaaaaatcattttaaaaaaaatttaaaaaaaatgttcggccccaaatcaacggttttattgcttttggcgaattccaaactattacgaaattagaaaatttgactaattgatttgtgtgaagtaagaaaaaaaataccgtattggaaatttaaacttgaattacttttatttggaaatgttagcatgttggcaattaaaactcgaattaatttttatgactttatttagaattattttaattttcaatttttcgcattttctttctctttgacttgtttttaacatctgccaatgtcgtcgcgtttctcatcatttacaaaagaatttaatgaatagaatttgcaaataattaagggaaaaatcgtttgcattttaaaataatttgaattcgtctccgtctctccgttcattcatagagcattcattttgttgagctgaacaatttttgtgtccttttggatttatttaatttttgtccaaattcccctttttaatttttaattaattagaaaaattagcaccgaaaacataatttgggaatttaaatctaattcacaatgtgccgtgggctgctcgccaccaaacatttgctttactcccgtcttgtatactgccccgatttgtgtgtgccacctggtgttaatcctaactctctttcgcactaccattctttttcgaatggcatactcattctgcttattggcatgcttttgctttgtggactcattatcggcatgcttcttgttttgctcattatttcttgccgccgttcgttgcgccccaaacaaaaagtaatgcttctttctcaaaattatccttagaaattgttactcattttatagttcgtttccattcgccaaaatgtccattctcgtctgggcaatcgcactttttctcgcccttctcctttgactgttgtgagcctttttttatttctttgcgtatgagtcattcaccgaatttccattttagccaggctcaatggttagccatgtctgattatgcgcgggtggacctttgcttttgttgttactcaattttgccgttttcaacattccttttatcaccggcttttctcttttattcaaatatctttttttaacttttaaacataatattctggttattctttaatttctaataaaactattttcattctctttttgtgtgtgtttatttaaggaatataatataatatgcacacgaaaataatggttatttaatttacaaaattgtacaagagtctctgcatttccgatggcgggacctccatgaatgttatgtgtcaccgtagggccatttgtgtccctttatcccccattaattcagtatctaacagtacgcctttattctggggtaaggatacaatgcttaggccctcttcccgattcggtctcgggagcagagactgccgggggagaggcccgatgtgaataataaagtgatcgagagaaagaccccgggggcgtaattgaaggtggagggggtgatcaaagaaccgcccactaggagagagacaattatttgggataagataaaaaggtgtgatagatcgattacgtaataattggtgaataattgattaaatgatgattatatattaggatcatgttcaaaatattaaaaaaaaaaccaaatgccacaaaaaattaattaatgttacttttttaagtaaaacaaaaaatgaagatgaactaaaaatttaaatgaaaacattttttagatcagaatattaaaagaaaaaaaattatttaataaacactttaattctcatcgataaactgtacaattaaaatacaaaaaatatttttatgttttttaaaataatttttaaattcttcattatggtaagaaaactgatgactaacaattatctggataaataaatactcgcgtatttgtcatcaaacaagttggtgtaatatcgctctttaaattttaatttcttcaatttattatttttttatttatagttcacattgtaatatttttggctcccggacatttcgancaatgaccgtttcgancatgccgtttcgacaataaaattnaaatatatttttaaaaataaaattcaaatttctgcaaaattatatggacggtgcggatttgggatcaatataaaaaagtttttttttcgtttttttcaaaatagcattatgagaatggctttagtttgtcaattttcggcgcaaattgcttatttttttttaattaaaaattgaaacattgttttacacctaaatagttgataatgaattagaagcttttaccctgaaaaaactattcttgattaaaaaacaattttttttgttcgaattcgggtctggagttcggaattgggcaaacccgagttaagatccgttatcagcaccctcaaaaacgcctaaaaactggttttgagcacaaaattaaaaaaaaatgaaaattagggacaaccattcttcaggattgccgcctgggtaaaaagaggacactacattaagttaaataaatggtttcattttggatttatattataggtccgtctcattttgtcttctttcttcactattaatagggctcggaaggcgatagataatgcattcattaaatttaaaaaatataattacctaattaaatttttctctttaaatttcatcaatatttttttaaattaatttattattttttatattcattttattatatttaatttgatattttaaattttggcaatatgatatagtcgtaaatggtcattgtcgagacggcattgtcgaaaaggtattgtcgaaacggtcattggcgaaacggtcattgtcgaaatgtccagccacccacagcattacccctgctcaatatagtgatggatgattcaatcttgcaaaaaaaggaaaaaataatgaagtggaagattcttaaaaaaaattctcttttttaaaaaaagacacaaaaatttgacttttcttactttttcggtcgcgcatgcttaatttttttacatctgcatgaaatcgaaaaaatggataaataaataagattgcttaaagtcaaccaatttaatcaacttgatatagttgaaagtcggccgtcaattagcttaaaatattttttttaaatccaccggtccttaattcttgaaaatttctaaaaatctatgccgttatgagcacgccttattagttaatgcgcctaattaatcatgagaaaaatttttaaaaaaatcaacaatttatcaacaacagcagagttaaacaacgttcacaatgaatgatttttcattgttccattgttttttattggatcaacaaattttggcgaattttttccaatgtttcaccaattttcacaatgttttcaaccgttttactttggtccaaatatttgaaaatttggaccaaaatgccgtccaaaatgccttcttccatcatctgcaattcat

SEQ ID NO: 2789 - DNA, 4113 bp, Heterodera glycines
  misc_feature (25)..(25): n is a, c, g, or t
  misc_feature (843)..(843): n is a, c, g, or t
cggagcgctttttcaaaaaactttntgggaaagaaggggtccggcggtgccgataggcgccgccgggggaaattttaaaaatttgggtgcaatttgttaacagattttcaacaaaaaaggttggtttttgcgattattaagctcaattggtaggattttcatttaaaaaatgataaaatatgtatcaatttaaaaaaaaactatgagtaatcatattttctctataggaaacccacgagtatacaaaaaaaaaattgaaaataatctaatttctgtagagggatcgaaccaggggaaagaagaagggaaagtcaaggcgactagccattaggccatttgcacacttgggcagtcttactttagtaaagccgtgaagtcccatacccagtgcttaatgagggatttagtccagaggagccctcttacgcgtccgtaattaggccccgcagggcttggaagggaagggatgttgatggatgcctgggggcgcctcccaggcggggatcgattagccattccactgaatgactcccgactgaactccgattgtcccctttggctggttatccgttgccttttaagcgcccctcgggatgggaggagccctatcggagagataaaatgggggggggggggagggtaaaggccatttccggtcccggccttacacctccggccctccaaaagaccgtccctggtcgttaaaatttaaataatttccaaatttaaatgaagtcctcagactttttctttcttttgattttttttttacggtgagaaatttgttttgattttaaagccaaactgaaaataaaataatttaaatatttatttaattactcnaaataaaaatggaaaatgccgagcctctaatgggaatgaacccattcctccaaccaatccacagaagctctgtcattgagctactaaaagaaatccgccctttttttaaattaattttcttgaaattctgattcaattggatttgaattaaattggcattgcttttcaaattatgagccaagagaaaatctgatgaaatttaaaacttttaaaattgtataaatttaataattgttttatttaatttccaatcgactaaaatttggatttttgatataacccggtgtgactgtatgactatacctccccttcatacctgaggatcgtccctgatacaagaacttaaatcccacgggattcatataccaatactccattcatttattttattttaatattattattattatttttttgtttaaatttatgtattaaacttttccctttaattatcatttctcacttgttgtgtttttgttttttgtgtttatttaatttaatcagctccgcagagcttagacaaatttgtgtgaatatatatgtagagtagctccgcagagcttattttaaaatatcaaatataaatgcgagaaataacaaatgaaccattgggacgaatgatgtcagggtgccatcggaaaggtgaatttccgggcaaaataaaggatgggtgaattttaattccagatgagagctgaacacttttgagaacaacattgacttgatgatctcttctgaagtgttcaagcggaaaatttgcttgacgtcgtatgacctttgttgggcaagacgctgatcccgaagtagtcatcacatattttggaatgacctcggttggtgtaaagcgttcattgatttcgacaattgtgccaatctcagtgatttgttcagattgccacatttctatggtaaaatatatataaattttcagaatcttagacttagatatttacttttgatgtcaattacggtcgcttggaccgccaaaattgaggaatttggattgatccaaagtttcctctcctttgtcatctccgtgacgtttgaagccaggatggcaaatctgttgtcggcttccaatttaccaggagtaaagaagtcacccagaccaagaccacttgacaataaacgatttgggagcagaacaaagtgcggaaagctgttgtcaaaatcaattttagctcctatcagtccattggcaagctcttgtgctatgagatagacaggagcagacggtggttctgtgacaagagataagataaagaccaaagtttcaaaattatattaactcctcagagttttcataattataagctattgagtcctcccgtttaccaatttgcctagaaggaccagcaacactttgctgctcatttagcattcgcatcctcaagctcatgaggatattgcccatccaatttcgcccaaatgccccattttctggtgtgtagttgtgcaagaatggatcgtctttgtagtatccgacagcccactttcgatctttacacgcttccgcaatccacatgtcgtttgtcgctagcagaagagctgccaagtgctgattttgccgaaacttcagctccacaaagaaagcgatggagcttctttgtgcgttctccgaccagtttcttttagtggcgggagaggctctctcttcggcttcgcgtccgaaccattttagttcacgtgggtgaccatcgggccaccgcggggagtttggtgtggagtcgtctttgtggacaaatcgcatcacttccgccgccactccattgagttcgtatgtacgaactttcttcattacaaatgcctgctccacacagcagtaactttctccctcataaacaaatggcgaaaagtagaagttgctaaatgggtcttgcatcccctgaaaagccattaaggaaaggccatcaggaagcgaaattatcctcatctctcccagattataattaacgaacgccgcggcgcatgacattttgctatgtaaacaaaacggttagtgagaaaaatacacttctttaagacttaaagataattatccggactgtcaaaagactgagttataagtgatcaatttaaagagttgaattagaatattttataaattaagatgtgttaagttcctcagaactgaaaaaaatgaagcgataaatagtcccgcgggacttattgttaaaaaaaaatttcattaaataattccgagagtctgtccaaatttttttttgttggcattaaagttgaaatggcttctcgagaccagtccacgttcttaaaagacagtatgtttaaaaaaaaaaaaaaaaaaaatggaaaaaatgattgaatttggctatcccatgaaattagtcctcagaaaagttaccaaaatgcttctttttcctagggttttcgcggagattatgttttgagcaaagatttctatttaattctttttcttttacctgattattggactgtggagagggtgagggattaggggtgagtgcaggtgcgttttctattaatactgtgttatcagagattttttgataggaatcatgagaatagccaggtacattggtctgttctcttgattctaattcctttagtgcttgttcttcatctttttgaagatttttcgtggtgcaagggggtcctgagtactcaaaatactttttaacttgattaatgtgtacaattcttgggtttgtttgaggtgatgtgcagctgacgattgtgataaggacaccattaatctctatcactcgatacagtcccttccaaggtaattgaaatttcttggatgttttgacttttcctgcgtaattgcgtaaaagaaccctatctcctatttggacggtttgattgcgtactaatttgtcatattgtacttttgaccgtaactgagcttctttaatgaccgccgcagcagattcccaagcttttctgagagacttaactaatttctgcttgacattgtcaacttcactggtgttttcgggttcggtgttgggattcagaatttgctcaatgcaaaatattgggtctcgcccaaagaccaaaaagaaaggtgtctcctttgtggaagagtgaattgatgtgttatagcagaagttggcacattcaagaaattcatcaaaatctggttcttcatttgaaatatatttcgcaagtatattgtgaaatgtcctaaaagatcgctcaactactgcattgccttggctccaatggggaatagcataacatttataagtatagagaagcgaacagaaggacttaaaaaaatcagag

SEQ ID NO: 2790 - DNA, 3489 bp, Heterodera glycines
atagccaggtacattgatctgttctcttgattctacctcctttagtgcttgttcttcatctttttgaagatttttcgtggtccaagggggtcctgagcactcaaaatactttttaacttgattaatgtgtacaattcttgggttcgtttgaggagatgtgcagcttacaattgtaataaggacaccattaatctcaatgactcgataaagtcccttccaaggtaattgaaatttcttggatgttttgacttttcctgcgtaattgcgtaaaagaaccctatctcctatttggacggtttgattgcgtactaatttgtcatattgtacttttgaccgtaactgagcttctttaatgaccgccgcagcggattcccaagcttttctgagagacttaactaatttctgcttgacattgtcaacttcactggtgttttcgggttcggtgttgggattcagaatttgctcaatgcaaaatattgggtctcgcccaaagaccaaaaagaaaggtgtctcctttgtggaagagtgaattgatgtgttatagcagaagttggcacattcaagaaattcatcaaaatctggttcttcatttgaaatatatttcgcaagtatattgtgaaatgtcctaaaagatcgctcaactactgcattgccttggctccaatggggaatagcataacatttattaatatagagaagcgaacagaaggacttaaaaaaatcagaggtgaatgccgtggcattatcagttaaaagactcgtacagcctccaaactttaaataacagtgtttaaagaatgctagtgctattgtttgggatttagcatcagggataggtacagagattacatatttggtaaatgtgcaaattatgttaaggatgtgtttgttacctttctgcgtgaggggaagaggacctgccaaatcaagtgcaatttgagcgaagagagtattttttggtggcatttgcatttctgcacgatatgaaggattgggtgaatgtcttagttgacatgtgatgcattgtcttgtccaatttgtgatgtcgcggtgcatcattggccaataaaattttctacatttccctaatgtctttttgatgttcatatgaccaccatttatttgtgaagtatgaaaagcttcaaaaattagtggacgaagagaaagcggaatgtacattcgagcattttgatctggtaagtgttgatataatatgcctgaggaaagactcaaattttccgctcttgatgcaatatcttccttttcaacttctgtggtcccctcagggaatgaaccaaaatttacaaattcaattaatttcctaacctcagaatcgtcattttgttctttccgaacatcaatggcgaatgtttttccttctatatcacgagcagtgatggttaaaagaaaatgctcatgaaccattcttggcttcatattcagtgcaagacagacgggaaaatttgctatgtcttccaattcagccaaatctctaatggcaatctcttgggttctttcatgtgggtaccgtgataaaccgtcagctaaaagattctgcttccccgctacatgaattattttaatattgtaattctgtaactcaattaaccaacgcgcaaggtgtggatgcgcttctgcctttttaagtaggaaggcgaggggtttatgatcacaatgtaattcaatttctgtcagaaaaatatagggtttgaaatttcgcagagcaaaaattattgctcccaattccgcttgtacagcaggccatttgcgttcagatgctgacagcgttctgctgcaataagcaataacttcatatgcttccgccaactcattccactgcatgagtgccccaccttggccaacattagaggcatctgtgaatatgtgaaagggtttatcataattgggaaacaccaatattggtttctcactcaaaattctttttacttcattgaatgccgcagcctgttctgtaccccactcgaaattgctctcctttttggttagtctggtcaatggttctacgattgtagaaaaattaggaacatgtttacgaaagaatgaagccattcctactacatgtttcacatctcgagttgttttagggtctggaaggtttttaattatttccactttgcttagactaggagtgtagccgtcagcattgactaagtatccgagaaaattcatggtcgccgcagcgaatgtgcattttttagggcttaattttaggttgaacctcctaaatctttcaaaaacacttctcaaagcattgagatgctcgccaaaattatcatccctggtgtataccagaatatcatcgacatatgcgattacacaatcgtccaaacctgtgaggacatgcgccatgcatctggcaaacgcactggttgcatttcttagaccaaaaggaagattaaccatctggaaaattttgttttcagtaattaagccacattttctggaagccctttctgttagtcttatttggaggtatccacttgacaggtccaaacttgaatagtaacggcaattacctattcgttccataattgtttccaatctaggaagtggataatggtccggaacagtcacttcgttaagtttacggaagtctatacatggtcttaacccaccgtccttcttctgcactaggacgatatttgagacccacggagtgtccgactcaaccatgactccggatgccaaaagttgatcaatgtgtttttggagttcatcacgatacttgaatggtgttcggtgtggcttcgacgacacaggagtgtcagacgtggttactatgtcatgctctcctgcagtgcaagagcctaagtcatattgacttttgctaaaaatatcttggatttcttcacacaattcctttaatttgttaagattttcacctgagactgatgattttgaaaaatcaactttaaatgacggatctgcgtgaattattttttgtgactccctcaggagattgatctcacccgaggtgcatttcattacgagattaggatgatcagatttgtttaattcacatgcagtcgcaatgcatatatttttgattatatttttaggaaaattggttggattgcaaattacaatgttcaataaattttccttaggccttgaaactgtggctggtgtgcttaggtgttcatcagacaatcttgggtccaaattttctacaagaatgtccttgtctattgacaagatagtatctatcctggctttggccagtatttgagtaccaggaggaattcggtagtgctctagagctcgaacttttaggtttgagagggtactatgacttgtttccatgtttagttttgacttacctatcataacttccttttttgtgaagtcaaatgttattggtggcaggttaacaaagatatcacatcctatgattatttcataatttttcatggctcctgcttggtcatcaggtataaaattaattgaactccgcagagatatatcacc

SEQ ID NO: 2791 - DNA, 2775 bp, Heterodera glycines
  misc_feature (905)..(905): n is a, c, g, or t
tgatactttttttctttttttcggcattttattttgacttttgaaaatattataaataaaattttttacttagggtggaacataattttgatacccaaattttttccaatttttaaaaatcataactccgttatttctgcgcctatttaaatgattctttttttattttgttcttcatggtttcctcttttatatcttactatcgtttcactttttatttgattgatagatttttctgccttttttcccgaccatgccaaaattgaaaattggcccactaatttttctcgaattttttatggtcaaaaaccaaagctgatataataaaatcttggtttttctatacaatttagaccagtagaatccgaatatggccttaaatgggacctatcttttcaacctgagcttgtactgctccaactccatgcatgaagttcgagctgtacaggtttgttgcgatcccagagactttgtgtaattaaatttagaatgttcacaggcagcaaaaaaggaacaaaacaaaagtaaaaaaagcacatgccaaatgcaataaatatactgtggaatagctatttataaaattgtaacgcattaatgaaagcgaaaacaattagtaaccgattagtaaaaaatggccaattatttgttaattactgaaattaaccaattaattaatcagaagggaaattaacgtaaattggaaccaaaatataaaataaaaaagcatttattcagatatatttcggaaagtaatttaatgatttattttaacaaatttttattggccatttaacttttgggttttggggagagaaaggactttcgtccaatttaaatatttaaatttttttttctttgaaatgccacaaattggccctttttgagttgaagtttaaagcgtgcgntctctttctcccccccccccttttgctcatattttatgtttctgtctccccccgcttttctccgcttttccttccccccattttctttcgccgcttttccccctaaatctccccggagatttacccattccgcccaaattctgtttgtattttggctttatgtagcggagtaacaacaaattcgtgatttatcccattttataattttgcccgactccaaaaatatttctcctgtttctgaattttcatcccatcgatttaaaatttatttttattttttgccgaattgacaacaaaatgccattaatcttttcgtttcaacgaagaaaggtgagcaaaaaatggcacccaaagtacccaattcagagctccattcattcatccatcacaaaaagaaaaagcgaaaataaatctgccgattgaaattaatgaaaaataaaaaataaaacattgaattgtttggcataatgccaatgaattttattaagaaaaggggggataaatgtttaaaaagtgcaaatattgatcaattcatgctctgatttggccattctttatttttgggagcagcccacacttggcacttttattttcttcacggcaccattttttgtcattttaatttattttaatttttttgtgtcatccttaaattaatatttttttctttttttaaaattttttatatttattatattcatcatttagttctgtttcgagcccaattaatcggaaagtgaaatcctgtgaaaataaaataaaaatgcataatttctttgtcccgtgcattatttaattttattttctcgggatttcactttccaattttcaactttatttataaacaatccgttcccattttccatctttttccaaattgtccgatttcccccccccctttttgggcttttcctcgtggccatcttccgctgggattaattcgaaactttgtccaataatttttttatcgaatgaagcggacggagcagctcttcctcctcctcctctttcgccttttttgttgcttttctccttctgttctttggttttcgcagaaggccaacgaaattggccaaatttgccaaaaaaggaacgaaaaaacaaaacgaatgtttttaattaattgaccaaaaatcctaatccaattaattattgccatttttttgttccattcgcatatgaattgtgaaacgaacagctgagaattgtttgtgcttttcatttttcagctgccgcgcgactttatagataatatttttaattaaaaaatctttttttttattttttaataatttcaatttgcgtcatcattgtcatgttcatgattccttcagctcatcttcacatatcgcatgtttgacctcattaaatgccacggcttcttcgcccccatttcttccctttctcacgtcatcattagcattaattgtatttatttgttatttttcttaattattaatttacattttcaatttcctattccacgtcaccccttcccccaatttccccccccccccccaattccttccgcttatttgtacagttcaaatcagtcctacaaaatgtcacttcccccatcaacagtttccttctgctgataattgtaaatttcgaaactttgagtgtcactatttaaatttgataattatttttccctctctttttgccatttaaattggcaaaagtgccaaaaaattttgctgaaatccgtggcaattttttggcacttccgtctctgttttcctctctcctcctccaccttttgacgatctgtgccacttttgccagattacggacgaacgcctcccccctttttttcgtggatattgatccctcgggcgcgacaaattttcaaaattttttttctggg

SEQ ID NO: 2792 - DNA, 3573 bp, Heterodera glycines
tgcaggcctttgttggatttttttttttgcaatggaccatgcattttaacttagtcacattcacatcatttctttcactttttattcgctgaatttttatttttattttttaaatttccatttttgtttctaaataattaattaattaatcattttgccaatttggcttttacttccaaaaatgggttgatttgttacatttgcaatttgttcccaatcacgaacattgttccatcaaatttccaaaattggctgcccaattagtcattcggaacatccatgcaatccccggatttccatgccgggccccgtcacggcatcggctgacttcccctccccccgaggggcccttcccaaatttggccaactcgtcgccccatttgtcctccccatttctcggaatgcctttggccaattcccgcgggaaaaagttctgtggtcgaataaaatgagactaataataggcgcagagcttacaacaaatgcattttggaaacaaatacaaataaaaaattaatattaaaaaataaatttgcactttaaaattcttcgattaatttggacattctaaaaaatattttcctttttaattataaatttcaaaaaagtatttttttttaatttgtcttatttttgttccttttcttcgtcaccttccgctgacaaatctctgccgaatgcgaatagcaaaaaaaagagaagctttctctcgcgcggtataatttggcgcattttgctccatttttcctttccccgccggccccccgggtccaattaatccttcccccccattttccccgtggcacatttttccgtttgttaatcggtttccgctctctgtgacaaatgccatcccctgctcagatgtcttccccatccccgccgaccttcgcttcccatttcaaatactccgtcgccgtttgtcacggcattggcaccgccggtggacgacgctcgccgatgcgccgcgtttcgctgccctccgcgctgccgcacccgcgcacgccgaacacgctgagcccaaagctcggcttcctcaaggtacagcccaactgctgctgcttaattatgctcattagtgaattgattattttatttatttgattatttttgccatttcatttggcggcaaatgtcctttttaacacattttcaccgcataaaattacgtttttgcttaaaaggtaaaagtttaaaaagctgtccttttctggcactttttttacgttttttggccctaaaatattttcacaaaaaaaacaatttgtccatttcttatgtggccaaggaatttctacatatattccatgatttgattacgtaaattgggcccatccgtccacaaataaatccgcgcttttctcggatttgtgccaatgtttgatgacttgcaagtcgcttttctcgcattccaataagggtttttgcggtccttctcccatttttgccattttttgatctcacattttgccaatttcaggaaatctccgaatttgacattgacccgccgttcatttcgccggctgcttcttccagttcaaggtcagtcagcagagatcaatctaatgaccctttaattagtcttaattgctgcattaatcacccaattatctgtttaattgtttatctcattttggtttgttttgcttttttcccctccaccgattgttgtgtaatccaaccctaatcccatttttggcggtgtcacacatcgcttggcactcgccgtgggaaaatgagtgaaaaggcatttaattccgcccattttggcatcatcagacggcacagaatgatgatgacgatgatgcaattggcatgtgctctccccccccccccccgctgtttttgtttttcaaaataagcataagcttgcgcatcttttgcggcattgcctttcgtacaatgcaaaattattttgttgggaattggacaccaatcttccgcatgtcggcttttcctcaatgcttttcccccttcctcccactgtctcagcttttcctccctatttttcttcccccctaatggttccttaatggtcgcagctgagtttacgaaatgccgaggggtccttaaccggaggaggggggcagtgccggctaattggattttacaaaatgagtgtaatttgtgagagatcacctcggccgggacgggggggggcgagtgacgtcaaaaatgtgccattggttaatgcaatttggcaaagtgtgtgtggcaccaattttgggagcagctaaaaatatatacataatgatgatggctttgaaagtgacctaactaaaaatttgtcgataataatttgctaatttttatttttattaatttcatttttggatttaaataaaattttaatattttttcctcctttggcattttgataaaaaaagtgccaattatctgtcgacccaagaaacttttagcggcgttttgcttatatataaatttaattttttatcgggcatcagcatcatcattaattattcgcgcttgcctgatcgttttgagccccgcgggtttctttccatggacggaccctcggggcaaaaggaaaggcaaaatgccaaatttgaattgcaaaataatgaagagtacgaaacgaatgactcatttttacgtcatcaaaaaatacaaatgaaaaagaaatgatgatgtgcaaataaacatacataatagaagagggatggtgaagcgcagcagacggacggagcaatgagctcattttggcatggaaaatgccaaatttttcagttttttttacttccttattttttggttttattttttatttattttccttttccgaatttattttccattttgttttaactcttttaaattaaaataattcaatttaatttttttaattttgaatttttcagtgccgacacttcgccaatgcttttgtcgccctctttccaacggccggcttccgcgcgcctttaccgtcgtaatccgcagcatcggcacagtcagcccaactcgccgggctcgcgcaaatcgcgctttttgaaccgccaaccgccgccgatgggcgacggacgaacggcggcagtggcgaaagaggcggaggacgacggattccgctggacggatgtggacggattttatggtaggaatgaaaattgattattatttttaaaaatactaattgctactaatgccataggtaattagctaattagggtacgaatgacataaataaacgtaataaattttgtttaaggccgaaaaaattcgatacctctgcaacaattgttggccaacgatcttctgaacggcgccaatttgtttggcgatagacacgacgagttgaagccgaacagagggaggatgatgatcagcaacggaatggacaacaatgagaacaacgagacggactatgacaacacaatcgacggcagtctgctgaatgttgagcagcaacagaacgaagtgagtggaaaacggagaaaacgacgaaatggaaaaatgccaaaaaaatcaacaaattaaatgactaaaacaaatggaagggtcgaaatggcattttgatgtttaaaaaattgtttagatgaacataccatcggacataac

SEQ ID NO: 2793 - DNA, 1379 bp, Heterodera glycines
  misc_feature (66)..(66): n is a, c, g, or t
  misc_feature (1374)..(1374): n is a, c, g, or t
tggaaagcatttaatggtgatcgactgatcagcaccaatttaaaaggacagactttgcattatttntgctgataaatttaatttgaccgttttaaacggaaaagcatttttgatcagtgttgatcagctcgttgatgcgaagtccaatcaatcatatttatttattattattttcaaccgggtttttttggttcatcccaatcatttttcacccccaatttgtccgggcatatccattccacaaaatcatccaattccttatacatatttattgtatactgtacaatttccattgctacaatacaacatgtgactaaattttaaaatgaattcaaaattatttggcattttatttttcgaaattaaattttttggtattatttgaaaaagtccgagtccgagtcgctgctgtctctgtttgccgtgtacatttgtggcacagtaactgccggtacagtagggcctgtaggaggaagggcgggaggagccgttacggtggtcaacggttgctgagagggcacgggcttttgttccttaattaaacaaaaattaattaattatttatttttaaaattgcgaacccttctcggcgattcagacgatgatgattccgtcaaagaaatattgaatttcctcgggtttttcaacacctcaagcattttccggaaattctcgtcctcttgctgcttctgctgctgctgcttcattggctcagccttttcgtcttcaaaataaatgattattttttatttaattattttcctaattattattgcaatttaaatcgtcccattaacataacaattaacaatttgtcaaagtttcaaaaatagtaatcaaatcagcatctgctgctgttttggactgatcaacaactgttttgcccaatctgctgatgctgactattgcctgtcacactttggcaaaaaaagtaaaaaaaatttttgaaaaaatttttttcttggcttaatttgaaagatattccgttttgacattgtaagaccttcaaaccaacgcagttctcgaaccggataagctcgagtgttttggcgtcgtgattagaaagattcacgcattctctcccgggattactatttaaagtgcttaaaaggaggaaactaattaggctaattaggaggtattattaaatttataaaatacagtgtctatctagtatgttattgtatctcattcattgccttgcttcctcctctccaattcatcgtccgcatttctccgcttttcctcctcttttgcttcgttttcgttcctttcgtttacagtatcccttggcttttcctcgcttttcgctacagtactttgttgttgttggggatactgttgtgaatccaaagcctagcgatctccgcccgntgctt

SEQ ID NO: 2794 - DNA, 3857 bp, Heterodera glycines
actttgttgttgtttttgatactgttgtgaatccaaagcagcgatctccgcccgtgcttcgtctcgaccaactgtagtaccgccgagaattagtggacggatcggctcaaatgtgaccgcaccaccaccaacaccggtgtgaacagcagacccatggcttagtgcattttggtgcactgttacggtaggcagtggtggagacggtagtcgtacattttgttgaccgaccgtcggtctgtctttgaattaatggattttttcgggatactatttattatgtgaataatatacctcgagcatctgttgtcccacttgcaaattcgctttgtgccatcctttgcgaatgttcgtcaaacagtgccaaattcggctgcagctgatgaggttgccccaggggaggaatatcatcataaattggataattagtgggctgctgctctttaacaaaatgcgcgcgattaaacaatgaagcggagggtggtgcagataattggcgacgagtgggcaccgtatgcgaattggcacgccgattacggtactcgtccaacagttcacgaacctcaagggattgggaaaggttaagtttccaattaattactaggctataattcttcaattaattactaggctacgctatcaaacggagcattttattatatataaaagcaaaatcggttagaaaattttttaggaagatataaaattattgtaaataaattaaaaatagtgaaaattaattgcccgatcattggctaatttgtgaccggcccttttgcctttttccccgtctatatttatgccgacctcttgcatacgtttttttaaatttttaactgtgttttcctgatttgtactcaatgtactcaaatccccccccccccccgctttacccttccttcgatgtgccattccatgttgaggagacgcgaccgaatttgcaccatcgaaggcggtggaaaagatttgccaaattcaccagcacttattctgaccatttgctgttgatcactcattactctgctattgctgaacactgattgaggtcgacgagtcgaactcaaattttaaattaaatttaaaaaaaaataagtaattaaatgcccactggtaatattcgctggtcggcccgctgagacggaactgtttcagctgggacaaactttgccgaatctccgccaaatgccgttccattgacggcacatccgagtccaacaaaatgccacttaatgcaattagtaattgattttaattgataattgcccactaattgtccggcattgttgtcctcagcggcctcagcagttcaagacgttggctgagactttcttgacggttttcgtggcggttggtgtcccaaaaaagtgccgaagtttcgagacgagagaacagtgacggcgggaacaaaaaaaataaaaataattaattgcttctttttattaccccttctcccgggttggccaaatttggcttgctctcggaatggaaaatctgtgaagtttgggcatcatttttgctgttgttttggtgccgctttgtgttttttgccagtgagcgctaaaaacatttttcaatttaaaaaattaattaattgattaattcgtgccgatcttcgtcgataaatcgtcggcatttccagcctcgtattagcagcactctcccgttgcaatgaggccaaataattatcctttaagtaaatttacggcacatttattcatttaaaatacaaaaaaaacccgcgattgaatggcgcgccttagccgcgcttccaattgttgcagccgctgtttttccccattttttgcggcatttttcattccaaaaattttagaatttacaaaaatttaaaaattttcctttgtttctgttttcaaaattgcttaagttattggcataataaaagcatgaggcattgcattggtggcatagttatgcaaacgaaacaaaatttctttgcccgcggcgcaatttgtcaccagggaaaccgcccccgggggcatttaacaattttacccatttgtcaaaacaaaacaaatgaaaaaagatgtaacaagaaaattgtataatatttatcatgaaaatttgctaaacaaaaacaaaaacttccaaataaattttcttaaacaaattgcaaaattgggaaaagcgtaaaaattaaaattgggataattattcaaattattatttttgtgtttaatgcaaatggcaaaggaaattggtgtgaatttgttcatttatccattaatccgcttcttcatcccctgccgctgtgttcagaaagcccaactcttttgatcgctttgtactgatcgggaatctgaaaagtgtgtgaatgaatttattaattaatgacccatttgctggcattttgcaaattgacctccatcagtgcgttcaatgcgaaggacgcctgggggtttggcgcattgaacatcacctgaaaatgtgccaatttgaaaggcgaaataattgccgaaaaagtctgacaaactgatcagacccaaccaagcccaaggaccttgtggaagtcgacaaagtggaaattgtcgaacaaccgtttgggcagtgtctcgtcaaaacgagtcatcatgtcccaggggccgtctccgacgccgaccctaacattgaattaatttattatttaaattaaaaataatcttaattgaaattgaaaattaaaaaaataaattaaatttcattttaaaatctactataaacaaataacaatttttaattgaaagattgttttgtaaatatttttaattgaataattataactaatagttcattaattgtcaattaattagttaatatgctgtgctcacatgatgatggacagcgggtaatgtgaagcctgggcaattgcacgttggtttatcttctcgttggtcacctgaacacaaattatttcgttttttttgccacatgcaaataatgccaattcttttgcttggtcacctgtccgtccgccacgatgaccaaaatgtgataggaatgcttttcctcgcaaatttcgatggccctctcaatcaatggcacaaaatttgtcggtcccgacatggcaatggtcggcattcgctcgttgtacacgcggagcacctctgtttgacaatttgtaatattttggcggttcggcacccattgagcccattaagaccttcaaatccgacacatgccgagtccacgtcgtcccggtccaccaagttgaagcagctctgatcagtgcattcctcgtcgccgaatccgtacacggggatgatcccatccgcgtcaaaggaggacaacgttttcccgacaatttcgatcacctgagcaatgggcaatcgatcattaattaactaattatgcccacttgttggtatgggttcagttcgttggtgtccaaatggtgcagcgatttgccttcaaaagtgcgttcgccctggtaatagttggagcgtgtgtagtcaatgccaaaaatcagattcgaatactcgaggccagcctttggaattaaagtaattaattaattgtccctggccaaatgatgctcttcacctccttaatgccggaaatgatgtcctcgagcgttttaaagcgtggcaaattgtgagggctgccgatgttcagcgccattagcagcgaattgcgccggacgggcgaactgtaaaaataattaaatttgaaaattcattccaattaatcaaaatcattagcatctgatcacactaacaatgatggcgcttcattgggcttcagttcgtgccgtcggtccctccgctcctttttcatcggctttttgatgatcgtcgggcggcccaagcgcagttcgtccgcttacatcagcatcattttctcagtcacttcggcagcaaaactca

SEQ ID NO: 2795 - DNA, 1678 bp, Heterodera glycines
  misc_feature (63)..(63): n is a, c, g, or t
aaggaattgtgtctgaaatttgccgttgtcgtcgcattataactcaatttgccctcttcgtcncctcccccaaaatgaacttttgtcctcttcccccctttgaatctttaaatgctccaaattctcttcccttccattttcaaatgcttcttcttttgtgccctttcattgttttgtctgatttcccctctttttctgtcccttttttgctgctcattccccaaattcctccacttcacttcgccaattcgaccgtccgtttcaaaaccaccaaaagagccgaggacaaaggacggacaaacctttgggggatggcactgaaagggcaatgagttagcccaacagaggacggacggacttaaagcccactaatataaattcctccccctaattgttttaccccttttttcctaccgcctttcaagtttttttttcaatttgtttgaacacaaattcaattaaacaaataataaaattagtccttctcattctcaactcacacttttcccacaatatttttttttcacgaagtgcgccaattaacgcctttcaacttaattaagggactaattatttttggcaaagagtaatttccgttgtctctgtttctcgcaccactttttggcattacccaccccatccgacgatcacaaaatgcctttgctttggccctgtcgctgtctctggctttgccccttgcgccccctctcccccgattggttgtgccgatgatcggccccctcctcttcctccgcttctccttgccttttctaggctttgtgccgcttttccgctgttcccatcgacaagtgttcattcccggtgatatcattctcgggggccttttcccaatccatgccggcagtcgcaacacttcggacggaactctctgcggccgcataaaggctgaccaaggagtacagagaatggttggcactcgcagcgaaagggcaaatgaaatgaaaattgctttaaggtggcaatgctcttcgcattagaggcagtcaacagaagtccgcgtttgttgcccggactcaaattgggagcacaaatattggacacttggtaaggcacaagggcaatttgccaagcgaaaaaaacgacaaatttgaactgcaaattggcgcccatctcttaatttgaaaatcgaaaagccaaattcgaacagttccgtcgaaacacatgctctcgaacaaagtttggagttcataaagtccgttcggctcgggtgtgcggacgacgaattcgacggcacccaacgaatgtttcttccggtggaaatgcgcgccaacgggccgaaaaatgtgcaaattcaaaggaacggccgacggcaaaaaatcaccgccgtaattggttcagcatcttcacaagtgattaattcatttaaatgttcgatggaaaagtcgtttcaaccctcacatttttcccttaattgaaagtgcctttgtcaggtgtccgttatggtcgcttcgatgcttcagctgtttaaggcattgcttttgccgcttatttgtcttctcattgctttgtcctctttctagatcccgatgctcagttattcttccacgggagttgagctcagtgagaggccaaggtggattttggcatttgactttggtatttttccctcccctttcattccttcgtcagatttgcctatttctcgcgcgttgtccct

SEQ ID NO: 2796 - DNA, 2307 bp, Heterodera glycines
  misc_feature (2281)..(2281): n is a, c, g, or t
cacaggcagttacggggagaggggcatgcacagtttccggggggcggccacggaattgggcatttgcattgagggcgaagtgcacaaaatcagcagacgatggacagacgaccaattcgagtgagaaaaagcgcaaattcgagagagacggaccaaacaaatggaaacatttggccagagaattgctcattcgaatgcgaaactcgaaggcccgcggggtggtgatgttcgtggacgaagacaacctacgcagattcctctccaatctgaagagattggccgagggcaaacagcccgaactaagcaattacttttggtaggcaaaatgacaaagcaaatgatgggcaattagaggacattagcaattaaaagggtttaatttgttagctaactgacaattgtaattgcaggtttgtggccagcgacagttggggcatgaaggggtccgtggtgaagggatttgagcacattgtgaacggcgcaatcactgtggcacccaaagtgcgctttttgaacggtcgttgtccctcccccccccccgcccggcacttttattttcatttgttctttttcggtaggcttcgacgattacttcgcttcgctgtccccttccaacactttcctcagcgaatattggcagtcaatgaattgttccgaacgctttcaccacaattttggcttatgctttcagtccaaagggttctcctccccttttgcttttgctaattcgtccattttctgctgaaggtaccgatttgtgcaggaggcgtacgtcccttttgtgcacgacgccgtccaattggtggcccgggcgttgcacaattccatccaagtgggcattttacccttttaagggcattaatcactcgttgcaggaggagtgcggcttggaggggcagtgggaagagtgtccgctgtcctcagtgggcttcgatgggcagcgtttgcagcggtcctaccgaaacatgtcactgttcggttcggatcactcagtggcattagcggccaatttaatcatttagggggccaacccccgctgatcgggccggatggagatggcaccggacagtacaacattttccaattggacagtcgcggggcgtaccgaagggtgggcggatggatggacagtggggagcagcagttgaacgtggcggaaatccgcctcgggcttcaagttggtggacttgctgaatgtgtctgaactgcttttagcgtgtcgacggctttttgtccgatttcgtccctttgtccgtgtgcagttcgccatgcccccggggccaataccgcgcctaccaagaccaaaactgctgttggacgtgcattccttgcgacacggccacttccatcgttccaaaccagaccaggtgttgttacctccttcttctgctttctcacaaatgtttgtttgttcagctgtgtccaatgtcccctcggggaagtgccaaattccgatttgaccgtttgccgcccgattatgccaagtcatcttcattgggatagtccgtaagtcttccgccaatgtttgtccgctccgctaattgccattgctcagttgggcccttgtgccagccttattctcttcggtcggtctcttggccacttctttcgtcactttggttttcctccgcttcaattatacccccgtggttcgcaccatcgaattctcttccatttgccattttttccaggtgatggcttccggaagagagctttgctattgtatgttggctgggattgcgctttgctattccatgactttcgtgttggtcagtcgtccttccgaattggtctgtcttttgcctaattggcatttgccgaattcggactgagtttcccactcacaattccaatttgttgttcttagatttgtacttttactcgtcttttgcccggtctctcaatggccaccgtttacgctgccattctcgtcaaaaccaatcggttggcccgcgtcttcaagccgaacaatgcgttgaggcccaaatggatcggtccgactccccaggcaatgattaattaatacctaattagtacaatcattggtgcctttaatgaaactccgtttgcaggtgttcttctgcacaggtctcgcctccgttcagctcgccatcgcctccgtttggctttggcttgagccccccggcactgccattcagtacccttctcgggtcgaagctgtgctcacctgcaaagtgtcccctgactgtgctgctttttcactttccgactttgtttaggctaccatctcccaattgttggtctctctcttttactgtgngcttctgataattgcctgcactatta

SEQ ID NO: 2797 - DNA, 1373 bp, Heterodera glycines
tttgtctgttccaaccatacaaaaatgtgcgaacgcggagttcagcagtgggaaaattggtcaatcagcaaatgcgatttataaggtacagagggagcagagaatggcattggcaaaacggaccatggcacggcattaaggggggggggggggtaatcggggtaattacgattgactccgtacctttgcctttttaataagtttttattctccccatttatccgtctttacctttgaatttgttacttttgtccacccaatccctttgttttcccctttcaaatatcttttttaatatgtattatttccctttttctccttttaattttccagtcaaatcacaagtcccgtgaacgacgggcgaacggccacttctttggttgtcaacagcgaatacgcaggtgaattcagagttgtgatctataaattttgaaaatttcgaatggtcattaaagctaaaaacgggtccaaatataaataaatactcaaaataaatactcaaatgtccgtttgttttgctggtaaaatcagaaaataaaaattgtgttatcattgtcaactcatttaatcatctctcccccttttgttgtggtcttaatgaactaattattctgtgaatatttcccaatttttttgttttttttttgcgttttcaaaaaaccttttgggaatttcagaaagataaaaactgaaattgcaaaacgaattgcgacctctaaaaacatttggtggttcagtcgcaccgagttgctcgccttcggcggcgtgtgccgttcacccggcacttcggagacgttcttcggcaggtgcgttgttcagtttgacaacgcccggcggcactttaaaatgttcgacgttacgcccattcggaaggggcgaaaaacgaaatttgcgacggatggaaacagttacgaccggcgcatgggccgacgacggcacaacagtctcttgggacagtcgaaacggcacacattggcaacagtcaacagacaaagaagttgcggcaattgctagaccaaacaatgggacaacgcgggggtaaataaagggaagggaagggaaggaaaaatgaatctaacaaatgggagatgaagcagagaagaagcatttccggggagggggaggagagaagcatttagggaggaaggggaaaataagcatttcggggggggggggggggggtaaagcgaggtatttagcagaggagaggaagggaatgaaaagaatatataggaaatatctctaaatggctgaacgccaaatagttactgactaaattaagtaatatgacatatgagcctataaagacaattttatgacatcattcatattttttgctaaggtgaatattttttttctatttgtttttttta

SEQ ID NO: 2798 - DNA, 3604 bp, Heterodera glycines
ggaatggaccggggaagaaaagcttattcaacaattttcttccagtgatgttgatgaaaaggtcaatgatcagaagcagaagaatgccattccaaattcaaaagacaaaagtaaaacacaacaaatatttgaacagaaggcggtgatcaatttgatatttggacaaaatgacagaagcgaaacggacaaaaagaggagaaagagtttggcaaatggggaaggaagagaaagagagaaagggacagagagaacggcggagggtcagcggatgagtgccgacggaggaggaaaggccaacggaacggtgccgcacgcgcactccccccggaggacggacatggacagcccaatgcgactgattctccggaagatcagcggcgaattcgccactttcctttgatctcttctcaaagtccaacacaaacattcggattgtccctccttttgccttgaatttggccatttattttgatcattgagtcccatcggcccattgcgcccgcggattacgaaaatgttgccataatgaggcaatttcgcatattaattgggtgtgtgtcatcgtcatcagactttcccctcccctcaatgcgaccatttccaaaatcattcaaatccgtccccctgggcaaacaaaacaaagcctttcctttcccttttccgaatttattacgcaacattttcagcagtcatttcgtttctatcattttttgatttgtacctttaaatttaattttaataaataaaaaaataattatagagatttgtttggaaattcacttcaaaggaattgtcagtgaatttggagttgctaatgagcagaacataaagtaactttggatgaatttgaacgatggacaaagaaatgaaatgaaaagaaaagaaaagagggcgaaagtgtgggcttttgaaaaacattgggggaaacgaaacatttaagaaaaacgaaaaccaaaaaaaaaatagtattagcatgctgagaaaccatgaaaatataagttttaaaaaattccaaacaaaagagcaattttatgatcaaaggggggggggtcattttcaagagcccacactttcggccttaatagcagttttctaacttgtcgggtgcaaaaaatgagcattcattgaacgactgtcctcccctcgcccccgttgtccccccatttgccccccttgtggccaaattgtccttttcctaattgtccttttcctaattgtccttttccggtcggtaattcatccccagatcagttgcaacattcgcattctcatccattcattcattcattcaacattcattgagttgatttgtccttctcccatcgcctttcaattcaattggtcaatgaagcattacaaccaataaattggccaaaatgcggtgccattggctgcccattcaattcattgttaatgctatcgcattttgcttagtaagtcggtcccattaacataatcaaagggcggaggacaaggatctattcaaacgcatcggattaagggccacaaacgaacgaatgggccgatcattttgggatggaacaacttttttgatcagtgcaatgtcatacggacaattgcgccagaagagcaagtggacaagtgcagaagaaaatgcgaatattccgaggacagagaaatgtcagtgaatgaacgaacatgaatgggatttccttttaaaatgattattattttttgcttaatgaccccccccccttccctaattagtttcaattcatccccccccccctcctcttctaatagtttccaattcttcaccttcaatttacccctgttttgaccaattagtgcccaaaatgcttcggttattgtgttccatgagactgctgcaggaggcgatctgcccgatcgtcgatggcctgatcaactttatgtgatgttcgacttggaatcgccgttccgtgggccgcagtttcccgcccccaattttttcaacttgacaatgacttattttgccaacgaccaaaacaatttgatggctccgtacggatcactgcacaaaattaaccgatccaatggagaggatttggaggacatttggacatgggaagaagtgaaaatgaagggatgaaaggaaaagcaagaaaggaacatttataaaggtggtggaaaaagtcggaagaaaggacaaaacggcacttcaaatcgcatcgaattgcgcgtcgcattcggcacgcgaagcgtacaccgaagaattgagcagacacatcgaagtgacggggtacggacgctgtttcggcggacgaaattgcgacagaaaatgttacgacacggaaatcggtggccaacgaatcacaatgataaaataaaaaggaatttgctttgcagatcggcacttcttttatttggcatttgagaattcggtttgtcgcaattatatcaccgaaaagttttggaacgctttccgccatttgacggtgcccgtcgtactcagccggggggtgatggaagggctgggcattccgccgggggcatttgttgcggcggacgattttggcactgtggaagagatggccaaattcctagtggaaatgcgaaatgaccggaacaaatacttgcggttggttattcagagattttttattctttggccacgccggaaggtccaaaagcatcgcaaaacaatccaaaaaatgcctttgtttgtttttctgggattttcgagtcttctgagtcggaacgcttgcgtcctatccgtgccgtgccgttccctgcccatttttccccaaaactttggcgtggcctttcccatcttttaatttgttggcactggctttgtccgcttccaattgctgttttgtctgtttttagcttctttaattggactcggttctatcgtcgaaacagtgacattgtcccagcggaaagggccatttgccgactttgcgatttggcacaccggcgaatggccccgggcagcaaagtgattgccgatatcgaccgatattggcgactgggcggaaattgtgtgctcgacttcggcgcccaattggtgctgaaacggccgaaattaatcgcaaggtcaaaaaatgacttacgcgcgatgtttccgatcactttgctcagtttctcgcctttgtttctcctttttgtcctgctcatcgccctgtctcttcgtcgtttctgtcatttgcctttctcttgcgccattaaaatccctcacaaaatgttcaaacgccgatcgcccatcattttttattaggattccgacggcgccaaaagtgtcgtcggggaaatttccaaaatttacgctgttcttttatgcacttggagcaatttttttgcataaatgtgaatatggggtttttgattttttgtttgagttcgggtcaggggtttgggtcatgtaaaagctgatgtcagattcgtcatcaacgaccccgaaaagtcatagaatatgttttatgacttttaaaattaagaaaatttctgaaatacttttaaaaaatcggattcgttcagtgttgcttttcagttctctgacttctgtgatgaactcatcaaatgactccacaggaggaagacccttcccatctcttctaatgcgtccgtccgtcggcggagttgccaatggcaacggaag

SEQ ID NO: 2799 - DNA, 3299 bp, Heterodera glycines
gaaaatgcaaaaaatatgaaaaatcgtaaatgagtctttctatggattttttgaggcgtagattccgaatataacatttattttgttctaattcaatcctaagcatcgaattcgatagacctggaaaatttgatgaaaaatcatagaaaaaatcatagataatggaaatctgagatcggattcatgatcagcgaactcatttaccccaagaaacataattttacatgaaatcgaattttttggatgaaaaatttgttgtggctttttgggacacttctcagacgacaaatttgaggggcggtgttgagcgccccccaaatatttggcgtttgtcgtaaaaaccaatcagaattttcgagacaaacgacaaacgcctaatttcagacgacaaacaacaaatttcaggagacatacgacaaaatttttaattctgattgatgataaacgacaaacggcgtatactgacgacaaatatatcgtttgtctctgtcgtttgtcgttcgtaattgtgattggccccagttcccttccaaataattattttttcgccttttttaatattattgaaaaggaaataattttaggtgctttatctatgtcaaatccttttaaaaatttttgtaaaaaaaggccaaagaaatagaaataacttgactatccacaatttttttttaattaacggttgtattggtgaatataaatgaatcataattcgaaaaaaataaaaattacttttaaaaatctttaaaaaagatttttttttctttttttaaaaattcattttgattttaacaaaatcaaaccccatgcctgatcattattatcaataaatcacagactttcttcgaccgctggtcctcaaacggtgtcaagtcgggcgccccgaagaaccgtgccggaggcagtgtccatttcccggcaactttctgctataatcctcagtttgcgtttgaaatcagcgaagaagacggaccagcggaagtgatgttggcattgtgccaaagagaagagggatgtgcatttgatggcagaccaaaaaatgccaaaaaattaatgaaaaatggtgaaaaaatgggcaatcggagaagagaaccttttgtggttatcggactgcacgtgatgaaagtggagctaaacagaaagcatcgcattcaccaggtgaaaagaaatgccattttaaagggaaggcaatggaaaacactgaccacttttaattgcataaattgctttttaattactaattgcattaattcccccctcccgtaggccattgagcccgtgtcgaccagtgactatcagtccgtccgttccgttcatttgcatatcgacggactttcgcccggccgttacatcgttctgccgaccacttacgcaccgcgagaagaggccgactttatgctgcgcatttactccccgagtcagctgagtcctgtggaacttcgcgacgatttgcctaccctttcggcactttcccttttgcggtgccgtccccaatttgttatcgctcgagtgcgaattatcgaggttcatctgctgaaactgatcactttcggaggtgtgcctttcttccatttaaatccatttgagagtccatagctcattcggttgggttttcccaatttcatttacaaaaaaattatgagacaccgtatcactgatacttacttaatccaactttgataattaggtgtaaaatctattagcaaataatttaattttttttccggtggcaccgatggactcaaatgaatgccttttgaatatttaaaattagcagccaacaccgaaaatagaataattttcgccttattttttctccctctttcacaatgttcagaatgcgatgtgttctgcgtgttctcctcttcccaagggagtgatcggtgccgcacatttcccgcaaaatttgtgccgggccgacccgtgaagttcaacgcgctctttgttttccatgcttttgcctcgcagcaatggcttctcaattttgaattgattgaactgagaaagcctttccaacgacaaaatcgccttttgggcgttggaaggttggctctaattagcaacaacgaatcaattgagatggaaatggaactgatcagaccaattgaaaagcgaaaggcaccgatcggaggagagggaaaagggcgagggaaagtcggagaagaaacaatcggaaaagcacggattgagatcagtgcttatgatgatccattttatatctgatcacccacaatatcaataacacagacgaataaatgttttttcaatttttgaattccaaaaatttaaacaaaacaaaaataaatgttataaaatcgtaattagagataattattaaaataaaatttattaataaaaaagaaattgcgtgaagtaatttaacggagtttgggaaaaagggaaaagcgaatcattcgtcggcagagaaagcgtttttactaagttacgctaagccaaaggaaaacagcggtaaaaaacgggaaaagggagaaaatgggagggaaaaggtcacacaaatcaccgccagagacgcgcggccctttttatgagggcgcgtgggacgacaaaacccgtttattagcgggacaaatcaaatcggtttcatggaagaagcatccgattgtgtcgcaattgaacggcagagattggccaagggggggggggggcactataaaagggagggccaaacggagcaaagcacacatcgatcagtgaacattcactcatcaaaggaacagcagcaagagcgcaggtgacagactcagcggaagcaccgcttaaccatccgttcagccgcttcacctccccccccccccattcggttcagacttcaacaatgacgaggtgtagtgtgttcgtgcttacccttttgggcgtcggaatggcccactctctgctgatgagcggcggttcggagtgagttggcgcggcacgcgttgcgcaattgcaggcgtaaacttacgcgtttcgctttagccttgctcccagcgccaaccgcgtgagccgtcaatgcggatgtggaggaggatgtggtggaggcggcggcggatgcggaggcggtggatgcggaggaggaggaggcggaggcagtattacgcttggagtcagctgcggtgggccaagcggaggaggtggcggcggtggatgcggaggaggtggcggaggaggttgcggtggaggatgcgggggtggcggtggatgtggcggaggatgcggagggggttgcggcggtggtggaggatgtggaggcggctgcggaggaggatgcggaggcggttgcggtggtggtggcggaggcg

SEQ ID NO: 2800 - DNA, 1002 bp, Heterodera glycines
gcggctgcggacgccgaaagcgtttggccttcttcagcgttctatggccaagcttgcctaaaatggggtaatgaatgcttcaaacattttatagaatatacaatcatagattcgttctgctcgcttttctgttctttaactcgtagttttagttttttgcctttgttattaattagattttatattccagtaattatggtaatataaccgtatttctttcctaccgtataacctaactcattttatttatctaatcgaatgccatattcttaatgtactataactttgatgtatactcattttcatttgacataataaaataaaacggcatatactgtaaatcagagatgggaacggaattccggaatttttgatgaaatttcagaaaatcataaaataaaatatttcaaattgtgcttcaaagattgactaattattagagaccgactaaaaaggcaccaaaaatcgcgaaaaaggcactataaaaatgcacgaaaatgcagaaaaaaaggcatttgcctcaaaagtcggtctctactaattatggatgaaaaacatgctgggattttcctaaaaaccgccaagggataggaaaacaaaaatgtaacaaatataaattcatatataaattggcttaaattcaatcaaattaatatcattcaattgctttctcttgtaaatttgatattcgaggtcgtcacggtcagacaaaaattaacgtgaccatttaaaaaatggcttaattaaacgagttgaagtttgtccgttgagacacgaaaacagacgaaatgacatttccgcaactctttcaccaactatttattctacataaacttaattttattatatattccaaataaatttcttgaaaagcagtaagacaaaatagttcaagcccaaaatttttcacagtataagagtttcttatcaaaacgctgtcgattatgcggacacaaataaaattgttgtgcaaaatattgagataacattttagaagtttag

SEQ ID NO: 2801 - DNA, 5655 bp, Heterodera glycines
taatgaatgcgtcaaacattttatagaatatactcttatagattcgttctgctcgcttttctgttctttaactcgtagttttagttttttgcctttgtttagttaattagattttatattccagtaattatggtaatataaccgtatttctttcctaccgtataacctaactcattttatttatctaatcgaatgctatattcttaatgtactataacttgatgtatactcattttcatttgacataataaaataaaacggcatatactgtaaatcagagatgggaacggaattccggaatttttgatgaaatttcagaaaatcataatataatatttcaaattgtgcttcaaagattgactaattattagagaccgactaaaaggcaccaaaaatcgcgaaaaaggcactataaaaatgcacgaaaatgcagaaaaaaaggcatttgcctcaaaagtcggtctctactaattatggatgaaaaacatgctgggattttcctaaaaaccgccaagggataggaaaacaaaaatgtaacaaatataaattcatatataaattggcttaaattcaatcaaattaatattccattgtatcattcaattgctctcttgtaaatttgatattcgaggtcgtcacggtcagacaaaaattaaagtgaccatttaaaaaatggcttaattaaacgagttgacgtttgtccgttgagacacgaaaacagacgaaatgacatttccgcaactctttcgccaactatttattctacataaacttaattttattatatattccaaataaacttcttataaagcagtaagacaaaatagttcaagcccaaaatttttcacagtataagagtttcttatcaaaacgctgtcgattatgcggacacaaataaagtttttgtgcaaaatattgagataacattttagaagtttagcgtcgaagtttaaacaatcaaagatcggtggagagccaattcttagaaataatccctcgcggcttccatcggctgagtgttgtagcggtcctaaacggctttgattaattgcccaattaattactcgtccgtccaatgatcacttttctgtaaatgatatgttcctcaatcacactgctgcactgtcccgattcgatctccgttttatgtgcgaattggacgtgcgaataacaggcggaacggctgtacgacgcgaaagatttgtgacagatggcgcactcgtggagagggagttggagatgactggggacaattaagcatggtaattacgtaattaagcaacaacaaatgatgtgcccaccgaacattgatgtgattgagtctgttcgtgattttgttccacaccatttccccgcacaatttgcacggcactttctcatctgtgccaacatagctgatgtgcttgaatttcgattacattgtaattttgtcgggattcatcctcggtttacccgctgttgttggttctgttggtggtgtccgccgttcgatggtcggactgtgcgcggttggcccaccatcgcatcacttcccgagtattggtgctgatgggacgaggaagacgggtcccccgcgcgacttggaactgaactcgaggaaaacaagcaaatgaaagcaatcgtctccccctttttgttgagtcgggattggtctctcgactcacaatgagtagtaattgacctttctcaccgaaatttttgtgcgtttttgccgtctccgttcgttccgctgctggaattctttgctgcgtttgatggtgcgtcatttccgcgagttcgtccgcccctttggaggcggcgtccatcatggccaacatcggatgcactgggccattgtccccgtcgcatccttcgtcttcctcctcttcatcttcctcctcttcctccatttgttcatcctcctgctgctggcggggaggggatgagaaacgttaggagagcgaaactcaagaaaagaggagggacggctgtgggttgtaagttgagttcgacgaacccaagaggaggggaacacgaattttgttttgttcgttcgttcacttctcccacctcattctccggttccaataagtccatctgctggaattcgctctcctcattcatttccatatgatccttctcataaactaaaagttgtgtaaattttcgtatgctaaaaagaggacataaaaaacaattaacgccattgccctccaaatttccctttttaatcccccggtgtttggtatttgatcattatcgaatgcgaatgatcagcagatgctttgtccaccgaccatctgtgctcttccgctgctcctccgtctcttcctccgccgcctcttccgtttttattgtgccaatgcctttctccgcctcctcctcatttctgtccgtgtttctctgttctgcgtttcgttccgtctttcgttgctgactttgtttcgcggtttgaactgacgacgaattggcgcttttcacttccgtacgattcttccgattctctgagcatataaaaatgtcttatcaatggcattgtttttcgctgttttccgaccattcgttggccattgttcgtgatggtttcgtagaacggcgcggacagtcgcgcacggatcggtgacgggcgcgcgtttgaggcgaccaaaattcgctgtgccgccgccgacattcgcagcggacggacaaaagtccatcgtctgttgctgggcaactgaaatggtcaatgaaatggagacgaacagcgcgaaataggccaattacgtgcagcctgaggcggtgggtttcgcatcgcatggattctctcctccttccgcccaaaacattcgtcgcgggccgcgtgaagcgcggcggaatacttttgaagagatgcaattaacaaatgagaaatgcctaatgggctgttgtgctgctcactttgtggtaattgctgaccaaatgtttggtgtcgcccgcgtggtgcagtcgcatgtgcttgtgaattcgcgtgttggacacttcgaagaagtctctgaaggattgacagggtcattagtttattaatccgttgtgttttcacttgttgcaaagtgtgcattggaacatcggcaggcgcaaatgtctgatcggagggaaacaatcgaattaatcaattaatgggaggggagtgctctttgatcatatgatcaatgaaacacctcgtgttcgtgtggtggttgaggcagccgccctgtgcattgatcatttccttgcactttcggcattggatccgatcgatcactttttcacgcttcaactccccttggaactgacaaatgaacaaaaactgttttttaaaaacactgaaagcatttcttttcttaattttaccaaggaaaaactctgcgcctggccagccgagtccctgccgatttggtactgttgcgcagaaattccttggtgaagcaaagcgtagggcgaaaagcgatttggacgaagtgagtagccctgagtagcaatgggacgagtattagacttacaattagtgtgattaattacgccatttgtggccaagtcggcgcgtctgccaaacgcggcatgctgcggctgctgctgctgggcgtgtgtcgccgcgcccacttgggaaaccgccgcggccgccgccttcagaatttcctgcacatcagccttaagcgactatcactaataaataaggtgatcattcgtcaattagcccgatcagcagttgtctaatgcccctttatttgcctgttgtccatccatctcctcaattaatccgtcgtcggcccggccgtcccccgccgcatttgccgtgttcattagtgccgcaacggtcagttccgcgccctctctgatttccaatgttccgccgtatgcgttgggacggagccgtccgctgcccacagctaattcagaacacaaaatgcattatcattacaattattctcaccgccgccgacgcctgcctccgctccctcgcgtcgtattttctgcagacatgccgcttggatttgctcagtcagcgaagctggcgattcgtctacgatggcaccgttccgttcgaaaccgacgcctgaggggtcaaatggcaaaacaaagtcaatgggtattcaataaaaaaagcaaaggtggtcattagggcgggataattaaaaatggttccgctgattagtcgcaattgcctcatttcgcccattcggcctccatttcccccaattgcttctcaccctcgtcttttcgctgcgattggtcattcgtttgttttgtgccgtcctccgcatttctttcttccgccgacaattcgtccaaatcgttaatttctctgaattttaaaaaccaaattattggaaatccttccgccggtttgccactttttgatggttgcaaatttattcgccgaacttttgacagtcgaaaaaccgtcattttgacccgaagcattggtggcgttcgactgctgctgcaattgttggtttctctgcataaataataatcaaagccttttttattgaatttcattttaataagtgaattaaatgcagtaattagtttaatttattaatttattttttgtgcgcaccgctccgccgcggctgagcaatgcgacgttttgctgctgcggtcggagcgacgaaaggcgaatggccggcgactgtccgccgtccgttttcaaagcggacaaaaactcgcgcactttgcgccgcttcgcctttacttcgggagtgatccgacaacgaaactgaacgaagatgaaattgatcagtaaagaaagaagagacaagcgaatgatcagaacggactgagtaactgcgattgccgtggtcagtttcgttgtgttttacgaccgcaaattcggtggggaatttcgcgaattggcactgttcgcattcgtaggggagaacgccgaagtgatcagccgccaaatgcgcttcgaactgatcaaacgagggaaattgctaaaaaggagcagagaaattactccttcactggtctttctatttttttcattaaaaccggattaggcaaaatataatgagaagggcgcgaatttttagtgaaaaagtaatgaaaaaagtgagcaattttttttaatttataaaaatttcaacaaaatttcaaaagaaaattgtcccaacttgggctgggaatttaagtcaaatgacttttttttttttttttgctgactccaaatggccttaaaatgacttaaaaagtgttctaaactctgtttgaagcttctaacatgcattttttgtgacttttttttttacttttacactttttgggctttttataacttttttgagtttttgcgactttttttcgtgattttttttgtctttttgaggcaaattgaattttagcgaagaaaatgccgaaaaatacaaagaaaattccgaaaaataaaaaggcaatgaaacctggatgaattttttcttaattgttggaagaatctcttttttatccctattttaggtgcatatttataaaattaagtgcctgaaaatatgatcaaaatgttattctataaattattaaaaatgggattttttttaacttttgcttaattattcaggacttttttgcattttatacgtgcttttggttttttttttactttttggctattttttcgtgactttttggcgatttttatgactttttgaagatttttagtgacttaaattcccagcccta

SEQ ID NO: 2802 - DNA, 6410 bp, Heterodera glycines
  misc_feature (12)..(12): n is a, c, g, or t
  misc_feature (31)..(31): n is a, c, g, or t
  misc_feature (66)..(66): n is a, c, g, or t
  misc_feature (6314)..(6314): n is a, c, g, or t
  misc_feature (6322)..(6322): n is a, c, g, or t
  misc_feature (6389)..(6389): n is a, c, g, or t
tattttcatttnttttaccccattatttttntcatttagtcacttctccacacgaacttttcattntgatccttgccattgaaaaaaaatttaatgccaaggttttcatttacctactcagccccactgatccattagaggtgaaattacttaaaactccattaagggtggacggggccggggaaaaaagaccataaaactacgagaggaaatcgacccgaattctgtactcatatttcacatttcgctctcttgataataaatgttcattttataggcttttctttattataaaatttaatttttgcaattcgtttaataaatttcctctgtttctttattaaatacatattcttttcccaattagtaaatttgcttcggctaatttctcaattactgcaattttttcaattttaaattttactctgctgagcttttgactaatatttcccaattttcttagcctttcttttatcataaaatttacgaataatgccacttaaaaattgttgatttaaagaaaactttatttcctattcatcgcaatgatcattcatcagtagtagagaccggacgggatcgggatcccgcgggatttcttcgggatcccgcggggttaaattcgggatcccgacctcgggatccgtcccgagcgattttttaaattcaccgggattggtcgggatcgggattcagtcgggatcccgactcgggatccctccgaccccagttgtccggtctctaatcagtagcgaattaaaaaaaattattttttttaaattttcaatttttacccttatttttgggtttcattttttatttttccatactttacagattgtcgatacaatcggtgcaaatttatttaagaaataaatttttaacttaaattaaatacccaccaatccaaattttaatggttgaattaattttaatgcattttctactggtttatgatggccaagaaaacggtcagaaaatggagagagtgagggaggtgaattcggtagtagaaaaaatccaaacccaagaaattttttggaaaattaaaaattaattattaaaaatcagggctttcaattgagaatttaaaaatctcatttcatggtctcttttagcatttttaagctgaattttatagcagtttttaaccaaacgaaacttttccattttttagctcaaattttcaaaaaatctaaaggatttgaaattttgtttcaccattagtaaatttagttcgacaaattcacaattcaattataatttttttcatttttaaattttgacaaatatttccccattttacccgccccgcccgacccatgccctacgggcaaaagtgaatggggcagcgaaccgccgcaaaaatgacgcaaaatatattatagaatttaaaaaaccggggggctttttatgaaatgatattaaatcattgcgtcgcccaaagcactggaatagcaaaaaccagtagaaaatgcattaaaattacaaaattcaaccattaaaatttggattggtgggtattcaatttaaactaattttctaaaaataaatttgcccgattgttccgccaggttgaaaaaagtagggaaaaagaacaaaaaaacccccaaaaacaattgtaaattgaaaaaaaaattgtaattcataattgaatgttcaatgcgatgagaaaggaaataaatttttcctttaaatcaccaatttttaattggcattattcatgaatttttgcattaaaaatgtgaatattagtcaaaagtgagggaattggcaaattaatgacttggatattgatcaggaattggccaactcacaaatcagcaaaaaagcaatggccaaagagtcgctcacgaaaataattggacataattagaagaaacctatcaaaattcaaatttttggattattaagcatcagtttttgaagtttttctctttttttcgttttttcgttttttactgcttttttgttaaaaaatttctcgaaaattttaaaaaggatgaaaataatgatgaaatataaaaataattaagcaattatttattataaaaagtcaaaaatatgcatcctaatgaagaatagtggtggcgttaaaatgatcaattgtcgagctaaaaacatgtttttcatgcttttctcatcaaaagaaaagccgcagaaaatagcagccaaattataatttatttaattaattgaacgttttaatttttgtaaaatttagttttgctcgaacaaaatgtaataaaaaaaagattgaaatttaactaccaatttggtcgctctacataaaacaagccgatatttttcattgaaaggcacagaaaaaatattacaaattgcatttgatttaatgagaaaacatttaaaataatgaggcgaaaccaaatttgaaaatgtcatatgctgccgataaaaaattatatttaatgaaattaattaatttttcaaattgagttgaaaagcatttgaacagagtgagtttttgaaccattcatccatcgctaaagtacaagaacaattattattatttctggggcaattaaattaaacattttcggatatttttcaataaactgagtaatatgtaattttcgcgatcggcaaaacacgcgaagccaaaattagcataaccccgtgccgaggcgttgcttaattccgcctccaaaaatgtttttgaattattaaaacaaaaatattattattttattttacttattaattattaattttttataaaatttttaactcctgcacaaaattattccaaatgtattctttttgctgaaaaaggtttttacaatttgattgaacggttgggcgagtgaaaatgaaaaacatatgggcgttcaaattagccaattagatcgctttacaatttcgtttaaaaatacaaaataaaatttccaatgccgctggcgattaacaataaattttaaaaaatatgggagttaataaccaatttgggtcgctttacaatttttgtttaaaaataaaaatgatttttagtaaaactagtcgcaaattactaaatgattgtggttgaatgaactgtataaattgcatataaaaagaggcaattgggtcattaaaaacatcaacaattaaatttttattaaataattaataagcatttcgaattttatcaaattaaaattttaccacccctaattttctctattagcataaaaatttcctttaaaatttttgggtaagacataaaaagtcgcttttccgtcacttatagagataaatttttgaagacaaaacaatattttgctatttttgggctaaaataaaaaataatttttttaaatttaattcaaaatagcgatcagttgtcgtttttttccatttaacttgggcatttttatagataaattagaaaatgcaattttttggtgggctcgtttttttcttcgtgatttttcatgccaatgggaacccaattgtgcttaccacaaccttggccaaggccctaaaggccacgctcacggtgggagcggtcgcagcttataccggatggagggctttaacaaaaacgaacggaattttggacggatttggtgaacagatgaaggaaaaggtgagcagattttcaagccaaaaatgtttagcatttaaccaattcttcagcctcatctgtttgcgccattttttcccctaatttttgcgatcgccggaggggaagtcttagtggagcaagacaaattcgaaatggactacatttttgatttatttgaaaggatgacagaacgcgatcagctcgacaaaatctgctttgatggggccgagggagaaaaaaatgtgatcgaaaaagctgaagggaatctaccgcttttcattttctacgctgcgatgaatgacaaaaaattagatgtttatttatgtgattgaataagcagttttttattttgttcatttattaataaattgaataaaaaataatttaataaattttgaaaataaaattattattttttaaacccaacaaataaatttgaattgatttaaaataatttaaaaaattaatttaattagtaataaatttttgaatggatgaagcatattccgaaatttgaaaatttacttaaaattttgtagcttcattcattaaaatggcataatggtaagaaattcgtcttttctcatcaaaataaggttccgggaaaaatagttttattggcttaatttctcggtaaaaatcatttctcgcacaatccctaccatgggcaggggtctggcggggcgggggtttgtcattttaaataaatttctgctgaatgcaattgtcccacttctgctgttgaagttgcactcaatttgtaatttatgagaaaaacagaaattaaatccggaaatggcgagaaagctaatggcaaaatgtaaaatagaaaataaaacttatattaaactaaatttttataaaaggtgataagatttatgcatttttattgaattgatcagaccaaacatctgctgatcattatggtcatttatcattgtatgtgatcatcatcatcattaataagcgattagagcagcttcatttgttgcaataaaagcaaatacttgtgacaaatttcattattccatgaattgctttttttagcctattgtttttgtttgtttagcccacaatcggaggcgccgccagcagtgcccgctcctgcggttggcaccggcggtgacacttttttccgcttgcgtaccatttttgtgctcggccgtccggcggcggacgacgcagcgcaaatgaacgcgttggaaagcgaggcggccgcgcatggtgacttattggtcggcgactttatggacacctatttcaacaacacgttgaaggtggttttagactggcgcgaaagaccggcgaatgcgacgccaatttaggcgctaaattcaaattgtctctctttctcatcccacctctctattcggcccactatctctttttactaatccaatctcaaaagcacttttaaatattttttctaaatttataaaaaattcctccccaaaaagtttgtccattctgtgcgctttgctcgtcactattgtgcgctgcccaattcggtgccttttgtgcttttgttggacgacgactttctgttgttcccgtggaatttaatcaccgaattgcaaaagtgccacaaaaataaataaacaattattttggcatttttatttttttaaattgtttttggcatgtcccaaatgaacgcctttacatgggctggcgctttgacacttcgccattccgttcacgactgttcaaatggagggtcggagtcaataatcaactaacttattaaataaatttgaatacagtataccaaaaaattgaaccctaaaaaacgtttgaaatttcaatttaattacaaagataaaataaagcaggctcgtcaccagtagaagccggaatcttgaaaaatacagaaaaaggatttgaaaaagctggattgaaaagcagcggaaaaaagtcctaaatttctgagaaaaactgaaatttaaataaattcgggctctaattaattaattaattaatcttcaattaaggtgtcgctggacgagtttccattcgccgcctttcccccgtacatcgccgctggcgcagtgctcttaacgggccaaacaattgccgaattttacgcagccattccgcacgtgcgactgtttcgcctcgacgacatttttgcgggtgggaaatttttcgtcaatagtttttgaaaacaatttttttaaattttacccattttattccgtttttatttttttgatttattatttcgacatcccatacaattgttctattgctgatttccctttccttttaggcattctctcccatttgttggccattacgcctcaacacaatgccaattttgccttctatcgccaatcatttgccgacgattcattggcattggcatcttcagaaacactcaccacattgatcgctgtgcatgactatttgcccgaagaaatgcgcgagacgtacggaaaggcagtgaaacagcaaaatcagcagaaattgaagctgctctgaccatttatttaggtgttagggcaactcgtacaatttttaatggatttggccataacttttttaggtaaacaaaattattcaaacttgatatcattcgaatgctctccaagtttagaagcgatcattaagtagaagctgagagatttcctttgtacgagtttccattgacccatttattatgattattacatacaataataaatgattagcacgaatttgccaattcgcctccaagtcgttgggagtgccgcttaagtcaaagcaattntgacctanaccatttgtcatatggcttcataacacttaaaatcgcatcagtaagaaatttagagaaataaataanatgctggaacattgattgatg

SEQ ID NO: 2803 - DNA, 2462 bp, Heterodera glycines
tttttagcaatttatggtgaatatttggcattaattgcatccaattgtcctctttaataaaattgtgtggagtcatatctaaaatttggccaaaaatctccttttttaaattgcttaaaaatagaaaattccattattaaaagctgggttttcaaattttagagaatgctcaaatttgcataaaatgcttaaaaaatgaaaggttgcgttgtccatttgtccgtttttttctcttttttgggacagacactcgggatcaaattcaaaattaaggcctttctcattcttcgttaattccattgggactaaattaatggcatttccttccgttcgaattttccgctgctttttgtcataacacttaaaatcacatcagtaaaaaattatcagtaaaaaattaaaaggctggaacattgcaaaaaataaaaattttttggatcttttttaacattctttgagctaaatttgagttgttttctgagtgacacacaaataatttgtgaagaaaaaataaagggataagttgaaaagaacaattcatttgtgtgcgtgtagaaagcgcagtcggttaagtggctgtcccagtgctaagataaaaggggttcgaacccatcagactgcaggccaattttttttccactttttgccaattttttcggttattgtaagaagaaagtaattttttttttaaatattcacaaagataaaaatatttattgagtttttgaaaaaagttttagatagctcttcttaaaaatgttaaaaacgtataaaaagggcttttgatcaggttgggacgagactgcgacccgcgcgattcgcgcatttttaatggataatttcactctccaaaagtgccaatcttataatagaggttaaattcgaatccacaaaattaatttgctaactccctcaggcaaaataaaaaaagaaacgtttttcaacggctgacaacagtggaagttgctctattctttgttctgccttcctttagaacaccgttttccctaaattgtgatttcaattaattcccaatgttaatttaaaggaaaaaacagcttatgttcctactcatcgcaatgaacattcagtagcgaattaaacaaaagattttttcaatttttaccatcatttttgggttttcctttttttctttttccaactttttcaacttgtcgttacaaatggggcaaatttattattataaaattaatttttaacttaaattgaataccaaccaagggcatttccacatgtttaattaaaggagtttttttgctaattttaaacaaattgcaaattacaagtaatgaattttaaaacattttgcctttttttcttaaatttggtattttcattttttttacccattatttttttcatttagtcacttctccactgaacttttcattttgatcattgccattgaaaaaaatttaatggcaaggttttcatttacctactcagcacactgatcattagaggtgaaattactaaaactcattaagggtggacggggcaggggaaaaagagcataaaactacgagaggaaatcgacccgaattctgtactcaaatttcacatttcgctctcttgataataaatgttcattttataggcttttctttattataaaatttaatttttgcaattcgtttaataaatttcctctgtttctttattaaatacatattcttttcccaattaataaatttgcttcggctaatttctcaattacagcaattttttcaattttaaattttactctgctgagcttttgactaatatttcccaattttcttagcctttcttttatcataaaatttacgaataatgccacttaaaaattgttgatttaaagaaaactttatttcctattcatcgcaatgatcattcatcagtagcgaattaaaaaaaatgattttttttttaattttcaatttttacccttatttttgggtttcatttaaattaaatacccaccaatccaaattttaatggttgatttttttaattttaatgcattttctactggtttatgatggccaagaaaacggtcagaaaatggagagagtgagggaggtgaattcgatagtagaaaaaatccaaacccaagaaattttttggaaaattaaaaattaattattaaaaatcagggctttcaattgaaaatttcaaaatctcatttcatggtctcttttagcatttttaagctgaattttatagcagtttttaaccaaacgaaacttttccattttttagctcaaattttcaaaaaatctaaaggatttgaaattttgtttcgccattagtaaatttagttcgacaaattcacaattcaattataatttttttcatttttaaattttgacaaatatgtccccattttacgcgcccccacccgagcgatgccctacggacaaaagggaatggggcagggaaccgacacaaaaacgacgcaa

SEQ ID NO: 2804 - DNA, 1644 bp, Heterodera glycines
taagggcgcgcgctatggagcaggcttattactgcgctttaaaggaaggaaattggaaaccaattgggtggtgaaataactcgaaaattcgcgcgtaagcagtttggaaaatacggacgacagagttgcagcttggaaaatatccaggttgccctgggagcagtttaacgtcgtgctcaggacggacctcgcacgtaaagttacagcttggaaatacggacgacagagttgcagcttggaaaatatccaggttgccctgggagcagtttaacgtcgtgctcaggacggacctcacacgtaaagttacagcttggaaaaaacgtcgcacgtaaagttacagtttgtgtctgtttttttcgcttgaccgtctcttagcctcaaacgagttgcccggcaaccaggatcgaggacctggacggaggaaaacagacaaaccacggtgccatataaccctcaccaggacggaaacgtccaggatcattgggtggtggaaagtcaactgctccatcacgttgtcgcatcgtgagcagggtcggcagagtcgacaactgcttccgcttcggcaacagcagcagcagcagcagcagggtggtcttgcgcttcggcgagttctatggggtttaaattttcactttacgattttttgatcaagtaatttaccgatgtcgaggtcgaacgagtcatcctcgtaccgagcaaaacccgcctctacgtcgtacacctgtctgcgggcgaccgcagacagaaccggtggtggtggtgccgatgttgatggcagttctatgtaatccaattgcaaaactgttaatcataaaagcgcaaaccgaagtcgtcgttattaaacgaatcgtcgcgaaatctggcaaagccggattccacgtcgtattcgacacgccggccaccgataaatgcacgatgccgaggcggggcttcggcaacgaaaacaacggacgccgacgatgaagcagaatccgaagcagcgtgctgcgacgggtgagcagccaccggggacagcagcacggcactatgaagcggaggccaaatggtgccgtcgtcgcgtgccggtgttgagcacgggccgcccggtgcttgactcgcccgtaggccgctgaccactacttcgtcatcctaatacgaaaaaataacagtgctccagaaatcgactgaatctaccgcattcaacgtttccgagccggacggttcagcaacctccgctgcgaccgcttcgaccatctcgcccaaaagcgcatcaacatccgcggccacctccgcggaagtcgaaggcagcgacacgcccgccgggtcgatggagctgacgcgggaagcagaaagaaggcaaaagaaaacaataataaaggagaacatttaaatagctaaaaaatgaaaaattgttttttggaaaaccattatattcacaaaaaaaatcagcagtaggaaattcgcgtgcaatcatcaagaaaattcatgacagacacgaatttgcagctttcaaaatatggacagagttggaaaacacagacagacaagtttcagctttgaaaatatacaggtttccctggaatcagtttaacgtcgcgctcaggatggaacatcagcttcctagctctgagttcacttgcgacgcacacgctcaagcgcgcatca

SEQ ID NO: 2805 - DNA, 2023 bp, Heterodera glycines
ctcggaatcgtaatgtccatgcgatagctgttcgtaagagcgaaagtgcaacgctcggcagcgtaatgtccatacgatgcctgttcgtaagagcaaatggacaacgctcggaagcgtaagtccatacgatgcctgttcctaagagcagcagcgtaatgtctatgcgatgactgctcgtaagagcaaaaggacaacgctcggcactcggcagcgtaagtccatacgatagctgttcgtaagagcgaaagtgcaacgctcggcagcgtaatgtctatgttatgcctgttcgtaagagaaaaaggacaacgctcggaagcgtaagtccatacgatagctgttcgtaagagcgaaagtacaacactcggaatctcaatgtccatacgatgcctgttcgtaagagcaaaaggacaacgctcggcagcgtaatgtctatacgatgcctgttcgtaagagcaaatggacaacgctcggaagcgtaagtccatacgatgcctgttcgtaagagcaaatggacaacgctcggcagcgtaatgtccatacgatgcctgttcgtaagatcaaaagtgcaacacttggaatcgtaatgtccatgcgatagctgttcgtaagagcgaaagtgcaacgctcggcaaaaaaaagcaaagtcaaagtgaaaaccttaaaaatcacaggtgcgtggacccgggcaaaaaattgccttaagaccaacatgccttcgcgaagaaaagtttatgtcttgtgttttaccagccacgcaccacgacactcccttaacttcagcatgagggtcacgggacatactgtgtgcaggcaggagctcccttgcctgagccggccgctgccagtccacctcgctcggctcccttgccttcgccggccgctgctcgctcggctcccttgcctgcgccggccgctgccagcactcaacacaagggagccatcgctgccttcgcgggccgctgccagtccacctcgctcggctcccttgcctgcgccggccgctgccagtccacctcgctcggctcccttgcctgcgccggccgctgccagtccacctcgctcggctcccttgcctgagccgtccgctgccagcactcagcccaagggagccatcgctgccttcgccggccgctgccagtccacctcgctcggctcccttgcctgcgccggccgctgccagtccacctcgctcggctcccttgcctgcgccggccgctgccagtccacctcgctcggctcccttgcctgcgccggccgctgccagtccacctcgctcggctcccttgcctgagccggccgctgtcggctcccttgcctgcgccgatagctcccatcgccgtccgctgccagtccacctcgctcggctcccttgcctgagccgtaccatttcaacacgcgcgcgcgcgcgcgtagaaaataaattgagctcattaccgtttcaacacgcgcgcgcgcgcgtagaaaataaattgagccaataggcaaaaaataggcttaaaaatgagatggttacgggtgatgatgggcgtggaaaggggaatgggtatggtggatggtaaaaataagatgggtgggggaggggcgtggtggtagtgttcggtatttaaaaggctttttgaagtggttgggcatggaaatttgggaaatctaattcattcaatcacaggtgcgtggacccgggcaaaatcttgccttaagaccaacatgccttcgcgaagaaaagtttgtgtcttgtgttttaccagccacgcaccacgacactcccttaacttcagcatgagggtcacgggacatactgtgaaccgtatgtaacaatgtatcagcaccagcgccacagaccccatcgaacgggcctggcgtccgcaagcggcggacgggcatgtggtggtgcctcgctagttcaacattgagtccatccataacactcaagcatacgctttcgcctgctgcgcagtcagggtactcacatacgagcgaatggtgaagattttctttcgcaccacgaacgtgtctcctccgccgg

SEQ ID NO: 2806 - DNA, 2800 bp, Heterodera glycines
  misc_feature (2604)..(2604): n is a, c, g, or t
cgcgtcagtgatttgtttttggatctgttgagctgacaagaataaggggttccccacatgtgaatgtgaattggatagacaggtctgtttagaaagtgccgcgagcaatgttcttccgttggatttggtatgccgcccagcgctgcacaagtgaaagccaactggtagtctgcttgtgtggtaatgggatggtggcggatcgccttgctttggttggtttgctgtccggcggaggagacatgttcgtggtgcgaaagaaaagtgcgtccattcgctcgtacgtgagtacctgactgcgcagcaggcgaaagcgtatgcttgagtgttatggatggactcaatgttgaactagcgaggcaccaccacatgccccgtctggcgcttgcagacggtcagacccgttcgatgtggtctgacgctggtaatgatgcatttttttgatcctatattgtatcttattgtgcgaactgcagaaagaaatcttaacatcctttgtgttctgtgtaggtagcttgcgaggccgtcgcgggttatttgcgcccaacgcagaggatgtctctctatgatgaactagcgtgccaccaccaaatgcccgtccgccgcttgctgacgacagacccgttcgattgggtctgtgcgctggtaatgattcatggagttattggtgggttggtagtgcatggtaacagtgaaaggcgctaacgcgtcagtgatttgtttttggaatctgttgagcttgacaagaataagggttccccacatgtgaatgtgaattggatagacaggtctgtttagaaagtgccgcgagcaatgttcttccgttggatttggtatgccgcccagcgctgcacaagtgaaagccaactggtagtctgcttgtgtggtaatgggatggtggcggatcgccttgctttggtgggtttgctgtccggcggaggagacatgttcgtggtgcgaaagaaaagtgcgtccattcgctcgtacgtgagtacctgactgcgcagcaggcgaaagcgtatgcttgagtgttatggatggactcaatgttgaactagcgaggcaccaccacatgccccgtctggcgcttgcagacggtcagacccgttcgatgtggtctgacgctggtaatgatgcattttttgatcctatattgtatcttattgtgcgaactgcagaaagaaatcttaacatcctttgtgttctgtgtaggtagcttgcgaggccgtcgcgggttatttgcgcccaacgcagaggatgtgtctctatgatgaactagcgtgccaccaccaaatgcccgtccgccgcttgctgacgacagacccgttcgattgggtctgtgcgctggtaatgattcatggagttattggtgggttggtagtgcatggtaacggtgaaaggcgctaacgcgtcagtgatttgtttttggaatctgttgagcttgacaagaataagggttccccacatgtgaatgtgaattggatagacaggtctgtttagaaagtgccgcgagcaatgttcttccgttggatttggtatgccgcccagcgctgcacaagtgaaagccaactggtagtctgcttgtgtggtaatgggatggtggcggatcgccttgctttggttggtttgctgtccggcggaggagacatgttcgtggtgcgaaagaaaagtgcgtccattcgctcgtacgtgagtacctgactgcgcagcaggcgaaagcgtatgcttgagtgttatggatggactcaatgttgaactagcgaggcaccaccacatgccccgtctggcgcttgcagacggtcagacccgttcgatgtggtctgacgctggtaatgatgcatttttttgatcctatattgtatcttattgtgcgaactgcagaaagaaatcttaacatcctttgtgttctgtgtaggtagcttgcgaggccgtcgcgggttatttgcgcccaacgcagaggatgtgtctctatcatgaactagcgtgccaccaccaaatgcccgtccgctgcttgctgacgacagacccgttcgattgggtctgtgcgctagtgtgtccagggcgggtgggctcggagaaattcctttatatgggttggtaagcgagacttgcttgtcgttgtcactattctgttatggcagatggatggcacgtttatcaaactgttcaaggcaaaagtagacgagtactcactctcctgaccccaatatactgagcctactggagcacctggcgagaaccctaatagggccatttacctgggggttaagcttggattctggtacagtggattgggtgttgtgacactcggagttggtatactgccctatgctgcacatgtagaagccaagtggtaaggctgctttgtggcaatgggagatgccgcctcgattccagtccccgcctcgggactcaaaagaggtggccagccgtgccggtccccgcctcgggactcaaaagatgcaggtggccagccgtgccggtccccgcctcgggactcaaaagatgcaggtggccagccgtgccggtccccgcctcgggactcaaaagatgcaggtggctagcaagagccggtccccgcctcaggactcaaaactctgagcacanttgaacggtgatggctgctgctggggtgccacctttgtcgtggcctcagtttctccagcgtttggcagctgtcgaaatgaataaaacatgcagctcgtctgtgtgttaaagaaatttggcgagttaattgacttgtgtaaatgtggcctaaggcacaaatgctgtggggaactcagcactatggatcctgtgattg

SEQ ID NO: 2807 - DNA, 6173 bp, Heterodera glycines
ctctctctctaccattaacgtcattatctcttctaattcatctccccgccctaggcaatgtcgccagtgtccaacgattgtttattcataaaaaataaaaaagtcatcagaagggcgaaaaccacttactctgacgactattccggtaaatgtgtcgtagagtaagtgacaaaatatatggatgatcacatgaattaaaaaaagacaaaaatatgtgaaaataaataataaataaattgaggtcaaagtcaaatgaggtcgaaataccaaatcacttagaaatttgttacattctagctttcccggtcttacatattaccctagtgaactttaagttttattttaaattgatttaaagaatttgtttttattagttctttatctagttgattccacaattttgttaccctcccagcaaagggaatgaattttttgcccagtttgtattttgtgttaaatctataaaaggggatgttaaagcgtgctgatggattaaaaatagtttcagatctgttcggccataaacaattttatgcgccatgaacagatcaaacagctttcgccttttctcaagtttctgatgaaggggctgaacatcagtttgtcaacggacgacccacttatgttgcacattacaaaagtaaaaattgcttcaacgagattttgaataatgaacttgttcttttaataaattttcaggaacctctgttggaggagtacagcaatgcccgtattctatggaagttgagttcgtgtgacatgtgcgagttggccaggaacaggtgggcgagttcacatggcaaaccgggggtcatggcagttcgtacaatgggactttcgtacaatgttccaattgcggatttcgtacaaaaaatatataaagtcgattttttctttagaaactcatttaacgacttgtttttattgccacttttgtgaatgtttgaaaaattaacacaataaattgtatttcctttcctaaaagcaagtatttaagttatgaaataattgtcgaaaactttcgttgaccaagttcagttgagtgagcaaatcctccgaaaaagcccccgaatgaattattattgtttgcgttattaatattgttattttggatactcatttagctcattacctatttataatttgcttatttttgtcattttgatgaaaagtatgtgtcgctgtcactatcacttatttttttaaatttaatattgtacgaaacgtcaaattaaaacgttgtacgaaacccgattgtacgaaacgcatttgtacgaactgccattgtacgaactgctattgacccggcaaaccgctttcgattgtactgattccccaataaatttcagcgttctccagtcgggatttgaggtggggatgaccattctctccttttgtacaatttgtttttctcatttgtcaggaccggaccaaaatgtactggttgggctccaactacaaggaggagggcgtattcggcaacgacatgacgcggtaatttactccgaattattttgaattaattatctcgatgggaccgattttagcaaacatatttgatcaattttcagcactaatgtgcccgacattcgcgtctcattccgtcacgaggcgttggtcagcgaactgtacaatttgttcaaggcactgatgctgtgaatgaaaagcgggtgaaggaggacgacgatttgttttgttttcgttttttccaatttcaaattgcccaaatgacgagaagaaaagaagcggcacacaatacaatacaaaatagttaattatccattaattcgatcgggttacatttttgttttattttacgggattgtttcacttttcatttcttatttccaaacaatttttcttaatttgtaaattctttattatttatattaatttttcacttttaattattataattggctaaagcattgtgaatgaattgcttcgtatttgcctggggttttctatttgaaatttgccaatgcttttaattgctctcatttgaggtcattagataatcggttcaaaggttttaatggaagaaaattcaaaaaatgaaacccaaaagaaaagtggcggcacatttaaacaacagccgcaacaaaacatacaacagcaaaggcccaccgaggcaatgcttcgcgtgtcatttttggaacaggcggcgacactgttggccaacaacgaggaggacgaggggccaagcagttcaagcggaagaagttgtagcacaaccggcggacaaacggaggtgccaaacactgccggacatggcacgtcgaacttgctgagtcggctgttgttgcgggagttgcgcgagtgcgcattcgttgaccaattgcgaatgcacagggactttaaacgcagcaattgcaaaaggcacagtcaaaagcatcgcagtttaataactgtgctcttttccggggtcaatgaactgatcaaattgttcaaggcagtgaaaaccgagtgaaagaggacggctgatgttatttctgttcttttcaattgaaatttaaattgttttgcaagtgcaaattgtggttaaatttttaggatccgatattatttggcacctttttcaaatttaaaatttgtctaattctttaaataaaacctaccttttttcttagtattttagttttcgcatcgaccgatcattgggacaaaatttgcttttttcattaggcaaagaccaaatgccggtggtgaatgtgtactcgacttcggtgaccagcgacaacatttcgcgcaacgatcttttgtcatgggtcaacgactgtctccaagtgagaaacattgacatttgaaatgcgacggcaaattcgaattgagaggcctccgtttgccatttcagtccagcctgaccaaaatcgaagagatggccacgggcgcggcctattgccaactgacggactttctcttcccgacccaagtgccgctcaaaaaagtgaaatggaacagccgatcggacgtcgattgggtgcacaattggcgcgtgttgcagcaatcgtggaaaaccatcggaaatagttttagcgattttgaggatatataacatgcgtcggttcgacttcattccatgatttttagacttagctcgttaagagctttcgaatgacaccaaatttgttcaaaatttttaaaaaaatggattttgactgattttaagctaattttcgtgatttaaaccggttcaaaaaacggtttaattttccaaaatggatgtcatatcgatcttcagcgacctcgaaaacccctaaaaatgtattttctttgtaatttatcacaaaaccgaaaagtaccgacaatacgttttatatatttataggtttgcaattcaatttgtatacattttttgtttgtaatcttgactcaaacttgtaaattttttctggcaatttttagatttttttatcattgatggagcaagaaataagtgaaatttctcaacagaaaacggcgaagaagacagaaacagtggcacaaaatgcattggagctagcctctccgcgacacttcgaaatgcacactttccgtgatgcaatcgacgtcaattatcaacggatggtactgaaggattttcgaaaaaaaattgccattgatcggaaaataagcattttttgtgttcctcccttttcagtgtctgaacggcgaagaactgtccggagtgccgttggacgacttgcgttgcgcttgcgcagtgagtacatggagcgcatcgggtcgcacttccccaaaaccacgtgcaattttctcaacggtgaatctagaagctaattaaaaaaacattttgggaaaatttatttcgttttagggaaatatcctggcggattgcatgcggagaggcgaaagggcggcgcgcagccatgtaagtgcttggattaggatataatcttttgaagtaattatacttatgaaccaatcctgaagggaaggtcgccttgatttttttatccgtccctgactcgtaattggtcaattattgtatctatttgacttttttagttactctttcaacagccacaatgtcaccaccatcggcttcctcggaccattggggacagtgttccgcaccgcgacttttacaacattcgcaaggtggacggacacgcacatccacggtgagtgatggtcatttcaataaaaaataaattcaattaacaatttgagaccctcacaaaaatacaaaacttcaatttgactatttattgaattactttgcttattcttttctttttttctgctaaattcattaattttttcgcttttagccgcagcggcgatgactgaccagtgcgtttttggctttatttacttagtttcaattctctcttatttcctttcatcaaaaagaaaatgcgcaccgatgctgatgaagttgtgcaggagaaggtacacaaataaataaataaaattattttaaagaattgtgccaataaattttattataacggtcatcatggcccagctgttcgacaaacttgacgtcggcccgcacgacctgtccgtggataggctcgaagtcagagcggatgacacgtaaacggcaaaattttgttgtctattttacaatttcaattttcagattccaccgcttcgacttggcacggtgggccattggacacgatgtgagtgaataaatttcaaaaaatttgataagtgctaatttgtgattgatcgaaatgagatttctgatcaattggtcattcatttaatttgtttttcccaggtttggtccccaaatgcccgttggataatccaagtgccgcgtctcttcgacatttaccgtgccaatgtgagcaaataccgtagcacttctctgatcacattcacatttttccattttcagaaaattttgaaaacttttgacgactttctcgacaacctcttcactccgctgtttgaggtattttctccaaaaagtaaatttttaaaaaactggcattttcaggtcaccaatgaccccaacactcaccctgaacttcaccgattcctcaaagtgatcgaaatgcaaaaataccataaaacactcaaatttcagcatgtttccgggattgattcagtcgacgacgagtccaagccggaaaatgtggcatttacgaaggattcaccggagccggcggattacgacaacgaccaggtaaaaaggatcaaaataatcaattcgcgttcaaaataaatcatatttcagaatccgtcctactcctattacttgtactacatgtaagccaattattttgttgattttgtctccgatctttaatcattttttctctaccctccaaaggtatgccaatttgacggcactgaacgccttccgacggatgcgcggactgaacaccttcgcgctgagaccgcactgtggcgaggcgggcgctgtcagccacctgagcgtgtcgtaaggagtccttggggatttggtgtccccaaaaagtgaatcccactttcattttgcagctacttgacctcggaaagcattgcgcatggccttttgttgcgcaaagtgcccgtgctgcagtacctcttttatttggcacagattggaattgtcagtggccatttacttattgattgtctttctatgcctctctcaaatactatttcactcctttctttctctgtcctctctcctttctttcgctctctctctaccattaacgtcattatctcttctaattaaactccccgccctaggcaatgtcgccagtgtccaacgattgtttattcataaaaaataaaaaagtcatcagaagggcgaaaaccacttactctgacgactattccggtaaatgtgtcgtagagtaagtgacaaaatatatggatgatcacatgaattaaaaaaagacaaaaatatgtgaaaataaataataaataaattgaggtcaaagtcaaatgaggtcgaaataccaaatcacttagaaatttgttacattctagctttcccggtcttacatattaccctagtgaactttaagttttattttaaattgatttaaagaatttgtttttattagttctttatctagttgattccacaattttgttaccctcccagcaaagggaatgaattttttgcccagtttgtattttgtgttaaatctataaaaggggatgttaaagcgtgctgatggattaaaaatagtttcagatctgttcggccataaacaatttta

SEQ ID NO: 2808 - DNA, 5665 bp, Heterodera glycines
cgacaaaattcgttcagtacggtatgtgaggcccatagcgttgatttcgtacggtaatcgcttttggttcgattacaattacaaacagagagattcttgcgcaccaacacacctcggaaaagtttttggctgctgctgttgttggtggtgaacaaccacgcctacggtagacgacgcatacggtagttgctggtgttgttgaagttgttttttctcggccaattgttgttgttgttgttgctgttgttggcgcgaggtcagaagctgcttgatctcctgatcgttgacgctgccgcacgagtcgcgcgacgcgtgccgcgaccgcttgtccgccggctcttcaaagcatccgacggcgccgccgctgccaccctgtaaatatcgtcatggggatataaaatgcactcgacaactccaagcagtacaccacgcagttgtcgtgaattaacccacctcgccatggtcgcccaccactgccaccagcatgttatcatcaatcattgcttttgtcccattattgttggccatcaatggcgtgatgaatgagacgtggtgttgtacaggtggcgccggtgttgaacccaccgttgctgattgtgttgcagcagccatcatactgttggactgttgctgctgctggcgttggtgcagctgcacaacaaaacaaggaaaaggggatgaattacggcattaatgtagaaactaaatcgtcaatgggattactgtaatcaaccatcaatgggattactgtaatcaaccactctccgatgggcttacgataattgtcaatttgctaataggttagggtaattattcactctccgatgggattacggtaattacctacgctccaagggattatgacaattgttacttcccaatgggattacggtaattattctctatgattgttatcaaaacgccccaagttcatggtcccttttgtgatttgctgaaccaaaccccacaaaaggccatcaagtttttcaaaaacccggcaccgaaccccaaaagccggcaaatcccggcttttccattcaaaattgcgatcctgcagaccaaccctgctgatggcctgctgctggagatggctgctgctactgctgtgaattgtgccggtgccgtccaccaacagttgctcctgcttgatgtttatgccgccgctgaagttactgtttttccgactgttgttgttgctccgctcgtcgccggtgccaccggcgccgcttcggctgccgttgttcagtcgtcgccgcagttccgttaccgtagtggtggtacagttactggaactgttgttgttgatgtgagtggtggacgatgccgaaatggccaccggttttggcaaccctattatacaaacagaattcattttttgtcgaaaaactgtggtggggttttttaacttttttggtgccccgggactgatgtgtccgtgccaaaatgcactgaataatttgatgccaaaaagttgcccccccccaaaatgtgacacttttctaaattaattactgttcttctaactcaagtaaattaaatattttcaatttgtggggaaatgattttaaaaaacgtgtccaattttgggggtttttgagccatacataatttcttttgcaattaaatgaaatttttgaatttgtaggctaataaaggaaaaaaacatattatcagttaattaatggtgaaataatacctacgaggggaacttataaacagagcgaaaatatttaccaattaattgcccaatgcgattgtaaaattgttaaaaaaagattttcttggcaaaatgccctcgagaagggacagaatgcgtgcgattgggggaaaaacaatttttggcgaaatgccacctgctgttgacaatgaaccgactaattggttgattgaggtgacgaaaatgtgaattatcattacaaattgcttacttgtctaatgaggcaattatgggtgtgtgtgatggtttaaaccaacattttttggcgaagtgccctgggggaggggggggggggggacgcgcgttaataggaggaggcaggcaaaattaattagccaattaacagatgttagttattgccccgagagggcgcctcaggcaataataacgaacaaaaataaatttaatataaaaaacagcacattttgggttaaacggtccagcagcaggtgcactatgtttcacgcccgggagcaggtcgttcccccccccccccgtcgtttcccctcccgaaaaattttttttttaaatttttttcaaacctagaaattttttcataaaaaaaatcgctgaaaaatttttcaaagaatttttttcttgaaattttcttactaagaaattttctaagaatttttttatgaaaaaatttctaggtttgaaaaaaaattttggggggggaaacgacggggggggggttttttttttgccggcccggccgagtcggacagtgccgccgactcagtccctccggcagccatcgatttggaggcgcctcgtcggaagctcaatgctcggccattgccgaacagcagctgctgtactcggtggtcaatttcgatggatgtgcttaatttgcttcaatgagggacaaaggagcgaatcattcggaaattgaaccgaccgagcgccgctttcgcaatctttgacatttcgcatcagcgattcgctatgctttttggactgcaaaaccctaaatgatttcagtcagcattaataggcaataaaatggtttgctttgagcagggaaaaagcgacggaagcgtttccttaattaggcgattaggagcgaaatgcgtttgaccgaagttacccagcaaagcaccaccccgggccgttccatccgaagcacccacgggagccaatacagcagcagggcgcgggcctgacaaacagagaaatcggccgtccgttcatttcccaattttcatttcaaagtgccattccctcccccgtgccagttccaaaatttacctttctttgttcccaattcatttctcccacctttgttcccatttcgtgtgtttcgggcgtccgatagtgcaaattcagcacataaacagtgaaaacggtggatgctgtgacgatgagcatgcaactcgagaagaaaaggccgaggaggggcaccgcctcggaagtcggcggagacatttcggaaagaatggagagaaagaagcaaatggacaacaggacggtgatctcttaaatactgtcattcttttgagtagccaacaccaatttagccataatttgccaattactctttccctttgatcactcctcagtttggccacccgccaagggtttagccggaggcatttcccgagaagtggggctgtcatgggacgccttcttcccccattcattttcgcacttacgaagtgttattttctcccccgcttcaggtggtaaggtgaagccgagaagggacattgtcgtggtgagaaggcacggcattatcaagttaaagccgtagtaaagagtccgtctgaaatgtcaacgaatgggcttaaatggtcgactttggcattggtcaccttcgcatgtgtaaaaagaaagtcaagtcggggtaaggctcgttaggacaacaatcgtaaaatttctcagttctggctaccgtagtcactgtaatttccggaaaagtatggcattttaacaaaatcaaattgacttggcaaagcccattctccgtttggcaaatattcgctggtgtcgaagccgccttccgcaggttgcaaatcgacgtaaaagcctggcaaaaaaaggaaagttaaccaaggatggattggagaatggacggcggacgaacctgaatatgtccaagagccgaatttgaagaagcaacgctgctcatcaaaagggaacctaagaggagaaaagagagtgcggggaagagagagaaagagtaggagagagagactgaaatgggacatagagggagagagagagaaagtgaggcccaattggaaggaaacaccgtccatggccagccgacaaacgaaccaagtgatgtcgattttgcagctgattttaaagatgcccgggggaacccaagacacatttccatcattgtacacgatcatatttgtggggaaagtcgagtcgaaactggcgtccacagaattgtacaacagaacatcgggcctccaaattttgccaacgggaaatcggacattgctacaagaaaaaacgcgaaagattggagaacccgcggagaatgggacaaccgaccttatgttaccgtactctgacgaatcccaccgtaatttatagtcattccataactgaaaaaggcacaatgaaagaggcgcaaatgagcaaattaaaatacgtagtcaagccaagcactgatgtgaacaatctgaattgggaggagccaacttcaaatggtcacaaatcatcaataatattttctaaacggctctaacattctgccattgattaattcgtctgtcatccaatgaccgataaatcaatatgaatcattttgatattaatgggtatgattattgatcgatcgatttgtccctctctcgccatgcccaccacccactcacttggttcttctcgtccacatcgatcagttgttggagggacactttcagatggacaatcaccggcttcgcgtggtactccaccggtcgctccaaattgttgtagtcgcgcaacaaatcctcgtacctttggtgccatataatggtagtccaagtccaattaatgccatggccattcattcttccattcgtccccctcccccctctcccacttcgaatttcgacttacaatcgccgttcatcgtggctggccaaaattggaaaaaactcgcagtcgaacaatgtccaaagaaaggccaaagaaaaagcaacattctgtttcatcagaatttgggctggggagtgtcagcggacggtgaaaatgccatccgccgatgaaataattttttaattgggggaatgaaatgacaagcggaagtgacactaatgaggtacttattataagatcagcagcagaaagacaatggtcactttctaatggaaaaacaattaggtaaattaaggatgggaaaattaacaaataaataaggacagtccttgaaaaaaggacaatggaaggaaaacgaagtgattaaacggaagaaaagggagaaaggaagaaagatttaaggattcagttgcaaagaatggaaatgcgaagttcgctgctcatacgataatctccgatgacaaattacactttcggatgggtgggcatttggccatttcttcctaattcccttctcccacaaaaaaaaacaaattttgtttcaaatgctttcgcttgggtaatttaatcattcattttaaatgagaaacaatttggcctttacttagagtccttttcattttctgcttttcataaaaaaacaacaaaatttctatcgctttttaagtcggtgaaaattgactttgttgatcgatcagagtgaaattggaaatgctaaaggggggggggggacgaaaagcagctgaaagggagggagagagagctgtggtggaaaagccatcaccaccttatcgcatcaatccgtcagagatgccaaaagacggacgaaagaattggggggggggggatgggagaggatttgagggatttgagaatttgacggaaaattgacgggtacctccgcccttc

SEQ ID NO: 2809 - DNA, 980 bp, Heterodera glycines
ccccccccccccgccccatttttgccctttcaattaaaaagacggcattaacttttaatggcaccgaacgaaaaaggcaaacgaaaaggacaaacgatcatcaacgaccaaatgacttaacaaatcacttctcttttttcttatcgttttctctgccatctcattaattccctccaatttgtgccttccctttattgtgtgattaagttcataatgagctcattagcgggtggagaggtgccgtccctttgtcccaccagttcatccgccgttggattaaataaatgccggggattttgccttttatccctgagaaatgtccaattttgtaatttactgatttttttggctgtacatattaattatattgtttatcgctcctaatatcgcatcattttttgtttcggccatttgtccgttttgtaccttttgtccgtgacttttatgccatttgtctctcaaattgccctttctcttcatcatttgactaacttttatatatttttattttctgtaacttttccaaattgtctttgttttttatatgtcaacaattctcacgatttaatctctgctttattttatgctaatttttatgagattcaatttgaaattcatttttattttttgttatgcaaattttaaaagaaaagaaaaaattgggaaaagtttaaaagagaggccataaagcaaaatgaataattaaaaattgtaaataaaataaatatataggtaaataaactagggttaagccccgaccccgagctccccgacatttttgggcctattccccgcccccacccccgacatgtcgccccccgaggtccccggcccccgactttttgctccccgactccccgacactaattcggggaattggggactccgagcattgtaaaaatttaaaaagttcaatcaacaacgaagggggggggaagatgtgaaaatttgtgaaattttgaataattttcttaataaaa

SEQ ID NO: 2810 - DNA, 3477 bp, Heterodera glycines
  misc_feature (3448)..(3448): n is a, c, g, or t
gccggaaaaaaagggaagatttacgagtatttaaaaagaggtttttttgggttaaaataaaatttggtcattctccgatcggggtccccggcccccgactttttgctccccgagggctcggggcttaatcctaaaataaacaatcaaacgtttaccaataattaattaaatttcttttaactagtaattaattgtcattggttaagtaattatacaatttttggacaatgccatgggaagtcttctccgacttcgggttgccctctctccaacggttcccttcggccgccatttccctccgacactttttaaagtgccaaaaattcctcaattttaattaaattcgttttttgtctgtgacttctgaattctacaaagttgcactttttgaggactgtttgtgctttcggtcatcgatttgctgataatttgcccaattactttacttcgtccgcctctctctctctctctttttggcatcggacggaacagtcaaagggtctctcagaacgacacttttttatggctacaggacatcagccaatttcttaactttgctcaggtaataatgagcaatgaatgagtgctgtctgatgagatccccaattagcagttaattagtctctttagtcttcctaatttagtaagtactcaatgaatgcgctttctttggttgccattaattacatttattcctgctcatccaaacgccaattattgcaatttgtgtagagcggcaaaaagaaagtgttgtgatcactccactggaattataaccgatgctaatttatcaagcttatcagtggttagagtttaacagaatttgcaaaacaattggcaatttcattgttgtccgtttgcttccacttttcttctcacttttttgtgcttttccatcgatggcattttcaatttgattcattttttgccattttcccttttctcgcactttttcctctcttaagttggtctttgatcgcatctgttggatggcaaatcaatcaccccattgaatgagctttaatgcggcggcgggcggcggaatgatgaattataattatttaccatcggtgggatgggatggttttgctggtcactctccccccccctatcccttcgtctcccgttctttcccccattctccgcctcgtcctcctccgtctgttccttcctttcgctgattgatcattcatttgtcatttgtgtggccaatcaaagaaaaaaaagtcattcaaagcgaaaaacgaaaggattctttttcattttacacattttcatattcgcaagttcaaattccttctttccttctgttgcattttatttattcaccttaaagaaaatccgccaaattaacaaattaatttataatgccaacagaaaatttgccgcccgaaaatgacacaatgccatatgacccgagggcacgggaagagagttgttggcacgaggacagtgttgaggacagattcggccgatatcccttcagaaagtacccgtaagtacttggctgacagagggtaattagatctaattggctttacttaccaggaatgagaatccagcaaagattatggactctgttctcgatgcaattggacacacgccaatggtcgggcaaagttttggggtgataggcaaatcgaaaaagtcgcaaaaatatttaaatgagatttttatttattttgaagaatatgagagaaattacatttttgaatacaaattttaatcccttttattctttccttcgaaattatttcttcaattaaaattccctaccacgcaaaacaaagctcggcattcaaatgtaataaaatgaaagcgttttatatttataatgtgccattgaatttttatttttacaaaattatttatattgaaataattaaattaaaatacataatttacaattttattgcaactttttggttcaccttgggaaggtccctaacccaatcctgggaattgcgtatttcgacagtcgcacttcaaattgaataggcgtgtcgtgtcgtctttcaaaagtttctaagagttaaatttttccagcaattttttgggcatttcgttccattgagactttttcggttcggcttacaattagcagctttttgcgtgtgttcttccttttctttgatcattgttttttaaaggtaaagcttcagcgaattccggcggaatttggcattgagtgcaatgtttgtgagttttttggcatttctcaattagtgcacaacaacaaaattcaacaatgaatatgagctaaatttctgaaatagagaagaagaaggaaacattcccgagaggaaatcccatggatcaattaaggcgataattgaccctaatgaaatgatcaatcaaattaagctggaactgtagttcattggtaattttatactcattaccaatattttgagacggaaaatgcgaatttttcaatgccggcggttcggtgaaggaccgaattgcgctgaggatgttggaaatagcggagcaaagcggcagactgcgtgccgggatgacagtgattgagcccacctcgggcaacacgggcattggccttgctttggcatgtgccgtcaaaggatatcactgtgttattgtgatgccggagagaatgagccgagagaaggagctgacgctgaaggcactcggggcaaagattgtgcgcaccaaagacaaagcgcggtacgacagcgaacaatcgcacatcggcatggcgttcaaattgagaaaggaaacgcccaattcggtggtgttggaccaggtcaatcgcaacggaacgggtgccaaaaggggagggagcagtcctcggcacttttagtacaaaaacatcgccaaccctttgacacacttcgaaggcaccgcggcagagattctggacgcgttggatggcaaagtggacatggtcgtcgtcggagtcggtacggcagtccaaactcagctttgtgccattcattggccaatgaattgccttaggcactggcggtaccatcacgggcatctctcgcagaatcaaaaaggccaacccgaactgcataatcgttggcgtcgaccccatcgggtccatcctcggcggagaggacgaacacgcaggacataagtacaatgtggagggcatcggatacgattttgtgccgacggtgttggacatggaagatatcgacaaatgggtgagtggcatttcgctgctgtcttatcggacggaattgcaggaaaaagttggggacctggacacttttcaaatggcgcggaaaatccatcggatggagggaattctcagcggaggatcttcaggtgggggaaatagcggataaagtgctgaattggcaaaatgccttctctttttatgtgccattctctgcggggcaatgcgagcggcaaaagagctgaaaaagggacaaaattgcgtgtttttgttgcctgacaatgtgcgaaattatttgaccanaattcgtcagcgatcattggatggtcttt

SEQ ID NO: 2811 - DNA, 5787 bp, Heterodera glycines
  misc_feature (5735)..(5736): n is a, c, g, or t
  misc_feature (5743)..(5743): n is a, c, g, or t
aggcagcagaaatccaagagaccttttttttgttcttcgggcctaatgtttttttctccttgttatgtcaacaattcaacaccagcggagcaaaaaaaggaataaatttttgctgttttgttattcaaatttaaaaaaccaagatataactaggggtccggcggtggataggcgccgctgtgaaaattttttttttggaaattgcagtgaaatatgataaggaaaattgcaaaaaattttaaaattttctatttttttcctaaaatgctgaaaaaggcataaaataaggcaccaaaattgcaaaaaaggcaaatccaggaaaaaaacatgtattacataaaaaagaagccctggttcttcttcacaaaaatgcttttgtatgactgggactgaaattcagcactctctcacttttctatctctctccacattttatttttccgccaaaagtcattaaaaaattgcttaaaattttaaaaattatcgaatttttaaaaatatcatttatattacattgatggcttaatgtatgttgatattaaataaatatcaacgccagtgttgatatttattaaaaaatgttcgctaagtgaaaaatgttgaatttttgttaaacaattgtcttttatgcattgctataatcaattttaatgtctatgtcataaaatttacggctcgttatttgcatacaatttaagattttatacagcaaaaatttatgataaattaaaaaaaaaacttttatataaagtttatttattaataataactatttaaatatgtatttaatataccttttgttaatttcgaatttgtaaaataatttattgtagtttaaaaataattaatttattcattttaattattttatgtattacgtttatctcaaattatgcttttattcatttaaagtgagaatttttcatttttttgtgaatttcaaaaaagattatttatttatttaattttattttttataataaatattttttatataatattttgagttttttattccgattgcaacgaaggcactcccaacgcagtcgaattgcatcgtgcgtcgcaactcggccaatgaatccatcaaacatttagtgatggcttaaaaattatccatctcattaacaacattaatatttataaatttaataaaaaaatttgttttttacagtacttaatcgatatttaataaattttgaaaaattaaaaaattttttttttgttattcttttgttaatcagatttttatgagggtttttccgaccatgtcaaaatttttttgggaaaaaatgaagaaaatataaaaatgaattaattagtgtttttacatttattaacttttgcttttctaccaaattattttattggcaatatgtagagaaagaatctatttgtaggtaaattcgaaatagtaattttattttttataatttctgttttaaatttattctttctatgtaatttatattttgattgaaaataataaagaagtttaattttttttaatatttaaatccatcatttcgtcgttaattaatatttatattttaaataaattattaatttatattaaacttttatatacaaaatttataatttttttaaatttcgctcttttttataattacataggttaatattaggtaattgtaaatttaatttaaaaaactatttatttaattttcatgcgctttaaagatggtcttccttctgaaaagttgtccaaatttttatataataattagagaccgagccggaccggatccggtaccggatttttctggatccggcaatccggtccggcgattttgggaaaaatccagattgaccggattaccggattgaccggattatgagagaccggatccggaatccggtcatttttgaaaatgccaatccggtccggtccggagaatttttgaccggatccggtccgactcggtctcaaccaaaaaccttcacttttgttcatttttctttgaaaaatatctctttggcataatgtctttaactttttaatcattttgacaaatttccagtaggatttatgtctaattttcataatctaaatttttttaattgataatttatgtcttctttgttttaggtttattaaaatgagttctatatggcaaattggtctatttaaaaaaacgtccaagactacagcaatttgtctcgagtgtgaagcaaatgtatattagttttattatgataaaacattcgcttttcataaatttatctctgccctcacttttcttattaaattatgaaatacttttatggaaattgtcttaattattaattatattggggtggaaactaagttctgtcatagctgggagaaattgtttattaaaatttataacaaatcaaaacgaaacccataaatcactcaaagtatctcccctaattctccacaatcttctgccatttttgagattttaaaaatgatctattgattaaatttgtgcagctagacaaaaactagaacagcagaagtgtttttcgtacaaaaaaattacagtaattacaaataatataattttttaaattaaataattgcataatattttatttcatttagatattaattttttgcagtataaggcctaagtctggaaactttttatgaatcatcattttattaagcgaaataagaaagaatttatcatttgcttttatttttaaattataacatttaattagtattgtcattaatttgcttgcaattttaatatttttttcttttatttttataattatatattaatgtttatattatttgattataaattatttgtgtttgaagtcaaaatgattgtttttaataggttaatttattttttatgaaattttttaaattttttaattatttttaattattaaattttgactgggtttttaatgtgaatattaaacaccatttttttatataaatgttttgaataatttgaatttttttttatttggtacatttcttctaaattttatgaaaaatatttttttaaaaatatttttagcaataatattatgaaaacatgatttaatattttgtgtaaaaattttttattggatttttgagcatttaggtttataattttaatttgtttccaagaatgatttataagtttaaatttttttatttatttaattttctgctagaatccctataaataaataagcgtttattcttgataatttcattcatctaaatgttcctaataggtaataaactaatttattggttagtttactctttatttataagttagtttctaaagcatgaagattattaaatataataattttttcatattttcatgtgaatagtttcgatactaaaattttttaaattaatttgtttattaaataatttaagcatattcactgatgagaaatgatccattatacattaaaaatttcaactttggctatattcacattagtttaaatgttactctaaaattataaaaataatatttctgtgattgaatttatatctaattaatttatttattagttttataatttcatttttataataataattaatagcatttatttttgcgtatataaataatttttaataaatttgttttttcttttataaaaagtaaagttttccatttttaaaaaaatacatttttattaaaaaaattaattacttgcttatacaatgctatgttcctaattcgttaaatggtaaaacttaaaaaataattttatcagactaaaattttaacttttataaattcaaaaataaataaatttgataagttttatccagggctcccagatctgaggctttagcctcattttgtggttttttgataggtcaatgaggctaaattttcaaaatgaggctttgaggctttttgtggttttttgagaaattttgaggatttttgaggcttttggggaaaatcctcagaatcttttaaattttgataaattggcataatgtttggcaatttaaagaatttttttaatgaaaatacgcaaaaaatatggtcaaaattcttaatttttccaacggcggcgcctatcggcaccgccggaccgtaaaaatccctaatttaaaagcaaaaaatttgctcaatcgcaaaatttggtcatttttcggacaaaatctgttaaaaaatcgtattgaaaattacaaaatttttcccggcggcgcctatcggcaccgccggccccccttgcgccccaaaagttttttgggaaaagcgccgcaaaaaaatcaacttcgtttttcatgttcagaatcctaaaaaatgcttatatctaacaaaaaatgctcaaatttatcatggacaatcaaaaatataacatttgaacattttaaacgtgttttgaataaattttgtaaaaatgaggctttttacccaaaatgaggcttttttgcctgccaaatgaggcttttgaaaattttgatctgggagccctggttttatcccatattttgaataaaacaaattcattttttgggctttaacttaccttttgagtttattcttagcgccctattaaagttatttgtataaaattaaaatttttttatttataaggtaagaattgttttatgcaattgattttagaaataaagattatgtcatattgtgtatttttatatttatatttaatatatatttaataatgtttttagtatctgactacatttcaacaatactctaaatcgaatttttcctgtaataatatttggtgtatagctatataatattattttcatttattttattatttaatttttattgattatgtattcaatccaaaatataatttacaaaaattttcatgcaaagaaatataattaacttttattatatttattttctttattaccttatatattttttaatttttattaaataaatttcttttttattcttataaactttgaataaaaaatgaagttgttttcagggcacttctggaaactgagttttcacaatttataatcttttaaaagattatatattaacatattatctatttttataacatattttcattaggttttctcatcaaaaatttattctgctattttaaaatttaagttttttcgaattatttttatatttttaaattatttttcttcatttaaaatgccttttttatttattactcatttaatattgtaattataatttttttatataaatatttttacattatataataatattattgtatggctgtgttggcgtcaaagtgataaagtttattaaaatttggaaaagaattttttatctgtaaaataatgaagataaaataattacacttaataaaaattttatgcaaaagttctgttttaataattaattttgttttccaaagcttaatttttcctcgtcatataggcggtatatttcattatattcaggggataaaaaatgcaaatttagcaacctaataacgcaattttgtacatcgccaaatttgcgcatttttccatcggccaaccacgatttcatctttctcatcgaatctaataattattcttatcacaaatttaaattaataaaaaaattccttaataaataattttgaaaaactaaacaagaattattataatttttttagcattaaattgagatagaataaattaatagttcatttataaatttatcaaatagtattaatttatataatttaaattaaaaaaatagatgaaatgaagtgtaaagtaattcaaaaacatgataatnnctaagtnacaaaatgcgcccataaattatctatcgctaataaaatttaaaa

SEQ ID NO: 2812 - DNA, 3969 bp, Heterodera glycines
gtaagaattgttttatgcaattgatttaggaaataaagattatgtcatattgtgtatttttatatttatatttaatatatatttaataatctttttagtatctgactacatttcaacaatactctaaatcgaatttttcctgtaataatatttggtggatagctatataatattattttcatttattttattatttaatttttattgattatgtattcaatccaaaatataatttacaaaaattttcatgcaaagaaatataattaacttttattatatttattttctttattaccttatatattttttaatttttattattaaataaatttcttttttattcttataaactttgaataaaaaatgaagttgttttcagggcacttctggaaactgagttttcacaatttataatcttttaaaagattatattttaacatattatctattttttataacagattttcattaggttttctcatcaaaaatttattctgctattttaaaatttaagttttttcgaattatttttatatttttcgaattatttttttttatttaaaatgccttttttatttattactcatttaatattgtaattataatttttttatataaatatttttacattatataataatattattgtatggctgtgttggcgtcaaagtgataaattttattaaaatttggaaaagaattttttatctgtaaaataatgaagataaaataattacacttaataaaaattttatgcaaaagttctgtattaaatgcaaatttagcaacctaataacgcaattttgtacatcgccaaatttgcgcatttttccatcggccaaccacgatttcatctttctcatcgaatctaataattattcttatcacaaatttaaattaataaaaaaattccttaataaataattttgaaaaactaaacaagaattattataatttttttagcattaaattgagatagaataaattaatagttcatttataaatttatcaaatagtattaaaaatttaaaaaataaataaatttaaagaagatatttgagaaaattaaagaaaaaaaaatcaattttatggaagttgaattacatcaattattggtgtgttttattataatgaaactccgtttttacaaatttttaattaatatttttatttaataaataaaatttatttaaattggattaaatattgttaacaaacttgctctcttatttcatgcctatcagtctacattttttgtatattgttcgataaattttagataattaattatgaacaatagcagggttcggatcgaatcaaattcaccatcaaattgaaaaacaaaagtgagaatgcgcgccaactgcaaatgtgacgcttgtcaaacgacccgagccgtccaagcgcacgttggaaacattggtgcgttttacaatatttgcaaaaaaaatttatacacttatgtttagtttttagggggtcgttgggttaaaatgattcgtttgaaaaagcaattatcatttctgaacgaactcttaaggttggcccaagcaaatccgctgtggccaaagcaacgcgcaatatttagccaaatttttaagaaaaacaaaaagttttggagcccggcgtcgataggcgtcgccggggaaaattttgatcatttaaagttaaaaacattatgccaaagattatttttcaaagaaaaatgaacaaaagtgaaggtttttggttgagaccgagtcggaccggatccggttaaaaattcgccggaccggaccggattggcattttcaaaaatgaccggattctggatccggtctctcataatccggatttttcccaaaatcgccggaccggattgccggatccagaaaaatccggtaccggatccggtccggctcggtctctactaaaaaaccaccaactgttcagttttaaattaaaaccgcataaaattcaatttaaataaaaaaacaaatttaacaaagtaaattggtagatgggtccatccgaaaaaacacaacaattattcattcattcttccgctcctccgtctatctgttcaaatcccttctttttgctccatcgggcgagcagacgcacgcggaattgggccaaccgatggccgaactgcttcaaaatgcgggcctggtccgcggacagttggtcacccgttttgcacacagtgaactcctccaacagctcaatggcacgcacctgtcgatggcaggggaaagggacggcacattattacgcaacgcacaaagtgcaggaaaatttcaaaaattttgcctggcgatggctgccagataaaagggaattcttcgcccttttgcatgaaaatttaaaataatttacaaaaaaaaaaaaaatttctgcttgacggcggcatctgacaaatgagcataattataagaaatttttaaaaagaatttattttttaaaacattttgttaagaaaattgtcttaaaattttcaaaaaaacattttttcttgaaattcccaggctaggtgcttggtatggattgaccaagtaggaaaaagaaaggttatggccaaagaaaatgaaaatatggctattgataggacgcttaactgcaacaatagagcaacaaattgcattcgaacaccttcaaaaccttgggccattgcaattaaaagttcgtcccattttcccccaaaatgcccaccattttccagccgtgtgggcatgcccaacttgcgcagctgcggttccatggcgccgtgcaagtgcaattccgccggcattggcccggccggcagcgaaatgtccgccgaggcgacggcgcccgcctgggcaaactcagcctcggtgtgctcggcgaaaaaccttagaaaatttaatttataagatttttttaatttttgccgctttttgggcccaaaagcattccattcgccggaacgaaattggaaaactaaaaaatttgaaaattttttactcagaaattttttaaattttgctacaagatgaataatcatagaattatgaggacatacgactgactataaatttactgtctcttctgtgtaagtgcctctgaaatttaaaaaaaaaaagaatttaaaaaagcgtcgcaaagtaaaaaaaaaagtgaaaaaattttctgttttaaaaattgggacggcaaatgcaaacaaaatggaaaaaagggagatgcttctaattcgtagaacctttaaaaaattttccaccaaatgcgcccccgccaaaaacggaaagaaatcaatttacgaaaaaattggaattatcccccgccgacctttgcacttcgtttgccttcgcattggtgaacatcagtccactttggccccgcaaaagtgcgctcactttgtgcaattcctttgcctaaattggggagtgcgttatttttttttaaatttaaatttacttccgaagggggggggaggaaatttctgaaaattgctattattttttttatcattcaaaaatcactctttttgttacaactttcaatttattgcccaatatgaaaatgtccttaagagaaagtgggaattttttgcgtaatttattttgaaaaatttttgcattaaacagatgcacgaccattagtttagagggagggcgggagaggcacgaattttaaacaaaatgctaattaattttttctggcatgtgtcaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggtcagcgtcagataaaccaaaaaaaaaaaaaaatctgccaattaaaagcttttatggctgcataaaatgactcccaaattatgaattggttcaacccaaaaatttttgaatttttttttggcagggggccggggttgggtt

SEQ ID NO: 2813 - DNA, 1066 bp, Heterodera glycines
  misc_feature (968)..(968): n is a, c, g, or t
aaaaatgaaaaaatttaatttatttggaataaataaaaaataatttatgaaaaaagcaatatcatagcagataaatttataaaattttttaaattatttaaaattgaaataccatcgtggataaattatgcaataatataacaaaagatttaagagaaaataataaaaaattatattaaatttcaatcgttaaaattaagcataaataaaaaaacctttaaaaataattaaactacattatctacaatataagtcatacatttttaaataacagtagaataaaataaattttaatttaaattttatttatatttattatttgttgccatataaataattttttattataataatcatcttgcattatatataagcatttttttcttaatggaattttaaaaatgcataacagattctataatcgataaacatcattaattaattaaaattataaaaataatagtaaaaagtgtaaagaagatgcaaacaataaaaaatttattgaaacaaaaattactatataaattgattatttacttatatatataatataaacagaaaaaataaataaaatatgcttattgattaaagaaattaagagcaagtgtacttgagattaaaaaaaatactaagaaatttattcttaaatgttttgattatttaaatgtataattaatttacctctacggtattgctattttttcgaacaataatttaaatctcaataataaaactcaatgattaaacaaacaaatttatttaaggcaaaaacgatttatttatttcttttattattatttttatcaatctttaattgaattatttaaactatttatcaaaaatttaatttacaaaaattttcatgaggaaccattataaattaatattaatttattttaaattttatcttctttttgtggtttttagcgaaattccatgggcagggaatttttcaaaaaaatggtaantttactggagtacaaaagttatgaatataaaattttttatcaaataattcttctcggggagttcggaattatgctgatgtttttacataataaagata

SEQ ID NO: 2814 - DNA, 2792 bp, Heterodera glycines
taaaaaaaataatttttttttaaggagtttttgggagttatttaaaaccaaccccccccccccccccccgcgggggggggatttttggggcccccgtcccccccccccgggactttgacccccgcatcccccgcccccgcgaaaagccacccccgcccgcggggctcgacccttacaataaaatgatttaaaataaatatttataaaataaaactaaatttgagtaaatgatcgtgttttgcagcaaatgtccccttgtaagcagctgtagcctaaaaatggtggaaagttcctccttttttcgtcaaactgtggtgccgaccgattggacaattgaattgtctttgtccatttcgttggatcgcactgtcgcgcatccgttctcctctggcggtgcaaatgccgaaaggcatcgcattgtcagggcacgaggggcaacagaagccgttggactgacaacggaagccgggcggacaaacgccctgcagcaatggcaaattgaaagttgccgaagaattaaatttttttaataattttttctagggtaattttatgcgctgaacacatatataacgtttatttttagctcttatgctctttacgtgtgttacgtgaaattttttgactagtcaactacagtatttcgtcggtaatttgtcccccctatttttcgaaaaaataataaaaatttaaaaaaatcgtgaaaacacctgccctgggggttttcgaggtcgctgatcacgaatctgacatccattcatattaatttcattgaaacatcaatactggttatattctgtacatattctaacataaaagtaaatttttaaaatttgaatttcgactttttgttcgagttcgggtcagggtttcggaatcggccaaaactaatgttagattcatgttcagcgcataaaattagtctaaaaaaattatttaaaaaaaatttcaggggggcgacaaaaggataagaaccaagcaagctctgtaacttaaatcggatttggtcgattcaaaatttcatttaaaaaattttctataatttttcattcaaaacagaaaaaaatggaaattaagcgtttaaacacttttttcgtgtaaatttctaatttttacggcctcaattatgtaactaacagactcatattgttaatgtttttaattttatttttcaaaattaatatgttttgggtttcgaacgccgccaactcaaattcccaaacttttaaacaggcaaaggtcacattctcttttccccattattaccagtaattagtgccaatttgcactaactaatccccgccccaccccctcaatttgccttgttgcaccgtcccatcgaacgtcccacggggcactgacaacagaagttggccgtgttgcacaccaaagtgccctggcaataacccgcgacgcattgggcaattgccatttggccaccgcatgcctctgaaaaataagccaaaaatgagaagcatatacggtaaccccacggagaaatgattgaattacattaatcaaaagaacaccgtacccacatagtcgtctttgcctctgcggcaacaaacgccgttcagacaactttgatcgggagggcattggcctcgggcgctttaaagggggaactgtttttggagaagaaattccatccgtaatgaacacctgcaacgaatcattgaacggaagccctgggggcagaagcctgaattatgattagtctgattgtgcgccactaattactcctaattgcccccattgccttccgcctgttccgccatgtatcccccttgagctccgttttggtacgggtcaaaaagtccggcatttccgtccgggtaattaatgtccaagtcgttgcccgtgcagcattggccgtcaatgcattcggtagggccgcggtaatagggggtgcattggacagcggaagtgcattgggcgtactttgagaagagaaaaaggcaatttgagtgaatcaaatgctaaattagtgcttctgatgtctgggaatttaccgaaattcgacccaaaaactcaagaagagttggaatttgatcggaaaatattttagattaaaaaaatgtgtataatttaaaaacggcactttaccaacgcgcgtccgccatttcgacaccgttggcacgctgtgagggaggggagggggggggggaactttttgttattggaattcaaaagcaaagagccaaaggcattctgctgaatgattggttacgtgttatttggtaggctaagttgggaaactctccgcagatgtaataaacggttgggtattgaagtgccgattggcgccgggggcgaaagggcgccgaagacggcggcggcactcttttggcggaaatgcctagggcaacaaaattcacataaatttatttatttatttatgtaaattcccgcggggctaagcaacattacagtaataaaagggaatttccaaataaattcaccggaatttgccactcttccgttgccgaggcaaaaaaagaggaaaaaaaggaggggagaaaaggcggacaatgatggaagacggaatggccaccagcgaagtgtgttttttgtgctcattggcagtgattttgagcccaatattatttttgggaggatttgcctaattaatgaattaggaattaatttgattaagtgcaattggcaaatgcttttttattttgtcatctatcaattattttttctctatttttctgctgaaatgaacaaaaccaacgtttgttagcgggagggggggggggggggcataaggcaaaacaattaaagcgatg

SEQ ID NO: 2815 - DNA, 6825 bp, Heterodera glycines
  misc_feature (6780)..(6780): n is a, c, g, or t
  misc_feature (6791)..(6791): n is a, c, g, or t
  misc_feature (6817)..(6818): n is a, c, g, or t
tagcgttttctagtatttttaccatcagaaaatgaaagtacttcagctgcgacaagagcacaaattccaccaatgctaaagccggcacaatctgtgcagaaaggaattttacaatatacaaaaatcaaaattgtacatttactcaccggtgagtcggtcgaccaagtcgggctgttcaactttcaatttctcaaaagcggccatacaagaaacgaacagagccatctgagcatagaatgtttggtctaatttgtttattggtccgttaagacagaggctgagaaggtcgaatttgagaaattctgacattaaacacaattaaatgccgataattttggttttttaaatcgcaccgtttgcctcctcaaaaagtcgcgcactgctcggattgtcaatgacctaaagtgtcaaaaatgatttaatgtaaactttggtgccaaaattgtttgtcaaaataaatttgaccggcaaatacgcccacctttttgcccatttgtaagtgttgcgccccttggcttggaaacatcagaacaacttggtcctgaacggaattggagcagtgacaaaacaaagcaaaaattaaagtcccacaataattggaatgtggtcgaagttcagctgcagcaaatgctttcgcttctttctgaccgcgttgatcactttgtacttctcgggcccccgcaaattttctttggccttcgaaattgggtccatttggtcgtcgtcgtcctaccaaaatgtcggaaatgggttataaaaggctaaaatgtctgcaaatattcttttcacaatgaatgccgacggtaacggcctcggctcgccgtctttgctgacgcgaaaagcattggtggcgggcgcccattgaatgccttcgccggacggagggggcgaaatgcgcggacgcgaaacaggacgacccctaattcgacggagttggacagccctgaaaaggcaaaacatttgcaaaaagggagccattttaagaaaataacaaattaaacgacctgaaaaacagtgatgggcagagaagaaactgtttgttttgtaagacagtcattccaatttcaaaagaaaataaaagatttaaatggatttgtcgaattcgttaataaatattttaaacatgtgtaaaaatgtttaaattatgagagtccgtgccaaattacttaattaaactggcaaatttatcggcacccgtaaagcaaaagcaaaggtcaaaaaagcattaaataaatttaattgtaaatatttgtcgacaaaaaatccgtgttgagctgaccaatgacagacaccgatttagagaaaagttggacagggcaaaaggcacagccgacgatcaccacactctcttctccaatttgaagaattgggaatagagaagggcagtggcggaaatggcatcatcgacgccgactgcaaaggcatggcatttacaagaaaaaacaaaacaaatacgaaattacaaagtacagaagtcaaaaatcaccactgattatgggtgagtgagtgagtgacctgtgtgctgaggaaatttgcagacaagcacgggcgtgtagatgaacacaatgtcattgcgcatccaagaagccaaaggactaaacagtgaagcaatgccaaaatgaaatcaaaaatgatctacggattttggccacctgtgtgggttgaaatggtacactttgcctatttgcttgtccagcagcagagtttggcttgtcctgatctccaacttgtcaatgtcttccattctgtcagaagtggccaaattgcacgactgtcgccctgccaaacgcgcaccagcagccaatccggcgcccaaattcgaccagtccgaccctttgttgacctaagaccggacgagttggaatttactttgttgtcgcaaaaaggaccataatgtgatatgtcaaagaatagtaatggatccgttgaagtcgctggttgtaacgtttgctttccggattggttcggtcgtgtccataggtggtcaacagccagtaaagcatttcaacagcctgaaacagaataccccataaatttattcaatttttaatgggccatccgaccttatgagcgtgaagagtgccggcaatgatcggataacgctctttgtatgggccatcgccaactttggacagataagtcaattcttgctcattgatggcaaggctaaagcaaaaagaaaaactcaaaaaactaatgaacgcacacctgtccacattgggaatgatctgaaaatgatgatcaagttcaccaattcattgcatttgaccaaccctctccaaaatgtcgtgcacttgctggtcgtccgccatgctgcccaattgcaaatgaatcggaatcagcggattcacttgcatcagcgaccgtttgatcagtcgcagcttttccaatcgcacgtcttggttctgcaaattgtatataaataaagataaaacaaaattgagatgccagaaatacctgcgcttccagaccatggattccggacaaaatgatcaggtcgggacggaattgcatgattgccttgaaaaacatttcgatgatcatcgcactgccactaaacgtgggaaaaccatggtaaagatacaacaataattcccacagtgtttttgtgagacctgaattggtcatgggaaacaatgaaacgagaagaggcgggcgaaacgtactccccgaggatttcgccctgtttgtactccaaaatgaggtgcaattcgtcctccgcaattcgtgtggaattgtttcgaacgatggccgggtgtaacagcgcgtggcttcgcgggccaatcggaccaaccaaataagccttaccaaaaggagacaaaataataaagggcatcaccaatgcaacacatgctagacccttatataaaaaagaaacttaccgttgcagcggggaacgaagaggcgattttctgagccattaatgcggcattgccaccaatataatgctaaaatcactcaaaatttgattggaatcagtaagtcacctgtgcacggagatgtttgtcttcaacggtgtggaccatccggtcaaatgccgcgtcattgaccatacatcgctcggcaggcgcaccacgcgtaaaaaagtgcacaaacgcctcgtacaaatcctcaaatccgttgagcacttctttgtccgcgattggatttggtgacgagatgttcagcttgttcaccatgctgactccgctaacgatcacatcaacattgcaattgatgctgaaaatgtatataaaaaattaaaatattgtgaaaaagcaaagagaaaaaaatataaaagaatgggagacgcacccgaccataattttccgaaattttatggatggctgtgaaatgacggtgtcccaagatttgagcatcgcctgctccacgggcatgctgctgagccggtgttgctcattgtaatagctgtagaaccatgggatcagaaagcaaaccaatgaccaattaagcaaatggttgtagggagtgttgaaagggaacattagaaaagcgggaagaagaaacgaaaggaaaaatcaaatttatcacaaatctgaaaagatagcaaatttagtaacccaagactggcggattgaagaggagtcaaaggtattcactggtcataaaaaataaaaattggaaaccttagaaaacataaccatgtcatacccatgtggatttcgggttggctttgtactgcctttttgtcaagttcattcattccgttttattctcactgcacaaatacgactagtcaatttcgctatctatttgcacctcagaacattttagaggaaaagctttgtaaatattaattactccatcctttttcattttttgtatttttgacgccacgaatcgccagctttacggattcttgagagttttgctacttctcttaattactgatgtctgttctgataataatcaattacttaacattacctaattcgttttacaaattttccttaaaaaataataataaaaactggaacaaattttagacatccaaagtgtctgccaaaccgtctatccaaagctcttcgagttgagatggcagccggcccgtgccggatgcgtcaggacgtattccgtgccgttctgatcacatcgctggcgtggttggtgctattctcatgtctgctcttctactatttggaccgttctttactcatatcagacaggtattttggcatttattgtaataatttggggaaattggtttggttttgtcagaagtgctcggtttggaggtgccggtttcgtcaatgattcgccagtcagtcagcggattcaactaagtccttttgaccatcccaaaaaagtgtctattggacacatgtcgacaaaatccgaagctgttgatccagaagtgcaggcccaacttgacctccttctggccacacttaatttcgaccctcaaggcattcgattgaaggagcatttaattatgaattttcgaaattctaaggtctcggcgctggtggaacgggcgttaccattgaaagggaattggaggaggaaatgcaggagaagttcaagcagaaccaattcaatctgatggccagtgaccggatcagtatcaacaggacactgccggactatcgaattgaaaagtaagtgaccgacaaaagtggcaattgcaaaaataataatttaattttgtccactgaacataattaaggaccttaaatgcatgtggacgattggcattcttaattattgatacatattatgtatctcccccctcacgacagatgcaaatctgtcgagtcgtccttggccactaactccgcaactgtgtccatcattattgtgttccacaacgaggcatggagcactttgctgcgcacattgcactcggtgctgaacagaacgccgttgcatttgctggccgagattattctcatcgacgacttgtccgagcgcagctatttgaagcggccgctggagctgtacacacgccgtttcccattgcctgtccatctgctgcatttgccccagcggtcgggactgattcgagcgcggttggccggctcagcgatgtccacgggaacagtgagtgatgatttttggattttaaatttattcaacattttcgttgtccaaggtattgctgttcctggatgcccacgtcgaagtgtccatcggttggcttgagcccttggtggatcgtgtggtcgacaatcggaagcgtgttgttgcgccgatcattgacgtcatatcggacgacacttttgagtatgtgaccgcctctgataccacctggggcggcttcaattggcacttgaacttccgctggtaccccgtgccggaccgggaaatgaacagacgcggctgggaccgttcaactccaattcagtgagtattttgcgtgattcgaattcagagaaatgggtcgaaatttaaaattaaattgaaaattgtcagaactccaacaatcgctggcggtttgttcgcaattgacaagaaattcttctacgaaattggctcttatgaccaaggcatgcaggtggaaacatcaaattattcactttttgtttaaaaaaaattgtttcaacaggtttggggcggtgaaaacctcgaaatctcatttcgggtgcgttttctccatcaattggctcatttacggtggcatttttaggtttggatgtgcggcggcacattggaaatccatccatgctcgagagttggacatggtaatattacaatttattttttatttaattccataaatttactttttttgtttgtgttcgttcagtatttcgcaaacaaacgccttacactttccccggcggtactgccaaagtgattcatcacaacgccaagcgaacggcagaggtttggatggacgaatatgcacagtttttctacgcaatggtcccgggttggttcagcgtttatcttttttaaattatattattatttattcgatgaaggtgccaaacacgtcgaacttggcgatgtgaccgagcggaaagaattgcgccaacggttgaaatgcaagtcgttcaaatggtatttggagaacatttacccagaatcgccggtgcctgccagttttttgtccattggacaagtaaaaaaaagaaaatgcaatttttttaactgctgggccaataaaacagataaaaaatcccgagacgcgtctgtgtgtggacacaatgggcaaaaagaatggacagcccgcgggagtgagcggatgccacggcctcggcgggaatcaggtggactttgcttacaatcaaaagcaaattgctggtcagatgaggtataaataaatataaaacatttttgaaggcctgggcatacaccgaaaggggcgaacttcggtcggatgagttgtgtttgtcgggcagagacagtgcggtgagaatggacaaatgcgccagcaatggacacccaatgggcaaacaacagttcaaatatgtgccatcggtggggcatttttgggcgggcatttgggttgactaagttataatcgcgacatgttccagaccaaacaactcgtccatgtgaaaagccaacgttgtttggccgtcgacccttcggcttcgtccccgctgagtttgaaggactgcgagaagaccaaattcgagcatgtccagtgggagctgcacaatctgacatttcgctctgatccgctctctccgccgggccctccggcaccagcggcggagcggtaaacggcacaaagccaacaaataaacacaaatcgggtaaaacaaacgacaataaaagggggagtctattttgtttgttttttaaaacttatgtttggtgttgtctcaaatntttcccatatntttcaccagttttctcgacctgcagnngcatgca

SEQ ID NO: 2816 - DNA, 2467 bp, Heterodera glycines
acataacccgcaccatttggcggtgtttttatgtgcgttcggcaaaacaccatacattggccgttgtgaattcgatcactgaattaattaattaatcagttaattatagttttcatccaattagagttccattttgtgctcacattccttcctgacgacaacactcggaatggtccacttttgaggtggcgcagtcgaacgctttgctcagctgagcagacggacaatgggagccgagcagagcgattagcagctgaaataacaaattatttttaaaaataaaaatgccattgctttttcgatttctccaccttttcttgagtgaaagtgtcgaaattgcaaaactgttggcacgtggagggcaactgctgtttctgacagcacagctccaatttggcattgggcgtcatcagtggggagactgtgacagcagcggaaacagtagccaatggaaggtgcggtactgtagccgctgaattgtgacatatttgaaattcagagtcaaatggaggcgtttttgtgcgttgggggaggggtcggactttgtgtcgctttttcgcgttttcattttgccatttgccttttctcccatttccattcgctcctccgcccattttccactgcaaaaccatccgaaggaacaacgggagatggaaacattttgcctcttcccccccaacacacataaatacatatctctccgttccaatctaatcgctatttttgcatttattggccggtgagcagcaaattttttctcatcccccgccgttaaacaaattgtcgtctcctttccccaccgctcattccctccgccccctctccccctcatccttttattttactcattttttctccactctgtaccttctttcttagttcaaattccgataataaatcatttttacaattttaaaaatgctataagtaaaaaaagaaatacttcaaaaatgattattttttaaaacgatttcattgatttcgaaattcataaaaaaaaaattgcgtacataaaagaaaaaaatctgagcatttcaccattccaactttttctaacactttgcccgcttatttttactcgcccgtataaacttaacaagcaaaacaaattttgattgttttttataaaaccgactagaacctcaaattcttagtcaacattttagaaaacccacttatcagtttttaactttccatttccaatgactgccccaaaaactagaagacatgtctttacaatatttctacgtacacaaaatacaggaatagcaagctttagtaatttattaaacgacgatgtcttcgatggaatgttatcgctgtcgcgagacgggtcacattggtcgcgactgtcctaacagtggcgggggtggtggacgtggtggaggttagtaaacgaatagtggaagattcacatccgttctatttaggaggcgatagcgtctgctacaactgcaacgagccgggtcacttctcgcgcgaatgtccgcagggacgcggagggggcggcggcggatcgcgcggtaaaacatcaaatgatggctggcagaagaatgccaaaaattggaattcctcgtaggtggtggaggcgacatcgtctgctacaactgcaacgagtcggggcatttctcgcgtgactgtacgcagccgcgtggcggtggtggcggagggtcgcgcgggggttcgtttttcagcttcggaattattttcaaccccatatatatattaaggaggcggtgacaatgtctgctacaactgcaacaaaccgggacatttctctcgtgagtgtccgaacggtcgcagcggtggtggtggaggcggcggctcgcgtggtattagctcattttccattcactgggttacttatactgttcatttccttaggtggcggtggcggcagtgtttgttacaactgcaacaagcctggtcacttctcgcgcgagtgcccggacggacgtcgttagcggcgggagaagagaaggcgattgacattggtggaattattgttcggatgagagggggagacatggcctttttcgattttttttgcaaacccatcatcacttttccaaccattgtttcagtcatcgtgccatcttttgttttgttacgtatatataaaaatttattggccgaatcttgcttgcaattccttgtttgactatggttcaactcccctactgagtgttatttcgtgttccacctgtttgaatttgggttattggtgcttgggagacgggacgacgtgcatttgatggcacaaaaccaatttcccttggcgcggtgttcacttgtttatttaattgttgtgtttgcgtagcgtggtgaacttggtaaggcagaaggcgtgggtgatgagtttgcccgtggttattgtacgtttgtcctttcttgtatagttttcggtacgacttgaactccgcgccaccaactgatattggcggattgagaaggtcgaaatcggctg

SEQ ID NO: 2817 - DNA, 4061 bp, Heterodera glycines
aaaataaaaaaaattggggcacgacgagacgacctgagttttgtgccatgtgaccctccattgtttgaacaactttgccggaagggcaatggagagggttttggatgggtccccccccccgggcattgtcctctctgtgccgccgtcgtccatcaaattttggcacccttcgccccccccccccccgggcatttcacaaatgtcccccgggggcagtgccatggggctgggggcattggcgtcacaaaataatgctgccctggggcgacacatttacaattcttttttttcgccttgtcgtcatttttagcaatttctgtctgtctgtccatcgttatgctcctctcctttacatatgtaatgaggcccttaataaatcatttatcatctgcaaaaaacttgtcaagacgacacccaccggtcgggtctcgagactcactctcgaccccgtcaaatgcctatgttaaccaagggaattgcttcatcatatttgttgcttcttatgttgttgaccccattaaaattgttggctctagctagaacttttgtgttggcagcttaaagtttctttttatgtttggcgtttttcccgattttctatagggccgtttttgatttacatttatgaactcctaaggacctggaaagagaacgagatcctcgagttttataataataatttatacgcaaagcgtgacgccgccaaaataaaaacaacaataagataaagcaaaatggtcacatatgagagtggttcataaatgtgtaaaacgtcatttttggattttttaagggccgaaccctaaaagattttatcctattttggcattaacttagatttcttaacgaaaatgtcaataaaaaatttgtaaattttcagaaaggttgatccaaaaattattttttaaaggatttatatttaaatgcttcactaaaatccggaccgggtcagtttagtacggccggtttagtacggccggtttagtacggccgttttagtacggctgttttagtacgagggtcggtttagtacgagggtcagtttagtacggcaaactgtttttgtccaaaatagattctactgattttttccgaaaaaatgtttaaaattaataacataacatatttatcaatgtgttaacaacaacaaaaaaataacaagcattgaaaaattacgggcgcatttcataatttcgagaaataccaacgagcaaattgatgatattatcgggattaacattggcatggtaattgtggtcattttggatagccgggttattgttgatggcattgtagccctgcaaaagtcgaagaattctggcatcggcggcacgatatttgggcttctttagaggagggacttcaccagcgatgcatcgggcgatgtctgcatcaattgacttttctcatatcgaattgtgttgatgaagcggaaaacagttggatataaacaagcaaaagcccgttgaatgaaaaaaaaattagggtttactttgcctgaagctataaaaaggcggtgccaaactgaaggtttcgctttgtttttattttctaattgggatattcatttatattgtagctaaacatagatattataagtttttccttctttataattgacaaaataaacatttgtaacagttatggacaaaaacagcttgccgtactaaaccgaccctcgtactaaaccggccgtactaaaccgaccctcgtactaaaacggccgtactaaaccggccgtactaaaccggccgtactaaaccgaccccgaccgactaaaatcgccttctacccgcattttaggtgccacttggcgttttgtattatattgccaaaaaaaatcaattagcagtgctaaactttcaacaatttctgactcaagattagcaaaaacaaaagtagtgaaagaagtgccaaatttggtgtcgtttttttgccggaagggtttttgtgtgccgccgcccatttgcaaatgaatggcattttggcattccgttgtccccttttttagcaattcaaaaataaattttcccacaataggcaagggaaaaaaaacgacaacaacagaaaatctccattaaaatgaaaattccatttacaattaggagaaaaacattccaacagaaaatggaacaattttttgttctttttttaattttatttcatgagaatgttacgacaattgggaattattggcattttgcggcggcatttttatttcctataattttcgataaatattttcgggaagctccggcagtgccggctgataggggttgccgggaaaaaataaattttgaatttttttttctttgccttttccaaaaaaccacaaattagtctcattttgaaaatttagccttgttggcgcctcgagaaatcacaaaatgaggctaaagcctcaccatgctgggtcgtttcataaaaactcgcaattttagcaatttttcgacaaaacatggcataactttgttccatcaacttatattaaatttgataatttatttgaaattttgcaggctaatagagaaaaatctctgctatcgaaggataccaatacttttaagcaaacttatgcccatatttgttcgaaaatagctaaaatgccggattttactaaacgacctagcaaaaagatcttttctaaatctgtctgaccgattttaaaacggtctttcacagcactccgttaactgcactctcattcttccacactcttactgcgtttctttgtttctttattatttttactgagggacggtaactcaaaattttatgctttaaacctaaagcttaggaccgattccctgccaacaattttcttataaaactccctataattgatccaattctggttttgttttttgttcctaattcccaccattatgccaaaaattggcgcgaaattaagaaattaaaaacgcacataaaaccaatttctcgcgttccaccgcattccgccgtggggcacactttttttcaacccaaaaacaaacattgggccgccctcaatttttgtgggggagacgagggcatttgatccgccgctgagcgtgcgcgatcgaacacacaaaagaaaatgtgtcacatttttaagcagcttcttcttagcacccgctcgctcccggcgggcgacgagaatttattttgtttttctcggagattttgtgcacctcaccggacccgaagggggcaagagccgaaatgatcagttcttctgatcacttttttttacacttttcacacaaaaaaaaatcacacccacactctggcattctgcgtagttgatttgataagagcttttttcgttttaaatcgcatttgcattagaattaattaggtccttatgatcagtgatcattctcgaactaaacagatttttacatttttgatcagtccttctgatcattggattgattcaatcgctctggttacggttaatggatttattaatactaattttttttattggttgttaattggctataattagggagacgaccgtaattcggaatcccacaatcaaagtcattaaaagcaattagggtccttttgatatcgcactttaacacccactgaaaatttaactcagaaaaacaatctgcatgatttatattcattatcatatttgtctgcacaacaattaatttgcgtcacctgctgctgcggcgccgctcgccaccccaattgcataattaacccttaattaccttcctaatgtcttccgcgtgcccattccaccagaattgtcgcgtgcgattgccacccgcggatgaatttgtgcccgccgatgtcactgctggtggcacctcagcgaaatcagcatgcgctgtgatcgcctcgggcaatgccacgctaacctttgctgcccatccgtttgccaccgatccgcatgccagtggtggcggaggctacgcgcggcgcttaaccagccccttgcgggcgtttggtcgtcgtctgcgacaacagtcgaccaccagcagaactgtggatgatctatttgcggaagaggatgccaattctgccactgtcgatgcggccggcataagtacgcctaagcg

SEQ ID NO: 2818 - DNA, 2645 bp, Heterodera glycines
  misc_feature (22)..(22): n is a, c, g, or t
gcagcaccggcacggctgcacngacgacaagcgatgcggcaggcaacggaccgccggctttgagcagtccacgctgcgacaacgtctgctcatcacgcgcattcagtggtcaaaggatctgaccattgtgtcggcggacgatgaagcggagatgaagccgaagcagcaaaaactggcaaggattgaatggacatcggaggaggaggaagaggacgaggaaaagccgccctccggggatgaggcggaagcggaaagcagtgaggaagaggaatacgcacaaaaacagcaggcgaaagaagtcgaagttgtacaccgagacagggatgaggaggaagaggaggaggagccagaagagacacaattcgcttcccatccgtcggacgaagcgctgctcaaaacgccggaggcgctgccgtcgaaggcgggcggcccaacgaggatgtccaagagtcgctcgttgcaggagatgattcgccactactggagcttgggcagaaaccatggcacaacatcagcaacaacaacaacaaatgcaaatggcggcattggcacgccaaaccgaaatgaggtgagtgaagagatgcatacagctaattgggctaattagttatattaatttaattaattaatgataaattaagcttctcttttgtaacaaagaattttgctagggtcaaaagggttaaagaaaagtgccgcttaatattggacatttaggcgtgtgtttttgttctaaaatatacctaaaatcacactcaaatttcaggagtttccagtacaactaaaatggttgattaggcatttatattttatcgaaaaattccagaataatgacaaaatccaaaattagaaaaaatatacaaaaattcgacaaaaatcattcaaccatattatacaatttacgtatttaaaaaatatattaaatatagaagctagaaaaaaaagttaaaatttcagttttgctataaacattcaattttgttaatgattcagtccctatcccaacgccgtcggtcccggcattgtgccgccaccgctgttggcatttctgctgccgccggcagtgctatgccacgtgcgcgttccaccgatgagcgactgttcgctgctttggccagccacacacagcaattggtagtttccggggaaaacatggtctgcataggtgtgctgtttatacccgagatttcggtgccgatactcaagactctcgagaccgacatcaaccccaccacttggccacactgaccgtgtcaaattcattttttcaatcaaacaaattgttttttttgttgatcaaaacacagtatcttacaatttagggaatattaaaaagtcacaatatttagttatgagaaattgagattaaaaatgtgagaaaagaccctccaaaaaccccaagaatttcttagtcgagacttgaaattatagtggcaatttcctgggcattcgaactcaacaccgatttggtacttcaataaacttgagcattttttcttaacccgaaatccgatacagagacataattaaatattttttgtatacaaattaaaatctttaaaggagggagaattaaaattaaacattatttaaataaaggaatgaatacccatataatttttataattttttaatttaggtgatgccccagtttctgtaccttcgttcctcccacagcagcgtgttccaagcaagtgcgtgtgaggcgattaaaacgcgcgcgcgattgggctttttttttttggttaacattgcttattgctattaccatactgtaagagacagtaagtgcaagtgacacacagtatgcttattggagtcatgttatgcttgttctattaatttcaatcaaaaagtttgaaaatattatttaagctccccaatttgctctccatcattaggggatcaacaattatcgcctcaattgatctaaattaatcttcctttcgggaagcttcttctcgagctgaatttccgaaccttttttgtccgtaacctttttgaaagagaaccaacttaattataatttttttttaattttaaataatcgagcaaagttttttttaattttttttattaatttttcagttttttttttgttgcaattttgttgcttttccgaccaaatttcccgttgaattacttccctattcctcgggattggctctcgagttcaatttgaagtgccgacgaccatagaataataatttggtggactctcagccattgtgcataataattaattacgcttttcaataattccatgccactcccgcgaattaatgacgccgagtctcgagaaaataattttattctctcgaaacacaatgccaaactcatgcaaaaatgcttttcctctcctcatttaattcaatattcaaatttattatttaaaaaaaatttatgtatgacaaatttgatttcattctctcaccaaaattcttttaaaaaatttttttattttcgctcttatccgtcttaaaaaaattttctttttgatattccaataaatattcgttcacaaaatgtttcatattcgacattatttcgtttattttaattttattccaattgttttaggctattaaatttcttttcgaataattaaatccccccccccctccattaatttgttccttttttta

SEQ ID NO: 2819 - DNA, 1065 bp, Heterodera glycines
ctttttgtgaaacttttgaaaaaaaatttgttcatataaaaaaaatttttgcaattgtctaaaatgctccttagtcattgttttggttttttaaagtcaattctgaattttttacataatttttagagctcgacattttgaaaaaagcctggacctggattccatgttggacctggacctggatttcctggacaaaaatccaggaaaatccaggctcctcgagacctggatccaggcctggacctggattttttgaatttttttttaaaaagcaaataaatgtttgaaaagatcaattaattgcttaggaacacataaaaatatctattatacaataataatatgtttttaaatctatttaatcatttttcgaaaacttttacaaaaaatcgctgaaaaatttttcaaaaaattaattttgaaattttttcttaaaaagttttgatttttttctaagtttatagttaaatcgattttaagaattttatggaaaacataagaaatttgtaaatatcagtgcattcagaatcaataagaaatgcttttttttgcggcacgcttcaaaaaattttggagacaggggctcggcgaaaaatttgtaatttttaatgcgatttcttaacgattttgttcaaaaaatgacaacattttacgattttgagccaattttttttaagagaataagaatttttagggggcggtgggaaaattttggcagattttatacccattttaaatacatttagccataaaaagactaaaaaaatttatccaggaaatccaggttttttgagcctggacctggacctggatttcctggacaaaaatgcaggaaaatccaggtccaggaaaaatctaggttgccgaaaaatggtctggaacctggacctggatccaggaaaaatccaggcctggatccaggtccaggtcgagctctaataatttttggcatttttttgaggattcaaagtcattattgctagtttttaaagcatattttagtgcatatttgggcatttttcgggtttttagggcatatttgggggatttttagtgcatatttta

SEQ ID NO: 2820 - DNA, 3901 bp, Heterodera glycines
cgaaaccgtcagtcgaagaagacccatcaaaaccgcgtggggacggcatcatagggcattcgggtgggactttcgattcggcatgtccggcatggaacgaaacattcaacaaccattccatgggtaaatcgctcatcttcgtattcgtcaaagtcgccgtcttctccgttcaagccattcggtgcataaatgggcaccggcagctaaatacccatccgattggtcgcccggagtggctttcgtcgccgccggtgccgatgtaattagcagatgagctgctctcaggcaataactgtcgcgatgatatcccaggcatattttgtgcatgaccataatattcttcattagggtattcatggccgtaataatcagtgtgagtttcacgagcccctattggacgatagtttttattcgtcagcacatctttagtgctttgtacgcaattggataaatttggtatccatcgttgctttaatttgttaaatttgcttggcttttttggccgaatttttgtaacattttcttcgccataataattgttttcgattcgagctgttggttcggaaatgcttctggtatgtgcaccatgaagagtcggactaaatttagaatcttaatacactaaaatttagaacccggcaattttgataggaatggttgggttttttttgaatctaaaaataagttttttatgtaaacataggatttgatcactagggttggcagttatatctcatgcatttctttctggactatggatgtctgaaaaaaagattttatcttgtttaagcttctctcacgaatttccatttgcatatctgcattatttacgaatttgcatatttcgtaaagaaattgtagctttattatattttttctaaatttcataccatatttgtcatttattcttgtggagaaatttaaagctactgaatgatccacgaatgtaaaattaattggcgtaattttatgattttatttttaattttagtaccacttggcggtttttactaacgtcctgttgggtttacgaaaggacctaacacccttgaaatcagcatccatgcgtttgaatactcagttaccatttaaaacagggctatgaatataaggatttaaacgcacgcattttatgagttagatgggcttagcttaaaaatattttgtgcgtattttagtgacaaattgtgtgctctcattggctcccggacaatccgacagtggacaatccgacagtggacaatccgacagttggacaatccgacagtgaggacaatccgacagaagtggacaatccgatagtggacaatccgacagtaaatttctattttaaaaaatattttcaagtcattagaacggattatttcctaaaaatatctcaatcaaatcaatttagcttaaatttgttaccaaattaaaataagttagtttggtatgctggtaacaaaagtacaataaaataaaaaataattaaagataagtgatccatacaaccataaataaataaatatgcaaaagtaaatgtggagtgacccataaaaccaaagtgatgagaaatgagagcatttttgctgataaaaatgtttgccaaagtcttgaccattccgtttacctcttcaaatcattcattcattttattttattttatttacgtgttaaaggccctcttaggcgtatattatgaaaaatggcgaagaataaaaatttttaattcctttttaaacagacaaaaaagtttaggcttaactttttttcagaaactgatcagaagcgcaccaaactttgcagggacatttaaaggacgcgaaatacctattttaaatagtaactagtcatttccttttaataattttttttgattgagatatttttaggaaataatccgttctaatgacttgaaaatattttttaaaatagaaatttactgtcggattgtcctcactgtcggattgtccactgtcggattgtccactgtcggattgtccagtcacgctctaaatcattacttcccctttttttttaaactcgtgtggcggggtgatcggaagaggcaggtcattcagtacggaagtttatcgaataattaaattaattaggtaattaagtgataatggaatataatctaataataataaaaatgtttggctcatatctgtttgcacgaccataaaaaaagaacgaccatataataatttatgacccgcttcttccgatcacctcgcacacttacttttttcgattcggctcaccacggtttgatcaaacagtttgctcaaaattcgagttttcaaataattggtgccatcttttgcacccctatctttgtaaatgttgtctcgaaattaatttttgacatcccttaattttttcatttaaatttattctcttcgttttgtttatctgatctaatttgttgatttgctgatttatcttattttttaagaacgattttcggtccaaattgccccaattagtctcaaaatactcaaatgtataatcgtcgccggaccctttcccatcggcgaatgccaattcccatcccaaaatgtccttccggcgattccgttggtgaattttttggatttattgttcgatcaccttcaccccattcgccaaatgctgtcgaagcagccaaccaaggtgaagcaattaagttcaattaaatttaataacttttttcattaaaatatcataattttaaaaaagtgctaaaaaactttgtattttccgtttatccgtaaatttactagttttttctgacgaatacagtaaaaagcccgaaatgatggcccataatggtggtggtaattactggttttaccgtaaccgttaccgttaccggaaagtatcatatttagaattattaaaaaaagcatttttgactaaagtaatttgaaatattttcaaatttatgtttcttcagcgtatatgtatgtttcaaaatggaattaaatagcacagcgccgcaggggcaatgcttgttttttaggctattcattttgccaaaatttaaaatttgacgccccccgcccactctctctctttttctgccacgccacataaatcatgtgctgttccaatataaaaatgaacctacgtacgtacgtatgtatgtatgttagtataggtaggcccaaaaaaattggagaggaaggaaaattttaattttgtgcttttctcatctttcctacatttcctgtgccctccctgccccccccccccctccgggggcattttggcccatccctttcgcccgccgggaacaacgacaacgacagcaggggcacaattggcatgccccccgctcagttacctcacgtagctggcgaaaatttttgttgcctctctcacaggacaaacaacagcagcagaaaggctcttcaaggcaaaagttttgttcatgcacccgtcttgaaacagaaagcatagagaaagccccgggaaccattgccaaagatcaaagcgtttctttccgccgctattctcttcccggggcaacaacagttggcactcggtggccccccttagcttggcctgcctgccctcccggcttaaactgattgctgatcaaatcgatcgatggcaatcgatcgggcccgaggcggcgagggaggggggggggggggggggagctactgcgttgccggtcgtggcgccatttccccgcttcccattctcagctgttgaaagtgattggggaagagagtgtgtcccaccactgattgccccccccccctccggggggagtccaactgattggcccctttcacttccattacccgcccccctcctattcttgacactctcgcggaggccgtcatcgatctgacggcagagcaaagagagggctaacgcaaaaagtttatcccttgacactcctaaacaagaatcatccccttct

SEQ ID NO: 2821 - DNA, 1421 bp, Heterodera glycines
cagcagtttctttccgtgccggaaccgtccgcttccggtgcgcgcggtggtacgtgggcgatgtcatcgtcgccgccatcctctgtcgcatccacttcggcttcacccatgctgcagcagcaccgttcatacgccgccatgggtggcggttgggtgtcgcagcccgcgtcaccgatgattccgcgcgatcgcccgtcctcactgctgttaccgcctccaccgttgttcagcgccggctcatgctcgccactacccaccaccaaccattatcatggcaatgatgatgatgatgatgatcaacaggacgctgcggctcagcaacgccgtctgcgtcaacagcacgcggctgcggttcggtcagagccgaatgtgtgcggaagcggcaagcagcagcaatcgatgctgcccttcttacgctcgctacgtcagctgaagctgttcaagcggcgcagtgcgtctgagctgtcgctggtgcttgaactgctccgaaatgttggcggcggtggcgacgacagcaacggcgccatggtcaatggctgcgccgaagatgcgaatgggtatgacagcagcgccctaacggatgacgagcagcagcagatggaggcgggcgacgacggcggactgtcggcgcggcaccggcatcgccacaatgctagccagcgctatcggcatcggacagcatcgccagtgccggccgccaccgggtcggttgaacgtattcagcggcaccacacgactgtccgtcgtacggccacaacattgtcgcgtcgcaccacccaacgcagtcagcagcggcggacacggcgccgtttcccatgggcgcactattcgcccgccgccatccagcgtcgttttatgaatggtcggtggtcctccaattagatgcaggctgggaacggggagcgagtagacggggcaatattgcaggcaaattacgattacggtattttggtagtaaaaaaacacattttattttttctcaagagcttattcacaaatttattttttgttttattttttgtaaataataatgtctaacttaagccctgttatttttaattacaggttactgattttttaaggaaatccgtaattatggattacggatttccgtaattaaaattccaattatgtgcaacctttgtacggggaagggccaaaagggtgttcggggcagaggggggcacccgaaacggacgggcctaactgcgtcacaggtacaaatgtgtactttattcttgtcctttttctcgacattggtcttgtttcattttttaaaatctttttagcgttttcattttttaatggatttttttttttgctctttcgataaataaagaaaaagaacaaaattcacacatacaaaattagctgacgaatatatggtgttgacacaaaattttcagcgtttaaaatcaaat

SEQ ID NO: 2822 - DNA, 1542 bp, Heterodera glycines
  misc_feature (34)..(34): n is a, c, g, or t
ttttatagatgagctcaactgagcactcaccgcnccagaaaagtctcatttttttctcaatatttttggactttccaaagcaattatgatatgaattcaaccggaatttttatgccatgacaaagaaacgacacatgttgtgggctcacacatgcttcgaagctttcaagtaaaaatatggcatatagatttagagaatccagtcgatgaatttcatatgattcaaatattcttaaactttttggatttttaaataagggagctcagccatttcaaagtttccacttttatagatggagctcaactgagcactcaccggcccagaaaagtctcatttttttctcaatatttttggactttctaagcaattatgatatgaattcaaccgaatttttatggcatgacaaagaaacgacacatgttgtgggctcacacatgcttcgaagctttcaagtaaaaatatggcatatagattttagagaatccagtcgatgaatttcatatgattcaaatattcttaaactttttggatttttaaataagggagctcagccatttcaaagtttccacttttatagatggagctcaactgagcactcaccggcccagaaaaggctcatttttttctcaatatttttggactttctaagcaattatgatatgaattcaaccgaatttttatggcatgacaaagaaacgacacatgttgtgggctcacacatgcttcgaagctttcaagtaaaaatatggcatatagattttagagaatccagtcgatgaatttcatatgattcaaatattcttaaactttttggatttttaaataagggagctcagccatttcaaagtttccacttttatagatggagctcaactgagcactcaccggcccagaaaagtctcatttttttctcaatatttttggactttctaagcaattatgatatgaattcaaccgaatttttatggcatgacaaagaaacgacacatgttgtgggctcacacatgcttcgaagctttcaagtaaaaatatggcatatagattttagagaatccagtcgatgaatttcatatgattcaaatattcttaaactttttggatttttaaataagggagctcagccatttcaaagtttccacttttatagatggagctcaactgagcactcaccggcccagaaaagtctcatttttttctcaatatttttggactttctaagcaattatgatatgaattcaaccgaatttttatggcatgacaaagaaacgacacatgttgtgggctcacacatgcttcgaagctttcaagtaaaaatatggcatatagattttagagaatccagtcgatgaatttcatatgattcaaatattcttaaactttttggatttttaaataagggagctcagccatttcaaagtttccacttttatagatggagctcaactgagcactcaccgccccagaaaagtctcattttttctcatatttttggacttcctaagcattatgatatgaatccaccgaattttatggcatgacaa

SEQ ID NO: 2823 - DNA, 733 bp, Heterodera glycines
  misc_feature (250)..(250): n is a, c, g, or t
  misc_feature (372)..(372): n is a, c, g, or t
  misc_feature (379)..(379): n is a, c, g, or t
  misc_feature (590)..(591): n is a, c, g, or t
  misc_feature (614)..(614): n is a, c, g, or t
  misc_feature (624)..(624): n is a, c, g, or t
  misc_feature (634)..(635): n is a, c, g, or t
  misc_feature (639)..(639): n is a, c, g, or t
  misc_feature (644)..(644): n is a, c, g, or t
  misc_feature (658)..(658): n is a, c, g, or t
  misc_feature (661)..(661): n is a, c, g, or t
  misc_feature (663)..(665): n is a, c, g, or t
  misc_feature (669)..(669): n is a, c, g, or t
  misc_feature (671)..(672): n is a, c, g, or t
  misc_feature (676)..(676): n is a, c, g, or t
  misc_feature (681)..(682): n is a, c, g, or t
  misc_feature (684)..(684): n is a, c, g, or t
tttttttctcaatatttttgtaatttctaaccaattataatattaattcaacaaaatttttataacatcacaaagaaaccacacatattattatctcacacattcttctaatctttcaaataaaaatattacatatatattttaaaaaatccaatctatcaatttcatatcattcaaatattcttaaactttttaaatttttaaataaactaactcacccatttcaaattttccacttttataaatatanctcaactcaccactcacccccccaaaaaactctcatttttttctcaatatttttaaactttctaaacaattataatattaattcaacctaatttttataacataacaaagaaacaacacatntttttcnctcacacatccttccaacctttcaactaaaaatatctcatatagattttaaaagatccactcaataaatttcatataattcaaatattcttaaactttttggatttttaaataagggagctcagccatttcaaattttccacttttataaatcaacctcaactaaccactcacccccccaaaaaattctcattttttggtcaatatttttnnactttctaaccaattataatatnaattcaaccnaatttttatnncatnacaantttttttaaagatnttntnnnctcncnncatncttcnnanctttcatttaaagattggcatatagattttagagaatccagtcgatgaa

SEQ ID NO: 2824 - DNA, 2188 bp, Heterodera glycines
gttccgtctcgccagttccgtctggggccggttccgtcttgggccagttccgtctggccagttccgtctcgccagttccgtcttagtactcaaagggccggttccgtctcaaaaattttggacccaattaaatttaattttaaatatcagtcaatttgaatttctgtttatttgcaaaagtaaaataaaattttgaataaataacaaaatgctaaaacaataataatcattcattccatttgataattgctggaaatcccctaagcatttcattaaacaaattcggattattttgattttggccgtattggtgatcatcgttgatttgcggctgcgctttttcctgattgtagcgcttcagaatgctcaaaattcgtctgtccgcttcacggtaacgctttgctttcagcggcggagcatttccggcgaggaaatgttcgaagtccacgtcgattaatttctgacgctcgcgcaaaatgttgataaatttccatattggggggtgtccatgtccgatcgcatgttgcaacgttcgatggtatgcttcggcgaagttgtttgtgcgatcggagccgttcattgttcgctcgtacacactccattcttcgggacgaaacaatggacgagtgcgtgtgccgttgttgcgaagccgtccaacgtagttgattatgaacctttaaaattaataaggaaattggaaaaaaactcaaccaaccaatcgagaacgccctcaagttcacccggaagataatcttctagggctgccagcgccggtgtaaggtcctcaagcggcacaaacgccagcgaagtgatcattttggcagcttgtgcaaaggctgcgtcggttgtgaagcgctaaatttgagaatttcaaaatcaataaatttatttttcttacgtgagtttgctcgtcggtaagacgtgatttcatgttgcgcaccaaatggaataggcaaaagttgattgagcattgtggatgttttgcacggagtgcgttgaccatcgcctgttcgaagtccatggacgcgtttgttggtgaaaatgtcggccagcggttgcggaccatgtcaaacatcttttcgtacgtggactgcgacttgcacgtcagcaggcaatgaaggaccggaaacacccagccaccacgactgaaatttggtgaaaaacgaatgtaaaacaaaattgacaaaaaagtaccccgccaaaatgacgtaaagttgtgaaaagagcgttggtgcacttgcaaaggttccgtcagcgtaaatgtacttcatttcggaagcccaatttccgaaagaaagtcggccaaaaatgagaattctaaaattaaaaaatggctgaaaattccccttaaacacaacgctgttgtccgtctcgcccattttcggtgtatgttcctgaatccgccagaaggaaaagctcctgcgcttcttcggtgcgtttgtagattcggtactgctcgggaagttccaattcttgaagcgttaacggcactggcggcggcaattcaatttcatggcggactcgcttcacaagcttaaaaccaaaaatgtgaaaaagtaaaaaaataaatagatttttcactttttttgtagcgttctttgttggaatgttcgccattactggcgtcggaatttgctgaagcgtgtgtgccctgattgaccacggcaatcatctgctaattattggtcccacaaaaaaatgaaaataaagcactttttagactttttggtcatttttcctcatataaattcccatcatattgacttaaaatccatcgacaactaaatttgaatcttcactatatatttatcaactgattggttttcagcgattttttgtaaaaatctttgaaaaacttagtagttcaccataaaattctgaaaaattgctgaaaagtttttcaaaaatttttctggcattttcttacgaaaaatttcctaagtactttttgaaaaaattcaatttgaaatttttttaaatttttcgggggtgtggggaaagaccacggggggagggaagaccagctctgcaactgattgtgagcatgttggtaatgttcctttttgtatttccttcaatttatttatttgcgcttccatttcatcaattctggccaaatgtttagcaaattgcccaatacaaactgaaaaagagtttattttttattgaattaattttatgctaattg

SEQ ID NO: 2825 - DNA, 2962 bp, Heterodera glycines
  misc_feature (54)..(54): n is a, c, g, or t
  misc_feature (60)..(61): n is a, c, g, or t
  misc_feature (1840)..(1840): n is a, c, g, or t
  misc_feature (1853)..(1853): n is a, c, g, or t
  misc_feature (1887)..(1887): n is a, c, g, or t
  misc_feature (1924)..(1925): n is a, c, g, or t
  misc_feature (2897)..(2898): n is a, c, g, or t
ttgtgcatgtgagtcgcatggggacgggagtattcttctttcagagcaattggnggaaannaaaaaaccagcggcagctgttggacgcattgatctcagccaccgattgaatgggcgaaaaattaacgaaccatttgggaataggcaaatggaatccagcagaaaccatttgacttggttctatcagcaagcaatgaacgcaacatttcaatgaaatttgagttcactgataatcggaaaggaacatcaattaagagaacaaacgatgcaacacattgatgattgagagctaaagactgactctgcaaaaaaaagacatcttttctaaatgttaacaactaaaaaagccatagaaagcgccgtagggggagaatttaattttcaatttagctggaaaaaatacattagagaattcaaatagtacggacacggaggcgcgaaagagggcctaatgcaacagaaccggtgtctctaaattgcctccgtaagggacatcatttgcgtgaagtgtcgctaaaatcagttatgccgtttatgcaaacaacagcttcatttgaggagtttttttttgcgcatgccgagaaagctaagcatagtccggaggcaaaaaggccgggcgaatgggcagagtcagagacatttgtttcttctgccgtggttaatgacagcgaactgcttccgaactaaaccgccctaccacatgacatttcattcataattcagcggtaaaagacaatgaatgcaaaccaaagcaacgaccttcggtccaacaattcggcacttatcactaagttagaataaaatgccaaacaagaaccaatcagaaggcttttaacctgctcgatcaacccccccccccccccccacagtgcccaagccacgaaatgtccaaactacgaatcccataaagccacgaataccccggccaattgttaagatgcaccacgcaatgcaatttgtgaagttgaaactagagaccggaaatttcaaatttgcggatcctgttgcaggattggaattcaaaattttttacaggacaggatccggcaggattaatcctgcaaatcctgcattttaaatctgcaggatcctgcgcaggattgcggattttaggaaatttcaaaaaattctgtattaataaaaaagtttttcaaagtataaaaaagtattcaaatatatttttaaaccaaaaaatgatgaagatgaaaaattaataacgtttttttgcttacactccaagcaatcgactgaatcttctttaatgcgtttaaaaagaccgatttgccaaattgggtggctcataataatagcttaaattaaagtaaaataatttttatttaaatttctttgcaaaaaagccataatccattatgtatagggatgggatttttaggcacaaaaaatcgcgaaataggcacttaaaaaggcagaaaaatcctaaaataggcacgaaaatagtaaaaaaaaattttattaacgctttttaggtagcaaaacacataaaaaattcaattgtataaacttttttcgaataaggataagtttttaaacgaaaaatttttattaagaaaaaaatttttgaaaaaagaaagtttctgaatatttggcattctatttttaaaaattttcaaaaaatcaatgcaggatcctgctgaatcctgcataaaaatcaaatttgcgggtcctgttgcaggattggaattcaaaattttttacaggacaggatccggcaggattaatcctgtaaatcctgtattttccaaaatatgcaggattgcggactgggatcctgcaaaatcctgcgcaggatcctgtcctgcgccggtctctacaaataatnacataattttcanccaaaaattaaacaaaaatattttttattcactnattccaattacaaataaataccactcccctttttaanntcaaaaaaccaaaataattacctaaaaaaataattttttaaattagaaattcttgccaagaaaaggaatttttgataaaatttttttgatttcttaggagtgatttttgaaattttttatgtcgattctagggtgtgtattttttgaaaaaattttttggtcgattcttaggggtgcattttttgaaaaaagggtgttttttaaaaaaaaactaacgtcgattcttagagatgcatttttattttatttttttacgtttttataataatttttttttgttgaaaagcagaaatagttgaaaaaatagtttttttttaaatttcacaagccaaatagttgttaaaaatttttataagcgaaaatagttgctaaaaagtcgctctaaatcgaaaagtgatcgaaaaaaatgtgtttttgcgcttatctcagcatatgctatccgcaaaaaaaatcggtgaaaacctaaaaatccgttccctgataataatagtccgattataaatcctgtgatgtagaatatgaataatttgattaatatttaagaattaattaagttgtaatttcacgtttacttttacaaggtttaattaatgaaaataatataattttgttacaattatatatttgaattattttttaaatatagtaatttttgaaaaaatatttttaaatagaaattataaattatttgtatttcattttggtcaaattttgtatcattctctcatagcattatttttcttgaacatgagtgtttcttataattttaaggcctaataaagaaatatttgattttttggaaaaaatattcttcgtaaagggtgagaaaaatttaattttcacaagaaatttcggtaaaactgttatatccgcaacattcaagtttccatatcttgtgataattacattgccctactttcccccggcccaatcccgtcataaatttgtctgtctggtcatctttatcccagnncatcctgcccctctcatttccaaaagtatcgtgacatttctatcccattcacctctgtatgcca

SEQ ID NO: 2826 - DNA, 2756 bp, Heterodera glycines
aaatacttataaaattttacatggctttacacatttggacccaaattctctgtttaaaagaactaacctaaatactcgaaataagtcatttttccgtttaaatgttaaattacaatctaaaaaatcttctaaatcttttgtaaacagatcagtcaaggcctggaatgcccttgataaaacattaatgtctagctccttaaacacctttaagaaaatattagaattgactcttgattctgaaagcaccaatgtataaaccaattattaacttttgaggcatttttttgactttgaccaattttattttcatataattttttcattattgtttattttaacctgtgatctcactcgatattttatccacttactctgcgtctattttactgtgatcactgatcagtcatcagagaagtggtccccgcccttctgatggcaattttttctttatcgataaataaataaataaaattattaaaaatgtgatttttttaacttcgcctaatttttcagacttttttttttttgcatttttcgtgctttttggattttttttttctgactttttggcgattttttatgacttttttagtcgactttttgaagatttttagtgacttaaattcccagccctacttatgtggtttagaccacataaaataaaaaggcagaaaaatcctaaataggcacgaaaatagtaaaaaaattttattaacgctttttaggtagcaaaacacataaaaaattcaattgtataaacttttttcgaataaggataagtttttaaacgaaaaatttttattaagaaaaaaattttttgaaaaaagaaagtttctgaatatttggcattctatttttaaaaattttcaaaaaatcaatgcaggatcctgctgaatcctgcataaaaatcaaatttgcgggtcctgttgcaggattggaattcaaaattttttacaggacaggatccggcaggattaatcctgcaaatcctgtattttctgcaggattgcggactgggatcctgcaaaatcctgcgcaggatcctgtcctgcgccggtctctagttgaaactattcgtgatttaggaattcttattgacaataaatttactttctctgaacacataagcaaaattacccgtaacgcctactaccgtatgcgtttacttttccgtgttattaaatcaaagaaaattgcaatttggaaaaatatttatgttagttatattcgtccacttcttgaatatgcccctgaatcttggaatccgcaactaaaatcgcatattatcaaaattgaaaaatgtcaaaatatttcactcgaatcgctttcagaaaatgttgtcttccaaatattccctatgaccaacggcttcggttttttaaattagctactcttaaaaaacgaagaaaaatttttgacctcctaactacggcacgactacatttcgccaacttgacatttcgccaactaacctaaaaacattcatttcgccaactcagccaaaatctgacatttcgccaactgacatttcgccaacttgacaccttgccaactgacatctcgccaacattcatttcgccaactcagccaaaaacattcatttcgccaactcagccaaaatctgacatttcgccaactaatttcgccaactagtcgaaaattgaattttaactatataatgatattaaatttattttaaaagtgcttcaaagcaaagaaatcttcataaaatatataaaatatcaaaaaaaacaataaaatatgaaaatgtttaaaatcaattttcatcggcctcagtttcttcaccactctctgaatttccacggacgtgaagtccctccgcaaagccttgcatcacgagcccgagaatttgttcttggccctagtaaatgttgtatcattattcgactgaattgttttctacctgttcgtcatttggtcgagtgcttcattggtgccaagcagctcaaagacttcgtcgttgacgttggtccgaatctgtgcgcgcagttgagatggttgttgctttgggttctccgtgatcagttgcttcatctgatttcgttttgactccgcatgaaaacgcgatggggcaaggccatgatggtgttctttgggacccaaaacgcccgtcatcagtccctcatcctccagttttgctgtcgctggacaattacgccgttcgcacctgaaccagctgccatcacttcgtattttcaaaaagcgaaagcctaaaaattaaaattaaaaccaaaaaaaaaaattttaacaccttggtgccaaagacaaagcgctcctcggattgttttgccacgttggaaatgaacaggctcacaattttcttcatcatcgctctcaccgacgttcaaatcattgctggtcgatacaccttccatttgttgttctgcggccgtcctctcagcattcagtactcagtcttcatttgttggatttctgggccgtttaattggcttttgcaaactctcaagaatttcgcgaacagttggcatttcttaatataatctgaataaaaaaaaacaaattctaaaaattaggcataaaaaaataaaaaggatgatgtatttgatatcagaacagattcatttcctcttatttactattccttaataattcttttttgatcagttggcgaaatgtcagttggcgaaatgaatgtttttggctgagttggcgaaatgaatgtttttggatgagttggcgaaatgaatgtttttggatgagttggcgaaatgaat

SEQ ID NO: 2827 - DNA, 932 bp, Heterodera glycines
  misc_feature (35)..(35): n is a, c, g, or t
  misc_feature (48)..(48): n is a, c, g, or t
ttataaaattttacatggctttacacatttggacncaaattctctgtntaaaagaactaacctaaatactcgaaataagtcatttttccgtttaaatgttaaattacaatctaaaaaatcttctaaatcttttgtaaacagatcagtcaaggcctggaatgcccttgataaaacattaatgtctagctccttaaacacctttaagaaaatattagaattgactcttgattctgaaagcaccaatgtataaaccaattattaacttttgaggcatttttttgactttgaccaattttattttcatataattttttcattattgtttattttaacctgtgatctcactcgatattttatccacttactctgcgtctattttactgtgagcactgatcagtcatcagagaagtggtccccgcccttctgatggcaattttttctttatcgataaataaataaataaaattattaaaaatgtgatttttttaacttcgcctaatttttcagactttttttttttgcattttttcgtgctttttggatttttttttctgactttttggcgattttttatgacttttttagtcgactttttgaatatttttagtgacttaaatttccagcactacttatgtggtttagaccacataaaaatttttttaaaggcatttccaggggttttcggggtcgctaagcacgaatctgaactcagattaaaatttcgaaccctaaccacgaattcgaacatttttcgaattttctttgtcaaaaaataactttttttttcgccgtcgccttcagtgaaattccaatcaattttgttaaatttcgctttttccgattagtgattggttatttcttatttcattaccatattaatgatcagcacccttctcaaatcgctgccttaaaattttttttttttatgtggt

SEQ ID NO: 2828 - DNA, 8282 bp, Heterodera glycines
attatataaaaaataaaaagttttaattacgattgaaaaaaaatagaaatgtataaatatttgcttattcttattacaaattttataagctcgcatttcatcaaaacaataaaaataaggaaacttaaaaagtttaaagaaaagttattatattttaattttaaaaaaattgacagtaagcatttaagctaaaaaaaacaaatcacataaaattaataaacattttttacaaaaaatgacatatataattttacatttaactatcgcacgaaatctgtttgagtagatttgctttaaaaaaacgacaaaattagaagaatttatttctattatgaaaaatggataaagcaatattttataaaataattacatcaacatctattaattaattggtccatattatataaaacatttattttttaatttccaaacggacaaaaaatttagaaaaaaataaataaataaaagcataatttataataaaggataataaagaattgaaaaataagtgtaaaaaaaagaatcaaatcgaagttaatttaaatcgaaaaaaactaattaacttatttattatcagaagacacagaaagttctttaaatcaaaaacaatggtcaatgatagaaaataaaatttgttatttaaaataaataaaattaaataatttttataatttaagcacaaatgtatgttttacatatagtaataataatatttaattattttagaagcattttactaattaatttttgcaattcatttgaattttataaaattataataatttaatataaaaaattgcatttattttagtttagaccaaatctcttcagattacagcatgatttatgctattataaatgaaattaaacacacagaaaatcatttattcataaaaaattaaattattttatcgaaatttttgggggatcggaattccgtgctaaataatgtccatttataaataatcaaaatttcaaaggaaattaaaatgttccaaagtgtttaataataaaaaatttgaattactttcataataatgataattttattaatgatattgtagaaagggaagttggtgtgggcccgaaaaataggaatacgaaaattgccgagtttaaacttgtcccgtggaatggagtttggtcccaatttgccccttccaatttaatatttaatttattctttaattcctcgtttaatcctccatttcctctctctctctctcaaatcgtccaaattccataactaatttatttgttgaaaagaaaaatattccataattaatttatttgttgaaaagaaaaatattaagtgtgaaatgaaagtgtgcgaagtttgattaaatagaaacgatcgatcgtctgaataattccgaaataaatatgatgccaaaaggaaggaaggaccgaggaatcacggacttcggttcctttagtgcccggagggtatgggaatggtttttgcggaaattgaatcgtaaatgtgtcctgaaggtggagaagggactggggagagttaaaaacggggacggagaagaaaatccttctccggagttttgctcgtaattgaccgggggagctaactgatcttccgtttccctacggggaaaaggatcagcgaaatgctgatccttaatccccgccttcttttgttactgtgtgtaagggggggggacaggggtactgtacgttacacctcccggccgaccagaagaccgtccctggtcttttcttctttttggccaaaaaaaaataaaataaaaagaaaaacaattaaaaaggatatgacaaaatgaataaaaatagagaacaaatagaaagataaaaaataaaacgattaaataagccataacagaattaactaaagggataaatgtggaaataggttatcaaaaattataaatagaaaaagaaagatgaagagggagagagagaaaaatcaaaagaaagcgcaaaacaacattgtagaaacatacataaaaaaatgtaagtgagcacataaaaataataaataaaagcaaaacaaggcacttaactaaaaggttttttttttttttttttttttgctttttatttattttatatattttttaaatcgggctccagccgtggtccgtccagacgcactgacgtgtttcgccaatccggtagcgttcctcataaggaggaggcagcagcggcattcgcggcgctcgggaagtggagggggagggagagggggtgggagtgatagaccgggggatgggggagatggagctgcgggagtggcggcggtttggccgacgatataaggggggagggatggtgttggggagtgggaaattgtgagccacagagtagggaggaagggccgcggggaatgaagggggatgggtgttgtcggaagggagaagagggatggagggggattgggaaatgggaggcataatggttgggggaggtgtggaaggaggcggggtggaaatggagtgattcgaaagaggtgaagagacggcggtgaggtaaatggaggaggagcgtgaaaggggtactgtttggggagattgagagaggggaacaatttgggaagggctagaaatgggggttggggaacggttggggacatttgtaaagcaaaaagaggaaaattttttgggaggagtgggaataatgttttggaagagggaagggatggggcgaggggcagaagatgaggaggaggaagggtacgggttaagtggtggggaagcgaaattaatagaaaataaagagggagggtgacttggcacggcgcggtttggcatcctgaaagtgagaaattgacggttagtgaaagagtgcgaattaaaagtggcaattagggggtcaattttattaaaaatatagctttgaccgattacaggggagtaagaagaagccgagcttaaatagttggaccaggatttacatgctttaagagtaccaaaattgccaattaaacaaaagaaatgtctagcccgggaaatagcaactgaaactctgttgggatcttttaaaaaatacaaggatctgctcatctcgtcgggagtggtggggagggatcgggtggtgataaggactatggcatcagattcttgagcctggaaggaatcaactgtcaagaccgtgacatttaagggggtaagggatctaatagcttttgcctgtgccgagtacagacagagacaagtaattgatgcagatggaggtaaaatgagagagagaagggagagaattgaatgggcaatgtggttttgggccgaatttaatcgtgaaaaggaggttaattctctataatcaggatttgggagatcaacaagaagaagaggggcattttgattgggtagcggaaaattggaagatgtaatcatggagcgttgttcggccgttactccggcaacaatatctccatgataaagagaatcagcaagacattgggtgagaattgggtgtcctcggtaggaaattgtgagttttgtgttgggaatgttaggaatagaaattaaatgagaaagaaatgaattaaatccgtattggagcaattcctcaggaagttcagaagagcgaacttgtagctgttttgggtcaccggcagcaaggattttttccagatttggggccagagagagaatatgaataatttgattggtaggtgcctgacctgcctcgtcaatgaatatgatatttacaagctttaaaatagagggaatatcttctaacatactaagggtgacaaagatgatggggatttcagtcccaacgtctctgataaagatttccgcagaagaacgttcatctgctttctgggggtttttcagagcattgattttatatttattaatgattttggcttcttttcgtgttaatttttgcacattaaagtcagataaagttttgattagaagatttttcatgaaaggctcaaaaagggaaaaatatttttcttttgcagaggcagagagaatgagaagggctttagaattttggtctaaattaggaagaatatcagaggctaaacgacaaagggccacattactgtgggtggtgataaggatatttttctctaattctaagaatttttggatggacataatgataattttggatttaccggtgccagggccggcttcagtgataattgcactggggaagggattgaaaagaaggtccaaagtttcaagttgtccctgattgggtctcggaaaaagtttttgggaaaatgaggaaaatgatagattagaggaggggagaatttttgggagagcggagaagccaagaatttgggaaagaatttgtccctgagggctttcattggaagcagtagcgaggggaatggaggaggagaagaaggcagacctatttttcaattgagtctgggacatagggacttctaggaggatcaggtcctccaaatcaaagctgtgaccttctgtctcggataaattaactgtgatttgaacagagaagatttgagggtcaatgagttttacggttttaacagtgccttgagcacaaatctttttgttgacggagccaatcaggagggagtcgggtttccaggtattgttgaactttatgaattcagataatgaagagagagagtgggtgaagaaatatggaaatactttttggattcgtatcgcttgggaggcattagaagaggaacaggaagggtttgagggattgacggatgagcagatctcttcattttttggattatgggggaccaattttaattttgtataaacagaggtggtttggtgtgaggaggacaaaaaatgggcctgtgcttttaaggctacggaaatggctttaagagagttaatattgtcattttttgtgagggagggattgaaaggaaagatgtacctgggcggtgatgtggagtccattgaaatggcgaagttgttgtcacctgacgatgctggaaggttgtttgttgggaagttttggggaaaagtgtaaaactcagaaatttgggtccccagggcaatttgtttgacataaatattaagtctcacaccttttatgaggggatgattgagatggggtgtcggaatgaaattgggggtaataagtccttctccggtcaccagggtaaaaattatgtttttaccctgagatgttttgaaaattttatgcccaacggcaattccttggacgagatgaaggggatattgacagccataaagttggggattgatgcctttatggaaggcttttagagtgggaatagtcgagaggggggaagagataattggatgagagggaggaacgacaacaaatgaggagaagaagatacaatcaccatttaacagatccttgccttgaattgggtcagaaataaggaaatttggccatttttcggcgtgaccaagcccttggctaactttagctgcaatggtaaaggggaatgattgggcaatttgatatttaacaatacgggagggggtttcgggttccaaaatcctgatttcctgctcagaattttgcatttgagagttttgggtaacagtaacttgggaggaaggagattgctgggggatttggtcaacagtttcctgagactgctgagattgggcaatgggaaatggggcatgagaaacattatattttgggctagggatgggagaatcagatatggtgttggcagcttccataacttcatcccaatttaagggattaacattttcaaatttgactttggcaaggggagcattttcttggattttggggggtgagatttcttccaaaaagattatatccgggtccgaggaagaagacatgggttgattttcagttcgtggtggggaaggagccggactattgttggacaaattctgattttcagaaggagaagagaccgagataagggccaacagagtctccatagaggatagaggagatgaagggacaacagaatgtgagagaggatcaaaagagtcagcaggttcagtagaatatgctgccgtagtgatggtcgaatcagcattagttgtcagagcttggagcgattcttcaagaggagttgtcggaaggagtctggggcatttcatctttggaatccagggtttcgattgtcgcttcggcatacttaatgtggcagtcagagatattcgaggagaggacaaaacgagattagaaaacaacacagcaatgtggaagtatggtaaagcattgttagtaaaacaaacaaaacaaagcatttaaggagaacttggagtgcacaggaggggtcgataattttggaagggaaagaggaagatagggggggggaataaaggtgtgagacttatgatgtttatttgagaagggacgctggggaatgaggaatcctaaaaccttttaatttttcacgaagttccattagcagttggcccatggtgtttcgcccagtaaagttccattgacgaatgtcgtcaatggtggcaccagcgccccagaatcggtcagtgtgactcgcttcaaccaaaaatttctccccagttgaaatgaggcactctgccagggcggggttctggtcgaacttgtggaagagaatctcttccatctttgactgcttcgtgctgtgccacacttttactgctgcggggtcagcttcattttgggcacgagccccgagtcgttttgctacgactggggaggtggttttcaggatttcggtgtctatgtcgtatctttggaagaatgttgcttttgtggattggtaacattgctctgacgaaaggaagtgacaggaggagggagggtagaagaagggggcggggtagaagttggagaggtatttgtgttcggggatgttggacaggaaggggatcattctgttggggaagggagggaaacgagaattaatcataaaaaattttgggtgcaaggcggtgtgaaggaatgaaaacaaaaaggggaaaaatgttgtaaaaaaagtggtgtgagaagttaaaaattaattgtgagtatgaaaatgggtaaggagaaaagtgcatttgttattgtttaaaactgttagaccttgggcgagagcggagattgtatttatttttatgcaagagatcccgctgagagaaaaccgcttgttctttgtcaatagaagtaggtaaaatttggggtacattggatttttgggtatcaggagggagggtttttggtgaaatatcaggggtatgattgaagcctatcgtgtttggtatctcggtggcttcagctgcttctaaagcagctttttcagcagaagagaggacgggggaggtgctgggaggaccggaaatctcaaaaagtttcttcagttgattaatatggaccttaaatgggttggattgtggggaggaacaactgacgatggtgacatggagttcttctatgttaataactctgaaaacgcccttccatggattgtgaaatttttgggaagtgcccggttttccagtataattccgtaacagaacacggtccccaatggaaatattaggattcctaaatttcttatcatattgtacttttgatttattctgagcctctttaattgagtcagctgcagaattccaggcttttcttagggaaaggacaaggagggttttgaactcagctaagtcattgtgagggagtggtagatggacggaaggatcaagaatttgatcaatactaaagattgggtctctgccaaacacgagaaagaaggggctttcgccagttgattcatgaatggaagtattgtaacagaaggtagctgcgtctagaaattcatcgaaattgggctctttgggattgatatatttagacagaatattatgaaaagttataaatgtcctgtctgtcgcatccattaccctgggaccaataaggtctggagaatgatttattaatatagagaagggaacttcaggcagtaaagaagtatgaggcgaatgtggtgacattgtcgatttttaattaagtctcagctctgcacttttcagtaagcactgcagctgtagtgtattaacgttagcgagaaaaagcataatgaagccatatttactaaaaattcaaatttatttaattgaaaaaaaacaaaattgtacaaattatcattggcattccgaaaccaaatgcagaacagctgttattgtctaaaaaatcactttttatgaaagacaaaataatattttataccactgtttgtgttttcatcggaataagttttttcaataattgttgccgtctccgtcgcatttttggaaaatgatttttccaaaattggcacataaaagggtgttggtgttgaagtgaccatttcatgtaaattcatt

SEQ ID NO: 2829 - DNA, 4823 bp, Heterodera glycines
ttttagctgttagaagcaaaagcatttgtttgaccctttatcagtttccgtttaacaatttgtgttaaaattagcacatatttttctgacggtgtctccatccaataccaaatggaaattactttgttttttgaaatttgtaaccgaaatactccaaaaggcgaattgaaaaaaaaatccttgaattctcctattggagttttttttttcttttgtcacaggctcatgtcaaacgcacccccttgggaagttctggcaaagtgtccggtagcaagagcatccgctccaagctcttcgaaggcaacctttcgcaaaaggttgaatttgattttcttgttacagccaacatcgggcacaatggtccgaccgaaagagcaattgtccacaaaattgctaaaactttatttacttcgataaaacccgaaaaaatcactaacataaaaacatcattccaatactgcttaacaaaattgacaatatgcaatttgattcccaaaaaagcgcacaacttttcagaatccgtaaggtcctcgctctgaaaaataggaaaaaagcgatttatgacagtgtacgagatcatttgaatgggtaatggaaattagtccggactgattgttcaggatgattggcccaacccgaaaattcaatttacctgtgggcaggacgatgagtcactcgcttcgtcctgagggtcccaattcgtctagaaattggcaagtttccactttacggataaggttttaaaccatatgcacgccgacgacatcaaatccgcggcgtttgagcaaaagcgcactcacagcaccaaagcaaaaagggaaatcattagaacaaattccaaattgacaaatgccacaaaaactgacctgtcaactccacccgaaatcgcacaaatgacccgacggacagacatttgttaatacaaatggaagacaacttccaacagatattaaacaaaacagacaaataatgttgtgatgtttaaacgaacatggtttaagtttgaatcaaaactgctttaacctaacaattgcaaacaaaacaagcgatgggtgaatgattcctgttgcgttgtctatgccttcgttcgctttcgtgtctcttcttccaactgaaaatgtctctttccgtaatattcccccacccttttgacctccttaagttcctccattcgtttctgcaatcgttgcatttccttctcatgtctatccctcaatatcttctcaaattctcttgctgctgttcgtcttaaaggttggtgagtaaggctaatgctttgtaataatattaattaagcagggacgggacaaaatttcgccgcaaataatttagaaaaaaattaaatttagaaattttttaagaaaatttatgacttcaaaaaaaaaattctggtgaaattatgtcccggcgaaattcgattgcgaggggtgcaccctaattaaacgtacatctccaggccgagcgggcgcaacgcttgaagattccaactgcctaatctgtttacgcaattccaatcggtaaggcgtcatagtcatgtcggccccttcgatgtatcggtcgatctcttgcaaatccgtttttgacaacagctaaaagaattatcaattgggaatcagtttctgcaaattaccatctgatctctgataatggcaaatggtctgaagtattgccaaacccgctccaatttgtctttgtcaacacgttttacggcctaaaaagaaagttaaatgaatacggagaagaatgaaacaccggatgattttgaatataatcactttgctgctcgaaaaacgactggtcgtgaggacttttgtttgagaggagctccattcgtgcacgaagaatctaaaaagacaatgaaaatgtagtaaaataaggcaaggccacaaaataacaccaattgtaaagcaatgccttaacgaattcaaaccaattttaaaagcattaataagaattaatttttggctatgaaccaaaaacctgattttgcaatatcagtgaaaaaggaagaaaatggtaaatgaaaggaaacacctcaatcgcctctctgaacatcactttattgttcttcatcttttccaaaggaagttcaaaaaatccgtattcgtgttcactgaaattctgctgaccatattgctcctttctgataccttgtctaaaaatttaatgcttacaattaggaaaggtttatacatttgttggattttaccagttcataatatttaacatttttgaattttgtatattctaacaataagggaatatgtgtccggtggcgtagcaagaaaaagtttatgtaaattattaattttaacaaaaattccaattaaagattggattgaatcaaattaagtacaattcgaaaaaaggttgaaaactggcttaactcttagttgtcattaatatgcacccaattttatgcttacctatttgctgttatcggaggatcggaagaattaatagtgattttgttaattctgtcaataaacgaattttcttttgagtttagcacctaaagcatgaatttagatcagtagataaaaaacattctgttaaacttctttgattttgttgtccttgtcaatgtctcgctgaagcttcgctgtcgttgtgtgtttgggagccaatgcctttattttccctttttctattgcgtcaattcgtttgagtgcacttttttgatttaatttgatgacagtttctgaccttaatattgggcttagcatcctttggagaaaatttttgatcattttaaatgagaatatctctaaattataaataattatcataattccgaatcattgaagtttagtttttagaatttttttacggcttttttgaactgaaaatttaaaaataattaatcttttctttttttggcgctttgttcctttataaaaagctaacctcacttccaatttctatgtacgtctacagaaattgattcaaaagtcctcaaagattaccaattgcccttgttgtttcataaaatataaccaaattcgattttccggaacctccgttttgtcttgattaaaaaaacatttgtttgttaactaaaacacatgattcttcgttttaaatattcaagatatgagtcgtcaacagagggacagcagtagttcaaggtctagtgactcatggtcaaggaaatcaagatcgagatccagagcaagctcaccttctcgttctagcagttctccgcacgaccgtgattggaggtttagaagcaggagtggagaaaggaataaacggcgatgcagacacagccgacagtcaccacctcctagaaaaagggaacgaagccgaactccggtaaattaagaacaaaaatgcattaaccttaaaaattccaaccaaatagttctcacgccgacgttctcctaacgaaactaagccttcaaataaagttatcttgacctcgttgccaaattatgctgacaaagatgcggtttgaatctttctaattgtttttttaattctaaaatattaagttgaacattttgctggcaaagcagggatttcatcccatcgatattagagttgttaggcgtaacaccgacagcggctccgttcgaatttttggttttgttgaattttcggatgttgaaacagcggaggattggatacgtcataaccaagttacaaatggtcacaaaaaaaaattcatttcatgttaagggctttctcaaaatggacgatggttttcaagtacgcttggagtattcacgtgaagagttgaaccgagaaaggccgatttataatcccctaacatcggattggacatgttccaagtgcactatcaacaacttcaaccggcgcacaaattgttttaaatgcggtacatctagaaaggactcagaagcgcttgatgcgagaggatatgggatggtcggagtatcgccttgtgacagtaaataatttcggttcgggttattactagatttgcattccatgtttagcgctgcttatccgcgagctcccctcttcggttaccgaggaaagcattcgcacttcgctatctcagttttcggggctgacaattcaacgcattcaattggcttcctctcgtctctacgcttttgttcaaatgaaatctgctgagcaagcaagttatttgttacaaactttcaacaaagttgtaccgtacgttgacaattgtgcaggtgtttcttcattaatgattttgtaatttcactttttgttaagtaataattacttattcgcgtcagtctctcaatcaaattttgatcatggagaatgtcaatttgcttaaaacacaaagcggaattagcagcgcaaacattcaagaaggtgaagattcgctttgctcccgttttttgcatttctaaaaattagacccaacaaattctgcggctcaattggctcagaatgctattcgattggcacaaatgggaaaggccgtgccgggtgctgtccctccaattgctcatatggaagggccagctcgacagagcatttctacgccttttggctatttgcctacctatagtgggtgaaattttcttcgtcatcagttaaatattttatttatagcaacgcctgataccaatctgttccaatatgaaccttcttctggatatttatgggatgttaacacgtaacacattctgagggttgttcattaatgacttttctttttagaggattttattacgaccaaaaaacaggatattattatagttccaacacctccaatgtttgtgttacttttcgttcgcttttaaaaactcagtgaattaaaattagtggatgttttggtcgtcgaaattcagcacatatatcactgcgaaggaggtgat

SEQ ID NO: 2830 - DNA, 3179 bp, Heterodera glycines
ataaacagtttttcagcaaaaaacgccccaagagattctataagagatgatgaaatgggcccgtcgtcaagaaaagataaatatgtcatttaaacttaactcaaacgaagtcgctgcagaatcgtgtgaaagtcaggattcgctgttgacggtagcccggagaaatctctgcgtcaactctgcagacgaacgaaatgtgaatgaaaagtcagaggcggctaaggttaaatttggactgattgcaaaacgttattcacatccgttttcagagactttgggacgatgacgatgaggttgaagcagcgcctcctcccgacgccgttttacccggcagaatgcgcgggcttacaaatcgccaagcgcgagttcgaattgcacgcgccgagctcagcggcggactggccgctgtcgatggtagaaattggatggcgatggactcgggacgaatcgattgttgttcttttgcgtccgactctctgccaatccctctctcctcacgggccaatgcggaaattgcctcttgctgacgcagtccctatttacagaccaacaacagcagccaacaccaattggtgatggcgccggaggacagcagcagaaacagcacaccgacactgatttgacttcttcttttgaccaagaaaaatttgttgaccggaacaaattctcatgcctcctttgccgtcgtcaatttgctaatagcgaaacattggacaaacacattcaacttagcaacttgcataaggtaacaagaaacaactgacaaattaaaacttggcagttcagagtaaggtcgttgaaaaaatacgagagctgcggaacgcgggcattgcaaaagcggcacagagtgacacgtcaacaatgcattacagggatagagccaaggaacgtcgggaacagcacggctatgatcccggtttagttgacttaaattactaattatcataggtatttaaggaataagcagtgggacgacgaatgaatcagatgcatcttcaagcatcgaattgacagccctagtgaaggcttctgtcccccttgatgcaacgaacatcggcaacaaaatgcttaaatccatgggatggacagaaggccagggactcggccgaaatgctcagggtttcaaatatttgtatatcccctcgatttttatttaataacaggcatcagagacccaatcagagctgaacaacatgtgcaaggagctggccttggtgcatccggctcaaagatggacacgaatttaccatggaaagtgcggaatagacaagcggccattcagcggttcagagacttggaagaaactactcgacaagactgatggaactcgaaagcaaatataccctcacatcctagatggccgttcataaattgctttgctttcttgtgaaatatttcttttattaaaaatgttaaaccacttgcttgtgatattttggactctaatctagttatatgcgtccaatcgacttttgtcgtccaatcaattttaacatttaattaattgcattgcattgacagtatttctaaatatacgggataatttagcccgagcccgacttatctgtacccggtaatacccggccagtcaacataaacagcatttattataataaatgaaagtttcgattcttacaatgagatcggtagcgatcatagcagttcaaacaaaacagcgatttcatacacccaaaagattaaagtatcgcagaaaagtcgcccgtgctgaaagtgcttccaattggatttgttgttgcgaatgaataatgggcaagttgtgaaacaaaacttttcgtgttgtgaacaaaagtggaacaaagtataacacgagggggtaacgacccctggtaaagcgaaggttgggaggagggcgagttcgaccgcttggcgtttaaatttgccaccgcagcactctcttcgaaagttgtcccaccaatgacaaacaaaataacattttcaaagcgggagctgaaggaagaggaggaaataaggggacaaatataactcacttcagatttgccaaatccgtagacggataaacactttctgggagtttgccacgcgacgccaaatcaatgagttggagaatgaaaggctcgtgctgtgtgtagatattttcaacgcctttcagtcctaaattttgtaaacggctaaaggacgtgcgactaaaagctatttaaaaaaaagatgagggagacgacgatactataaatcaaccttaagggtattttaaaagcaccaacaacttttcagataataatagaataagtcctcgaccttttatgaatcgtttggtcatttccattgcggatctatccccgaataaatcgttttgccgtcttcgctgtcccgcgaattcgagcagtgttgagatcaattgcagctgtttgttggccatccctcgctttctcaacagctcatgaacgaagctcaaagcgccgctgttcccttcgaaacggagagaaaaaagcatcgctaatcggagggcattctgtgacaaaatccactatttaaaacttaaaaatattgcaccaaatcagttgttttgggatgctggataagtcttcgaagggaatccagacaagccgaataatccccatttgcgaccgcaatgttttgctctaactccgatatttccaacaaatttccatcggtgaccattcggctaagttcacccaccaactgaacgtgtttagctaccgttcctgaagttttggagcactctccatagagaaccagtcggtcaggtttgcttacccgatatcttcttgaattgagggtactgttccacaaactttttcatatccgcaattgattccaactgttggtgtgttttagccttccgttgatattcattcatcagtcctttgatgttttgtccgatatcgccaaaattcaaatacatattctgtaaatttgttttgatttatggcacgcttcctttctttgacttttgaatagaattcgtcgtattgagcattcaaaacaatatttttcagcccatcgttgcccgtgttttctaaggtcacacggtggttattcagcccgatcagttcgtgaaccatcgcctcgtaggtccattggttaagcagtggtgagacagggtcctaaaagcgggaaaaatgacaaaaacgaaccctgtctcaaaattagcatacctcactcctgtcgagtatgac

SEQ ID NO: 2831 - DNA, 1646 bp, Heterodera glycines
ctctctcacagtctcttgttcgtctgactccggtaatattttaacgtccgcttttggaatccgatttgaaaaatctttaattaaaataaaacatgtttcagagatggaacaggtaattattcccccttaagaaaatcatttatttaaatatttaggcttaaataatgttagatagaaaatttcttttaaatttttctcggagaagaaacgatgtggggagagggaaacaatggagggggggggggggggggattaactgtaccaataaaaaaatcacttacaaatataatactgcgaatatttcggagattgaagttcctccgacaataattgcacattttcttgtgtgggacggacaaaaacaacacactttctaaatgacaaatattagatgaacgaaaataaacttacaaaaatttgataggctcgcgaatgacaacggaatctaatcgctcgaacaggtaaatttccttttgcatcatttcactttgggcataggcacaagaaacacagctcgtctttaaggtgtaaagaattgttaaacaaatttaggtagtttatgaagaatctcacaaaccgtttctttgtccattagaatggctttcatccctggtcctgctaatcgcaccatttcattaatatattgctgcacaataagcactaaatccattatagcgaagtcaaatgtcctgtagttccttcgtacggttcttttaacaaaaaatttgttttttcaaaagcaatattttttgaccataaattttcggggtcgttaaacacgaatttgacttaaagaatagccatttggtcttgggttaggtcgtgcaaacggattggttgttaaaattaatttaggtgaactgttttagtggacgtattcgtaacgcagggttcggatctgtccttatttataagatttttccttatttggagggtccaaatcttacaaaataaaaatgtccttatttgtaagatttgtccttatttcgggctatcccttactatatattaagtgaggcgaagctccgcccacttttgcccttttgaatttgcgcctaaagtggtgttttgttttcatagagaaaaagaaacataaaattgaaaaatataattggggactaatagagaaaggctgggtagagaagagaatgcagtgtatgtttctctgtcggcgcggatgggagggtagagtgggtaacgcgtgcggttttcacacatgattgaatgcgtgcgtttttgtgtgtgtgatgggtgtataggagtggttgggaattagaagttagagaagaggaaaactatagagagagatgaaaaaggaagcgagagaggggatagaacgaagattcagaaagaaaggtgagggagacagagaggaagagaagagagaaagaaaagataaaggaaaaaagcaaaaatacaattaaaaagagagcaatcgagaagtgagaaatggtaacgatagaaaaagagggggaaaattgatagatgatagagagagaacagagaggatgggaaagagaaaagagggagagcgaaagagagagagaagagagaaaaaacagagatgggagaaagcagtgagagagagagagcaaaagatagagagagagaggtgagaggctgggagagagagagcagagagagag

SEQ ID NO: 2832 - DNA, 1357 bp, Heterodera glycines
ggagacaaaaatatactatttgatacatttttgatcgaataaattgtaaaaataactgatttgaaaattttgcaaaatgtccttattttggacccaaaaatcttattttttggccttgatgttcttattttgaaaaattttcgatccgaaccctggcgtaacggctggatttggacacttcattcccggcactttttcagcctaaaaaagggcaagcgcgccccaaattctattttcatcgatttagtccgcattaaataattttgagtttggagactgaccggtatttgccatttttaattagcatgtcacgttgaatgctatttttgtacacggtaactgacaatgagcaggtcgtcctaatctgtgaccttgatccatatcgccatttgtcccggtccgaacaaattccatacggaaaaggccgtacgaaaacgactctgaccgctgttctttattcaactgatgctaatattatagagtttgacttaattaaatgacatagtttccgtagtgattttgaaccggacggtctcttgttaaataatctgtttaagaattacataattttatgtcgtacacaacaaatttcccgcacagtcggcaacgtacagtttatgttggaggtttcggaggagaggtcaatgaaaaaattctcacacttgcgtttataccttttggagacatcggttagataattttcatcaatacatatttaaatcttattagttggcgttagcattcctttggacaatgaaacgggcaaacatagaggttttgggtaagttttcttctttttcagttgaagtctttggttttaagatttgttgaatttgaacttccgagggatgctgctgcagcaattgacaatatgaatgacactgaaatttatggaaaaactatcagagtaaattttgcacggcctccaaaagtgaatgaacgaagtcaaagaccgatttgggctgatgatgagtggttgaaactatatggccagtaattagctgaatctccaacaattttttttctttatttctgaataaaattcgttgctaattgagcttgcccaatttatgtcctctgaagggttgtacgccccatatttcctccttattgttaatagatttggctattttaatttatatggtaatttctgttagagactaaccaaaatgaagtctactggtggaaacctcgagccgatgccatttgttcgcaaatggggttcagcggttgatggcgaaaatggcgcagaggcctcgcaaccagttatttcagacgagcgattcgaaaatggtttgaaatgacactctcatatgttattcttcttatcacagatgctgcgaaaatggctttcgtc

SEQ ID NO: 2833 - DNA, 2486 bp, Heterodera glycines
tgggtcccgaccgctttaggaggtttctaatcatgatgtaacgatcaaaaacaactccaaattcgtttcatgactaccagtcaatcttctatttgcttcttattgcttttagcccccgccacaaagccaggaagagcaagagctgcagcaagaccccgagaagaagaatgacgcgctttcggcagctttggccgctgctgcgatggtagcccaaaaattgggaaaaggtggactcatttctggcgctggtgctgccgtggtttcttctatagatttgcttaaccgagttccacaagcgactcaaaaggcaacgccattagcagaaacagttctggccaaagaaatcggtgaatttgtatattttggttattttaccacggttgataaacatgaaacagttaaaagagaaccatcggagcaaaatgatcaattaaccgaagaacaacggcagcgcgaactgcgccgtaagtctcgttggagcacaactaaatcttttgtgcccggaatgccgacaattttgccttcggatattgatgagaatcagcgtcaagtttatttgcgtaagcactacataaaaaaacttaattcaccttcctattacctaattgaccttttacgtatttttacttctaatttagtgcaaatggaaatcgaggaaaccactcgtagattgcgtcaaagcgattttggacaaaacgttgacccggctgaaaggtcgattactcaaaaatatgttgctttaataataattgtatgtaaaaaggcaaacggtttttgtcataaacagcttaaaacgttttagaatcaattcttaatggaaaggaattgctttttcagaatcggtactcgtgggtcgatgctacacctttaatataatcctcttgtttagctgtgccaatttgtcatcaaaaattaatttaaaaattcactatacgttttagcatttagtgcggtagcggggtgatgtggtggattcagacatcctccaacaattttaatgtaaattttgaaaccattgggccattaacattgagtcaaaataaggctaggcaaattcgaaatcgcaatcagtcaaatagatttctgaagtaagaattggacttttaggagtccttctccggaacccgtttatgacgcgaccgggaagcgactgaacacgcgcgaagtcagaaaacggcaggagattgagcaaagacgacatgagaagatccaagcattattgcgtctgaatccaaattacaaaccaccggctgattaccggtaaagcaacttttatatgtttatttttccaaaatatctttaattagtccgccaaatattaaattgcacgacaaagtttggattccccaagaggaacaccccgaaataaacttcgtcggtcttttgatcggtcctcgcggcaacactcttaaggccttagaagccgaggttttttttgttgttgttgttgttgttgttaaatacattgattctttcttcttaagacaggagcaaaaataatcattcgtggcaaagggtccataaaggagggaaagctcgccaacagaacgggtcctttgcctggcgaaaatgagccgctccatgcttatgtgacatcgactgacagagaggcgattaaacggggatgtgacaaggtgggcgaattggaatttttggatattttctttttaagatacgtgagataataaatgccgctttgatgattccggacgggcaaaatgaattgagaaagttacaactgcgtgagttggcactgctcaacggaacacttcgtccggaggacgttctcagtggggcacgttgtaccaattgcggctctgaccagcataagacgtgggaatgcatggaagcgccgaatgtgactgctaacgttatttgtacggcgtgtggcggggccgggcacattgccagggactgcaaaaatccgaggcccggcttcgatggggcggtgatggatgctgaggtatgtcagctttttctgtagttttcttaatttagccttacctataccgatttcagtattctgctttgatggctgaacttggcgaaaaacctcccatttctttggaagccggcactgcaccaccgttagtcggtgggaagccgatccccgggttccccggcagtggattacgcccgcgtttcgcgctgcccgcgcccactcctattgtgcgcgttaatttggcgaagcaacaaaatacgcctcaacaacagtccgtctcgggtggcggttaccccgggtggggtgagtgactgactttgttttttgtgctttttctcacagctatcagttccgctcttctctaaagttgatagtgaagtgtttttacttgtagctaaaatcaatataaaggcgttaaatggaaaggcgattttagacaaaatggttttctattaatcgattggtggcgcctaacaatttctttttggcctttcttttgttgtattgccgtacaaatttctaggatacatatacaaaaacatta

SEQ ID NO: 2834 - DNA, 1115 bp, Heterodera glycines
  misc_feature (987)..(987): n is a, c, g, or t
  misc_feature (1072)..(1072): n is a, c, g, or t
ctttataaaaaattaaatttaattaagtaaaaaataacttttacagacaaaaattcattaattaattttaaaaaatatactaaaagccaaattaaaaaaagaacctttaaataataaaatagataaaaataatatgtcaataggaaaagataaagcaatttttaaaatagcataaagccagaatacgatattggcgcctacttgtatttttaaagcacgacttgcaataatacgtccatatttgaaaattattgaatgtttaaataaaacccaaataaattaaattgttttataaagtacataaatgacattatatcatcaagaatttacactaaaatattcaaaaaaacatacacataaaataagtaaaaaacaaataaaataagtaaaaaaacgcaataattagtatttataatcatttatatatgaaattttatttattaatttaaaaaagaaataaataaatacaattaaattaaataaaagcactaagttgatttaaaatatcgaaataagtttgtttagtgtatatactttttcgaaaaaattgaattaatactgattaaataaatgaataaacgaatgatagatcattttactattattttctataaataaaacataagcaactcattgtatacaaaaacaaacatgtcaattcaagaaaattggtgaaaaaattataaaaaataaaaacatagttttatacataaattttttacttttatatcttctatcgcatattttacaatttaataaaaaatatatattaaaaatatgtgtatataaaatgaaaagcatctttattctttatattaattgttataaaaaattttattttattattattccaatttttatcattgtaagattaatttattttttttcatttaacacctgataaattgaataatttaaattaattagctttttaattaatactattttattcttttttatatttttctatttttgctaatttagtanaattattacaaagtatgaagcagatataattattttttatttttggtgttatgaaatattacagaaatgacgttggatttcgaanaatttcaaaaaagattttttgaatccataactagatgattttc

SEQ ID NO: 2835 - DNA, 6658 bp, Heterodera glycines
  misc_feature (6636)..(6636): n is a, c, g, or t
tcaatttataaagatcattaatttgaccatttcatttttgatcttagtgtttgttatatctttaaattaatcaatatttgtaaataaatttatttttaatattatctccagcagaaattagactttaatattatattatttttaaacgaaaaatgagtggaggaaaagatgaatagagtggaggaaaagatgaatattgtaattaaaggttttattttattagagtaggtttcttcgagcatttaatatttgtatgcaatatgaagaattgtcatatataaaatttttgctttaaaatactttttttaaatttatgaacaagaagtcttaatttgatatatatgcggcagataatattgcctaatagcatcaacaaacagtgaatttgattataaaaacatttttattttaaatttattttttgttttaatattaattaatggaattatgacttttttcataatttaaattaaagttattaatttttaatgaagtcgattaacattaattaaatttacattattgaaaaaaattatatggtaattttgctaatttttgaattatacctgaatatttgcttaatatagtaattaaatttttatttgtcgcttttaatatatcaacacattttgtcgcctatgtcagataaaatactaattaaaacttttctcattcactcacaattaattttttaaacgtatttgtaatgttcaaaattttaaataatttttgataatgcatatttttttgtttaaatattaattttttgttttgtttaattatattcaacatttaggttttaaaaaaagatttaaataggtttttggctcacatgtacttcgtgagatttagaagtatttttgaaatttataaatttaaatttgaaaataaaagattgctgcaaatttcaatttttcaatttatatctttttctgattgtattcgaggtataaggtaagacttggataataatggtttagtccaaaagttttctttttcaaattctaaatttagtacatttgttgtttttacgacattaatactttctcaattatcgttttaccagagtataaaaaccataattttttaatgttattccgtgaaatatttttaaaattattgttgtgatttaattttaaaattttaattttgtcgggagttagtagttactcctacattttttgggggttggaaaaccaccgttccaaaccaaagcctattggtttaaaccaaagcctattggatgggtgcgagagtgaacctaaacctattgaagggtttttattgattaataataaatttgaataattaaattaaattaaaaataaataaataataaaaataaaaataaataaacaatcccaaaactaaaacctattgatttaaacctaaacctattggatgggtgtgggagtgaacctaaatctattgaaggcttttattgattaataaaaaataaattaaattaaaaataaattaaataataaattataaataaattaaatacataaatttaaaaaaaaaattttttataatttaaaaaataattgaataaaaaagctaagattcattctctctctcactatctttcttttctttctctctctcactctctctcttatctctctctctctctctctctctcactctctctcttttttctttctctctcttatctctctcttttctctcactctctcactctctctcttttttctttctctctctctcattctctcttctctctctctctcactctctttcttttctttctctctctcactctctcttatctctctctctcactctctctcttttttctctctctctctctcactctctctcttttttctttctctctctctctcacattctctctcactctatctcttttctcttgctctctctaataccacacaaagatataaataataataataaattaattaaaaaattaaatttaattaaaattaaattgttaaaataataatagttaaaaaattaataaataaatttaaaataatagataaaaatttaaaaataaatgaaaaaaatataaaattaattaattaaataattattaaagtcaaatcgtattggagggacggacgtcagctgtcgtgccctttagggagggaagcgacgccgggtcatttgagagcacgcaggggccatttgagcgctcgcacgtgtcatctatgcgcccgcaggggctatctgagcgcccgctggtggtcatttaaccgctaatgactgaccgtggatggcataaaatgttagtcagacggcgactcattttagtgtagtgtggcatagcatgaacaatttagttggcaacctgtcaaatgaccacatgcttgagtgaaggtcaagctccgcccacttgtgagggtataaatagccggctattaccagcaaaagtcaacttctcccattcattcgcgaaaattctacccacattcattgcttgcgcgctccgtcaaaaaatatttaaactaacaaatttgcaactacattaccctttcatccaatattttaccaatattcaacttataaaaaaatatattttcaataattttctattacaactataaaatttacatttttctaattcaaaatattctttcatattatatcatttataaatcataaagttttcattcatatattattcaaataaaatgaaacgtttttccctctctcaaaattcttcctcctccttccccaaaaaatcccaaccaaataaatgcattcgtaaaattgataacctcacttcaaaaagtaaaaaatatcaactggtgcgctcaaaatctaaatttgttattgatcaaattgaaaaatgtgcagatccacaggctgaattacgttcatgcgtgcacaaggcggtcgaggaggctattcaagacgcacagaacacacttggaggagcaaataaggtaggtgtcataatttcttcggaacttttagaccagggtgacatcatactgcctataactccaattacattaaatgtcgtggacgccgttttcaaccagttttgtaaagtggagcagagcaaatcgaaacacgtcaacttatatggggccccttttgttgtcaccgtaactgttctaaacactgtcggacttccccgacgacgaacaaccaaaggaagtgcccctccaattcactcttcccaatcacacatcttcaaaattaacaacaacgacaactattgccttttttatgcactggaactgatgcgctactactctttgtataaacgaggaattatcacgcgtgataactggcggtggattaacaacaaccaaacaacggttttacgacaaaaagcgcagcaactgctccgcgaggcggggatccctacaacagagacggagtacgacgcggaagtttatatacatcaagtgcaagggttatggaacgtcaaatatcccggtgagtacaaaatatttatttttaatgattatcagatgcgcccaatcaccaaatccgatatcaccgattaccaattccccattcttctctaccacaacaacaaccactttgacggcatcaaaactctttcaaaatttttcaacaaacgttactattgcatctcctgtgaatccgcctacagtcacaaatttgaacactcttcaaaatgctcttcactatgtcacgggtgccgtgaggtgggcgtcgactatccctgcgaagcccaacaaggctacttcaaaaaatgtttgcactgcaacaactatttctataacaacgactgctatgaacgccacctccacaaggatttgtgcaccaaatttcagcgttgcgaagattgtggggtaatttataatgttaaggttcacggaaatgtaggccaccaatgcggagaaaggttttgtcgtctatgtaagcagtttcatttaaaagaggaagatggcgagaacccctgcaaaagctgcttcatccaacccctaaaaccccataaacttaaaccatacaggatcatcgcatacgattttgaagcgacacaggataaaaaagtaggtaataaattcgaacacgaggtaaactttgcagcggctaccgttatttgcaccgaatgtatcaacaacgacaactggaacaaatctctacaaggaaatccctgcaaaatttgtggcccctaccgcacaatcaccttttcaccctttgactacacggagacaacagtcgaccaaaaaattgtcacacaacaaccactaagtgaattcgtccagtggcttcttttcgatcacaacaaaaaatttcccacggttgcctttgcacattttgggggccgctacgacatgacgatgatcatcaaggaggttttagcgcaaggaattcacaacccggacatcataaagcaaggaaatcgtctctacgagctgaaaatcaaggacaatgaacattgcccactcacaattctacacgacagctacaacttaatgcccatcaaattatctggcctcatcaaatcatttgggcttcatataaaagataaacaacattttccacacatgttcaacaaatcatcaaactatgacaacattctctcccatcttcctccacgtgaagaatactgtcctgatcaaatgaaaatccccgatcaacagaaatttgacaaatggtacaataataattacaaccaaccttttaaccttaaggaaaaactccctgaatattgttgcaacgacgtacaaatactcacccacgccctcgtcgaattacgccgggaattcaaacaactgacacaacggaacggaaaacacgggggaatcgacattctttggcaagccatgaccatcgccagcgcctgcgtcaagaactttgcactcaatcatttgaagcccaactcgctcgccatcgtcccggagaaaggctatacaccacaacagaaccaaagtgcactggctatcaaatacctcgactggtactcccacatcaacaatgtcaacattcaaactgcacactcccgctatggtgaatatgtctttaaacgcgagggtcaggtgtatcaagtggatggttatataaaagggactaatgggaagagggataaaattattgaggtaaatggttgtctgtggcacgggtgtgaggaatgttttgaggacttggacgacgaaacgaaaatgccgaacggaaagacgctaggacaattaagagagagggaggtaaggaagcacgagattcttagccggtacgtagacttggaggtgatctgggaacacgaaatcaatgagcagctgaagaaggacaagcaaatgagggagtttttcgacaactggaaggaccactcaccaataaaaatcagagacgcatttcatggaggacggactgggccaatgaagttactccacacagctaagccgggacaaaaaatcagctacaaggacttcaccagcctctacccatggaccaatttctctacagactatcccctcggtcacccaaaaattatcagctttagattaaatgagcaaactgtcaactggcgagctccatccgacaatccatacaagggacttttaaaagttttacttttacccccaaacaggaatatcaatgtgaccgtaatgcccataaaatttgatgagcgactactcttccctctctgcgaaaaatgtgccaaacacatcaccaatgaacacccgaatggcctcaaagacgacaactactcgtgtccacacttcaatcctaatgaccgtgcctttgtctctacctgcactcaccttgaattgaatgctgcattggaggccggctacaccgtcagaaaactcttccatgtcctgcaatacgaccaatggagcgacaacatcttcaaatcttacgttagcgaaatgatggccctgaagatccacgcaaccggcttcccttcatggtgcagcagcgaagaggagaagaaggaatacattgaggagaaccgtcatcgatttggaattttgttaaacaacgaaaagatgaaggctgaaccagggaagcggtacatcgccaagctctgcctcaactcactttggggccgcttctccatgaggaacctcctctccaaagcaataatcaacaacgacgaaagcctgattcgccaatataccgacgacaagaaaatcgaattagtggacttggaaatgatcgacgacgacaacgacgtattcatgctcacctacaagccgaaagaggagtttgtcgacgaaaataaatactccaatgttgtcatctccctcttcacgacatctgcagctcgcctctacctgtacgaagcactcaaaaaagtcgccgacacccccgactgtgaaattctctactttgacacggacagcgtcatctacgttcaccccgaggaaaacgacccactaccaacaggaaagggacaccttggagaactaacagacgaaaaccccgaccacaatatattggagtttattagtgctggctgcaagaattatgggttgaagctgcaacgcaaggacaccggtgaaatagaacacgatttgaaaataagagggttcacccttgatgcacaaactgttcaaaaaattcattacgatactgttaaggaccaaatcttacgctatggctccgaagacccccctgaccctatcattgtaaattacctccattttattcgccctaatnctaatccaaggtaaagtgtata

SEQ ID NO: 2836 - DNA, 1701 bp, Heterodera glycines
  misc_feature (1543)..(1543): n is a, c, g, or t
  misc_feature (1607)..(1607): n is a, c, g, or t
  misc_feature (1652)..(1652): n is a, c, g, or t
acatttaatttggctctttacgagtatattattttatttcgctatttatactacaattacaatattcgttggtataaatattttcatttgataaaactaaagtaatttgacatcttaaatttttacattgtctatttgttagatattgtttttaagtgttataattacttataattgtaaataattatcaaattccatacgagtcgatttaatcattgaagtgtgtgtgcactaaatgatagtttgtaaagctaaatcaaatcatattaatcattatgaaaaatataataaaaaataaggttttgtttaaaataaatgaaaataaaaaagtggaaaaatataaattaataattaaaaataaaattctgctgaaatcaaatactttattatgttgataacactttcaaaaatatgaattttattatattaaataatatttccttcaagaataacacttttgtaatagagataaccatttgcattaaataatcatatcagcgaaaataataaacctgacaatgattataaattataaacaaagattaatataacttgatgaaataattaaatatatttaaaataatgaatgtaatttgtctccaaatgtacttaatgattacaacttaatttaaaatcaaaaaataaatattgtatgtaagtaaatcaagaaaaaacaatcttttggtctttaaatttgctgagcatttcaacgatggacgcatttggcctgctggacgatttaaaaaggaaaatcagcaattccgcgattaatttgtgtgaaaacatcaattcaagtgcaacatttacgaccgaggccgccgataaatttattcgggaattaaaggcaactttctccaccacttttgaggaaggactcggactctgcaccaaggaattggcacaccttcaattaaaggatggtgccactccaatttacagaaaggcacgaccaatgccacatcattcaaaggaaatcgtcgaaatggaattggaccgattggaacagctgggaattatccgtaaagccgaacatttgacttgggctgccccgattttggtggtcaagaaaggagacggatcagcacgattgtgcatcgattattccacgggattaaatgatgcactgctggattttcaacacccgctgccaattcctgacgacatttttgcgactttgaacggaggaaaatttttctcccaaattgatctcaaagacgcatatttccaaattcaattggatgacgattcaaagaaaatttgcggcatctccacccacaagggcaattattttatggagcgcctgccttttggagtaaaatcggcacccggcattttccaatcaatcatggacaaaatgctcgccggtctgaattttgcgacggcatatttagacgacatcatcgtcgccagccgaacattcgacgaacacaccgatcatttaaaggaagtgttcgatcggctgcaatcattcggattcagggtcaaaatttcgaagtgcgccttcttccaataggaaattaaataccttggattaattattgancagaatggacgccgacccgacccatcaaaaattcaggccattgttgacatgcccgcgccgaccnaatattcgtcattgcgctcatttttgggtatggtcaacattcccnagcatcgtcaggacatgcgcttcattcgcaaccgctggacgtctgctca

SEQ ID NO: 2837 - DNA, 2765 bp, Heterodera glycines
ttcaacgaaagcaaatctgggagtcgcagcgtcggtatggtaacaaagaacatcaatgccacttcactgctgaaagtcggagttttcgtcaacaaaaagaaaacaaaatttgttgccgacagcggcacggaagtgaacataatcgacgaagacgcctatgacaaaattggccgtccaaaaattcaggaatgcgaagaaaaaggcaaactcttcgacggaacaaaggtcgcattcatcggcaaaggagttgccacattccaatttggcgacattgccatcgaccaggagttttacgtcgcaaaaagagggtctttaaatttgctgagcatttcaacgatggacgcatttggcctgctggacgatttaaaaaggaaaatcagcaattccgcgattaatttgtgtgcaaacattaattcaagtgcaacatttacgaccgaggccgccgataaatttattcgggaattaaaggcaactttctccaccacttttgaggaaggactcggactctgcaccaaggaattggcacaccttcaattaaaggatggtgccactccaatttacagaaaggcacgaccaatgccacatcattcaaaggaaatcgtcgaaatggaattggaccgattggaacagctgggaattatccgtaaagccgaacatttgacttgggctgccccgattttggtggtcaagaaaggagacggatcagcacgattgtgcatcgattattccacgggattaaatgatgcactgctggattttcaacacccgctgccaattcctgacgacatctttgcgactttgaacggaggaaaattgttctcccaaattgacctcaaggacgcatatttccaaattcaattggatgacgattcaaagaaaatttgcggcatctccacccacaagggcaattatttaatggagcgcctgcctttcggagtcaaatcggcgcccggcattttccaatcaatcatggacaaaatgctcgccggactgaattttgctacggcatatttagacgacatcatcgtcgccagccgaacattcaacgaacacactgatcatttaaaagaagtgttagaacggctgcaatcatttggttatcgggtcaaaatttcgaaatgcgccttcttccaagaggaaattaaatatcttggattaattattgataagaatggacgccgacccgacccatcaaagatacaagccattgttgacatgcccgcgccgaccaatatttcgtcattgcgctcatttttgggtatggtcaaccattaccagcaattcgtcaggaacatgcgcttcattcgcaagccgctggacgatctgctcaagcacgaagcaaaatggaattggtgcgacaattgtcgcaaatcatttcaaaagttgaaaaacattttgacttcggatttattattgacacattatgatccaaaattggaaataattgtgtccgccgatgcttcggagcttggaatcggcgccgtcatttcccatcgattcgcaaatgggacaattaaggccatcgcacatgcatcaaagtcattcgcgcccgccgaaaagaattactctcaaattgagaaggaaggactggccttgatcttcgctgtgcagaaattccacaaaattatttatggtcggaaatttattctccaaatcgatcataagccgttctctccatttcggaaataaaaagggcattcggcagtgcagcgtcaaccgattgttacgctggtcactcatttttttggcatatgacttcaaaattgaatatgtcaaaaccacggattttggacaggcagacgcactctcccgtctcattgcaaaaggcggagaagaggaaaacgaacgcgtcattgccttgatcaccgccgaaccaattttggaagaaattatccattcagcctcgaaaaatttgccgatcaaattcgaagatttgatcatcgccagcaaaaatgactacaacattcaaaaagtcataaaattcatccgccaaggctggccaaatgaaaagcaaattgagaaagaatcggataccatcaaactcttccatcggcgcaaaagtgatctgacaattttgaaaggctgcctcatgtatggcgaaagagtcgtcattccgaaaatttttcagcccaaaattctccgactttttcacaagggccatccaggaatgaaacggatgaaacaactcgcccgacaatacatattttggccaaaattggacaaagaaattgaggaatttgttcaaaattgtgagccgtgccaattggctgcaaaggcaccgatcaaaaccgatctccattcatggccaaaaccaactggcccgtggcaacgaattcacatcgactttgctgggccattctttggcaaaatattttttattgtcgttgactcattttccaaatacaccgaggtatttgagatgacaaattcatcagcaactgccacaatcgaaaaattgcgttatttatttacgcgccatggcatcccagaaacaattgtttctgacaatggcacgcaattttccagttcggaattcgacaaatttgttgcagccaacggcatcacacacttattttcggccccatataatccaatgtcaaatggacaagtggagagatttgtcgacacatttaagagagcattcagaaaattaaaaggggaggggaagccaaacaaggagatcatcgacacttttctgatcacctatcggacgactccaaacgacacacttcctgatttgaagtgtcccgctgaattgctgctcg

SEQ ID NO: 2838 - DNA, 2562 bp, Heterodera glycines
ccgttgctttcccattttcggaaaataaaaagggcattcggcaggtccagcttcaacccgattgttaccctggttcactcattttgttggcattatgactttcaaaattgaattatgtcaaaaccacggattttggacagccaggcgcactctcccgtctcattgcaaaaggcggagaagaggaaaacgaacgagtcattgccttgatcaccgccgaaccaattttggaagaaattctccattcagcctcgaaaaatttgccgatcaaattcgaagatttggtcatcgccagcaaaaatgactacaacattcagaaagtcatcaaattcattcgccaaggctggccaaatgaaaaacaaattgagaaagaatcggataccatcaaactcttccatcggcgcaaaagtgatctgacaattttgaaaggctgcctcatgtatggcgaaagagtggtcattccgaggatttttcaggccaaaattctccgattatttcacaaaggccaccccggaatgaagagaatgaagcagctcgcccgccaatacatattctggccgaaattggacaaagaaattgaggattatgtccaaaactgtgagccgtgccaattggctgcaaaggcaccgatcaaaaccgatctccattcatggccaaaaccaactggcccgtggcaacgaattcacatcgactttgctgggccattcttcggcaaaacatttttaattgtcgttgattcattttccaaatacccggaagtatttgagatggcaaattcaacagcatcggccacaatcgaaaaattgcgttatttatttacgcgccatggcatcccagaaacaattgtttctgacattggcacgcaattttccagttcggaatttgccaaattcgttgcggccaacggcatcacacacttattttcggccccatataatccaatgtcaaatggacaagtggagagatttgtcgacacatttaagagagcattcagaaaattaaaaggggaggggaagcctaacaaggagatcatcgacacttttctgatcacctaccgtacaaccccaaacgattcacttccggacttgaagtgccccgctgaactgctgctcggtcgaaggccaaggacaacaattgatctgcttcggccaccaccacaccaaccatttgaaattgatttggagatggaaaggcaattcaacaagaaatttggcaccaaaaatcgaagatttattttgaatgagaaagtcttcgctcgccatcgctcctcgcaacattggaagacaggagtgatcagcggcacatctggagtgatttttgaagtcaaatttcccgacggatcattcggccgttttcacgcgaatcaattgcgcaacaggaaaacagccgacaattttgatcagtccttggccatattaaatgaggcatttgagttgccattgcctccggccctgcccaatcaaccacccgacgcagaaaatgccaatttagggcccaatcaattggaaaacgaggtggcagaacccattcaggacaatttggctgctccaattgaggacgtcccaattcaacgacgctatcctcaacgccaacgtcgtaaaccgaaccgcttttcacccgggccatgaactgatcagcctaaaaggggaggtgttcgggcaggcacattttgcccccgatttatttatttccctctcttcattttccttcactgtttgcagtgtctgttctctccgtgttagagacagacacacacatgcatattgattgacctttgcccttcccaattattcctccccattcatggctgaattcattctgttgtttccccaatttatttgctccgctcccccgtttttggatttatttttaatttattatttgcgtaataaatttatttgttgtttggacttgtggtcctaacattggcgacgcccgtcaaaattcatcggactatttattattcgaacgtgttcgaccatttattcaattcgaacaattttcatcgcaaattcatcgcgtcaattggatttattctcgtgttgaataaattcatttttgggaagttcagaaagctcgtgttgatttctgacttcgctgatccatcaaaaaacttaattcctcgtgttggaattggttctgctatgtgcagtttttaattcatcaatcaaatggcaaacgcaaaccccccgacattggaccagctcatcacggtccttcaacagcagcagcaattggtccaacaacttttggccaatcaattaccgcaaaatgctgcactgctgctgctccaccgacaattacaattccgtcactgccagatgttcatccatttgaaccgacggatgacaaaagcaggatttcggaatggttggcccgcttcaaattcgcacttgactgcgcggcacccaatgccattgacgcaacaaaagtcaaatgcctcatgaacaaattgagcgaggccgcattcagcgaatacagccgctccgtcctcccatctgctgtcactgattttaattatgattacacaattttgaaaatggaaaaattatttgcaaggcccca

SEQ ID NO: 2839 - DNA, 3457 bp, Heterodera glycines
aagccatgtttgacatgcccgcgccgacccaatatttcgtcatgcgctcatttttgggtatggtcaaccattaccagcaattcgtcaggaacatgcgcttcattcgcaaaccgctggacgatctgctcaagcacgaagcaaaatggaattggtgcgacaattgtcgcaaatcatttcaaaagttgaaaaacattttgacttcggatttattattgacacattatgatccaaaattggaaataattgtggccgccgatgcttcggagcttggaatcggcgccgtcatttcccatcgattcgcaaatgggacaattaaggccatcgcacatgcatcaaagtcactcgcgcccgccgaaaagaattactctcaaattgagaaggaagggctggccttgatcttcgctgtgcagaaattccacaaaatgatttatggtcggaaatttattctccaaaccgatcataagccgttgctctccattttcggaaataaaaagggcattcggcagtgcagcgtcaaccgattgttacgctggtcactcattttgttggcatatgacttcaaaattgaatatgtcaaaccacggattttggacaggcagacgcactctcccgtctcattgcaaaaggcggagaagaggaaaacgaacgcgtcattgccttgatcaccgccgaaccaattttggaagaaattctccattcagcctcgaaaaatttgccgatcaaattcgaagatttggtcatcgccagcaaaaatgactacaacattcaaaaagtcataaaattcatccgccaaggctggccaaatgaaaagcaaattgagaaagaatcggataccatcaaactcttccatcggcgcaaaagtgatctgacaattttgaaaggctgcctcatgtatggcgaaagagtcgtcattccgaaaatttttcagcccaaaattctccgactttttcacaagggccatccaggaatgaaacggatgaaacaactcgcccgacaatacatatttggccaaaattggacaaagaaattgaggaatttgttcaaaattgtgagccgtgccaattggctgcaaaggcaccgatcaaaaccgatctccattcatggccaaaaccaactggcccgtggcaacgaattcacatcgactttgctgggccattctttggcaaaatattttttattgtcgttgactcattttccaaataccccgaggtatttgagatgacaaattcatcagcaactgccacaatcgaaaaattgcgttatttattcacacgccatggaattccagaaacaattgtttctgacaatggcacgcaattttcgagctcagaattcgccaaatttgttgcggccaacggtatcactcattttttctccgccccatataatccaatgtcaaatggacaagtggaaagatttgtcgacacatttaagagagcattcagaaaattaaaaggggaggggaagccaaacaaggagatcatcgacacttttctgatcacctatcggacgactccaaacacaacgattgatctccttcggccaccgccacaccaaccatttgaaattgatttggagatggaaaggcaattcaacaagaaatttggcaccaaaaatcgaagatttattttgaatgagaaagtcttcgctcgccatcgctcctcgcaacattggaagacagataatttttttgaacgttccattacattataatcgaaaatatttgtaaaaagaattaattgctgatcggacggtgccgaaaagatccaataaaaatttattttttaaaatgtttggatttattatagactaatataattcatttattttattttcggatttgaacccggaccttcaaaaataggaatttaaatgggctactaattccgttcgcccaaaactccgccgggcaaaaaattttcaaacttagaattcaagagaaaaagcttagaaaaattttttcttataaaattctaagaaaaaattaatttcaaaaaatttctagcgattttttcaaaacttaatgatgaaaaactaagttttttcaaaaaattttcaaaaaaatcactggaaaattctttgaaaatatttttatcctcgagttttttaagatacttcatgaaaaaagttttttgagaatttttgacttttcgaatttgagtccgggactcgtaattggtcgaaatggagatcggattcataatcagcgccctcaaaacccaggaacaataatctttatttcgatacatatttaattgtgaccaaatccaaaaaggccaaaaacagacaaaaaaatatacacaaaatgtttttacaaatcaccaaatcctaaaatcaaagacatttaatataaatggaatggaatcatttgcggaaaatcgcactgaaaagcacagtgtcatcgcgaatcagaaaggcacagaacggatggttagcaacaaaacgttcttctttgctcgaaccacactccacttcttcttctgtgactgccgcagcgacggtgccctcctcattcacctaaatttcgttgtttaaattagtttttttttttgagaattgagctaaaactggtcaaaaatatataaattttctctggaccggctggtgacttttttttattttgcaattcgatggtggcaaatttgtataaatggaatccacaaaaataagggcactaattgtgggcaatcaccgtacctcaatgaccgccttctgcaccactttgctgatcagcaacggtttattgttggaaatgccctcaaaattggcgctgtcggtgaacgcggtggccatgcccatgttggtcaacggttcgttcaattcgtgcgtggctttcaacgtgaacttgggcaactgcacctgtgaaaagaagaggattgtcattgtgttttaggacagttcatttaggccaggcccgtatccaggggggggggatccccccgaaatgaaaaagaaaaattcttcaagcaaaaatgggcaattttttaaaattttggcaaattttttgaaaaattcttatcatgctccattaaatcttttaaaaaaaatttccccagcggcgccatcggcaccgctggactccattgaagcattatattttgaaaaattggcccaaaaatggaaaaattagtgccttttggcacaaatcgctacaaaattctgccttttcagcccagctctattttttgtgattttttcggagaaattgtcctcctcctggggtttatctaccttcactttgcatttgtcccgctttttgatcagtttcaccagccttttgccgtccaattgagccaacacttcggtcagtccaaagcgtttcttgggcaacaaaacgaacatgaactccttttcgcctttgtagggcatgccgaggagttggagctgtacaagcaatcagaaaattgtcaaattcataagaaaaaagcatgaaaatgtgtgaattgatcgacctgag

SEQ ID NO: 2840 - DNA, 2332 bp, Heterodera glycines
caaaaaatttttttttgtctacagataggttagtctggcacatagccgtagcgatttcatactaccgttgtggttctatactaataaattcctcaaatatgctcgataacacgaaatttgctctcgttaagcactgaaaaaattcccgagcagctacagataggttagtctggcacatagccgtagcgatttcatactaccgttgtggttctatactaataaattcctcaaatatgctcgataacacgaaatttgctctcgttaagcactgaaaagattcccgagcagataactgggtcagtatttggggtttcgacgattttttgcaattttctggaagagtttaacctcagctttccaatggtatatgaattttttttgttactcgaatattcgcggagatatgcacaatcgaatttcagaaaaaaagatgatgcagaattctataaaaatacatcgtttgatgatcattttctggggacaacgggtgaaaattattcacaagtccaattctgaataataacttgcaaaaaatttttttttgtctacagataggttagtctggcacatagccgtagcgatttcatactaccgttgtggttctatactaataaattcctcaaatatgctcgataacacgaaatttgctctcgttaagcactgaaaagattcccgagcagctacagataggttagtctggcacatagccgtagcgatttcatactaccgttgtggttctatactaataaattcctcaaatatgctcgataacacgaaatttgctctcgttaagcactgaaaagattcccgagcagataactgggtcagtatttggggtttcgacgattttttgcaattttctggaagagtttaacctcagctttccaatggtatatgaattttttttgttactcgaatattcgcggagatatgcacaatcgaatttcagaaaaaaagatgatgcagaattctataaaaatacatcgtttgatgatcattttctggggacaacgggtgaaaattattcacaagtccaattctgaataataacttgcaaaaaaattttttttgtctacagataggttagtctggcacatagccgtagcgatttcatactaccgttgtggttctatactaataaattcctcaaatatgctcgataacacgaaatttgctctcgttaagcactgaaaagattcccgagcagctacagataggttagtctggcacatagccgtagcgatttcatactaccgttgtggttctatactaataaattcctcaaatatgctcgataacacgaaatttgctctcgttaagcactgaaaagattcccgagcagataactgggtcagtatttggggtttcgacgattttttgcaattttctggaagagtttaacctcagctttccaatggtatatgaattttttttgttactcgaatattcgcggagatatgcacaatcgaatttcagaaaaaaagatgatgcagaattctataaaaatacatcgtttgatgatcattttctggggacaacgggtgaaaattattcacaagtccaattctgaataataacttgcaaaaaatttttttttgtctacagataggttagtctggcacatagccgtagcgatttcatactaccgttgtggttctatactaataaattcctcaaatatgctcgataacacgaaatttgctctcgttaagcactgaaaagattcccgagcagataactgggtcagtatttggggtttcgacgattttttgcaattttctggaagagtttaacctcagctttccaatggtatatgaattttttttgttactcgaatattcgcggagatatgcacaatcgaatttcagaaaaaaagatgatgcagaattctataaaaatacatcgtttgatgatcattttctggggacaacgggtgaaaattattcacaagtccaattctgaataataacttgcaaaaaatttttttttgtctacagataggttagtctggcacatagccgtagcgatttcatactaccgttgtggttctatactaataaattcctcaaatatgctcgataacacgaaatttgctctcgttaagcactgaaaagattcccgagcagctacagataggttagtctggcacatagccgtagcgatttcatactaccgttgtggttctatactaataaattcctcaaatatgcatggaacacgaaatttgctctcgttaagcactgaaaagattcgcggagatatgcacaatcggatttcagaaaaaaagatgatggcgaattctataaaaaaacatcgtttgattgatcatttt

SEQ ID NO: 2841 - DNA, 1019 bp, Heterodera glycines
  misc_feature (20)..(20): n is a, c, g, or t
  misc_feature (65)..(65): n is a, c, g, or t
ttttcctccctttttccgcntccttttcctcccattgtcccacccttttcctccctttttccgcntccttttcctcccttttctttcccttttccccttttttctcctttttcctctctttttttctcacttctctctttcccctctcttcaattctctctccaaaaattcattttgtccatttactatttgtttttctatgcaccgaggcaaaagaaacacattttgcccaaaaatggccaatttggcccgaaacggccaacaaaccaaaattggcttatgaatggcttatttgggggcgtagcgacgggcggccaaatccgtcgtccattccccggggaaatgcatttcaaagcgacagattccgaaaaagtttggccagtcgccctcggggcgagtgcattatgccaacaaatttcattcatatttgtagcgttttctcccaggccttcgaagagagaaaagtcggggatagctgagaaatttaaaaatatagcaattagtcaggggaggaaattttcattatgaattgaaaaagataagggaatttttccaaaatgagaaatcttagaattttaaagacgctctcatctgctgatttggagtgcaacagaagggattcgcaatttccgaatctgtcgggggggggggggtaaccctaatttctcgccatcctttaaaattttacaaatttgcattttttaatttaatttttaattaaaaattaaaaagccataaacattatttttctctttattaaattccttttgcattctctccgaataaatgttaaattcgcctccgttttttggtccaccgccggcgaacggcgcccaacgacgggcgacggacgatcattacgacattccatgggagttcaaaaatcgggcgttggccgcggtggttggccaacaatatcagaacaaaaagagaagcgaaaaagcggcggaagtgccaaaagaaagggccgaaaatgaaatggtaaaataaaattaaaaaaagtaggcgacggaatgcca

SEQ ID NO: 2842 - DNA, 5254 bp, Heterodera glycines
  misc_feature (4674)..(4675): n is a, c, g, or t
ttctccattttcactttttgtgccaatttcagtcgtttttcgactctccccagatggcgtctcttcttccgcgtgctcccccgtgcttctccccgtcctcctccgcctccccttccgcttcttcctcttctgctgaaagtgtttctgccattccccaaaatgtttttccgtccgttccgtcccatcgccacggagagacgccgccgcgccaaacgaacgaacggcgccaatcgccgcgcaaatgcaaaagaccgtcggcggagcagcagaacggcacgtcgtcatcatgtgatgcgatggccaatagcaaaacacagctgcgcaattatccaatggtggagatgccggcgaatgccaaagcaaaagaagtgagaggaaagtgccagggaaatttacaaattattgcgtaactctctctttctctcttcatccatctccaaatttctctctctacaagatgattttctacagtaccctctctctctttctctctctctctctacaagatgattttctacagtaccctctctctctttctctctctctctctctctctacaaaatggtttctatcgtaccccacccttctcaaaggtaacagcgctttgccagcggcgccactgtccgccggcgctggaggagttggacaatttggtgcatgagaagttggaccggtgtcagtctgaacaaattctgggcaagatgaatctcggcgcgcatttgctaaggcgaaggcccgaccgaaacttggcactttccttcagggcaaaagaaggcaattagacacgcagagaatgagacgagagtaatcccatgcttttgcaggtgttttgcacataaaactcgagttccaccaaggcgaatggattctcggcgacggaccgtacggaaatttaattgggccaattaaacaaattggcgggattcaattaaaataggctattcgataattatcatttttaatcgcaggcgcttccccaacgtccacgaaatgcttcgcgcctatcgccgtaaagtgctgccggtgcgcggtgccgaacaaattcgccttggcgttctgctaaagccgtcggattttcccgggggccttttgctgctttgactgtccgacggcggcgtttcctcgtccaagtgatcaaaaaaacatataaatgattgtgatgtacatatgtatacattttataatcgcaaataatatataattgtgatttattggacattgtctttgaaaaataattgcgattttttggaattatgctttactccgagtaaattgttggtaaaatagcatgtaccgtatttgttgaatttgagccccccttttgagcggagttgaaaaattgagctcccgggggttttaattcaataaatacggtaaataataacaccaagacgaatatgaacagataatgaagaaaagaaagagagctaaatcaaaattcatttaaaactaccatttaaaattaaaagtgccgttgaaaaatattaaaatggaaataaacactgtgtccatttgttggcatttcctttttcgttattttccaaaatataattttcccctttttacaacaacagcggagtttgtgctgctaaattagctgattatctgtcttcctcccaaatgcttctctgtccaaattaggctgctccgaagtctctgccgttttgccaaatttgccgatgccctcgggcaaagaattaatccttcggcatttcggtcgtcttacatctcgccaaagggcatttcacttctcccccgcttcgcttccattgctcccgtcgttgtgacaattcgacccaacgcatttttggccataactccgggggaaaaaggggaggcaaaggaaggggagaaaagttcagaaattaaaaaaggaattgccggagggagagaaagaagggcaagccaaaaacactcattcattcattcgaatatcacaaaatatgcttattgttatgagatcaactttttgtttttcattgtttttttctcattatttaaaataattttgctgtgtaaaagcataaattccctaattattcgctaattctgtcttttgttcctttgccaatgaatttgcgctccctttgcttcgttggcattctttcgcttctttttccgttgtgccgtccctttttgaccgagcttcgccattggtcgtacgatggcgttggcacttttttgccaatttgtcgcgtttgtttgtgcacgcgacaaaacggcgtggagtgtgtgccgcgccgggagggcgaaaagtttcagcttagggaagtgagtcgcccattcattttggcataatatttgtctttttcccccattttttttgtcattttcggtgcttttgccacgttgggccgattctctgtcttttgtcaatctttcgttctccgcctttccgcttttcgccactgcgcctcgcattcgtcaacttcagctccgccactgtgccatcgatgctccaatctctccgtcggcatttttgccgtttcactccttggaaagtttccatttgacgcattgtcgtctaatgggtcgtgacaacacattgcctcaagcattgttcagaccattggacaaattgcgcgaattgttcctgtcgggcaacggacttcgaaccgtacgcattgaaattggtgggtacgtacagaacgacgttggcatgaagatttttatataattgtaggcttattaaaggaccgaaattaagctagccaatgaccaaggcttaatcagtttagcaggcccaattctcgaccgattggacttgagccgaaaccgattatgcccttctcgaaaaaattcaaacgacactttcggcatcgaatggcctccggcaagacaactgagccttgaaaatgccaatgtgttagaactgaacagcacacattggacatttggggaagtcaaagtcgaacaacagcagaaggtgcctgataattaattgcttaatcatagcaattcatttgatcagcttaaaatttcactaaaaacggtggagtgccatgtgtcaattactgagagccattggaaggcgtttgaacagctccgaattggaggaaaccacgcacttcgactacacccttctgtactgccacggtatctgctgaatgccgacaaataacaaataattatgtcaattgggcggattatcaattaattggctaattaaatgcctcttactcaccgccgttgatttgcatttgcatttatgcctacaattagactgctcactcttcatcatttggacttttccgatgccgcgtccgtgccggaagagttgtttttggaatggacacgacaggcggaaacgcaatggcatcacattgggctgagaagagcaaaaatcaaagccaaagctggtgctgatcagccaaatctgcgccaaaatcagtggacattttgctcagccaaattggaatggttggacatctcagaaatgggcagcattggtaattaattaataattaattaattggggaaaaggcagcaacaaaaaacagctgaagtcggcacattacgattggacggatgcgttcagctcaaatggctttatgcggacgcaaatgccctgggggacattcaaatcggcgactcgggccctgcggcgcttctgtctttgtccgcacgcgacaaccgccttcgccgttggccagcgggtctgttgcgctcggctcgctctttgtcgtctgttcagttggccaacaattccatcgcgcgactgccgcccgaacttttcgagcagtacacgcagctgaactcgttggacctatcgcaaaatgcattctatcacttccattttggcgattcgtcccatcagcagcagaccacactcatattcctcaacctcagccaaaaccgactccgttccgtttcactcccaacactgtctagtctgaccctcttggacctatcgtacaacattttgacggagttcgcctctttgagttcgctgccctccctggagcatctccacctgagtgggaacgcgggcattcgtctgaccatcgcagcggaacatcccgcgctccttcggcttcacttagccaactgttctcttacgaaaatgcccgatttgagtcggctaatcgcactccgagaattggatttacgtaccaatgggtatggttgttttcattggtttgcttttaattgttttggcacaggctcgagtcagtgccgggccatttgctgccttcgcgcggagtcaatgcgttggacgtcgaggggaacgctctgcgggaattgggctgggattggcgagccgaacaattggccgcgttgcgcgacttgcgcgccgtgggaaatccatgggaatgcgcgtgcgaattcgcaccaccggtggtgcagcaactgttcaccccacaaacacagcaaacgaccgtaagagcagcaacagagggaaaagccggactgtggccattcccatggcttatgaccccccggggcatttggaagaatggcactcaccttcccaaaaggaattgactaaatgcgaaccaatgaacgaatgccattcgaacattttcagaatcaaaggacacttttctgtggggggaaatgttcacgcggagacaaacacagaaaagttgagaatgagcacagagaagcagcagaacagcagcaaaacggtagttattaatttagcactaattaactggctaattaccccccccnncccctcctgcagattccgtcccaaatcccttcgtcttttttctgcctccatttgcgcttattggcgccactttcgtcggcatttatttgctaatgcgcgggtctctgaaaagggaatggcgccgccgttctttcgtttcttcgcatttcgcttatcggcgagttcagtcagatggagaagcaatttgagaaaacaaagagaagaaagtgttgaagggaatgatcacctttccaattgattaggttaactgatcaatccattcacattacaaatttttaattcctcactaaaattaacaaaaactgacaattttaataattcattattttagaaggaattttataaattttttaaatgacctccattgcatgaaaaggtaatactttagatggtacccccgttttgaaaaaaatattttctaagggttttctgggccgctgatcacgaatctggcatccatttcgaccaattcctatcttggaccataattggaacaagaagtcgaacattcagattttccgagtttctcatttttggtactaaatcggcttaaaaataaggaaacaaactataagttat

SEQ ID NO: 2843 - DNA, 2184 bp, Heterodera glycines
  misc_feature (26)..(26): n is a, c, g, or t
gagctggccgatttgtcggaatttgnccaggaggcgccggggcgggccgtggcactggcgaggaattgttgctgaaaactcacattcgaatgtacaaaataaagccacccaaaagggcgcaattcgtctccacccccgcagtttctcccattaaaattgtcataataaatgactgaagaaaggcattgcagaaaatgccccgaaatgttaccggaaatcgttcgccggtgacaccaccggagggggcaaatcggtggccatcgtggccatgttcacgtcgctgatgatgcgcagtgcctccttgcacgattggtacatgcggaggatttcctcacgcttttgagcctcgagcggcgactcctccatcaattgttcctaagcagcaaaatgcgtttttaatatgaacaaaaataaaaccgaagggggctaccgtatccccgccatgttggtacagactcgccaacagttcatccttcagaaagtcgcccaactgaaaaaatatgtgatttttaatcaatgaaaatataatttaagtaataaaattacttgtaaaactttttctttgcttaccttgtttacgataagatgcattatcgccttcgggaccaagtcgcggatggttttgttgataatgcgcatgtacgagtccaccaaatttcgaatggtttccacctgacgctccaactgcgggtccaaactgctcggctcctccacatgaccattctgaaaatgtaaaattgaaattaaaaaacacaaaaaataaataaaaataaatttaaaaaggagaaacggacaaaaaacaaaaaaggacaaacgaaaagacgaaaaatgaacccactcaatggccaaccaacggaaggaaactgacctcttgctttaagggaaggataaataaagcaaacattcggatttgattaaatgcgacaatcaaaagaccaaaacgtaaatgatggactaattttccgaatttgctaatgaaggccctccccccccccgccgttctccgtccgctcacttcgtccgatgtcggctgatgctccttctcaggataaactccggcacggagaaagctggccttccatgcgtccacttcgtccaagtttttagcactcagctccaattctttgtagtctttgtaaatgttcctgagaaggaaggaacaaatttcaataaggaaatgcaaaaataacaaaacccaaaaaaacaaagcaacgaaaagcaaaggcacaaaagaaaaatggggaaattggagacaaaacgcaacaaaaggaaaaggacagaaaggggcaacccaaagggacgacaattgggacgaggacagaacggcaaaaaggcagctcactatcatcgcgagttatgtgcgatttggccctttccgcccactcacctcctggaagcgaaaaacgtaaaaatggagagacaaatgaacacacataattagggataaaaggtggaaattgtaaaagggagggggcagatagggctgtataaaaacagcaattcccgggtcaaactgttcagtttttgaagcatcccttgttaatgcatgtaaaataatgcccaaaaatggacaggaccgaattcacaaagggaaaattggaaagagggaagaatgtattggttttgcgcatttgtgccaaataaaagtttaatgaaacttggcactgtttttggctgatggcttcgtccactccgacacagaccaaaaattgggggaaaatcggaagggatgaagactcactcacatgctaaatgcacacttttcattcaatgattgcgcattttgtaaaaaaaatacaagggaagggaaacggcaaggaatgaatgaatgaatgggcccggccaccccgttcccttcccgtctcactttccgtccgggtagaaaagtgcaaatttgtgctgccgggacatgaagccggcctcgaggtccttcagtttgatgccgtccagtgggagcatgtacttcttctccttctcctgcaaaacccgtttttcggttacttcgccttctttcttccttttttttacctcgtcatctttgtaccacgaaagactgtccgatgttaggacgaaccaacactcgcgagaaccgcgaacaaaactgatgttgtgcacggagagccatccctttgcgatcacttggttgcccaggtttttcttcgtgttcgtggacgacgcctttgc

SEQ ID NO: 2844 - DNA, 1601 bp, Heterodera glycines
agtcgcgcagtcgtgggtatcggttgacgcacaccgcgcactgtcgcacgacgttggccaactcattgaccaccaaatcgacgcatttaagcgccggctccttcagccgttcgatttgcttcttcacgatcgcttcgaatgccatgtcgggggtgaacagaccgaccctggcaaaggcaattagcgaatgatgggcataataattggggaaggaaccgaatgccgtggatgttgcgaatggcgaattgaatctcacggcgcatttccttctcgtcgatggtcattttcacgatttcgaaggggaaacgctcgtggaagagccgattgatgcgagcaccgccggagagttcgttggtgctgaccattttggcggaagaaccctcaatggaccgctccatgtcggtggtgaactgctggaccatcctaagcaaaatggcaacggatgcaagaccaatttattcacagaagcgaccacgtttgataaattagcaaaacaaatattagctaaattctcaatatcagcgacccattagccattgaacgaacataattaaatttcaacagagaaatacacatttagacacccacgtggcgtaaaataagcaattatccccaattatattaattgtatgttttctgagtcgtttctttatggaaggggctgatgtgtgactaaaatttgaccaatgccttccccccccccactcactgcatcagtgccttagttttgcgcgacgggtcgttgaattggaagtttttgtactcggccacctccttctccatggagtacagcttcttctgcaggttgtccctcagcgtgggcagtgtgtctttgatgtgattggtcagctgttggttcagtgccttttgcaggtacggcgtgcccaatctgtccgccatgtgccggtattgttggtgtgacagaaaaaatttccgctcggcgtccagcgcctggcggatgtccttgcggccgacgatgtccttctgagaacgattgatcacgccgacataacctaagcagaaaaggggaagcgaaggcattggaagggaaaaacactcggaaaaggaggaaaatggcatccaaaatgcccaaagaataccccgtctgagtgggaacactttgttctcgaggatgtcccgcgcgtcagtgccttcgtccatcaagtccaacttggtcagtactccgatggtgcggaggccctgagggtccacttcccgggccaatttaagcgcgtccgaagtggccaagtcgctgttggccggtgtaacggccaaaacgaggcaagtttcgcgggaaatgtacgtgccgatcatgtcacggatttgctgctcaatgtcgggcggctgatcgcccaccggaactttggtcagtccgggcaaatcgatcaaagtcaaattgagcactaaaaatattcccaaatttcacaagcagcatcaaattaaatcatcagaaaattttatttacaaattcaaaatttaatgaagaaagtttgtcgattttcgcctacatacgggcataattgggtattgatttgactgttaagctggcttttaaagacacgcaccccgccaaaaaatataaccaaatgacaattccgaaa

SEQ ID NO: 2845 - DNA, 4601 bp, Heterodera glycines
gaaccgaagctgtctgtacgaatcgatgacaaatttgtgccatttccattgccggaccgtccgttgcccagcaaaattcgctttaagcgtctttatattgagtaattcaaaatctgagctatgacaataaaagcattcatcccatttttaggtacatcgatcactccgtcatcgcttttcttcgttcaaatcatcaaattttcgacaaaagaggcaccaatttacagttgttttggatttcttcaccacacaccacggatggccagcggatttgggatgtttttgttcgtgaaatttggcccattttttcgacaaacattcgccatttgggcttttaccatggtgatgatttcgaccatttgcttcgtcgcacttcgccgacaattctcactgatcttaaccaattgaattcaatctattcatttggtctgtcgcccgctgcgattgatgctgattttgatgcaacaatttctgctggccaagcattgtccaaatggttgcactctccgagaaaagatggccaacccaagcgattgcattgcgaagattacaacgcacaagcgaacactgattggatcaacaatttcaaggaggtgtggtccgggggggggggacaaaacgtagccgcaaatttttattttaattaaaaaaattatttaaaatttagttatctagcctaaatcaaaaaaaatagataaattcgaaaaaaattattaagaaaattcaaggaaatgtaaaaaagtcgtttttttatttttctggaaattcagaaaattagtttttatacgagacggcgacgttttaggggtgtacccggtctgtggatggcattctgagttattttctgaaacccgaccccaaaatttctgaaaaattccgaattttatcaaaaatttcggaaatcggaattcagtgccatccctggtgtggccacaattcgacaaatgattgatttttgttttcaaattgtttagcattttcttcgtgccaatgccatttcttccgtcagttacgaaattcatttttatgttcatgcgccgtcaatacaaatggtgccatttgaattggtgaacgaatgcacaaaggaaaagctgacattggccagagcaaaagaaaatgaatggggcatcggttggataatgaaacgatgcaaaattattggggagaccgcgacggtttattggaaagacggaaattgggacaacaattgcaacaatgtgttcttttggcttttcggtaccactaattgcattgggtgagcaataaaaaggggggatttgtttttatacatatccaaatttgagatttgcgcttaattaaggccattgtctccgccaccggcagaagatacgggacaaagcatcacaaattggccgtcttctgctgacaaatgagtgatggacaaaagaacaaaaaacacaatgatgagctgcagaagaaatgaattaattaaaaatgacctaattcatcagtgatcaaatgcattttatgaagaaaaacctctcaatttcggtaaataaatcagatgcataaaaatggcaaaaaatgtacgaaaacacacaaatttgagatttgcacaaaataatcgacaaaaattgcgggtaagactatggatggtggtgggcccccttttttcgaatcccgaattcgaacaaaaagttcaaaattaaattttttgtaagtcatgaaaatacattttcaaaggttttcggggacgctgatcacgagtccgtcatccatttcggccaaatccgcggattcaaacaaaaatttaaattttaaaaattcacatttgtaaattgttgagcttttaactatgttttcagcgcttaatatacctaaatggctgtattggaagagtttcaaaattttacattgaaaaaattgcatgaaaaactggctttgaatgacaatgattttgtcgaatggcttgagcatttgggactcgtgcattcgcgtcgctcatgtccttgatgtggtggaaatacttcgattgtagcagttggtggaaattggcgttgcactacaaagaattgtcgggcaaaaacagggttcttggttcgtagtgcgacttttgcggaccactatttctcgatagaactgtctaaataaagaaaaaataataagaaattttaataaattcattattccaaattgaattagtgaaggtaagctgatgcaaagcgatctgtctcaattggagagaagtcttatttgacataacttttttctttcttttttatagaatttctaacttataattaaactgtgaaaattggcgaaaaaaattcgctaaattaaatataaaagtcagttcaagaattttatagcaagaaaaatttttatcgtgtttcacttccacgctttagttaaccgagagcttaatttttttccggcatgccaaaccaattaaattaacaaacaaaaactaaaatagtttttctttttctcaaaaattgtccgtaatttgctgttattaaaactatgggtccaaaattaaaaatgagcaactacatactatatttatctatggaaactaagcttctttaaaaaaatgggttctttcgatgttgattgcaaacagttgatcgattactcttgaagggcgatgttcaacttggtaaaaatcacaaataaaactacttagtcactcaatttttgaaaaaataatttttttttttgtttttttgacagttcaacccagaaatagtggtccgcaaaagtcggtccgcaaatgtcggctaacctcttggttgggactttttttgaaggtcttaacttgatcaaaagatacacattgggtgtattggttctattataaggttcaaaattgtcgactaagcaagtttttgaactatcatgtttagcaattttatccatgccaataagcatgttttttatttatttcgtgcatttgaaatttggtttcataaatgtgaatttttaaaatttaaatttttgttcgaattcgggtctggggttcggatttggacgaaatggatgccgcggattcgtgatcagcgtacccgaaaacctttggaaatgtattttcatgacttataaaaaattttaattttgaactttttgttcgaattcgggttcgggattcgaaataggctgaaatagatgtcggattcggtttccccgaccctggcaacccctagaatggtgttatctcgaaaataattttgaaatttttttttcaaaaaattttcgtattcactaaaaattaattaaagcctttctataatttaaaaaatttatacttttcataataaatttttattttgattttgattaggggtatcaaccagggctgggcgtaactggattttcaattacggaaatccggattttctcaattacggaattccgtaatccgtcatgacgggtgtcaaacactgtcaataatatttgctgctgaacaatttaggctaaatctgaaggcttcctgcttagaggaacccaaactcgagaccaaaatatttcaagtgcaatttacgactttcgtaactccccgaaacatgtaggggaacaaccctaattttaatcgttaaatttgtgatcgaattcccatcgaaaaaggtatatttttaaaaattagaagaaaaaataactacttgaaggggaactgatccaacacaacaaaaaagaaaacaaccaagagcacaacccactagaccatgcatatgaatgagtaaatgaagcagaaagttgccaaaattaccttaattttaaattttaaaaaagccaatcattaggggtgtaaaaaagtctcggtctcgagtctcgaaagtcgagaccgagacttacaaactcgagaccgagactctcggacagcactactctgctgccgtctttcgcaagagggtggacatggagggggttaggaggcaaacaaagttagggcccacgagtgattacatcaccatcgaccaaacttggggagagatcggtgctcccgagtttgacctctcaaagtctgaacccttttgtcaacacctctgctggcgtgctgaccttctgtccaaatcactgcgcttgggagttccgaatcaggactgggctcccgttctgatcagtgcgatcactccgatgctagcagagcgctgaataggcactcctgcgaaaaggagtccacttcagtttgatgcgccgaaatgccaaagcaaatgggccgaagataaaacactccaatcgccccgcgggtgtctcgccatttctattttcccacccgtccaaaattgccgacacaaaatcgaaaattgtttattgcaagttgggttcaaacttggataattaaacccctcaaattttttggcggacaaaaattagtgacgagaaaggggcgagcgagtgattggtaaatgtctccccagcagaggggatgggcacaacagataaataaatgcaaatagatgctgtctcgttaaacgcacaaaactgatttaaaaaacaaaatttctgtcccgggtattattcgaacgaaatattgtaactgaaacactgaggacaattcaccagtgaaatatggatacagaaaaccatcctagaagcttcaaactaagcaaacaaaaaaaaattggttttcgtgcgtttca

SEQ ID NO: 2846 - DNA, 6286 bp, Heterodera glycines
  misc_feature (6212)..(6212): n is a, c, g, or t
ttttttatctttctctgcatcaaatttgaaataaaaaaatgcgattaatcgtcaaacgtcaaaagtcttttgctacgccgtcgtccaaaaaaaatcctccctcaacggggcacaagggactgcgacagaaaccaaagaagactccgccatcgaaggggcatttggggctgggattgaaaccgttgaacactccaccaccgaaggcaccgagcccactaatgaatagaaatgtattttgcccttagagtttgtgtttacttgaaaaattaataaaagggttgatcaaagggcccaattggccggcgccaagccgaactcgggcccggcgcttccacaaaatcgtgaacacatttgttgcgaccaaaaaaagaattattgcccagtaaaaagtaggaacaagaagcgaattttgcgtggctgggcatggaacagacggcacaatattcggcacagtatttgggacaaatgccgtttgattatgacagtatttattacaaaagttagtaatatttccaagtatatttctataaaattcccgcatatttttcggcccttccttttgcgttctacgatctgcttcagcagaattagtcaactcatgaaaaaatggataccgaacacacgcagaaaaattggaaaattttagcgaaatttagggaaatagtcaatttttcaagtccccactctgcgttcgacaaatcaccctcatgtcagggttagttggacgcaatgcacgaccctttccttgatctcgccgctgccttttctcgattttcccccttttccttttctctctcttttttctttcccttttttcctttctcccttttttctcgacccccacccttgcacaaaagccttttttcctgacctccccgtggcctgaaacgaacggaaaatatgttttttttgggttattgttaagccatttttcgagttattagtagtgatgctcgaaactctcggtctcgatctcgactcgagaaaagtctcggattttttttggtctcggtcttgagtctcgggttttcagtctcggtctttgagactttcgagactcgagaccgaacttttttacacccctaatgattggctcttggcaaacttatatttttataaaatttagttccttttttgttcaaccttgttaagatatccgtggtccagtggttttgttcttggttctgttccttattttgcgttggatcagttaaatgaaaaattacaagcgtaacaaaaacaatcaaaatgtcactcaacaaaatagtttccccgaacccttaacatttctccaacgggaaggaagtttgcgaatccccctacggaaaaagtctgtgccgatctttgaggtgaggtactgccccaccgcctcctcgacctcggcatcttcagtgaagcgcttgtcccgtaagaaatttttgagagaaaggaaaaggtggtaatccgagggagcaaggtctgggctataaggcggctggggtagcactttccaattcaatgtgttagtgatgtactgggtggtcaaacgtgagcagtgtggaggggcattgtcttggcggaagaccatgggtccatcaaattggccctgctgcctctggatgcggtatgcgatacaaccgcccgcagttggttaatatagaggtactctccaaaatggtcccgggaggcagcagttcccaatacagtgggccatgcacgaaccaaaaaatacacaacattcgctttttttgatggatgttgggacggaggaccaaaatcgggtcttcattcttcttccgccaaacaattttctgcgttgtgccgtcataacatatgtagttagctttcatcacaagtgacaatccggttgagcacatgaccccttcggtgtctggcgatgttcgaaagatacaggtccagccgtcgctgcttctgttgatccgtcagatggtgtgccacccatttggtcctcctcggccgacgaccggactttcgaagccatcgccatgctgttgttttgtggcaatgtcgcgccgacaattctgcacttgaactgtccggctgtcgtcgcaaccgctgtgccaaaacgttcttgtcaaccatcagcggccgccccgaccctcccttgcgtttttgagctggtgcggccctcgcgaaattgctggaaccaatgtcgagccgttcgttctttgcaaacattagctccaacagcctcattgatatgtcgagctgcttgggccactttgtggccaagttggaattgaatgtgtaagagggtatggatattttccttgtcagcggccattacaataagcataaataaattagaaatgcatgaaaatgaatgaatttggtatcaaaatgtagagaacactttaatgtatcgaataaacatcaaattagtctattctaataaaaacgaaaatagttatagtacactaaacataaacggcaactttttatgcaacgacctagttgttttttcgatgggaattcaatcacaattttttaacaattaaaatatgtcatttttggattttttttcacaaagtgcattaaaaagttcaatattttccccggcggcgcctatctgcaccgccggcacctaaaattttgaaaaatgagcaccacaaaaaatggtgtaaagacgtcaatcatatgaaaaggaaaaatggatgggatagcttaaataaggtaaaatgcaaaaaattatgagaaaaaacctcaaaagattcatttttaatcgattttttagtgtgtaagaaaattttttggagaaagtctcggtctcgactcgagaaaagtctcgggttttttgggtctcggtctcggtatctagtctcgggattaagttcggaatcggtctcgagtctcggggtcaagtctcggtctcgggaaatttttgctctcgagcatcactagttattagtagtgaaccgactttgtgacgaaaaatcccgaaatagttaactaaaatagtgacgaaaaagtgccaaaatagtgacaaaatagtgaaaaaagtccaaaatagtgacgaatagtgacataattttcagccaaaaattgagcaaaaaaatctttattcactgattgcagttacaaatgacattcctttcttacatttttttttagcaaatattgaaatttttaaaccaaaaattttgtaagaaaaatttgggggaaaaatttttatgaaaattttccaattctaactggtattttttgaaaaatttttaggtcgattcttaggggtgtattttttgtttttattgcatttttgttaacaaattttccaaaaaatgtcgaaaaagtgaaaaaatagtgacgaaacgccaaaatagtgatttctagtgacgaaaaatgacgtccaaatgaaaaaattttaacgcagaaatgcgttttttgagctcctttcttcaaaacaattgagcaaaaaaaaaagttttttcactagaaatcggttccctagttattagtgactattaggtttttatttttaggtcctaaatgcctaaaaaaaaatttcgaaagaacctatttttgattttatagatacacccttaagcaattaaaattttctaaaaaattcatttaaaaattttattttttgaaaagaatttttgtttttaaaaatttttcctaatttttttacttttttgaataaattttgtcaatttacacacctaaatttgagactttttagagcctattttccttttagaacctatttttagggttttttagagcataaaacctacatattttgcggtttttaatccgaattttttaaatatatttgagaggtttttttcataaatatacattttatcactaatcaattatgattggtccattattttcttaattaattcatttcttcttctgcggctgatcaccgttccgtttttgttcgtttgtccgtcactaattgtcagcagaagacgacactttttcgctgttttgtcccgcttcttgttcttcttctgctgatggcggagacaatggccttaattaagcgaaatttgaattatttaacaaaactaaatgttttttttaattgctcacccaatgcaatcagtactgaaaagccaaatggccacattgttaaaattgttgccccaattttcatctttctgaagctgaacatccgcggcctctccaattttgcatcgcttcattatccaattctccaagtcattttcgttttctttggtcaatgtcagcttttcctttgtccattcgttcaccaattcaaacggcaccattggcattgacggcacgcgaaaagaaaaatgaatttggtaactgacggaagaaatggcattggcacgaagaaaatgctaaacaatttgataaaacaaaaatcacaaaaatgttgggccacacctccttgaaactgtcgatccaattggtgttcccttgttcgttgtaatcttcgcaacgcaatcgcttgggttgtccatcttttctcggagagtgcaaccatttggacaatgcttggccagcagaaattgttgcatttggcccatcaaaatcatcaccaaacgcagcgggcgacagaccatatgaatcgattgaagtcaattggttgagatcagtgagaattgttggcgaagtgcgacgacgcaaattgtccaaatgatcaccacgggaaaagcccaaacagcgaatgtttgccgaaaaaattggccaaatttcacgggccaaaacatcccaaattggttggccattcgtagagtgtggtgatggaatccacaaatataaattggtgcctcttttgtcgaaaatttggtgatttgaacgaagaaaagcgatgacggagtgatggtgtaccgacatttcgccaacttgacatctcgccaactgacatctcgccaactgacatttcgccaactcagccaaaaacattcatttcgccaactcaaccaaaaacattcatttcgccaactcagccaaaaacattcatttcgcctactaagccaaaatctgacatttcgccaactgacatttcgccaaatagttaaaaaaattaaagaaaaaagtaaaaagagtaaaaaaatgctgtgttaatatcaaatacagccctattccagtttacacgtccaatcagtgaccatcatcatttcttatgtcctaacttttttcatatttgttcattccaaccatttttggatcaatcaaagcttaagaattcctttcacttttttataatttcgtttctagcgtaattcagattctagcaagaaatgccaactgtacgcgaaatacttgagagtctgcaaaagcgagtaaaaagaccccgcattgctacaaatgaagacagcgtactgaatgttgagaggacagacgcagaacaacaaattgaaggcacttcacccaggaacaatttggacgtcgcttcgagtgatgacgaagaaaattgtgagcccgttcaattcaaacgtggagaaacaatccggggagctctttgtctttggtatcaaggtgttaatagttttttttttttgatttttggacgagcagaacgtctccagaaaagcacaaaacgacgacaacggtacatcatcaaagaacaaaatgtggtgcgtatccttgacgaggctgactttgaatcgcaagaaggattgacaaacgccttgaatctgatcggacttgtaatgcaaggctttgttgagggacttcacatccgtggaaatgaagacagtgaggaagaaactgatgatacggatggaaattgaatttatgattttaacaatttttacttttatgatttttaacattttacttttttttctttggagtttaataaatatctatttgcttccgtgtatttttaggttaaatttaattattattataataaaaatagctaaatataaaccaatttagaatatatattttggtgaaactcgttgtcaaaatataaattttaggttagtaggcgaaatgaatgttttttgcttagtaggcgaaatgaatgttttttcaaagtcaacagatgcaaaaacaagacgaagaacaacttgtacgaagtgtcaaggaagcgagtgagattatcagaaagttttaattgtgaatgaattgaaaagtccaaattaatgaattttgaattgaattaatttaataacaaacccaattttagttaaccaaagggagcaattgaagcgcaaaatcattttggcgaagatcgtcaccaaaagtttcagtttttagtgctttttactattacgttntcgtttagagtcactaaaattttgggtcgactcgcattgaacgtgggagagagtggccgaacacgaaatgctga

SEQ ID NO: 2847 - DNA, 1356 bp, Heterodera glycines
  misc_feature (7)..(7): n is a, c, g, or t
ccccccnccccccctgttccacaaaatttttggaaaaagcgcgccgcaaaaaaagcagaaaaaaaggagtcgcaaattaggaaaatgatcagtgaaaactagagtggtacgggaccgggaattttgggaaaaaccgtgaccggtaattctcgcccagacccggtcccgacccaccgtagtgaaaacaaaaaaattggaaaaaattcattccggtgaaaaatacaagccatttgaataaattttaaccatttttcattgcataaaataaaaattttaaatgtccttggatttcatgaattttccccactatgtccttgcaaatcggatgcccgtccttggaagccgacattgggcgatcccatccctgccataacgttttgaacctaaaaaaaatttttgccaatgcaccaaaatttaaaagttcggagggattatccataattgacattggtctcatttatggtaatttgttttgacagtgattatttttataatttattttcattttattgcttgttttctttattcacttgctctgtttcgctataattttgacagttacagagtaagtggtccccgcccttctgtgacttatttttcttgcttaataataaattaaatttaatttaaaaaaaaaattaatcaaatcttttttggtaattgcctgaacgctgcgattttatatattttagcttcgttagaatttgtgctttcgaatgataccaaaaaggtagggtttatcgaacatgaacaaagttattgtataaaaacccgggattgacaattgattggactcataaaggtcgattggactcataaactgcactagagcaaaatccgttccctaatcatgacacataaacaaaaagatacaaaaacattcatcaatcccttttcatgtctataaaaatgtttgttttttcactttgtctcgcatttgaaaaaaaaataaaaatttctaacgcaattaattattctgctctttgttgtgtgatatcattcggaactcggccaaaattgtgctaattgccacaaaaatgaaccgacggtaagcaatttgaaaagtcacacaaattcatcatttatttagctaaactgttttccataatttcagttggatttgcaacgacgtttggatggacattttcccatcctttgaccatgctcaactcggcctcaaattggcacttctttcgccacgtttcaatgcgttggtggacaaacatttcgatggcaaaagcgaattgacaatttggagaccaatcgaaattcgtcgcaaggacaaaggaccagaaccgaaactatctgtatggatggatggcaaatttgtgccatttccattgcccgaccgtccgt

SEQ ID NO: 2848 - DNA, 5195 bp, Heterodera glycines
  misc_feature (5174)..(5174): n is a, c, g, or t
tgttgttgcgcgaagtgtacattttttcacgaaccctatttaacgtcaattggttgtgagtaagcactgaataaaattgttagacaaaaccttgcggaatcaatgacataaacgacatcgtcgatagtcactgatgtttcggcaatatttgtagaaaggattatctgaagacagactttttcgaaacattcataaagattatggcaaacagctttttcaacttttgaatatttccttaacacttcattaaagctttaattataatgcagtggtttaaaattataccgtatttttttttaataattcagcccggtcctccgtttgtaaaaaatttgcaaatttaaccttaaaacactgaaaaacctttcgaactccgtccgggacatgctcaaaaacgcggtgctgctcccgggctgtcagttgagaatgaagtgggagcacgagaaagcgttgttggttggagaagacggggtgatgcatggtgagacgattcagcagcagagagatcaaattccaacctaacaattagtcgatgaaaatgcttttctataaaacacggcagcagcagttgttttttaacgaacctggcaaaaagatcagaaccgccccgggacgaccattcgcgtcaatgtcattgagcagtagctaaatgacccaatttgttaactacagatttgtcgtgtgaagtcacttcaataatgtccagtggaatttccctttcgtccatccttcgcagtgctttgttcacttcaggcccgtacccatccccacatctcattaagttctccgaaagttccattgagtcttccgtttcattcatttcttcagtattttcgccatttttcgcggtggcaccagccgcttttgagtccgaatttgatttccgttttttcttctttttccgttcaggttctggcacgggaggcatgtacttgagcatttgaattacatcctccataaagaaatattggacggggtgtacacgttgagtgatttcgatgatgggacaattgccgaaataattcgtgaacaaagttgtctaaataaacaatctactataattggataaattgaaaatcccacatcgatcgtggcggacatgagcagcactttgagcttcggatttgccttgaccatgtcgcgaacgacgatcaacatgaagtcggtgttgatgtccctttcgtgaatctcgtcaatgatcagatgcgaaattccgcgaaggccatgttccatttttcgcattaacactccgacagtcatgaaccttgacagtagagaaaaaggggtcgtttatgccgtttaagtaactcacattattgccccataaggtcgcggacccatccattcaaagcgcacagaataacccacggactcgccgaccgactcacagcgctcctcggccactctctcggccaaagtaatggccgaaatgcgcctgggttgggtgacaacgcaattgaaatgggcacctttgccctgggtgagatggctttccaacaaatattgacagatttgggtggactttccacatccagttgcgcctttgaccaatactacggaattttgctgcacattgtgcatgatttcatcccgatgctaatggtataataaaaaacaaacaatttccagtttccattgaataaaacctgaaaaacggggagggcttgacgtgaagcagtcaaacgggcaggaatctttttgatcttttcccgcgttaacaaatcgttgcttatccattccaaggaacgaaatgccaatgtttgattgtcaatatttgaagcgctgtaaataatgtttatatttttttataattttaactttattatgagacttacttccacgcattccaattttcctggggcggagcccacacaatgttttggctggggagagcttcgttgtccgaaaatggaaactcttcaactttcttctccataaaaagcgtttttggtttcgaatcggacgcaaaatcaatgagattgtcgactgattctatgccattttgcgtcaaatgtgcgtcgatacgctccaccagagaagggtcgacgctcactttgatctcgggcaactgaaacagggaatgaaccacataattctcgtagtaagtcgctggaagccttacattttcgggagatgccttcttcttcgacagctgataaccggtggccccaggcaaagtccctaaaccggagtttattgcattacatttgtgggggattaaccagttacccatatgataaagctgacggacaattgaaagtgcacagctcgtttctgcaacttttttgttcgaaccgacgccgcgaccattgacagctaaaataatctgttattaaatcggtggtgaattgttacttttgttaagcgacggtataaatattccatgttcggacacaaatgttctaaactttatataaagtgcatgataacaacaaaaacccaaacctgttgtgatcagaacctgtagcaacagtgcgatattcgttggttggaatgcgatttttctggcaaaattcgtttagtgcttgtttgcagttctccattgtccatccacctttaagtgtattttaaaaaagaaaaaaaaaacaaaaacttataccatgaatatcggacgtcatgtcaacggattcagactaaattccataatattttcaatttttagttttttgtacctgaatgatttcttccgccttctgttcaacatattggtcatgcgctgtcttttcataaggtgcccattgcggcggtaaaggaacaatatttgtttcaaaattgtcatccgtaaaatccatttgggcggcattttgttgctgatgataaggttgaccaattgcatcagcggaaacagaatcatttccattttgaggagcattatcaatattcgatgcagattcctaaacagaaatataatgcttgtttttggaaagaaaactgaataaaagcaccagaagctgcagttgtggtacttccgacgcattaattaaaccctcacgcacaagaaattggctaaagtcccttgctaaaagaatttatgattaaataatttgacttcctcggacctgcgttagactgcgcatcttttttagaagtggaatttcccaatccaacttaaaaaaaagaataaagacgattttatcttttaaactcaaccataatttagtccggcgactgtcagttggcagatgaagcgtggcttaccacctcgattttcaggcttgatgttgtaattaggagttcccaatttgcgttttcccaacactgcgtataaagactgtttgatgtcactcatttcttattatgtagaatggtgatggatgatggttctaaaatgtttattgactatggctgggattttacacgttacgaaaaaaaagtagagaacgagattttcaaatcagccggactggtccgagccgaaatttccaaaaacaaccggtttacgggtccggactctcgaaaaccgggcaaaccggaaaactcatcaaccggattttcaaatttccgggtctggaaccggtttcctgtgcttttcgagttattagcacctattttcggtactagttaagtttgggtcccccttttgggtcaaattttttcaaaaatttttttttcttttattgtcgcaattgctttttagattgatggaaaagcttaaaaatttgatcctgtcactgggcagcatacaaacacaattgaatcgacgtggcagaagttcaagcaggaacacaaaacgagatttggcagtcacagatcacttttttccacatacatttctgattttttgtggcgtaagcaatttggaggaccggacattttttataatttgtggacccaaatcgcggaattgtacccaataatcacataaatctccttttatttgttatttaaagcaattgcgacaataaaaacaaaaaaaaattttttttttaatttgaccaaaatataggacccaaactgtactagtaccggtttgctatctatcgaatgtatgaatttctccttgaaacttgtgacaattaattttcgggattttgacgcgggatttgcgacacacaaaattagcaccggcaacattaagtgccgatttactgctgttcttttctcttttcagcttcattctctcctcctcctttttgcgccgaatttttcctttttctctctttctcttccgtctctcctccttccctaatgctattttcctccttttcctcctcttgccttatttctccatttttgctgttgtccatcttcatctcctttcccatcgaaatttgctgtactgcttgaacttctatatacacaaatactgctgaaaatcccgaatgagaaatttctcgagcttttttgagctcattcttcggtcagctgatatgaaaaacgaataaaagggaagggatggccaaaaggagaaaagaaaatacaaacaaatatggcacttttggtgccaaagcaaatagtatatgatggaagattaattatcaccgaatcgcggaaccaattaggaggtcattagtatatttttggattttgacgcatatttcgcatcttgtcaatttctggattacctaatttgatttgttaaaatggaacattttgatttttttattaaagaaatttttaatggaaaaataaaatggttaaacttaaattgttttcgttttgtctaactgactaaaatttccgattaaatgtgaaaaagtgattaagaaaaaaggtaaataaaattgagaagaattttgagatttattagcagatattttgcctggaattaccaattttaaaacataaaaaaataatttctcaaaagattttataaactttagctgattctgatcactttcggcctcagaagagcataaaccaaataattcatctttgcttttcattttttggttgaggattaggttgcttttcccaaagtgccgttgtgcgagcaaagaaaatgccgtccgttcccatttacgggcagaagagggcattaagccactcaaattaaccaaacgaaaatcaaatggacagattaatcaatggcaattaatctgagagaagagaaacaaaatgggaacagcagagatgggcagagaaaccatggcatataaaagcacaaatgaaagatgccaaaaccattcagcaccaaaatccaaattagcactaaattctattttgctcccctnatttattttatttatttaccg

SEQ ID NO: 2849 - DNA, 2887 bp, Heterodera glycines
ttttctaaaaaatcgtttcaaataaaaaaacaaaaagaagcaaaaagtatttactcgtaggtgaacctaacttgggggtgaaaaaattctttgatattcatacattgtcactagcagattcactttgacatggcaatccttaacattgtaaaaattctccgctcccatctgggaacgcatgtcggggctcaatgatgttacattgctggtatttttgaacatcaataattcgttttatcgctcattagttgatccttttttgagtttcacttacattccctccgttttgttcatctcctccttgctcttctccaaatcggccttcattttgtcacgatccactgacaatttttgcattttcttttgcattgacttcgtccattcgttggccctttgtgcctaaattcaataaacaaaatgtaatcgtaaatgtttaattgggttcttctatctacctcattcatcaaatgtccttcgagtttctgctgatgcgcctgttggaatgcgatgacctgattcagtttgactccgaattcgtgcatcaaatcgttgggcgagcgaaacaatgcactcagctcaggattcagatggcggttgagcttcatgagtttggcattctgtttatgacacaccaaacaatcaaacggctgtccatttttgatgggggctttaaaagacaatataggtttaaatgttgaccaaaccatcgaaaaagtgtaacagagcaatattggcgctagtttaagaagagcgcaaggttcggaattagtagatgcccttcaaaacacatggaaaaaccgcaatttttcatcattaccgaaaattttgtccccctttttttagtttcaaaaacgcttttttagcgccgaaatattcttcataaaaaaatcgtacaattcgttttcagacacttcgcacaaagcaaatgtccgcacgaagtaaaccaaagtcgcgttttgttatagttttttgtcggcaccgagaagcattggttgcctaagttgtaatgtgatgtttaagtcagaaatttgttttggttcatacaatgaatccaagttgacatttggtgattgtttaaggattgtttaagaatatttacgtaaaatataagctaaaagaaagaaaagccataagattatagcgaacaacaaaaacacacagggccagaatgaggaactgattaatgggtgaaaaattagagacagaaattggggtaaaggaaagttttagagaaaaataacattttgtcgtgggtacttttggtcaagttgatgatatgacatatgaagcagtaaacaaatccatacatatctttcaattaaatgcgggattaatcccgcaggaccgcgtccgcaaaaaaattgagttcaaatcccgtagcttcgagttgacatcattcattttcggtaatccttcggaattgattggtgtcccgaggtcccgacggaaaaaaagataaaaattttctttacattttttcaagggcaaaaaatagctgatcttatatcagaacttggatctttgatttcgaaaatcattgattttcaaaattatcagaaattttttggtgtatctaaattttcaaaaacgccaaagaatttttttaattgcctaaaaggcgctaaaaaatagagatcggcatttctccattcatttggcagccgcagctgcactagcagtagtaaatatttcggcattggcgacggataaattccggtctctagttgaattgttagaataaaattaggtagttaacacttctaaaaatcatttttataatttgaattttatgcctaatgttctttaaaaaatgttagagcaagcaatggttttatgacgcgcttcctcaacacttaaatttagataaaaatgtctgtttctccttcagctaatcggtcggcctcaattggaatttctgcaacagaaacaacttcaaaccaatcttttttctctgaccaacaatctctttcagtgaatatgtccgctaatcaagtcagtcacataaaaaattgaatttattcattgtctcatcttgttatccgccgaaattagattttttcatagatattaggtaaaatagtatgctgatagatgaacacgaaaacgtgaattctggggtttttggagtcgccgatcacgatatggcattcttttgactaattctggaccactgggctgaattcgaaccaaagtcgaaaacaaatttttattcacattatgttcgaatctgaacagagtaactaagatttaatcgtgttatgttatatgactaatttttgctagtcttattatcaattttaaaaacaaaagtgcgaaattgaaaaaattctcggcgggagcaattcctagggattacctttttaccgacattaagttttaaattgggttttgaatagattaccaactcggaggaaaaaacacaacatttgcgacaaagcgaaggtgaaacaaataaagcaacttacaatgaacagcaaaaaaatggtattcttccaattaaattattattgcaaatcgatgccacttaaataaatatttgttttgaatagcaaactgtgaaatgtccacttttgcagcggcacaaatgcagcaacaacaacaagtaagaggacgaggttttgttttgtggaatctgttgagtgcttcggcttgctctatttttctagtctgatcagcagccgatggctcagccgacgctcttcccaattggtgcgatgccttcaatgtcttcttcgtcgatttcctccacgaaacagccgagagatgtgagtggtattttctcaattgactcactcccattcgattgtcaaaatatgggcgtcggagggtggtgaaaagtcactttccctttgaggctaataatgttaagggcattttggcaacatac

SEQ ID NO: 2850 - DNA, 3683 bp, Heterodera glycines
  misc_feature (18)..(18): n is a, c, g, or t
  misc_feature (26)..(26): n is a, c, g, or t
  misc_feature (38)..(39): n is a, c, g, or t
agagaaaaaaaaaatggnccatgttntgtggaaaaganncgggggagcggtttcttaccggtttccctttgttcgatttgtaatatttggccgggggaataacgcgctggttcaaaggaaccgcattttgtccgttcaaaatgttgcccgaaggctgttggtgattttgggtaatttggggaggattttggaccgccgctggggcattattttgagccgaatgatttggtggcggattttggggaggcggagcattgtaagtttggttgtgagtctgttgttggttattttgggcatccgtagggaaatggtaaaccggagggtttgacgcaccattttggttggtagggtgagggtaaaaaggttgttggtacgggttgtagattcccggagggggtgcctggttgtacccgggattgggtacgttgttgttcatagccgggtaggagtaagtgttggggtatgaataattggaattcatgtttctgcagaacaaatatgaggacgtacgggtataggaggcaattaggaacataaacgagagtggtgtgatggggtgaatttcctatttatatacttccccaatttgctaatagagaatcccatcgggattaatgcacatttggggtgggcaatgtgaaaaaattttataaaattattagcgtaaagtgtgggtgggatttttgtacataggcaatttcgactaacttgtcactgcatgactaatgccggccgtccatctggagttagccattgcattactatggtcggtcgtctttgcggttcgacacggtcgcgtcttaggcgtatgggataacgccgtctacgctccattatcatccatgagaaagcgcaaattgtgataaatatgcaaatggcaagaaagccctgccctataatttcttggtgcatccatacaaaaatctttacctcaaaatatttttggtcaatgaatgactggctttccacctcttcgccatgaattgcttgcactattatgcatattgccattattcttatgaaaaggcggtaacctcggaaaattgggtttagcctaattagacaataaaatactaatatgccaaataatatgacacttatgatgatggccaattgaatgcctccaaaaatccagttaaaaaggtgggaaaaatcgccaaactcgggaaagctaaaacctccgggatggtggtttgttcgcgatcctgaaatgcgccaatttcggcctaatgagggtaaataggagagggtccctttcattacgaacatggtttctcccccagggcaaattactttacaaatggaattgatttcagccgaattaagagagagagaagtgttgtgctggatggggttatttgtgcatgggatggcccaattcgccccattttcacacgaaatttcggctaggggggtaccgtaactagctgtacaggtgtaagagaagcggctcccgattcggcaccggtagcaacctgtgatccctgctgggattattttacacgtggccatttgatgacttatggccaattttattccttccatttttaaggcaatttggatcggtacaaaatctgtttcggcccaaatttccttagggtgacggtaatttaggacaaatgggccaatggacaacggtaatttagtcgttggatcttccaacaatttttcaacgtccgtttcgcggcaatgacagcggacagtgccttcactgtggtccggtcggcactttgtgcaagaatttagggaaagactgcactgcattaagtttgccgatatttcatccggacaattcagagatggttgaaaagacggtacgagtgcggctttgtcccggcctccaatgaatatgccggataatccaggagcggcgggactgccaaaaacggctggcgttacggataattttgccattttaagatggaaagtgtggcccgaatataggaccgtttcctcaaaatgtgatggatttccatgcaaattaatttttacccttaacataatcctaaagtcccaggcaggacatctgaatatttcgtaaacaaatttatttccgtgtttagtgggaacagcataattccgataatataggcaagcggaattggtccctccgcagccattaaaccaaaaggacccactatcgatgcagtaggtgtttccgggataattattcgcctcggctaattcgggaacagactgatttgttaacagattttcacaattcttcccggtgcaggaccccattccagggcaccgtttgttccctaatgtttcaattttgtaggatctgataaagcccaaagactcgggaatgcattcctgaaacaatcccttaagggtgaaggtcatggttcccaaaagtacggattctggccctcttatcagtaaatccacgggttggccgactgggagaagatttactagggtaacagaattgaaactacattccgttccgtttgaatttgtctcacattcctctgtgtttgctgttatagtggctggttcgcctaatccgggtgtgaatgcttgggatagacaaataagtgccaaagccatccccagtttagtcaatggcttaaagcgcctatttcggtgtattttcctccactgctcatattcatcatctgagtcttctgtggtcaattgccttgtctttgtcttttttattgtttttggccagcggcacaaaacggtgaaaagacagcgcttcgaagtgcggaggagacaacgagtccacttcaaaaagcaacaaagaaaaaacagcgctactccggtgaggaaaagcaaaagtccggtcaaaatcgcggagaccgtgggagagcaatggaaattaaaaatccgttcccagcaccagtaacagtccaaaattagacaaatatcgactggggcacattgggcggaaacggtagtggagatgtttggtccattccaaaattgggctagacaggagacccctaacagaaggttctcgtcgggaattgcaaaaaggaatggatttttatactcccgatttccacaaattccgtcgcaacatatttcaacccgttggatatcatcccgtcctatgacatttattccctgggtattacatgaaaatgagttgctaacattggctgattgggttggatttcccatcaatttcgggagggtagggaaagcactaatgggtccgaaaaacagagaaatgacgaaggtcagcgttataatagacgaaaggaaggatgccgaagtggtggatcctggtcgcttatctgcccacttaacaaaccgtttttgtggtcggggtggttcttttgcccatctgagcattggttttgtggccttttttgccttttctagtgatatgttttcggcgacatcatcatttccattttccgttaggaaatctcccccgggcgggagagagttttctttttccttaggaatttcttctaaaggtaccaatttggacactggtcttgaaatgattctaccatttggcatgaggatattagcgcttcgagggttctcttttggctcatgtaattcgatgatttttcctaaagaacatgtgtttcttggaaatccttcattttctacaaggacaatctgattaagacagggacggttttgggcagtgatccgtggccccttatgattcgttagagttcgctgtcggagcataagcaaatattcttgggacc

SEQ ID NO: 2851 - DNA, 1212 bp, Heterodera glycines
agcaagtcactgtggcagaagggaccaggtgaagtgctctttgatgggcgaaccgcccgtcttgtgcaacgaggacagccgctcgcactcgacgattagcgagggcagagggggcggcggcgccgggcgcggacggacgggcggcggtggcggaggcaccggccgttggggcggactccacggctgccaggactgttctcgcggcttggctctaacctgaaaagcagaggaattttatacaccgaagagttggagcagtacactcacgctaaaatcgaacacggccggatcccgtgacagtccagtgatctgtccacagtgcgtttgcacttgggtggtgctgggaggcaactggtagcgctgcacgagttggacgtcgcatggattgtacgcggggaacacgcgttcctcctgtcattgattttgttacagtaatcgcttctttgatattctgacactcaccacatattgctgagtgccaacaggtgcccatttgcaggcgaacttgtcgaagtagttggccccttgctggtccgtctgccacaccaattgcgcctcctgtggccccgttgagtaaacgcgtggtttcgggtcgtattgtacgacggacagcgcgacgggtcgcgtttggaagcgcacttcgggcgaccatggccccgccccgcgagcggtgaacgcgcgcacacgagcggaataagcggtggagggcagcaggccggtcaagtgcactcgagtggtccgtgtcacgtccgtcagacgcggaatttgggcggaaagacgatcggcagcggctatttcgtactgtaatagcaaatggaatacggtaagtggaaagagaaaaagcacagacttcatattcagtaatgtctccgttggtgtgaacgcctaaagggaagtctggtcaagccaatccgttctccattttctcacatggcggcgcgtgccaactcagttcggcattttgttcccccacattgtccacgcggaaatttgccggaggcgcggtcggcgccgactcatcagtctgagcaaatcggacactgatcacccgtccacccatgcccttcgctccccacctgaacttccctggtgacgcgttccccgattacctggacctcccgcgttacgcgttcgccggcgcccaactgagtgcgggcggcgactccgatgcgatatttggagtgggggtgtagttgttggatggtatacgag

SEQ ID NO: 2852 - DNA, 2473 bp, Heterodera glycines
cccgcgtcgtttcgtcccgcgtcatttcgtcccgcgtcttttcgtcccgcgtcatttcgtcccgcgtcgtttcgtcccccaagccaaaatgagtcatttcgtccccaaatttctttttatttataaaatatttagtttttaaagtgttaccactaaaaatttttctgggtttagttaaacaaatcataaatttacgaatttagacgtatgatgaatcgtaaaaaaattgaaaatcttcaaaaatgtcgtaagcgcaagtttttggataacaatgacagtgaaaacgaaacgctatctgctgatcaccgtgagcaaaatgagaacaacaacgaccgcgacgatgattttgaagaccgcccctatggagatggagcagtttctcctctactttgcgaagacgtacatcggaatgacgcagcaacagctgcttgatggtgaaaatgcgtttggagttcgtcctggtggtctttctccattttcgtgtccgtttttttcattttgttttatttttattaatttgcttttaagcgtttgctgggacatcatttgcgtccgttggatctgaccatacgtactcacggcagcccttgcaatttggcatcgactcgcccgccccctcaacactatcatggccgtcaacagtggagcaaaattcgccgttggtgcagtactcattgagtccatcatcaacgacgacattgcagccaggcacagaaaaattcccaaaattgttgatttaaaaaattttaagcccgtccttgggaagaacccgtcgttcgtcgcgcactgttcccaattccatattggaacgtgcactcgcatgcggcttctgccctcgctcggaccaacaatggcctcgaagcaacccatcttcatttctctgtatttattacttataaaaccccaaataaaataattttagaagggtctttgtcatcacccagccctttccgatttcatttctgggcccgtaccaaaagaatgaggtaggggttaacctaccctcagctgcgggtagacctacccgttacccgcactaaaagaactacccttagttgagggtaacttaacccggttcacttaccctcagctgcgggtaactttttaacccgcactaaaagaatcgagtaactggtaaccctaccctcagctgcgggtaacttttctaccctgacccataccagggtaacaatatgagcatgttttttaaaaaattccgaaaaaatttaaaaagatgacattaaaaaatttccttttgctaaattgtactaaaaagtctgctctatccaatgatataattttggttaaaaaatttttggatttcactgagctagagtatcgtcaaaaattttgtaaatttttactaattttttttgttggtttcttgtctattttacttttaccggttcaaaattatgattattcgattctagacaaagttattctcctttttttgaaaaaatattcgccctttggaacatgaaatacccacaaaaattcactatgtttaacgtttaataactttctttataagtaatataattaaacaacttagtataattcgatagctctaagtttcctcactaattctataaaatttcatagaatttaattaagtattgaaagagttatgattagaaaagtcaaacatctctttttgtaaggcaatttcatcatagtgatactaaaagaaacgggtaacggatagccaaacccgcagctgcgggtgagcccagcgagaacccggtaacattcatttagtacgggttaacccgcagctgagggtgagttaaccgggttaagttacccgggtaagtctacccgggtaacattacctcgttcttttggtacgggccaggcaaaatttgttaattttactcattttttcttcttacactttaatgactatttgtcatgggttcggatccgctcgacagatgatgaattattttgaatttttttcaaagtattattccacttaacatatttttattctgttattttaatttattttatgatgctatttgatagaaaattgtttgctgatcattttttaaaagaagtttatggctctatcatttgttttaagttttttatgaatttttaaaaattttgtcattttcatcgatttttcagaactttgatcacttttttctgatcatttttggggccggggccaaaaaagccgaaaattggcaatagcaaatcgactatgctctacacgaaagaagtgattttaaagtgatctgggtggttacagttcggaatgttcccttgtgagcaatgatacattaatctttcctcgctagtcttgacctcccccccccccgcctaccccaactttgtccattggcacctttctgttcagttcgttccatcgctgttctgtcctcctccgccactccaccacaaaatggtccaccgtttcctctccgtccgtgctgtctctgctccgccaactcagtcttggcgt

SEQ ID NO: 2853 - DNA, 1158 bp, Heterodera glycines
ctgatcgcccacgggtggtccgtttccgactccaaaacatggctgatccgcgtgagactcgcacgcgctgaccgatagaacgcccactttgttcgtccacctgccgaatggagcactgttgttgaccttctcacttctgtgctcgcctgaagttccacttcggcattagcacatcgccacgcgctttgcggaggcggcatccaagtgacacggacatggcctgggtcgggagtgtcaatggccaaattggacggagggagcagagggacgagacaggtgggcgaagaacggacctttggggggggggggagaaaatgccgatcaacaaggcaaatgaaagaaaaggacgaatgaagcgccaaattatcagatcactactggttccaatggcaagttgtttgtttttgtttttacctctggcgatgtgtacagcacgtaagagttcctgtccaatgcctgaattttcacttcgtacggcaccccaacagaaagtccgctcagcaaaacgctgttctcctccccttcgccaacgtacggcacaatttgactgcaaaatcggagttataaatcatcgccctattatgatcttaaatgtggacaaaattcacccaaaagggttccatccggcgccgggggcgcggtacaaaaggcggtaaccgaacaccccgcggccactgccttctgaacgccatttgacctgtagggaaccatcggaactttgggagaaagtcggcgcggagatgagtgctaaaaaggggagatggcatgagaaagatggaaagcagggaaaaagcggaaaagggaaagcaagcaaaagacggtgaaaagtgagagagcggaagagaaaaaggcaaacgatcaaagggcagggaacaaaaatgattagagtaatcagcgtagagaaagaatgagttaattgagtaaatagggggcggggagggaggggagggaggggacagacatcacggcacgccacacacagtgtttacctcgaccattttgttcggatttgttggtgctgaaagtgtccggacgacaccaaaagtcagtgcgcggatcgcagatgatggaacgacgaaatcgaacggcagctggaagggagtggaggtggggaggagacggaagagaaggagagaaagaggagagagtgcatttgcg

SEQ ID NO: 2854 - DNA, 2151 bp, Heterodera glycines
catttttcgagttccacctggtatgcccgtacgtctcccaccgattgtccgttcactttccatcgcacaatcgttttggcgccctccgtcggttcgacgcgcacttcgcttactgaaatgcccggcagttggtcgtccggcgaagtaatgccaatgcgctgttcttccgacgaagtcttgaccaaaatgaagaacagtgggctgcccctttggctccaacgacccttcggctctttcagttcgtacgtcacttccgcttcgtattgccgtccaaagtccaatccctgcaggttcaagcagtagtccgtctccgcgtaggtgctcagccccggcggacattgcaattcggcgggggactgaaccaacgaagtccacggggcggaagcagaagcggtcggtttgtaagacactcttaatggaagaagaatgatgcccttttgccagtttggacccacttaaagcgcgcaatgttctcgcggtgttccggcggcggactccacaccaaaaaggagtgaggtggtgccaaaacaatgcgcaggcggtataaattctcagcagatgcctttggctgtaccgcgtccgtcttttggtcctccaacttcagcagttcgtcctcatctttgccctcggcggttgtcactccaatcgcaacactccacggactgtgcccgtgctgaagacgtgtgcggacacggaaagtgtacgcggtggccgcttcgaggtcaccgacggtggcggaagtatccgcagagaaggcagtcgtctcggggggcgattggtcggaaggccaaatctaaggtaaatggttggcagcgttattttcgatttcggcatgccgatgcatcagtcgataaccaccgaccgcgtgttcgtatccctgtatatcgccctcgcacttggactgctcccagctgaaccgtacgctttccgtgccaacttcgtccgcttttggcaccgccggtgccattctttcgcatgacttttcgtccgctctgtgcgcgattagctgctccccggtcaccgccactgctcggcttcgctcgtcgacgaacacaacgcggacggataaagcgttgtcctccagctcagtgagacgcgcagccaaactttggtgcccattctctttgggcggtttaatctctgccgccgcacggcgccattttgaatcattgccaaggcgaaactcaacgacgaaatgagtggcgggaacagtcggctcggacttccagtgcacctgttattaatgaaattcgacttggttttgaccattcgtaccttcaattgttcgtttttgatcacttccaaacggttgatcacctttggccactgtcgctctctctcctttctccctacccccccccctccctctctttctcttctttctctctctccccttaccctttcttcctttcttctttatcactcactatcactcttgctctttctatcgtcatgtctctctttctccccctctctctctctcccccgctttctctgtctctctctctcttcctcaccgtctctcatttcctctcccactctcttcccctgatcacctcgtgccttccctctctcatttcgacaatcactggcttttgcgacagcttttgcattggttctgtgttcgttcgaattaacatgtggtagatgcgtttcggttcatggtccctgtgatttgatcagtcattcatttcacattgttttgtctgttttgccattttaaatttattttttggccatttgcccgtgactcacgcgtatgcgaccacgccgactcggtactgagtgtcggggcgcagttcggcaaaataagcggtgtgctgcttgggacccactcggctgcgctccattctctccccttcgcccgcccctttcgcggcttcgtctgtctttttctgctgctcatccgtcaccatttcggacaaaacgacctgtaaatgtttaaaatggcgcatcagcaccaacattttcacctcgtaatgttgcagcaaagggtcctccaaatgaggccaatcaattcgaatttcgttatttcccgcgtattccaagcgcatttctccagactcttccggcactgaaaaacggcgtaaaaattagtgagagaagggaagtaaattcactgcttttattggcattattccccccattttc

SEQ ID NO: 2855 - DNA, 1443 bp, Heterodera glycines
tcctctttccgggcactggaaaaacgggggtaaaaattacgtggagagatggggatgtaaattcactcgcatttattgggcattattccccccattttctccattttgtcccctcttctctcctcaccttcgcccttcgtcgagacagtgaacagttcggcattccatgggcccacaatgtgtgccctgtccactcgctctgattttgactcgcgtattctgttcccgacaaaagcccggtgatgctagcggatggttgtgccacagtttgacgatggacgtcgaactgctgactgccaagcccacgaagttcgatttggtactcgccgatggagccgcactcaggcggttgccaagcctaagggggggggggggggggatgaatggaataggggaaggaaatgagcggattgatcaaacgactactgatcagagagaactgatcatccgatcgatcgatcgtccaaaggcatggcttaccaatgccacgctgaattgtgccctttccttcacgtccacgtcgcccggttcagagatttcgtccggttcgcattttatgctgacaatttcgttgcgggcgcggatttccggcgtctccaccagaacttcgcccttatcgccaagcactttgatgcgtacaaaataggaaatgccggtgggtaactttggaatctgaaaagaaagagggggagggaatctgtgccattgagtgatcattcactaattatcaacgaatcattccaattataattagcaatcactgcccatcacagactgattaatcatgaaattgaaaatgctttgtttactttttctccccacgccttgtccatttgtccccctttatccccactgtcttttgtttgttttgtcatgcgatatccccccccccctctttcccttctgtccccccccccttttcacctgtactctgtactggtggtttggtcctttgtatgggatcattcccgagtgcacattccattgggactccttctcggcccgatattcgacgatgaatccgcgaatggatgagtccgggtggtctccgctttgaatgccttcccattccactgttaacagcgattcggtggtggcgcgccgatgtcgaagggaaagggaatctgatcaatggggggatcaattaagaatggatttggctgatggttagtgtctgtgtttctgatcactgatcggcactgatttggccctcattttaaaaaaaattccaattcaaagtaccaatttgtggcaataaatcgaccaattgttgagctcgaatttggtaaatggcactgtttggaagatgaatggaagggcaaatgaaatgggcaagtaaaaggtgaagaagaatgggccaaaatcgcaacaaatcgggccttagccgaaggcgactttgtccagaggacgatggactcattctgcggatgccaacggagtcgg

SEQ ID NO: 2856 - DNA, 9893 bp, Heterodera glycines
aatttgctgaccaacgaaattttcaacacacaatgacttacaaaataataaagtaataatgataaggggtgaaaagaacggggagggttgaactaatcacttttatgtgttaaatttttattattttttacgagtttttcatctttttgtgcctttattatatacaatattaattcccaattttctattgtatttgttccctccacccaacattcgttgttaaaattgccaaaaataaattttaattttttactcattggctttttgcaattcaaaatacacaattaattaagaaaataaaacaatttatactttaaaaaagcaaatgataaagagttttgtctaaatgagaggccaaaatgagagaatgaatggtgcggtcggttcgccctcattttccggtccaaaatcacacagaagaagcgggcgcaatattggccacgatcaaatggtccaaactgcgcacaaattgcagctccaacttcagcgggtgctttagcagattggacaggatttcctcggtgaagccccacagccaatacaactgaagaaaaggggggggggaaattgaaattttcgtgagcctggaaaaattctcccagaccaagacccagaaaaaccggatattagccctgaaccgggttctggtcaagttgccgaatgcccctgacccgtaattttaaaattccttccctcgcccctcccaaaaagtgctcactttgcgttggcttgcgacggttcggtcattccagcagagaaagccggtgacaaatgcgcaattgccacgccgtttgatgaccaactgaacgcaaaaccaatgaatttcagttcggcttcatttttccccggtttctcattttttacttcgaaatttcattttggtttgaaaactcaccaattttttaaattatccaaatggcaaaatcccctaattatgtaaaaattcgcacttcggtgggccccgcaatttcgggcaaaaattcgaagaacagcgcgcgacagaagcgccggatgatttcgtcctgagcaatggtcagccccggctgctgctcgaactccttcaagttctgcgtgttccacgccatccacgccttgtgattgcctaaaatgggacaaaagacaattcaatttgtgacatttgaatctcggaaataaaacgccttccttccccggccattaaaaaggccaaattcgtagttaattggcaaaaaatgtgaaagtcttgccaatgtgatggggccgtctcagcatgtcgtaggtgagccgcaatgtttcgtttttcttcagcaaatgccgctggaaataattttgggtcaaaacactgaacaatttatgaatgtgtaattggaattttatggctcttggtcttatttttgctaacaataagacaatgccgaggaattttataaattgtgttggtcaattttatagtaaatttagtaaaaaaaagcctgaaatttccgacatctcattctgttctctctatcggatgccaattcataagaaatgttcactcactctgttgtaaaatttgcctgccacatttttggagagcgccgaactcgtcgaaaacggcggaaacgacgacgaaaaagtgggcaaaaacggaggaacggcggaaaagcggtggcaacgaaagggcaaaggcggaagagcaccagacatttggaagggaagggaagcggaaaaacaactgaaaatggggacaaaatttacttaaaaaacggggggggggaaatgggcaaaaatgttatgaaaacaaacaaatgaaatgtaaatgatgtagctacaatatcagtgatcagaatatatcttccttttcgaactattcatttattatttttcaaaaatgaataaatttctgaatttctctgttttttgtgtcaaaatttaaacatttttaattttaaattttgtctatttatttgttcatccgtctttctcttcttcttcttcttcctcgcccttttccctcctgccgttttgtgcttcgcttttctgttcggcgagtgccaacgcgcgccttttgtgcgattcgttgcgcatcagccaattgaaaaggggcgacggaatgcactggaagagcagttcagcctgggaaaacagacgtttttttgaaaaaaaaagaaaaaaatcaacaatttgttggagcttcagtcattttgaaataaaattctttttccaaaagcacatgcgtttcctggtacttttggattttgtgcacataccccaaaatctaaaaaaatatgtcaaaaggataaacggagttttttgatgaaataaaaggaataatttgcaccagaatggcaaaaacctcagatttgttccccaaaaatattttgtttttaatggagctccttagaatttcaaggtttaaaagcccttcgaaattatgaggaggggactgatggagatgaagcccagtctgtgtatagtcctagccccgagtccccgcgactccaatccatccacctgaatttggtgtatcgggtggcccgtcgtgtccgacacaatgccaaccgttcgaattgcatgccgcgcgtaggccgccggggacggcaccaaaaaggagggccgtccctttgtccgcgaggccattttggtggacaccaacaaagggcagagggactggatgacaatgttggcactctttgggccggcaccacagcacagagagggggcgaattcggcacgcaaaatggcggacagatggacaatgaaatgctaaaaattgggggggggggtaaatgcgattgagagaaaaattgaaagaaaatgaaaaaatgaatgccaggaatagaaaatcccgaaatcgccaaaattcgggacttttaatgacgcacaaatttcggcattcgaaataaacccccaaaaattttgccttggccgccgaatagacgccgtagtaataccaatggcaacgggcggccgcggaggcgacgttcacaatgacaccacgtccacgggaggccatttgtcggaggacaaaagcggacaaaagagcgacgggcaaagtgttgacaatctgtggggcaaattgatggaaatggaattcaaagaagggggttaaaatgcatttgaaatttgtgaaaaatgtaaattaatgggatcaaaatttgtgtaaaaatatgaaaaaatgccaacatggatagaagaaattaaaagaaaacatacagaaacatcgacaatttcttggaaccctccgggcgaattgtccaaccgttcagggtaactgttgaccatgccgacattattcactgaacggaattttattgccaaagaaaaccttaaaagatttttgattatttttttccccattcaaaatgccaatgtttccactttaattgccattttctcacccaaaatgccaatgttcaagtcactgatggcaccaaaaatgtgtcgttcgtagtccgccgggttggcgttggtgaagtcgaattgtatcgtctgcagctgcacttcgccccgctgtccgttggtggccgaatactgcttcagctcggtggccaccgcctccaatttgtgggccgagcgcgagatcagcaccaggttgaagccgcgcagggccaactccgcggcataggctttgccaatgccatcggtggcgcccgttacaacggcccaattggcatcccctggcaatcagagggcattattaaaatgatttaagggagtattgtgatcaatgagagcaatttccaattttcatttggactttgatcagttcagttactaatgtatttgtttgtttgcttttttatcagtgatcagtcataattcctgatcactttctttgatttgatcggtttcatcccatcgccttgattttttgtgcgtaggtttgtgtcaaatttgatgtattttaaaatccaatcatttttcttgaattttgatcaagttgcttcctgatcactttttctttacctcccgcaagttcgtgcaggtcgcgcggttttgcgatcacataagggtagagaatgttgtacagagagcgaaacactttcacgagaagcaaaccgagcccaacgcatccaatggcattgacaacaaataaaaaaagcatcagaaaatgacaattttaataaaggaaatacaaaaagaaaaactgttctaactgtaagaaatacagaattcgtgtccctttaaatagatgagaatgtactgtatgattcggaaaattccgtgggacgcataaaaatttttaaatcaattacggtatgaatatgtgaaggagatcaaataacaattcaagagaaaattataacgcaaaataaaaatggcccgtttataccataaaattaaacaattttttgttttgtgacaaaaatgcacagcataaaataaacaaaaaatacagcaaaaaccacgaaccatgagtatgaaaggagtacaaatgttgcagtaaaatatgacagaattctaggaatgatagaacatttaaaaataacccataatataacagggcaaaaccccccacgtgggcataattttgtctcaaaataatgatacaatttaaaaaggtggtggatgatttgttgcataaaaccgcagtgttatcgcatgacgacaatggcattcattgatggagtgccatcagtcggtttttgatggctttgcgtttggcgtcgctctctctccgctggcgttgccaatgcccgactgctcaaacacagcacgtatttcggcgaaaacctgcaaaacggatgccaatttgacgaattcctagcaaatcacagttgcactgatcaggaggttattccgattcagtccgacatttccaaatgggttcggtcccatggcactcacaaattagcaggggtttgggatgggaaaaaggaaagggcgtgcgtaaaaatttgaattttcaacttttgttcggccaggaattagtcaagttgagcaattaacgaaaaaggaagactaaaaaggccaaatttaatgaggaaaacggaattattgaaggggtgtggcgagcaagaagcttttgtcgactcaaaatcagtggagtctgtctcaaaattcgatttccccccccccctccaaaacaccgacaataattatgaaagtccataagtttgtgatcagttgcagttccccctcgccccccttaattactggagaaaacttcgtaattcaactccaaaaaagaaacactgactgaccaagtccggtcccttggtgctgtccaccgtcttcaccaaattcagcgacgcgtaatggtcaatgatcggtaccgtttgttggttgtaagtgacgattcgtttccgtattgactcctaacagaggaaacaaattcttaccaaatgacatcaattcatttaaaataatttggcaattcaaaatttttaaaaaatgtgtagttcctgaaaattttggccaactctttaattaatttcacaaatttttctccgcctaattttgaaaatagcatcacccctcccctcccacttttcacctcgttgtcatcggttcggccttggccacggtttagacatcgttgcacacaaatctgttgaaatctcgtaaatcaaaatttttgagtgttttatgcctcaatcggcgcttggatgctcagaacgaagagcactttggcattggtgcccatttcgcgttgccaaccgtcgaagttgtccttgttgcgcgggaatccgtcgacgagaaaaccggcggcagtgtccgaccgggcgaccattgcctgacgagaaaatgtccacaaatttgtttggtgaaacatcttccctaattatgtgaccgtgccggcacataataatgcctgccctttttaacagttagcaaattaggttatttattctgtcaataaaatgtcctcaaaacgcacattttccaacagtttgcacgtgatttccaccggcacaatgctgccctcgcggatgtgccggtcgatcagctcgccaaaggtggagccttcccgttggcgttcctcgcgcaacaaatcgccggcactcaaatggacgaagccgaaattcttaaaataacgggagagagtgatcattttaaaaaaatggaaagaaattaaccaaaatcataaggggattgactatcaaaatgccatgttttctttgcccaccttttcaatgcgttggcattgcgtccctttgccactgccgggcggacccaacacaaaaatcactttgaacattgacattgtcctcctgctgttttgctgttgcgttggcactgtttggcgaagggtcgccgaaattttggcaaattgtctcacttaaaaattaaaaataaatttaggtaataaaaatcaaacaaacgacaataaaacatggttatttgctttgaaaatgaatttcttatctttccgttcatttattttacacagagaatttctgtgaaaaaaataacgaaaatttatttaattgttgcaattagagaattacttaatgaaaagaaattaattccttagtgatgtgttgctctttctacctaatgggttgaaataatgaaaaaagaaagacagaaatggaaaaaatggagcacagaaaatgactaacaattccccggggaaggaaaaatggagcaaaacaccacaacaatccaacaaggtttttgtttctcattgttattccaatagacgaaaatactgtgttgattcagtttaaaaggtgtgccccgtggcaaaaaatagaaaccgtcaaacggaaaaatgcatttcactaacacataaattctggattaaatattcaatttttgaaagtgagcaatcaaaggacagataaaacaaaattaattagtacggatattaacttacccaaaggcgctgttaatgccggggagaaaagcagtgccgacaaacgatgcacaggaaagagagtggcaagccctattgtgtttctaataaaattttaaaaaaaaaatttggattttattaaaataattggaattcgaggaaaccaaatggataaaactgaaattacgtaaatctggaaacatttatagctctgataaaattataaattataagttacaaattgtaagaaaatcaaaaattagaaaatgaaaacattgaaacataatgtaacaaacaaagttggctgattgttaaaatcagccaattaaaaattagttagaattaagggaattagcaaaattcgtccatcaatgcgtccgcgtgggacttcgcctgctgctggccactcccgtgcatcagttcttgcctggtcctctgctgtttctgacgctgttcgactttttcggcttgaagtcggagaatttcttccatgctcacctgaaaaaaggaacaaaattaagtgtggaagaaataattctgttcgttgttcctttaaaatttagcgacaggtctaaattagaaatctgaaaatattcctgaaatggaggctctctgattgtgaaaaattttcaccaatttccctgcttaaatcggtcccacctttttgaatgggttcggctttgtgtcgtccacctcgccggccagcacaacattttcgccacggataaggaaaatgccgcgcggaatgtccccataaaattcgtccacgtgaattcgttccagcgtttcgtgcagcaccaaattggcgaactgaagggaagacgaattgaaaattaatttacggattcataatttggtgacctggtcaagggtgcgcagataaccgacgagtgtcttcccatctcgcagcacaaccaccagctttttgtccagttggtccagcagtgaaactgcgcctggcagaaacgggtccggcaattccattaaaattaggtaattagttaattgtttatgttatcggctgaatgaaatttcatggctgatcagttgcacacaaagatgcaaaaattaaaattaaaattaggaaatgccgaggaaagtaatctaaaattgaggaatgattccggaaaactgttggagtcgctgacccacaaaatgtccagcccacgaaatgtccaagtctcgaatttgagttttttattattcagatgggcctaaggttaggcatggggtaatataaagggtatattcgtattcagcgaccccgaaaaccctaaaaatcctaaattagactcattttgtttttataaattttgaaaaattttggacatttcgtggcttggacactttgtgggggcgccgttggagtccagaagaaaaaaattatattggcattatgtttcaattaatttaaattataaatttgaaaaagcggctttttgatttttaaaaaaccaagggattgatttccccgttcccagttttctgggcttccatctgcaaaagtgccgaataatcaacatctaacttaattgctttgattaaatgtaaattaaactctaattagaacaaaatacagtaaaatgaataatgaaaatgtcaataatgcgatggttaatgacacccgcgtaaatgtaaatgacaactgtcagaatccaaatgatacccgtgtccatgtcaatgacactcggtcggtttttgcctcaattaacccgttgaagcgtcgcgttagcttccgcgacattccgaacattcggcaagttggatgaaaacatttaatcagtcgactatctaatttagtgagtttgagcagccttcttcttcctctactgcaccttctcctttgccttgtaaattcataacttaatcaatttgataagatttaatcccttttcttttagccgggtttttggacacaactcataccatttttaaatcgttgatggtggcgcaaacaccgaccaaactgctgaaggtattttcttttgaagaagaatacattttaatttcttaagacaaattcacgtttttaaggttgatgaggtggccaagtatgggtcgctggacgaacaactggacgtaactcatgtcatacaacacactccgtttcgtaatcgtgagtttttaaattattggaccttgtgtccctgaatttcaataaatgccattcaagtgaaggtgttgaatattttacaattagtcactttttcaggccaccaaagcccgttgctgcttgatgacctgacgaaacaacatgcctcatcacttttgtttggctctcaggtaaaatttagaaaatgaaaaaaattttctttttaaaaaccttttaggataattacggacttgacgaattgtcggaagatgctcgttcgatgaatataagcattcagcaacagcaggtcctatcataatgttactagtaaacatcctaaaaggattattggctctttctttaaggtcgctatttcactcgtcaaatccgctgctcaaacgtcggcgtcatccgccgacgcgatgacaatgattacggaaacgccgaaaagttcgcactattcgacggtaaatttaggcattgattttcacatttaaattttagcaaattttgaatttgcaggccacccgaaccgttcctattgactttgaggatgagcgcgtgtccgaatctccgcaacttccgcctcctccgactgtgccaattccaatgggccatctgaacgattcggagtttgaacagtggcacgagacggaaatggacgaggcaatggaagggtattgcgacgctgtcaagcagtacacggacaaatacgggtgaggaattggtggtgggatatagaaaattgtaaaaatttaattgcatcgttttttcagccgtttggcagcggagaaaaagcgtttgttgagccaaatcgacgcggtgaaagagcgcattttcaaattccgttccgatttttccgaggcgtaccaacagaacgaggagaagcggcgtgcgttgtgtgccgatttgacgaatatttaacgggggagaaacaacaaaaaataattcttttaatgtgtgatttgcatggaatgacttttttgcctcatgtgctttttgtcttaatgcaataaatgattttgattaaaggaatga

SEQ ID NO: 2857 - DNA, 1694 bp, Heterodera glycines
ttttcaggcttccaaagcccgttgctgcttgatgaccttaccaaaaaacatggcccatcacttttatttgggtctcaggttacaaaaactgaaatattgtttttaaaaaatattttaggaaaattatggacttgacgaattgtcggcagatgctcgttcgatgaaaataagcgccggtgcgatgacaattcttacggaaacgccgaaaagttcgcaccattcgacggtaaatttatgcattgattttcatatttaaattttagcaaattttgaatttgcaggccacccgaaccgttcctattgactttgaggatgagcgcgtgtccgaatctccgcaacttccgcctcctccgactgtgcaaattccaatgggccatctgaacgattcggagtttgaacagtggcacgagacggaaatggacgaggcaatggaagggtattgcgacgctgtcaagcagtacacggacaaagacgggtgaggaattggtgggatatagaaaattgtaaaaatttaattgaatcgttttttcagccgtttggcagcggagaaaaagcgtttgttgagccgaatcgacgcggtgaaagagcgcattttcaaattccgttccgatttttccgaggcgtaccaccagaacgaggagaagcgccgtgcgttgtgtgccgatttgacgaatatttaacgggggagaaacaacaaaaaataattcttttaatgtgtgatttgcatggaatgacttttttgcctcatgtgctttttgtcttaatacaataaatgattttgattaaaggaatgataacaatgtccactcatttttccgcagaaaatggaacacaaaagtttgtagcttcctcgatgttgtcagtctcttctatgtcgcattcgtgaccggcaaccccggggggaggacatcttttttgatggggtaatactggaagaaaaataatttttttggttggagcccagattctcaagttattacttttaatggaaagcttttatttgatccttttcaatttgtatgtttcctccaatgtcaccaacataaaacccgggatttaaaacaggcaatctttcggaattgtggtcccgaaaatttttttttaatttgtatggcactttttctaggcttaaaaatacgctaatcacgaatatgaactcggatttgcccaattccgaaccccggacccgaattcgaacaaaaacttgaatttttttttcaaaaatatacgttaaaatcgatcaaattttggcgtaaaccgcgcatttttatccaattaacaatttgaagcattattttaatcaaaaaataatagttgttgcatagttttttatcccaaaaaaatgcattcttgaaattttttttttaatttttgttcgaactcgggtcaggagttcggaattgggccaatccaagttcagattcgtaatcagcacccttgaaaacccttaaaatatgaattttaaataaaaaaaattttttcgggaccacaattccgaaagattgccttccgtgccatccctaactaataggaaacctatttttttttgtcgtgtatcactcacaatgctcgcctggctgtggcgatggcggtcgagcctccttcggctttttcgaccctggggtggacagggggaggagggaattacgatgaacataaatgcgaaaattacactcatttctcccttctctccc

SEQ ID NO: 2858 - DNA, 3019 bp, Heterodera glycines
  misc_feature (2868)..(2868): n is a, c, g, or t
  misc_feature (2875)..(2875): n is a, c, g, or t
cctcagtgtattcatcaattttgtcattttctaaatatttgtccaaactttgaattgtttcgcatcctttttccaccgcccaattggccaactcgctgaaaagtgatcgattttggttagtacagaacagatgatttatttaatcttggtgttcttttagaggatgagtgttttttttgtgaaaaagtggatttacaataaatttcaatgcttctaacattgaaattaactttggcatacttttttttcttgttgggaaatttaccctggactagttttaaatttatagagtaccaattgttaaaatatttactgccaaaatttttacccataaaaaatattttttaataatatgatcaagtttcttataattagcccatttaatttttgagatgataattattattgtcaagctctccttgtggtcaaacactaatttaagtaaattatcattttaaaatggttatatttttatacttgtaaaaaatatttttatatttctgacttaattttataagaaacataaattttaaaaaagtagaaatcagttggcatgcgaatgacttgaacctctaatctataaacattaataaaggcactaccgatagaccagtgatcacagtgtgaatttattaataattggtttatttatttatctcctaaatagtggaacttttggcataccatatctttggcacagaggctcattccgttgttataattttttttttttttttttgttatacaaccaagggtgatctactcagcgacaaaatttcatttaaaaattccaccttcatttaacaattaatattaagaaaaacaaaaagtgaatttttatatctaattccaaaaattgtctgaaatattgctgttcccaactttagacccaaaatttcaatcacctcaactgcttaacgcaaaaaaaacaaagataaaaaaatctagatgttttttagataattcaaaccagaaataggactcgtaaatgtcggctaactaaagatgtgactatattgatgaatttgagagtcttaaacaaaaatatgaactttttatcatgtaatttttccccattattaatttaatgtcgtttaactgaaaacatatctgagattgaaaaaggggataaaaggcctaacattttgcccatttaaaaaaaattcatgtctacctgtttttgtcgttgttttctttttggttgcctgctacacctaaatttacgcaagtttttcattttcccagttaaccctaacctcggatttcatctagcagcacaatgtcatcgcttttaaaattgacggtattcagctttgacaatgccaatgttggaaaaagcaataatgtaagcgtaagcaaatggatcattttaatgtaaaattaaaaaaaaaattttggataaagctatataaaagataaaattttttgtttggatttagctatgtaaaagaaaaattaaatgtcttagtgtatgcatacctataaaaatgaagtgttggcatccaacactataatgatgtcataaaatttttattttcatccacgaaaaatttacaatactatttcgttgtttctctttttctttctaatttctctcatcacttcggcatactatcttgtcatttttttttctaaaaagcactcactcgctagagaaaaaaattttgcaccgaatattctataaggaattaataactttctgtcctgttttttagtaaactaatttaaaattttcatattccttttttctccttttggtgcactattttcaaaactttaaccaatgaaaaaaacatgaattttgttggataggatcaaagatcacttacacctcatcactgttattgacttttcccctccccctttctctgtcttacattatttccattgtctccctctctgccatctcctccacatttctctgaccccgcgtctttataagggtgcccattccctcactcatggctctccgctctattcattcgcattggacacttattattttgttctcctccgccgctgcactcctccgacctcaccatttttgtgcatttatttttatttgattattaataaattgttggtacacaacaattttggcgcagtcagcagcagcagataaattctgcacatcattaagccaaatcaaggctaattctgcaaaatctagccaatttaaggcatatttgcacaatcttcaagccaaatcaaggcataattctgcaagcctaattttggcacttcaaaagcctgggtggctttcaacggacagcgacaaaaactgatcacctgggtggtgtaagttccgctgggtgcggtttctcatcgacaaaaactgatcacctgggtggtgtaagttccgctgggtgcggtttttcatcgacaaaaactgatcacctggggggtgtaaagttccgctgggtgcggtttatcaacaaacaaaatggacgcgcaacaacttcagcagattttggatgcggctcttaaaaaatcagccgaagtttttgccgccgcactcaacactcaaaatcaaaacccaaacgcagggtcatccacaacggcatcacttgcggcatcaatcaatgcccgcctcgaaaaattcaattataatccggaggttggacagacatacgatgcttggttgaatcgatacggaaaaatcgttcaacaagacggcgcttcgctcccagagcagtccaaagtccaacttttggtcggaaaattagacgaggaggaatacaaacggtacgttgacagcattgcccctaaagccaccgaacaattcaactggctcgaaaccgtggcaaatctgaaaaagatttttggtgagacgaggtcgctcttcctcccgcgtttcgattgttttcnaattcgncaatgccaaaaccaagacctttcgagtcttttggcacaaatcattcatcgtgtgaaatgccgaattgatttgaagaaagagagctaagtgcatgattctcatcatctctttacgcgacgaattttcggatttgaaacagcgatg

SEQ ID NO: 2859 - DNA, 4669 bp, Heterodera glycines
tagcgcagcgattttagcagcgccaagtaggtgttcgagctgatgtttgacggctggaaaacagtaataaaatataaaaatattgggtttttaagaaaagttttctccaattttaacttgatatgacctgcatataagaaaattttggagaaacttcatgttggataggatcaaagatcacttacacctcatcactgttattgacttttcccctccccctttctctgtcttacattatttccattgtctcctccctctctgcctatctcctccacatttctctgaccccgcgtctttataagggtgcccattccctcactcatggctctccgctccattcattcgcattggacatttatttattattttgttctcctccgccgctgcactcctccgacctcaccattttgtgcatttatttttatttgattattaataaattgtttgtacacaacaattttggcgcagtcagcagcagcagataaattctgcacatcattaagccaaatcaaggctaattctgcaaaatctagctaatttaaggcatatttgcacaatcttcaagccaaatcaaggcataattctgcaagcctaattttggcacttcaaaagcctgggtggctttcaacggacagcgacaaaaactgatcacctgggtggtgtaagttccgctgggtgcggtttctcatcgacaaaaactgatcacctggggggtgtaaagttccgctgggtgcggtttatcaacaaacaaaatggacgcgcaacaacttcagcagattttggatgcggctcttaaaaaatcagccgaagtttttgccgccgcactcaacactcaaaatcaaaacccaaacgcagggtcatccacaacggcatcacttgcggcatcaatcaatgcccgcctcgaaaaattcaattataatccggaggttggacagacatacgatgcttggttgaatcgatacggaaaaatcgttcaacaagacggcgcttcgctcccagagcagtccaaagtccaacttttggtcggaaaattagacgaggaggaatacaaacggtacgttgacagcattgcccctaaagccaccgaacaattcaactggctcgaaaccgtggcaaatctgaaaaagatttttggtgagacgaggtcgctcttcctccgccgtttcgactgttttcaaattcgccaaagccaaaaccaagacctttcgagtcttttggcacaaatcaattcatcgtgtgaaaacgccgaattggatttgaagaaagaagagctaaagtgcatgattctcatcatctctttacgcgacgaattttcggatttgaaacagcgatgtcttcagcgaatggaagaagcccgaaccaatgggaaaagcatcaccctacaggaattgggcgaagaatgcaaaaagtaccaaattttgaaggaaagcacattggcactcagcacaaaacagtacaatgccaatgccattcgtgccaagccacaacaaataaaggacaaggcagacgcaacaaagcaatatgccaaaccaaaagcggttccaaaaccgtatgagagcaagcacaaattgtcaaaccgtccatgccaatcatgcggaagcacaaatcattggcgctccgattgtgtgcacagagatgccaaatgcccaaaatgtggtaaaatcggacatctcggcaaagtttgccgaagcaattcttcaattcgccacatccaaacggtgaatacaactgaaaggcatgcacaaatcaacacagtcatcatcgacttaaattgcatggaaatcaacgcagaccatccaaaatggtggaaaataccaatcaaagtgaatggctcagattatccaatgcatgttgattccggcgcacaaatctcattattcacaatccaaacatggattcaaatgggcaaaccgcctttgaagtcagcacaaattcgcgtcaaaaattgcaatgaccaaatatttgcaattgaaggacaattttggtgcgaagttgaatacatggggcgtccacccaagaaattgttggcatatgtgagccccgaaattacccataatttattgggcatgccatggattgaagctttggaagtgattccgaaagagattatgcacccaaatcttcatccaaaaatcaatacaatttcaacgaaaataaacgaaatcaaagacacggagacattaatttcggcgctcaaaacaacacattccgatgtcttcagcccagaattaggtcactgcaccaaattcaaggccaatctcattctgtaaaacggtgtcaaacctatctactgcaaggcaagaccagtgccacacggggctttggacgacgtaaatgccgaaattgaccgtcttttgaaaatggaggcaataaagccgattgaatttagccattgggccgcgccaattctggcagttaaaaagaggaatgccaaaacacgcgcgtgtatcgatttttccacgggattaaacgatgcacttgagcttcaccgccatccgctgccacgtccagaggacatttacaatgcaatcgcaggctcaaaacatttttctcgtctcgatttgcgcgacgcttatctgcaattggaattgtctgaggagtctaaaaagctgtgtacaatcaacacacaccgcggacttttccaatgccagcgtttaccattcggcataaaatcagcgcccgcaatttttcaaagtttgatggacaaaataattacacccatcaatggtgcatttgtctatctcgatgatgtgattatcgccaacacaactctcgaccaacacgtcaaaacaattaccaaagtttttgacaaaatcaaacaatttggtttccgaattcaacaggaaaagtgcagttttctacaaaaagaaaccatttcccttggccacataatttctgaaaatggctttcgcccggacccatcaagagccgaggctattcgaaaaatgccagcgccacacgacaagtcaacactacggtctttccttggagcactcacatactacggcaaattcatcaaacaaatgcgcgaaataagaagcccattagatgaattgcttaaaaaggatgtaccgtggaattgggaaactgatcaacaaaaatccttcgaaaaagctaaagaaattatgctttcggatttattgctgacgcatttcgaccccaaattgccgtcattgtggccgctgatgcttcaaaaggaggaattggtgcaacaatcagccatcaatttcccgacaaaagtgaacgtgtcattgaacacgcatcatgcactttcacggctgcgcaacaaaattacagccaaatcgaaaaagaggctttaggattggtttttgcggtacaaaaatttcaccgcatgctctacggcagaaaattcattctgttgaccgatcacaagcccctactggccatcttcggatcaacaaaaggcattccaatatattcagccagccgacttcagcgctgggcgttaattttgtcaaattacgaatttgatattaaatacgtcaacacaaaagcattcggaaatgccgacgtactttcgaggctcatcgctaattacccaaggccatcagaagacattctcatcgcaaatatctgcaacgatactgattgctgtgttaattttgtgtttgaggcgaaaatagagcaactcccgatcaccgcaaaaataatagcggatgaaacagcaaaagacgaaattttacaacaaatcagtgccttcaccaaacaaggatggccgcaaaaatttgacaacattaaattgtctccttttcttccaaaaaaggcacaaatatccgaaatcgaaggatgtctcgcctacggtgaacgaattataatcccttcgacgctccggaacaacatcctcaaatcattgcatttcgcgcatcccggcattgtgcgaatgaaagccattgccaggaaccatgtttactggcccggaattgactccgaaattgaacgactggtgaagcaatgcgaggaatgtcactcagcagccaaaaatcctacaaaagcgaatctttagccatggaaagcagcaaacggagtttttgagcgaattcacattgatttcgccggcccgtgtgctgacggccaaacataccttgttttggtcgacgcttactcaaaatggccagaagtatggcaaatggaaaggacatccagccaactcaccatttcaatgctgaaatcattcgtgcatcggcttggaattcccaaagaaattgtctccgacaatggaagccaatttcgatccgccgaatttgcacaattctgcaaagaattcgacataaaacacaccttcacgccgccgttccacccaatgtcgaatggggccgctgaacggtttgtcgacatttttaaaaggtcaatgaaaaagtgccgtcaagaaggcaaagattggcttcaaaaagtgcttttggcgtatcgcacgacaccaaacacggcactcaacggtcattcgccagacgatttttcatttttcaatttaaatatttattaatttgactcaggacaaatgtgacaaattaggacagatctcatccctaaagatgagtttgcatcgtgtgttatttgccacgagccagtgcccgtgtgcaacaacgacaaaattgaatttaaggagccatttcctccctccaatcatgaaggcaatcaccgatggtttgtg

SEQ ID NO: 2860 - DNA, 10376 bp, Heterodera glycines
  misc_feature (46)..(46): n is a, c, g, or t
ccttgttaacatgtaaataaaattaggtgcgtttcagagcattttnctgaaaaaatattcatgaattaattttgcaaaaaattggaaaagtacgcaaaattgcaatgtttaaaatttttaaagaaacattatgggacagttaaataattatatgaataagcattcttctcagctgttaccctgcaaaatctggtgcatttctgatcactactcgtaaaattatgagtgattgaattttcactaaaaagttaagcctaaactttttggcctgtttaaaaaggaattaaaaatttttaaaaattttaatcatcttcctttttgatagaaaaagcatcagagagccttattaacatgtaaataaaatttatcagattcagatcgccatgaaggagtaatctgatcatgttggtccaaaagatttatttgttcagcatcaaaagttagcttacaaattagaggaaatttttctgatttttttctctatataaatagatttttggttaaatttaagaaaaatttgaaaaattttcttaataaacttagttaaaaaataaaatttttccttggagatttctacaaaagcctaattttcatcaaaaaatttgctcaaaatcgtaaacttagtcattttttggaaaaggtacgcagcaaaaaaagcggattgtgttttggtttctttaaaatatcttttaggaatttttccagcgattaaattccgtttttctaaataaatttaaattaaaaaaatcactagaaaaaaattttttaatcaaggatcacggctcacggagtttttggggtgccgtgatctcggattttttttaaagccccgtgatcacggctcacggatttccgtgattggaaattcaatcacggccagccctggttgggatataccataaaataggacaactaaaggaaaataaaattttatcttcaattcacagagtttaaaaaagagatgggcacaaataaaacaggaacagtgaaaaacaaaaaaatttaatacaactcatcgtcgaactagaaggtcaccggcttgcgctccgcttttttgacgaatttggggtgcacaatgagttgggccattgtttcgtcgtctttggctgtgcatttgtactccccgtggtcttcaatgagtacattgatgatcagcaggcgacgacggcatccagcccgttcctgtaaaacaagaagcatcaataaaatacacaatagaaaaacaaaatgaaatttggcataaaaacaaattttagataatgtaaaaaaatataaaattaaaaaaaatattgttaaaaaatggttttgtttctgacttttctaatatattttttaaatttctgataggcatttgaattgaagaatttgagctagttttggtttgaattttggaaatatccatacttagggatttttgggcttaaaggaatcccaaaataggtaatttaacctcctactcaattttttaaattgatctttcataacacaaaatatgaatgtattctttgattagcaagagatttgccccctccttcccaccttaaagtgccgcccgtccatcccgatctcggcaccgtcatggaaccatttcacatcgatctccttgtcgttcacttcgcattcaaaagtggcattttccttttcgttggcatgctgcgagttcaacggcacaacaaatgtgtcacggggctcctccaccacatacacttggcgtttgctggaaatttttgtgccataatttaaatgaaaattaatttttaaaaataataataattttggctcctggcaaatgcgtcagtggaaaaggtgtcaataatacagtatttttaaaataaagttactgtagcattaagtattgtattattacaaaaggacaaaattgtctaataattttgttctgaattttatcaattaagtttttaaaagtcaaaatacctaattgaaactttcccaaatccctaaaaaacaagttgtgatttcggtaatattactaccgtatctcaatttaaagaaatcctgattcactgacgcattttccactgacccattttccgttcacgatttttatttaatcaaaaaaattgaatttcaataatttcttttgccatgtctttaaatttttgtcaccatcaaaaaaaaagaaaaggcactgaaattttttttttgaaatttcagtcaaattaaaaagaaaataagcgaagtgcagaatttggcatcgattttttggcaccattccaaaattcggtgcaaaattttttggtggtagctgtttttggctcaccgtcgttcagccttgcttttgggctcggcatcactccgttggcgctgtttttcctgttccgaattgctaatgcccgtgccacgttttttctgcttggcccggaagtccaaatttgactgtaaatttattttttgtaaatattattatttaaatttggctggcaattttttttcacttcggccgctggcgtgacaagcagcttggcgccaactttgtgcttgccatgcgcgttcttcaccatcaatgtgtactcgcccccatcttgtggccgacatttggaaatgatcagagaaacctgacaatatttttaacattattttaatttgataaaatatttttaacattattttaggatttgataaaattttttttattaaatttactgctaagttttgaatttagtttagaaataaatgagctacattaattaattaattgagtgccgtaaaaatcccttccaagattagaactacagtaaaaagttttcttgtcctccatttgagggctacggtatgaaaaaatgtaattttagtgaaattaaaacaaaaatttttttagtgatttctcagttttatgataaatgactttttcgcaaaaaaatttttttccaaaaaacagcagtttttttaaatttctgtgtttaaaaatttcatttaaaaattgccacttacatgtcccgtgtcaccgtccgtttggcaccgcactcggtcgtcggtcaatggcatttttcggccgccctttttccacacaattgtcggtgccgggttgccctccacgacgcatttgatgatggccaattcgccctcaaccaccgtcacattttcagggatttcgacaatccgtgccggtgtgccggatgtttccaggtcctttaaaaaatagaaataaaaaaggggtgcccaaaaattgaaaaaaacaattaaaaagtgaaagatttttgtttttgtgctgcttttctcaaggaaaaatattaataaataaaaaatccaaaaaataggcgccaaaaatggcgaaataggcacaaaaaaagcgcctaggtgtattaagcacaaaaatcccgaaaagcatacacaataattttgaaatttttttttaccaaatttgccatcctttttgtcaccaccgccatgttctgtcgctcctcctcgttgttgtccacctcgtcccttgcctcttcgcccgcagcgcaagccgctgctgccgcctttgccgaccggtccgccgcggtgctgccaacgcgtcgccttccgctaccggacgcggtccgctctattttttctcggaattaaaattgagtacatttataagttttgtacatccctactttgagtatttaaaattttatgaaaatataataaatttgataaaaacttaaaataataatttatgttgtttagtgaagaatttattattttaaaaaaattaaataaaagattttaaaatttaatatgtggaaatattgtaaaagccttgcaatttttttaaattttaattttgctaatggattttctccactgattgattgaccagtgatggactgattgtccggggcttctttgttaggcactaaattgattgaaaaccaaaagtttcagtggaaaagctcttaaactgctcatttacaaaatcaattaaatttctttcatagaatgaaattgaaaaaaacatttttgatcatatattttaattagttaaaaaagcatttaaaacacttttccgcattttttcgagttttcaatctttttcagtgtcaaaaaaatccgacaaaattacattccaagctgtgagtcaaaacaaaattcagctttgaattgtgaattcctaattttaacggtaaaaaattattttagtgcttccggatggtttcccacgaattagaaaatccttgaaaatgtgcaaaaataattaaaaataatgatctgatgaggaaagtatttccaatcactattcttaggcatttaccgtacaatatgaaacattttttaccaagtgagcgaaggccaatttcaacagtgcctggcggcacctcttcagctggatcctcggcatccgattcgtcaaactgtaattgggtttaaaaaatgaaataaatataatcttacaaaataatgaaaattttaagtttaatttaatttttttctatttttatcaattatttaaacaaatcgtttaatcattaaacaattcttttaattttcataattgtaaaaaatatatgttattttcggaaacatgtgatttcgtcagaagtgatttcgtcagtaagggatttcgtcagtgataataatcattttttacgaaaaaacatttaaaattaaaattcgttcgatatttaaatgcaaaatgaaattatttgctcggttgtcaatcgatatatggaccggtcatttgcatatcataaaatattttgtatttgtgcctcgtttttgctacttttataatcctatatgttaatttcttggtcgccagccattcattctgcataatcttggaatttcgcttttaattttcttaccaggggtggagcgcgaccgcggcaatttgaatccgcaatgcgcgaccgcgtgagctttctgtcctcgctccatccctgtctaataattttgtatttctacattttgagtatgttgatgctcttaatcattttatgtctccaagtcgaatcataggcgtctgccgatcacgcatggaaacgaccttttccttttcgagtgtgttacgattaggtgattttcgcgtagcccagctgacgtaaagtgggacgtgaaaagcgcaaatcaaaatggattcggcagagcaacaatttgagaaatcttatagaagactgcaaatcgtgactcgtttaaatatttagagcttggactcgaatttttgaatttttttagctagttgtacgctttaattaattttcactgacgaaatcactcactgacgaaatcacttactgacgaaatcactcactgacgaaatcaccgggaaccttattttcgggcctaaactgtgtaagagccattttccataaataattagtcacattctaatttgtcgatccaaatttaaataaaaaagtggacacgaaaatttgattatgtaaatttataatattattttcttatgttaatcattttaaaaaactcaaaacattaaactccaaaaatgaaatttgcagatcaaatcttttaaacagtattttctttaacttttcaaattttacatatttttccaaaagttcacaaattaggattttttggtgaaaatctgttgtaaaaatgttaaattgtttaaaaaaaacgcaaaaaaagtaaatcttgatcagaatttttgatgatcaaaattattttatgccgaatgaaaattttcgttataattgcttagaatttaaattttgttttgagatcattcgatagccttaagtgttttatttgcaaaatttcaaaaaatgagaaattttttgaaatttaggtgagctaatagttttgttgaaaatttttatttgatggctttttatataacaccatcaccctttttaatagtattaatagaacgattcagcaccaaatccggaatgtccctgccatcaagccacaaaaaagctaaaactttcaccccccctctgccatcaatattccctttttttgcacttcatgaaccgctcattccaatataaaaaaataaaaattgaggggttctcgttgtttagccttaccaaaagcgaatagattttcaagcttggaaaaaattttattaagaaaaagcttgaaaattttgactttttctcaattttcttgtaaaacttttttggtatttgtctaatcgcgaagcaatagcttagaaaaagcttctaaaagctttcgaatgataccaacaatgttggatttggataacaaataaaaaaagctatagcggaaaaacatgccggggccgaaccgtgggggccgaactgacgtagaccgcaaatatgcatgaaatatgcattaaaaatgagttttttcaattttacaaaaaaatacctacctacctaagtatttttttgttgatttttgcaaaaatgagtgttgaaaaataaagccccccccctaaattagaacccccccccccctaaaataaagcccccctttcgagggggattgaacaataaagcccccggggctatattttaggaaatacggtaatttattaaaaataattttttttaattattaaatatacagaaatcttgaaaatctcctagttccacgtttgcggagttcaaccaagtcatttttataaattttttgacataggtagaaagaatttattttaaaatatttccgtcttttttatttaacatctataaatattttaataaaaatttaaattcacataaataaaattcaactcacccaacaatgtgcgacagcgatcagtgaaaagtcggacagcgcaaacagtgatttgacggacaaagcgcaaaaatggcgtgtgaaattcggcactcaaatcgtttgctgctttaaaattaaaaaaacatttattaagttaaaagcaatgaaaatttttcctttattcctctcttgagcaattaaataaaatgaatttttaaaattaaatttacttttttcattttaaaaaaatttaacttatttaaaaagaagggccaatttcataggcgcaaacgtctggggtgcaaaatgcaagttaaacaaataatcaaattttttgcgggcatttctcccccccccccccctaattgatttgtggtggtcatcttaggtcatctttttgaccaaatgaatgatttttgcaaaatcaattaaaaaaatatgcagctgggaaaattaaaaagattggagtgaggggggaggggaaaaggaggagggcggatggggaacgggaagaggaaagagagcgggagggagcggagggaggcagtgagaggggaggggaaaggaggacggggagggaggaggaaggatgagggagggagcggagggaggggagcgagcagtattttttaaatcaaaaacacattaaaaagggggtaggtcaaacggaatttttgctaggactctgaacattaaagtgactgcattttttgcctttataaatgattttttgtgccctattttccaaaaaaaattttggggaacatgggggtcctgcgctgccggtatgccagggttcggatcgaaaatttttcaaaataagaatatcaaggctaaaaaataagatgctaaaaccaaaaataagaacatttcgcaaaattgcttaaaatcacttatttttaatttattcgatcaaaaatatgtcagttattatttttttgtctcccattatcgttttaacaactttggagaaaaaattagcgaatcataaatttagtgcattcgggatcaaaaaatcagattattaacaattttttttgcggtattttttcaaaaaactttcttttttttttaggcggggagtccggcggtgccggtagacgccgacacgaaaattttttgggatttttcatgaattttgttaaaatttccaaaaagatggaagtctggattccgatttccgaaatttttgcaaaaattcgggaatttatttttttaaattttttgccaattcaaaatggtttattattgtgaaataattattttgtatgtgctttctacttcgtttttgtttccaaatgaaactaaaaagcataaaatttgccatccctgctctaatgttagaagatatttataagcaagtgctgagctaagcatttaatcaattcatcaaaaaagttcgcggctgaaaatctaataagtcagaatttttgcatattttaatttacagttttttacatgcctgcaatgctttgtcatttttgagagcttaataatgctaattaagagcttccgggtgattccatggttctttcaaatttttatttgtagcacttcggcgctcaattcgctgtttttcttaaaaaaaaattagatttcatatttaaaatgtatttatttttactttttttattattttcgcccgttcctaagccaattttttccatgaattgaacaatggactgaaccagttccattcgcccgatttgttcaatgaacgtcaatgatggcgtagaatctgcgatcagagtgatcagataagagagagggggcaaaaaatgcatttgaaatgacgtcagactggctttaagcaactaatttttgtgttattactcaacgctattccttctatttatttatgacctaaccaaactaattatatattttttggtggcaaaaaaaatcaggaaaaaagtggaaatattttgaaaaatatcggaattatgaagcatttattttcaaataaatattcaagtttttaagtaatattttttgaattttccaaatctgataaaattcagtagaaaagtgaaaaatattaccgagcataaatttccaaaaaataataaaaagcgcacaaaaaatgaaagttgttttaccaattttttcaaaaaatgccaaatctgacgaaaaatggcactattaaatgagcatacagtagttagtatttttcaatgcttagctttccttacattcattgttggtgggttgggttgattgcaatttttgttgataattgaattctgtccgctgttgcttggcgctgctgtagctttcggccactattggcgctgccatttggccatgaataattgccataaaaatgattaaatgataataataaaaaatggacatttcgccagcctaaaaagcattcgtttttaaataaatatcgatacagtcatggtcatatgccccataacagctcatggggatgaggtacctatccatagaaaaatagatttcgcaagtattgaaagattatctgggatttttgggtcgctgcatggtgtcacattgtttctgggctatccattggtaccacacattcctcgtttgctttattcctttttgtaaaaatttgtgttttcttccatatagtcaaatttcggggtggtcatatgtttaggaacactacccatattttttttcatcagcattaaaaaaatctaaaaaaattcaggtaagcataactttggatgctgatcaaaaaaggtagcaacaccaagttgatcagatcactccttcatggtgctctgatcagcccattttggctgggaacgaggggtaaatttcaaaaaaaatttctagggggttgggaaaatttttctggaaattttgagtaggcccattttatagagaacaaaatttgctaccgaattgcctttggaatagtgggtgtacgatttaggcccgctgagatacgtcgacttttatttcggtgcctataaaaagaactgtatttcttaagaaaatagtgcattttaaactacgtcaaaattgaagaattgataagacaaaatggaatatggaagttggataagacaaattaagaatgatgaaatgcattggaaaatacaaatcattaaattgtaaacaaagattcacctattattacattgtattatcagaaaatacgtactatgaaaaaacataaactcacatagaaatttacagtaaaaattaattttataaaattgtcaagaataagaataaaaataatgagcaccaatgaaacaactcattttattgatttataaaaaaaaaaaaaattaaaaatcatataaagaggtggatgaaagaaaaggtgctgggacgttagtcaaaaaccatcaaaatgggcgttagtcaaaaaactatcaaatgaataattgttgacagaaaactattcataatttcgtctaaaatagatcaaattttataatatagatatttttcgatagccctaattgtattctattatcctgcaaaatttttaaaaaattctttaagtttaaaaaaagttatgatttgagaagctcaaaaaaccaagtttttttgaacattttaagtcatactttcttgatacttaacgaaactttttggaattttgtaggctaatagaaaacacttagagctatttaatgatatcaagaattaaaaatttagatgcttttgaacaaagtcatatcaaaaaatattttcatttgatggatgtttgactaacgcccattaagaaggtttttgactaa

SEQ ID NO: 2861 - DNA, 7874 bp, Heterodera glycines
  misc_feature (7)..(7): n is a, c, g, or t
ctcactntcattgctctttaaaatctaatattttttaaattgtagctggcgttaggttgggttttccttttcacaattatgaatgaattgttttttttaaataatgagttcccttttggcctgcgaattaattttaaaaaatgacataaaaacgactgtgaaacccataaaaaaaatttagattttacgtcattacacagcttttttcgcatttggtgaacttaacttcatccgattactaaaaaggtaaaatcatcaaaatgaaaacgacgaccaaaagtaatctctggattgcattactatattttgttgtccgcacctttcacccgctcacattcaactgttttttttatttagcccgtctccgaaggcgacttgtgacttttgttttttcgccgaatttctctccgcgaccattttctcgatgtcagagtttacttcgtccgacggatcagggaaaaggtttgtagttttttttagttttagcaataagaaaaattcttttgctgtaaaatatagtaaatgaaaatcaaatttcgtttttagcgttagcagtaaggtcagtgagtcggaaagctacgacgcgaccacgcttggtaaattgatgaacctcgacgccaaagtggtcgaatggctcgagaaagagccatatacggacgacgatccgctcttggttcttgacttccttggtccgtttaacaatcttcatggcgactacaaccaaaacaaggcctttttggtgcagaagttggtatgtcttaacagcaaattaacatgaaagctggatcaaattcaaaataaaaatttcaatcagaaagtagaaaatttcatggaaaatttgagggttttatcacaaacaaaaacgtgtcgtgctacgtaattgaaagtaacataatagaacactacgtagtacatattatggttggtataaatcgatcatttcgttattaggttgccgctggaggggctagaatcgccgcgaacgtggacaacgttatcaaatttgcgacttgggacatgtttttcgaagcgcgtcgcattttgcaggctgacatggaagtgcgtcactttttctacaatcaaatccggcaaattgctcttcaaaacaacattaaccaatttccgatcgtctctacaaccgtggttacgttttggtcagatgactcgcagaaattgaagacgcagccgtgtcagttcttcgagttttaaaggatgatccattgttcattcagcattttttgttgcaaataaagacttattgcctttaaatcatttgagtaattagagtttaatcatgtacctaaatttttcaaatagggttggtctgctgggaccaaattgatgcttttggacccagtcaatacagaatcgtgtaaatatctttacccggacccgatttgtctaaccctatttccaggttccaaaaatatcgaagaattacttgtacactttattatggatgctcgggttctacatgttgattacgtggtggtgggtggcggtgttgcgggtgtttgcgttgttcaagagctgtgcgatttattggaaagggacgaagttgctggcacatcaaaccatcgcatcgtttttatctcaggcgccgaaggattcgttaagcgtgtggccaatcaaagacaggttgagatgtctgttcaagcctgatgcagtcaatctttaaggttggacaggtcacaatggccttcgacgtggagggcattgacccaaatttactttttggcgggtcaagcagaattcaattagttcagacccaacccatccaaaagtaatccgattacgcgacctgcaaacagttaaggaactacaaaaacaactggggaacgccagacgtctgctcattgtcgggaatggcggaattgccaccgaattggcgtaatttaatagacgagaaacttaaattctttcgaatttgtgacaaatttacaattttcttagatttgaattgcgcaacattgaaattgtgtgggcgatacgacattcatcaatttcagcaacttattttggtaatttttcttttcctttttgaaattgtttattaaaaaaggtttagatattgctgcagcaaaattcttcgagtctaaattggcttccgggagactgaagggcgaccagaaatccgaggtccacgctgacaggtccttcattacatttttggagatgtttggtcgattttagttgcctgacttttctataattggttgaagaaaatatgcaaaaccctctaaattattattttaatttgaattgatcaaattgtctttgccagattcactagtttggtggtccaacgcacggacaatgccgaattgaccgccaatgcgtcagacgatgagacactgcgcgagcattttggcgccgcgctgggcccgcattggctggccaaattggagcagaatgagtcgcatgaaaatgttaattattttcggttcttatcacttttgtgaccccccccctgaaatttttatttttagctatcatgagttttgcgtggtgaaattttacgtgcaaaaaatttaaaaaatgtaaagttaaaacatcaggcgggcggcatgaaatctacaatgcagcccaaccatctgatatgagatagtggagccgtgctcaattttttcttcaattacattaagcagagtctctgcagtcataaagcattcacgcgtttcccgacatatccccccaaacacccactgctctggtaaaatgcgtcccacatggtttttgcgttcgaaaacatggcctcgtcgatttcgaccgtcaaattgtttccgcctattttatgttgctgttgttattgtgattgatgatcaactatttataaaacagtgatgcattaactaacaacatttataaacagtctcagattatctttaatccttttaaaatgtctttttcatgccgcccgcctgatgtttgaactttacattttttaaaatttttcacgtaactcacgcaaaactcatgatagctaaaaatgaacgtcatattcgtgttcagcgcataaaaatgccctataaaaaattgttaaaaaaaattttatggggggtcacaaaagggattagaacctcattttcaatcgtattatcgccactttcattgctttttcaatttcagtccgttcgaaaagtacacgtcatttccgatgtggaactgattgggctgagtgaccaaaggccatcatcattcgccatcgattcggccgtttctttctgtgaacttccttcacattttcttggtgcccaaacggattggccattgtgggcacaattgagcaacggagagcgatggttgggatgtgatctgatcgtcgatgccagcggagtggtcccaaactctgaccaatggaagagcgattgtccagaggttgtgccgctgtgcttatcgccagaaaatgtgccacaatttgttctaagctttctcttgccgaagattatggcattctggtcaacgaacagatgaggtaaggagacggaataggtcacaaatgtttatcattcaaaaatttaggacaaatattgaagacgttttcgccgcgggcgatgtttgcacagcgaattggacagcaaaaagtccccattggaagcaggtgaatgaattcatggccacgggttgggtggtaagagacctttttatatttccagatccgactctggacacaagcgcgacagatgggcttgttctgtgcccgatgtatgctcattgacaacggtacacactttgtttggttggagatattaaaaccatttctcacaacctcctttaaaatttagcccaaacaaaaaggaaccgaattagttcatttcaaccttaagttttgctcgacatcgctttcgaacttttcacccacgtcacttctttttttggcttcaaagtgattttgcttggcgatttttcgggcgaacgattggaaaaaccctttgagaagaattatcggatcactgaaggctgtgaatatgtgaaggttctgacaaaggatcaccgtgtgcacggggcggtgttggtcggcgagactgacatggagggagcgattgaaaatctgattctgaaccaaaccgacattggtcaaattgagcaagtatttctagatcctgatttcgatcttgaagatttttttgattaatcccaattattttgcatttaatataccaaaactatatgataaattcaattttgaactcaaataatttagcaaactatgttcataaaacaatattttactagcacttaattatactaacaatgaacaaacagaaaggtcatttgtcttggtgtgttcttggcccatctcaatgcgcaagaaatccgcaatatttgccccatgtgcttccaaatattcgttgacagtctgttcaggattgagcatgaatggctggtgcaacagctgagtttcttctccgtccattctcgtcagcttaaatgggattggtgccttctctaagaaattgccatcccacctcggattggtcaacttgtgaagcgttcaaatcctcctcttccccgccgtcactttcattttccgcattagctgagcgttccttctccgttccctccccattgtcaacgatttccatttgagttgctcgtttagctccctttttccttggttcacccaaactttccggcgccattccaatgatgtgctgacaaagcacttgaccaagttgtgctgttggaaagtcagaaacactctcatccgatttgtgacccaaagacaccaacgaaataaaacgtcccaattgaacgccattaaattcctctaaaaacaaaaattatttcactcataaaaaccatacgacgaccttttggatgggtttgaccaaaaagtgttcctggtgaagaagaaatgacagatgctcgggcgagttgaatattctcgccaactttactcacagtggcaacgatcgcctcatcggcggttcgtccatccatcatgcggaatttatcatgttcttaacacaaattggaaatgttggtttttgcatcaaaccatagaatcaacccaccaatattcttcagcgttagtttctgtgcttcatcaggcaaaggcagcaactccgaagcacagttccgcaaggcattcaccaattctgtgacctgaatattttccatttgataaatagcaggattaaataaataccaaattcttgaattctgcactacagaatttcgatggcacattccttcagcgaatgccaatagggagcagggcaaagaagaaagatgcctttaaaatcaaatggaaaaatcagccaaaaaagacaagaatggccaaccatttgtctcgggtcaaaagcttccaaccaatcgccatgcttctgtttgttgtcatatacatggagactaagaaagtcaatagaaatattttgaaaaaatctaattataaaaggaagaaaatattcagagaccggttaaaatagttttggtacattcatattcaacttttttgttgtttggtttattttttttaaaccaacaataaaattaaataacaaatctggaaattttgtctttgaattgtagagaaatttgataaagaaatgattaaatgataactcaggcacaaagacaataaattagaaaaatcaaaagctatggaatatttccaattagacagaagacacggagatgagctttacgggtgtttgttgttgcttcttttgggcatggcttttacaatttgcgcaacgactttttcaacaaatgcagcgcacaagcgtaattctcaaaatgcacgaagcgaatgtgtttgccctaaaatgaaaattgttgaaacaaaaaaattcagggaaatttcaatgagttgattgactaatgacaaaagcacaccttacaaaaaaaactgggcaaatgcgcgggttttagccctttctgccgtcgtctgtacaacacaacgttgctcagctgcgtgttcagcgacttcgggtcaacactgtccactgacccttcgagcgcagtttcgtccttaagctcaatgaccaccgcagtgccaatgctgccttgtaaaaatgtgccgagcgtcacagctaccatatcggaaatggaaacactttgaccaactgattagagatttggattttcttttgggtatatctatttctctttcctcttttatctctctctctctctctctcaaattttcgctctatcctttccctctctctctcaaatgtttctctctattgttgggattggtactcttttgtccgcccattattattttcatttctttatttctctcccgtttattctcttttctctcttcgttcatgtcccacataaataccgcgcgccctctgacctctccgtcattcagttgtacccatttattttgcttatattgtttaatcaatattcgccctttgcccttctgtccctcgtcatttatttatattgtgttttccccaacttgaataaatttgttatttattcaattcgccggttcgggacttatcgccggttcgggacttgacggcacaacacctatcctttccatctcaaatatttctttctattcctcgttttaccctttctgattttcctccagccctccctactcccttgctgtccccattgtcataatgtgctaaccaacttgaaaagttttcctaagttaaaataggtcaaaaaatcggctctaatgtctttattagtccaatcgacttttatgagtccaaccaattgaaaatactttgtttttatataataattttttcatgttcgaacaaaccctttatttttggtatcattcgaaagtccatagtctgaataatgtaattatacgagaaaacaagagaattataacatttaaagaaagttacaaatggaaataatcagcatcactcaattcatatcttttttggtaattgcatgaacgctgcgattttatatcttttagcttcgttacacttggtgctttcgaatgataccaaaaagataggtttagctcgaacatgagcaaagttattgtataaaaacgaagtattttcaattgattggactcataaagtgcatttgtgccaaaaaaaaatcgaccattttcgcataaaaaccctgatttttctgaaaatagccatcgattcagtcgaataaaagctcccattttatcaacacaaaatttgccaagtttgtcagcttaacgactaatttgaattagattgacaaaatatttcaccgctttcatttacttcgacatgtccgtgtttagcagttcggattctgcgacttggtaaaattgattagaatataataaatcgttaccaagttatggtttttcagcggggtacctaaaactatggatgtaccaaatacctttgtctcaacaaataaaaaaaattttgtttctagcagcaacagtgaggcgtttttcgaaagtgcggaagagctcggggaagccttggatctccatcccgatgttattaaatatctaaaggaagcgccgcgttcggatgaggacccgattttggtgcttgattacaccgatttgttcaatggccttcaaggcactctcaaggacaacaaaacctgggtggcgaatctcctggtatgatttattggcttgaaattcatgatgaaaattcagtcgaaaattaatgcaaggcaaattttcgtatttaatgctcaagttaaattttcggtaatactgtcgatggtacccccccccccctttttttgaaagtttttttttgttttcgaaagacgcgaaagcgtgtttcctaggggtttaggggccgctgatcacgaatccggcgtctatttcgaccgatttcgaaccccggacctgaattcggacgaaagttcgaattcgatttttcgaatttcggatttttgatacaaaatggcttaaataattttttattcaa

SEQ ID NO: 2862 - DNA, 1051 bp, Heterodera glycines
  misc_feature (925)..(925): n is a, c, g, or t
gaattttcaaaaacaaaatgtgcccattttcctgaaatttaacataactgataaatagtcttgttacgcatcaatcattccgttaattaggtgggccagaacgccgaaaaaatccgtgacaacgtgttcaaattcaagaacttgacggacctttactctgcgcaagacaatttgaagtcggacccgctccttcgacatcttttctatttcccgaaccctttgattgcgcaacaactcaacattcatcagactccggtgatttcgtccattgttatcacatttttatctgatgtgtctgaaaattttcaaacggatccttatgatttcttcaagttctagagatgtcttgttgttctcttattgtgttaaataaagatcttttaaattaatgaattgctctttcattctaataattttatttaaaattatactatcttttcttcattaaaattacgccatttcttgagtgattcaaactggggaatgccagacgtgtgctcattaacgagattgccagggaattggcgtaatttaatagccgaaaacttaaattctttcgaatttgtgacaaatttacaattttcttagatttgaattgcataacattgagattgtgagggcgatacgacatcatcagtttcagcgactttttggtaatttcgatactagcagtgaacagaaatgtcgtttgtcttggtgtgttcttggcccatctcaatgcgcaagaaatccgcaatatttgccccatgtgcttccaaatattcgttgacagtctgttcaggattgagcatgaatggctggtgcaacagctgagtttcttctccgtccattctcgtcagcttaaatggggattggtgccttctctaagaaattgccatcccacctcggattggtcaacttgtgaagcgttcaaatcctccccttnccccgccgtcactttcattttccgcattaggctgagcgttccttctccccgtcctcccatttgtcacgattctccatttgaagtgctcgtttagctcctttttttctttggtcacccaaactttcc

SEQ ID NO: 2863 - DNA, 3990 bp, Heterodera glycines
agggggaggagggtgtattttcgttttttagaaatcccaaatagcaagaattttgcatgaattgaagccgtttttcgccaaaaaatgactatttttgccattttggtccacattttttcaaaaatatggtaaaatgggggtaacctgtaaaatcctgtcaagttggggctggtcatccgggcccgacgaaaatgccatttggaatggtttgtccagtgcgataaggtcatctgaaaggcaaaaaaaatcaaataaataaaacgcaaatacaaatcccgaacgttttttaaaaatcatggccattctaggtggtaccccctcccactttttcgaaaaaaatataaattaaactttacagaatttcataatacatttttagggattttcgggctcgattcaatttcatattcacatttatactctctgaatttttcggcttattataatccggattaggggtgcagaattggtcggaattgaatgtgagattcacgtttaacgaccccgataatccctaaaatgtgtttcatcaactctttttcaaattttgagattttgaaaaggtggacacttggccctcaattgccttaaagagcgaaaagttgcagaggggagcagaaaatttttctgtcttttatatatacgaaaatcatggaacaagtagctatcaccagtctcgtagatgacccgttttgccatgcagtcgaccaattcggcacggtcaaatttccaaattgggtctatcaaagcccacaactgtttgatgccgctggtcccgtcagactggttcagctcgaacagttcagcagcatcatctgcttctgctgtgtcaatttctgttgttgtcattggtggactgtccaatggcggcatcatttgttgttgttgttgaactctgaaaaaacgggatgcaaaaaagaaaattggaatttcaatggaaaatccctcgaaaacgaagttttcaaggaaattttttaatttagcctcaaaaagtaagccgatttgcaccattgaaccctctttttgcaacaaaaaaatggttgaccccctccatttttacgtcaaaacggaagcagcccaactcgggcgttttttaatttttaatttttgaaaagtcatgtgtttctaggaggtttaaggggtcgttgaacacgaatctgacatacgtttaatatgatatgattccgaaccctggaccccgaattcaatacctaataggtaagtctaaatctcaaaattttcaaaattcaaccaaatgcacgaaggaatgggggtttcgagggtgatgattacgaatctgaacttggatttccccaattccggacccttttgagcacaaattaaaaaaaaaataaaaatagaaacccccattcttcaggattgccaaaaaaaatttcgaaaaaggtgtgtctatcactggctgtactcgtactgtcctgactcgcagttttagattctatagtcatttttcggcagcctggattttttctatgcctgtacttttgcccagaaaatccaggtccaacatggaatattaaaaaaaaaatttaaaaaaaaagacttttttcaaaatgtcgaatctagaaatttcaaaagttggcgacgcttttttaattgtgaatgccaatttttctcgtggcaccttcgcgggaagaactgttcctcaatgaatgtttgagcatcagtgtcggcaccgtttttcccatccattttttcctgctcctccttttccgataattccgggaagaaatgcgcttcgaacacatcagcctcatcgcttcgtccgccgctttgctctcgccgtttgaaggtcgattttggcacttttgctctgtgctgatataattgtggcaatggcatggaatcgagcgatttgatgccgaaaaagtcatcctccgtgggcattttgcgagggaatgaaaggatttgaagatttttctaaattggaacttccaatcccgcagccgcagcaggatccacgaatttgatttttgtattgacaaaaaacattatgccaaaaattttttgaataaatttaaaataaattttggttttgtttttgacaatcaaaattttattttttaaaaaatttactcaaaaaaacaagacgcgaatcaagggttagaaggacaaacaaaaaccattccccgagcgtttttttcccgtcctgattttgaaaaattttttactagcctattaaatttttttctaaaaatttccttcaagccatcattcttggatttgagatcactatgaggaatgaatgcactgtctaacttggtttaattaatttttttgttcacatcttcttagaaatttttgccaaatagacctaacacacaaatataagaagaaaacaaaattgggaagtgtagatgaatttttttgtaaatttacacgccctctaaaattggctcaaatttgctggaagaaaatttatacatacaataaactttgaagaaatgtaagttttatgcacttgaaaaaaaattgaaaaaattcacgctagatcaacttttatgccaggggtcggtctgtcctatttgtcagttgtcctgatttggagggtccaaatctgataaaatgaaaatgtccgatttgtaagatttgtcctgatttggaggtggtgaccaaaatttgttctgacttcttaaacgaactcattatttttaaattttatggcaaaatgtcacttttatcaagaaaatataagatttgaggcaaaattggtcattgttggactaaaatctgttaaaatcgcattaaaaattacaaaatttttcccggcggcgcctatcggcgccaccggacatccctgtccatcccccaaaattttttgaaaaaacgcgccgcaaagaaagcgtttttaaaagcgacaaaaagtcaacgcttgatttttaattgcaaaaattggcctttttgatgaaaagctgttaacagatcagaacgaaattacaaaatttttccggcggcgcctttcggcaccgccggaccctctcctcttgccccttcaccaaaagtttttttggaaaaatgcgccgcaaaaatttttaaaaatctgattttttgatcccaatgcactgaaatttacgatttgcttatttcctccccaaaattgttaaattcgataatgtgaggtgaaaaatataattttaattcattttttgatcgaataaattgtaaaaataactgatttgaagcaattttgcaaaatgtgctgcttttctacaccaaaatctgattttttgggccgatgtcctgattttgaaaaattttcgatcgcacccctgatttatgctgataaaaatattaattgcaacactttgatcagataactcctcttcagagtgatcggaagtgttcacaattttagtatcccaataccatggagttgggtccgctctccaccttttgtaaatgtaaaactgcacccacccacaatcatttttgatttataacaaaaggatatagaatttcagtgcactgacaaaggggggacggaaaaaaatgttcgatgaaaaattttggttttaattttattttacattttaaaaagctaaaaacaaaattacaattgaagaaaagcataaagaagattaaaaagaacaatttcatagcaaaaatcattaaaatgccaaaaaaaaatttccccgtcggcgcctttcggaaccgccggccactaaaaatctttacctttagaccgcatcattttttggacaaagattttaaatccgcgatgcgcgatccgcgaccgtaggatttaaaatccgcgatgcgcgatccgcggcaaataataattagtttttttcgagtttataaatatcattatgaattttagcagacaattggaaaaaccctattttttgcaaattttcatcttttagtcttaaatacccgggaaacgacaaaattttccgattattacagaaaacaaatttttatttgaagaagaaaaacataaaaatgataaaaacgagcaaattgatcgaa

SEQ ID NO: 2864 - DNA, 6225 bp, Heterodera glycines
  misc_feature (6026)..(6026): n is a, c, g, or t
taaaattaatgatttttcatggaaattcttttaaatatatagccaaaatttcaaaaaagatttcccggggcgcctatcggcaccgccggatccttaaaatcttaaattttcttaaaaaacttgctcaatttgcaaaaaattggtcattttgaacagaatctaacaatgtattgtattaaaattttcaatttttttcccggcggcgctttttcaagaaatacaccgcaaaaaattttgtaaaattactaaagggagtcaaaaatataaagttaataaatgttttgttcgaattaattataaaaaataatttatttaagcaatttgaaaaaattttctgatttttgactcaaaaataagattttttatttcaaatttctcctttataaatttttctatatatttttaatttaataaattgattgtcctttaaatttgtgcattaaaaatatttttgtgagtttttaattaaatttttgaattactcccgctcccgcccgggactcccgttaaaaatggacgggattttaatgggagcgggatttttacgggaatcccgttcgggactcccgtcccggaaaattttgaactcccgctcccggaaattttttttaccggacaaagtgttggtcaacagaacaaaaacaccgaacagaaattggatggaaaatatgccgtggtggacaaaaacaatgttttgggtgggcacaattggcaaattaatttaaaattaaaaatggcgttataaaaaaatgcattttttgagaggggacaaaaccctcgtattatatcgggattttatacatatttggtacatatttcggacttttttcttacatattttcatttttttacatatttgaggattttttacggaaatttttggaaattctcaaaaaaaatccaaaaatttcggcaaatttttcatttttttacatagctattctgagaatttttgaaaatttttagaaatttcttgtgaaaaaattaaaaaatcttttttttaaatgtacccctccaaaaataatttttaaatgttaaaaggtgattttaaacattttggtcatttttatggcattttgtgcctatttaacactttatgaaaaaaaattttccaaaaaataacaattaaaaaaaattttatttacatattttcgtacatattttgggtttttatacatatttcttacatatttcgggatttttttttacatatttatgtacatatatgaccactttttgtacatattttttacagccctaattataaatatttaggtgttaaaaaattaatttttctttttaaaatgtatttattgctaatttagttgctttagtgacgtcatcgggcgaccattcgccgccggcggttgtctcagcgaatgttgcaaaggtgggaaggaaaccttaattatttcacaaatgccatttaatttcaggaagtgcctaattcgcagcaacaaaatgattgggatgccaaagtttgccacaaagacatcgaaatcattggggaaaagcaattgacgatcaattgcaagggcaacagatttggtatttaatataaaaattaaaaaatgtaattaattaattactttcttaattaggatggcactctgtttttgcgaaatttccaattacgaacttttgtcgtcccggaattttctacttcgaaatgaaagtgttcaaattgaaaaggtgttcattttgatgatttcttagcgttttatttataattttgaatttattttaacagttttgccgcgattggattcgccacgaaggaagtgccattggacgggtcaattggtcaaattttgaacagttacgggtaccgaagcgatggctcatttggctgtaatggcatcaatcggccgtgcaaaatgccaatgtcattatttggttcgtcattttcccccgtggcaatgcaatcggcggacgtggaaatggcatacaaatcatcggagttttccactggtgacgtggtcggatgtggcattttcttggatactcgactgatcttcttgacgaagaatggccaacgaatgggtgggccaattaaaatgaaaaaacaaattaattaaaatttaatttttaagattattcctcttttttcattcaaactcccgccaattctctcaattctctgtttccgtgcgtttctttgtgggtgggcgacaaaatcgaggcgaactttgggccaaatttcaaattcaatttggcgactctctgaagaaagcaaaaagaatggaagaaggagaaattcatctaattgctgtcatttttactttattatgtttattttttaaattcttttttttcaattttgattttggctttataatactaattactattttatttgctattcatttcgtttattaaaacgtcgattttgtgactcagtttcaagtttcttcgaaaaaattcctatgaatcttaaaaattaatacgagaaacttcacaaaataatttaatttctcttaaataaggatggcatttcttgactcttggttttaaactagggtttctccccgactccgagccccccccccccaggcccgtaccaaaggaatttttacaaatatttgttctattctcagatattaattaaatccaatttttcaattgcatttttaaataaaattctgaattggggcattcttttttaggtcatcattttgccttaatttatgttaattgaccccgataaatatgttaatataagcaactgcagaatcagcagatgttcatttattacttctccaatttgtttaataatttatcatttattaaaatttacatcttttattgtgaactttcattttaggaacttaatgaaaagtttgtcaaaatggaattggtattgaaattaaaaatgtgagtgttatttaaagtgtcatttttttgaaaattaaatgggaattgctaattaattttgaaaaaaaaaattttttttaattattaaatgattttagaagggactccaataaaagttgaggcagaaggaaacgaatgtactgctggcgaaatcgaagcggaaaatgggaaaatgaaaacaaacaaaaaaactaattttgcggatcaatttttgagaaaaatttcaattcttagggttgtatttttctttttattgcatttttgttaaggattttccgaagatcccgacacaattagtgccactaaaagcaaaaagaacacattgttacaattgttatcccaattttcatcgttcttctgctgctgaaccgtcacggcctccccaattttgcatcgtttcattatccatcggttgtccaattcctttgctttggccaatgtcagcttttcctttgtccattcgttcaccaattcaaatgtcacaattgatggcgcatgaacagtaaaatgaatttggtaactgacggaagaaatggcattggcacggagaaattgctaaacaatttggaaaataaaaatagaagtagtcaaaatcagtaatatgcaaaaaaatatgggaccataccttcttgaaattgttgacccaatcgaagtacacttgtcgttcaaaagtgtgcaacacaatcgcttgggttggccatcttttctcggtgtgtgcaaaatcgtcaccaatcgcaattgcctcgggcaacagaccatatgaatcgattgaattcaactgattgagatcagtgataatggtcggcgaagtgcgacgaagaaaattgtccaactgatcaccatgttaaagcgtaaatggcgaatgtttgtcgaaaaaatgggccaaatatcacgcacaaaaatgtcccaaattggctgtacatccatgatgtgtgatgatggaatccacaaatataagtcggtcctcttttgtcgaaattttggtgatttgaacgaagaaaagcgatgacggaatgatcgatgtacctgaaaatttttctaaaatcatccattattaaacattcttggtatcattcgtaagccttagttatcctctagtaggctgcaaagcttcaaaaaatttcattatgtttaaaaaaggttatggccagaaaattttaaaaagttggttttctaaacatttttggctataaattttttgaaaccagacggaattttttgaaattttgcatgctaatagaggatcttaggactatccaattttgacatgacaactcgtacaacaagggacctatcaaagaatagactagtttcatctttcattttaacattttacaatattttttaataggaaagattttctttttaattttttaaaattaaattgtcttttgtatgagttgtcatgagttgttgccaatgttttccaatttttaactcattctcagcacgcaacaatgaattcaagaaaaaaaagcattggaaagtgggtccgacgatgtagtagtgattttgtccaaaaaattctaacttttcaacggggaaagaggtgagaggtgtccgccgagaaaacaaattttcgtttttcaccctgcctcccccggccctctacgcaccccttggactgtgtgtgatttttaaatatttacgaaaatttatgaaaaaacaacttttttaatgcttattgtttcttgccaaccatttctgcgtccaattttggcacatacaacattgaaatgtgctacgaaaggggacatcgtattcgggggaaagggatgaacgagccaatgatccgggccctggattaatggcctccccgaattgggatccccgggtcgcgcgactgattggatgcgtatggagaaatgccaagaaggagtaaaacagatatcatttattagccgataaataagttgaaaatcccatcgcaaaaagcccatctcgctctatcgctctcgactctttagcccccccttgactgactgccgcgagaacggggagaacgggaaaaggaagcgaaaggggcggggaaaaagacaacaaagtgatcgatgatcgcttataatcatattccgtctctgtgcctcacacgtccctccttcttttgagtttgtccacaaactctcagttctgccgtgctggtggattggtgcaacgagtggagacatgacctggctggttacaacgccaacatcgaatttcggcacgagttcgtgaaaattcgcgctgaacatgacgagaaggaagtggcggattggagatgtccctggattggctgataggagaattttggaaattgagattatttggtcgatttaaatcgttcaatggcctcccatttcgagacagaacagccgcggttgaagacgaacgaccgggtgccaaccaatcagcatgaaaacgatagttctggactgactcaccagaatcatcgactaaaagtccacggacgtagctcgaactcgggcttttgatggacttaacaacggacggggatgttaccaccgtaaactcaatggccttattcagaaatctggaccaaattgggctgcctcccaattcaagaaagtcgcctattacaattagtccatgttttccacgggaaagggcaacattcaccctttgggcatcaccccaaaattcactcttacgatcctttgaaaaattggcccgttgccaattgctgaactgttgctgcttggtgactgtcgtcgtgacgatggtgatatcggcctcgtgcccctgcattgcgtctgcagtggcagagacaatggaccgactaaacccttgctctttcagctcagtgccaatctgcgcagcttgcccagcatgaaaggaaattatgcggatgctgccggggaatccgtccaacaaggccaagaggtccagtactgtccgagtttgtccgctgtttgttgccgaaaagctcgtcagttccggttccattagtgattcctggtggatcaataaaagaggggattccgccaccggcattttccaaaaatcgattagcatcctgaaagaacccggcccaggctgaaggcgttccccgtggggtttgtacgccatgtgctcaacacaggccacaatctgccaatgagaacggtaatttgtcagcagtgttgtcctatccaccgctttagccttgtccnaatttatcagaactgtgtcaaacccaaatcctaccctaaccggctcgggaacgctttgcatgttgaccgccaattggtaccggtccccggtaacaaaaaccttttttatctcacagagagcccgacaagttgagcagacttgcacgaatggtccctgaccagcctcgtccaacaccacgatgttcccgtcacaaatcag

SEQ ID NO: 2865 - DNA, 759 bp, Heterodera glycines
atcaaattagtatagttaattgcctaaattcaattattaaaaatttaattattagtttgagtaaattacctaacccaaacattggaatcattaaaatctttgccgccaaacgatactcaatgaaattttgtcccgaaaatgctgtataaacaaacaaaaaatggccaaactggtggagcatttcaaaaaaggaacaaagtgccaaaaggtaattaacggtgccacggaatgaccttaaatagggttaaattatgaatcaataagcttattccaagaatttatctacactaattacgcactttgttaaaaaggttacaccaatgacagaagaattgaaaatgatgccaaatgtggcaatgattccataagtcagtgcgcaaccaatcagagaccagctgggatggaggtctttgaaggccaaataaaactgcaaaaattaaaaaaaaacaatttttaaatatttcaattaatgactaccgtgttgttgttcgttgagttgtcattcattttgctgaatttttgtttaattaattttttttaagataaaacaacaaatggcaatacttaatttgcttgagtaaaaccgaaagctcacctgacaattaatttaattaaatgtttctgaatttacataatatttgtgattttttgtgtctgcctttctgttcatggcacctgccaattttaatgaaattacacgttttacatttttcaataattaaataataaatgaataacgttttttgtcgtacctaactg

SEQ ID NO: 2866 - DNA, 3650 bp, Heterodera glycines
tttgtgcctaattgggatttggccagtaaattgaattcgccaaggagtgatttggccagtaaaagcaaatttttaaaatggcagagaattaattaagttcacacaaattaaacgcggaaacaacgattcatttcgtcagtagctctaaatttaaaaagttgagagatgaataaaaattgctgaattttaattctacaaaataattgatacagtatttaattagaaaaaataataattttcgtattgacctttcaatcggcggtagacctataaacttttgccaggcaacaacacgtagacacatggaactgagcaatgatcaattatcgttgaaactgtgtaaagttgtgcaaaccctcttggacaactctaaattttagtaagaataaaaatatataaatatcatttaaattatatttaaaaagttaaaattttcaaattattttttggatcacttcaaatgttccgtcgatcgctatctcatttctgaagtttcgcaatgtttgtattccaaaattcgagcaaaaacaattattcttccaccatcaacgtttccatccaaaatgacaaaattctgcaaccgagcaggtatggcaattgccgtggcagggagggcatccaaacaaacatctgctgcgtttattttaggaattttgtaattaaaattaatttttaattcgtaatttattaagaaatcacctcttcttggttctttcttttttggtatttgtaattccaagccatattagatgctgaaggtgcgcttccgactcgcacatcaataggcaaattgctccgcgtttctcttacaatgttccggcttgttgtcggaaaatcgcttgccgcctcctgtcgaagtaattcattggcatcacggacctttaaagggatgagaacaaccatgttcccccgttttgccattcaccccccccccctgttttaccatttttttcctaaaattgctggatggttatgtgcagcagtgacacggccttttccgaagaatccagcgcttgccaaatttgttgaatgactaccgaaatgatgaaaaagttcaacggagccttcgatgtttgcagtctctcgcctttgttcctccggaatttgtttacaactacttttgcattttggtttcatcattgaattccactcctgaactgcgagaactgataatgtactttgtcaataaatggattgcccaaggcgaataatcgaaaatgaagaagtgcttttgcctgatgctggtgggctgctgacggttggattcgtaggcaaattgaggcattgaaccttgcacaaatgaatgcgctgtttccgattcaactttggaatgttgtttacagagttgccgaagggctttgccgtacgaacaattcgtgtgaaataagattttgagattgaaattatggtcagtttcatttgagggatggcataaatggtggaatgaacattaaaggcaatcagagattgagtacatttctgcgaaagatgataaaggaggatgaaatgtggggagttagtgtggcagattttcaggcggcacctgctgatggtattagagggtcacatgtcagccgccgatcaaaatatatcagacaacaatttgcaagctttgttagcagattttgataacagtgatccgattttatatatgagttcatgttcctaccactcatttctgatcaaaaatcaaactaaagaattatttttctgatcaaatactgtatccattattttgtagaattaaaatttaaccattattatttaattgattctctgccatttttaaaatttgcttttactgtcgaaatcactatttgtcgaattcaatttactgtcgaaatcacaattaggcacaaagagtaagtgaaatagttcactgtagaaatcacttactgtcgaaatcaaccactgtcgaaatcacctgacacgatattgtcacacttcgtttaaattttcgagttgtattttcgaatcacaaaaatattttattaaaatgaatgaaaaaaggtgcaaaagcctcgcgttcacctgacaattaatgtttgagaatttcaattatttgtcattttctgttacttttcttttggtcatcaaaatttattattccttttgttaattaaattcaatgccaataatgacaatgaaaaaaaataatgcctaccaatcatatgacaattaaacactaattgactaatggaagcccatcgtgcagtgttaaatgattttattatgtacactgaaaatcggggaaattttcgaaaaatttgtagggggttggtaaaatgtttctgcaaaaaagtcacacgtactatttcttaagaaatacagtaatttttgtagacacaaaactgctgaagtgcccatacctaatcgcgtgtaagttgaagtcccatcatccaaaaagcgaattggaagtaagtttttttgtgctcttttcaataaaaactattttaaaagtacctatgcatttttttataaaattttataaattttaactagaaaatataaattctcaaaaatgtaagaaacaaatgaaaatgtgtatgtaaaaattgcgaaatttttgattttttgtacatttaataaaaatttcctcaaaaaatgctcaaaaattgcaaaatatgtacaaaaaattgcaaaaaagtccaaaatatgtataaaaatatgtaaataaaagtcctgattttgttctcaaacataaaaaagaaatttttttccctacttttagactatagagaatccaggaaaaaatgtatttaaataaaaaatgaagccccactaatcacaaacttagtccttctgaaaatctttttttaataagatgtttgcgctcacgtttaggtgccaagccaaaaataaaaaaatcaccaattaacaggaaaatttaatatttaattttataaaattaaaatgtttttaatgaaatttaaaaaacaaaaaataaataagaatatcaaaaattcacggatttacaaaataaaattcaataaaaccaaaatgtttcgctttttggtgattgttttcgttttttatacatatttgaagttttgaaaatttataggaatttcttatgaaaaattaaaatatttttaaaaagacagccaaaaaatctcttttttcaataaaaatgagatcataaattaaatgtaaaagtgctcaaatgttattttaatttatttaggccttttgacgccattttgtgcttattcacgcttttcgaagaattttttgtccaaaaaattgtaataaaaatatttatttacatattttcgaaccggcgtctgtgactttccggacaaatgttctaccagctgaactaccgaccctgccacacaatcatcccaaaacagataggacaagccttctttgtaaaaaatgtggcactttcccaagggtaactcttcgattttcgcgcaaaaaattcacgaattatccctttttatcaaaaatttattactttaaataagtgttggacatgtcacaaaatggttttatgtgctatgaattttctcctaatttattcagcttttctttgctctccaaagtcaaaatcccgatgacaacggtgtgtcttcctttccatggccaaccgaattgtgttggggcagggttgggcatcaaatggcttggaattggggacattttgg

SEQ ID NO: 2867 - DNA, 2470 bp, Heterodera glycines
ccgcttgggcatcccacgtgagatgaaagttcactttttattccatccattccatccacagtacttttcgcgattgagcatactgtagattggtcagcagcagagaaagtgtaaatgtaattggacatcacagcaaccacttgctgactgcccggacagcacggaaaacctatggaatttaaatttataaatttgcaaattaaattctaaattagaaacataaagatttccattaaatgtttttaaaatgtgattttaaaaattattaaaattaacttggcattgcattgcaacagactaaaaagacaattaggaaaacggagaaaacatcgcaaaaatattttttttttatttactgaataaaaatttgatgattttttgttttgtcggtgcagttaaataccctcttttttcatttccttaatagcgtggattttaataaatctttttagcggaaattgatgctttttcacgtgaatttacaaagacttccggaattttgtagaatttttaaaataataataatattttatttttaatctgtttttttcatattattattgcacatgaaatacatttatcttaaatgtctcatgaattttaaaaatccagatttcttttattgttaaaaaagtctctaagtgataaatctgaaaatttcccaagggtaactcttcgatttcgcgcaaaaaattcacgaattatccctttttatcaaaaatttattactttaaataagtgttggacatgtcacaaaatggttttatgtgctatgaattttctcctaatttattcagcttttctttgctctcaaaagtcaaaatccgatgacaacggtgtgtcttcctttccatggccaaccgaactgtgttggccagggttggcaatcacatggcttggacttggcacattttggtgcgcggaaatccctggaaaaatatttatttgcttgattatcaaataattagttttatttgcctttgcttgggtgtccaatgtgcacatccgtaacttcaatgttcatttcttggccaattgctttgattgcttggctttcctgtacaaatttgcttttcatgttttgccattctgtgtcgttgcccgcatggccagcagcagcagcggccaagtcgaacatggcacgggcaaagcccaaattgtagggacactcatcctcataattgatttccatttttgcaatatcttaatgaggtaattaggaaaatttcatattaattatttatgtctttcaatgatctgctgatagtattgtaattactagtcagctgtcggtcgatttcgttcacaatttgtgcttgtcctccccttgggcatccgatgcgataggacagttcattttttattccttccacagtattttttgcggttgagcatactgtagatttgtcctcactagtgaaagtgccaatgtaattggacatcacagcaaccacttgctgacttcccgggcagcacgggaaatctgtggaatttaaatttcataatttttgtatatttccattgaatgctttaaaattttaaagttaaatgttttttttgttttatttgtgtttacttggcattgcattgcaacagaccaaaaagacaattgggaagatggagagcagcagagaaaacatggtaaaattatttaatgaataaaaatattttaaataatattgttagtttttctgttcgcttaaatatccatccttttttcttatttccttcatagacgtggcttttatagacaaaaacatcaaaaaatctttttttgcggaaattgatggattttcttatttgctttcacgtgaatttacagacttcgctattttgtaaaaaaaaaattttaataataaatattctttaaatatttttttgtataattgtattctttcttgttaaaaatgtcttcggccgaaaaaggccaaaaattttataataataatatgttattgttctgttttagaacattttaaattattttaaaaatatttttttgagaaaatatttttaattgttttttatactttttaaaaagggattttttactataaaaactataaagtaaaattatttatatttttcaaaaagaaaactctctttttttactttttttttgttaaatcttttgcaatacattttattgtacaaaagaatacaattcaaaataggaaattactttttgtccgtcgccacaaatttttcaataaatatcactttttttcagcagctcgcattcattggtaattattgtttgttttgtataaaataaaatcaaaaattttactatttttaatatataaattatttttcgacttttatttcttttttgcaaaaagaaaaatcagtgctttttctcacatttccgagtaatttaccgtccataatcctttgtttgatattttggagataaaaaaattaagaaaaacaaatcagtgtttatattattaaatttgccaatccattt

SEQ ID NO: 2868 - DNA, 3610 bp, Heterodera glycines
cttgattatcaaataattagttttatttgccttgctggggtgtccaatgtgcacatccgtacttcaatgttcattcttggcccaatgctttgattgcttggctttcctgctcaaatgacctttcatgtttgccattctgtgccgttgcccgcatgcccagcagcagcagcggccaagtcgaacatggcacgggcaaagcccaaattgtacgggcactcgtcctcataattgatcttcattttcgcaatgtcttaatgagataattagaaaacaaaatttcatattaaatatttatatttccaatgatctgctgatagtattgtaattactagtcagctgtcggtcgatttcgttcacaatttgtgcttctcctccgcttgggcatcccacgcgagatgaaagttcactttttattccttccacagtattttttgcggttgagcatactgtagatttgtcctcactagtgaaagtgccaatgtaattggacatcacagcaaccacttgctgacttcccgggcagcacgggaaatctgtggaatttaaatttcataattttgtgaaaaatgccactttggaaaaataaacatttccattggatgctttaagattttaaaaggtttttttttaatttatttaatttacttggcattgccttgcaacagaccaaaaagacaattgggaagatggagagcatcagagaaaacatggcaaaaagattttttatttaataatgaataaaatatattaatgatgtctttattttattttttcagtgcacttaaatacccctttttctgatttccttaatagacgtggattttattagacaaaaacatcaaaaaatctttttagcggaaattggtggattttcttatttgctttcacgtgaatttaaaaaagactcgctattttgtaaagattttttaaaataattatatattttctatatgaatttttcttgttaaaaaagcattcggccgaaaaatacaaaatatttttaattttaaattttaaaaattattttacgtacttttttaccttttctctttttcaaaaactttcttttaattaaatataaatttttttttggggggttttagggaataaatctatattccgctatttttgcgtttttagtccatattttggccatttttggcaaaatttcacaaaaaaaatgcaaaaaaaaaggcgaaaaatacacccttaaagatcgacttttttggaaaagctagaatctaataaaaattggcagtttttagcttaaatacatttttcgtaattttttagggtttaaagcatatattttggcagtttttagtccatattttggtccatatttggtcatttttgacctttttagtccatatttcgggcttttttagtccatattttatgtccatatttgccgttttttagtccataattttattggtctgttttggagtgttttttaaattagtttcggattttttaataaattttttaattattttttataccatttaaaaagggatttttttaaattataaaactataaagtaaaattatttataattttggaatataaaaactcactttttctgtttttctttgttaaatctttagcaatgttttcttttgtacaaaacaattcaattcaaaatgggaaaattactttttgtccaccacaaattcagcaataaatgtcacttttttccagcagatcgtataatgggtaattatgatttgttttgtataaatacaattaaaaataagaccaatttcaataagttttttttcagaagaatcccgcgttaatttattttttgtaaagtgaaaaaatcggctttttctcaaatttctgagtatgtatttttgcatttccgagttgtcacccctgagcctaatcaacgaaattcgaaaaactaataaaagaattaagggctgaaacataaatacggatttcatccataattaattattaaatataaaacatttcatttcctaaattttgttcagttaaattttagacaaaaatgttgtcaaaagtttgttttccaaaatgtttgttgctgttgttattcggctgtataattggcaataaattttcattatgcgaccaaattttatcgcctcaaacaactgaagaaaaagattattcggaatgcggaattccggactttgatccgttcaatgaacgaagcgcagaggattcttcggaaatcagccatgtaattatgttattaattaccttttttcatattagggttgcgcatcagggatgggccaaattgaaaaataaaatcgaaaagcgaaatttgcgaaactgaaaaatgcgaaatgaaaaaaaagcgaaatgcgaaaagccaaaatatgcgaaatgcgaaaagcgaaattttttaaaaaaattttaccaatagcttgaggttgtgatgcaaaaaaaaaatctgcattttccggttcgatctttttctcagatagaaaatgacaaattctactcattttgtggttaaaatttcaaaaattaaggtaaaatgaaggtccggcggtgccgatacgcgccgccggaaaattttttggaaattgtaataaaatatggtaggaaaagttgcaaaattttcaaaaaatttaccgttttttcaaaaaaataaatcgcaaggcaaaaaaaatgcaccaaaaagttcaagataaaagcttcaagccaagttaaaaactcgttttcgtgcatattaggctatagcaagttagcaaaaaaggtaattattagagttgcacggaaccaggaattttgacaaaaaccgggaccgggacttacggggaccagaaaagtcgggaccgggacctcgattttcgtccgggactgggaccaaccggggattttcccaagtgaaattttttgaaaaaaaatttgaaaatttgagtgcactttgttacaaaaaattgcctatattcaaaaatgtacccataaaattttttaattctcgtttgtggggagaaattcgaagaatttttccattatgcaattttgagtgtaatatgttaacagaaaataataaactgaagcattcgttttaataattaaattttcaaatatattcatttcttaggggtggaaattttgcattttgcgccaaaaagcgaaatgcgaaaagcgaaacgccaaaaaatgcgaataatgcgaaaagcgaaacctcggcccatccctggtacatatgtcattgaaaattaaatctttcttgctctcctctggtcttaatgaaatgggcagtcctttttcaagtatgtccttgaaagtttttaatttcttttgccccttggcgtttgttcaatggccactcattttttcatgtaatttgtccattaaacaacactttttctctcgccagttattctcccaaggacgtttgtacatgttaaaaattgacattttcattttattcctagtcagggatttaagttgtttttttagcttagtatgcattcatttggcttactgtagcagcgggctgttggccacaactgaaaagtggtggggatactgtagttatttatattattaaatttttgtgttaggctctaactgtattgcttaatatattatgggttaggggtataagttctatga

SEQ ID NO: 2869 - DNA, 979 bp, Heterodera glycines
attctgtgccactcgcgcattcgcttttcctccctcacactttttgttctgcgcaatgcgtcgctccatctgagcgcgcgtctccaccgcctcccgcgcctttctttccgcgatgctcaacgcctccgccattttggcaaagttttcattgatgtgcacttaaattagcatgctttggctaatgctttgctccacccattttgcccaccttgttgcaatccgcgcccatccgccgccaatcgcttgtccaatgccacggtgtaccctttggggtttttccagttggaaatgcaaggcggaattttccagtcggcctgttcctttgcgcttacctcaaaaagaaataaataggatgagtttgccagtttgagtgcatttccaagtcatatctcgcaaaatgaatgggtccctgaaaacgcacttttctcgtcggcgaatgcatcaccggcgccggcggagagggcggcgcccgagggattttctgattgatcctaaaacacaaatttaatgcaccagtaacaacattgctcttcatgttatggttactgaaaacgtggcggttccatcgggtccttttgctcctccaccagccgaatgattctctgttgggcgccgcccgcgtttaggcccgactgttggctgggcgtgtagcgaatgtattgggcaggcgccgtctttttggcgtgttgaacgggcaaagcggcggcaatctaaaagtatgaaagtaacaactttcaaaatgtacattaaagaggtggaaaaaggggtcgacgccgaattttacgtttatttattgctttttaacatatttttcgcacttttttcttttcatctaatttaataaatggccaaattttcattcacaataattctatcatgagttatgcagtttattgaaaaataatctgttttgatatgaccattattttttaatttgtagaaatgaattttaataattggatagagccaggactacttt

SEQ ID NO: 2870 - DNA, 1983 bp, Heterodera glycines
caattaataattaatttccgtccattttttgtccctttttcgtccgtctcactttgtcttttccgtgcgcaatgcgtgcaatttcgtcaaatcgcaactttccctcctcgtcaaattgcagtgccaccgttttgtctttgtttcttccgactgcgcgttccattcccatgcctaaaggagaaagaaacgcggaaaattacgacaaattaacatttttaaaggaccaagtggaaattgcgcgatgtgaatctccggaaaggcaccgccatcgccaaagtcctgaaaaagtattaaaattagcaaaaaattattttagtaaaggggacaaaaatatacttcaggcgtacgtggcacaaatcctttgcggtgcccatagggcggtggttctttgatggcaactgtttttgatgcggcattgtgattgatggccacctaaattagcgtgggggtgtggtattttaaacggattttcagtgtaattattaaacagggacttgatcgaatattttttaaaagaacatcaaggctaaaaaacaaaaaatgacaaaatttgcagattctagactaattttttaaagaaaaataagtttttggacgccggcattgccaataggcgccgccgggggaaaattttcacgaattttgttagaaatttgtcattttttagaaacttcctcttacaaataaaaatagggcactacccccaaatcagaacattccttagaaataataacagatctaatccctgttgttaatgcaaatccaaaacctcgtggcctttgaaccaggggtcacgcgtgacaacatttgcccattcatcctttccttcgttttggataggcgaaggtaatattctgaaaatgtcaaatgtattatattataataacggttaacaaaactcactcgttgagcttaatagacgacatatttgaaaaaagattcaaatggaagaaaggttctgaatatgagttataccaaatggtgaaattttcataatatagatcctgacagtactacactgttggaaaaaagggtaatagtcaggttgttccccacttttttggtaaaaacgtgtaaaacatgttcttgtgagtggtttcggggtcgctgatcacaaaatggacatctatttcgatcaatttcggaccagccccgaattgtaacaaaattcgaactcatttttcactagaacactatgggtacgccccactgtgcagagaaaagcctagtactatctcgtcgtttctctttttctttgtaatttctctcactttggcgtactatctcttcattttaattatgtaaaaaacaacattcacttcgctacgtttaactttttttctacacgttaaatccaccccaaattttgcatatcgatagagaaaaggaaaatgagcaaactttcagtgttttgagtaaaaattttggcctagaaagttattcaattcgcatttatctgaaattttttaaattttttaggatttatggctaaaaaaaaattattgcttaagcttcaaggcagaagaggtgctgaacaactgaaaaaaaggcgagaggaaagaaaagctcagacggccaaggcgacagaagcccggctggccaagaatagtgagtttttccattcatttttaataaaatcctaattttccaaatttttagccgctccccagccgaacactgatgcagaaacgccacaaccatccgaagaagagccgtcgacatcagaggcaccggcgcgggacaacgacggacgaccaccatcaactccaacaccgatgacaccgcaggaaatggacgtgccgtcggtggagatggtggacaccgatgtgcaaatcccttcaacgcctgccgatgaagaccaacaagccgagcccgtgccgtcaacatccacggcacgctgtgacctcatggcgacaccatcaacttcaaagtgcgccggtgcctttggtcttgacgatggtgagtgcgaaattccatcaaaaa

SEQ ID NO: 2871 - DNA, 2611 bp, Heterodera glycines
  misc_feature (2279)..(2279): n is a, c, g, or t
  misc_feature (2367)..(2367): n is a, c, g, or t
  misc_feature (2377)..(2377): n is a, c, g, or t
  misc_feature (2400)..(2401): n is a, c, g, or t
ttcgctaattcaaataattttggttataaaagaacaaattcactttcgacatttaacatcaatagaaaaattattagttttaggcattttggttaaaatcagcagtcaatgagctgagttataaggtgataaaaatttgaaactctcgtaacttttttctgagatgacaaattacttagcatttgcttagaaaaagattctccttttcaaaatccttttttagataccaaatttgttcagtttggttgggaatgaagcgaattatggcagatcaaaataaaaaatacaaaaaaggcattttccagtgtaaattttgaattaacgccaaaaatttacgccaaatgcgctatttggcgttatgagcaattttgtctgacactggcgcgtacccatagtgctagaatcaactttattgggcatgaatcccgattttctatttcatttcgtatacactgcgactcacaattttgggctcccggtacaaaaaaaagtttattttttattcataaaacagaacgccaaattgcaaatcttaaaattctttgagattttcccttctaaaaatggcagagccgagattcgagttaaaaactaatacgggaaaaggcggggatcccgtcccgttcttttccgttttcccgtttccgtaaattttttttccaaaagatcgaatcgccgaaaagctgactgaattgggcgcggccggaacggaaggaaagtgagggatggaacttttcatcttggaaaagcagttcctcaagaaattcaaaaatttatttaattactcattttaaaaacaatcgaaataattggcaaaaaaattttaaattattattatttactcatttaatgacggaattgaagcaaaatgctggttatttatttaagtttgattatttaaaagaaaagagacatggcaaatcgcaaaattagttatggaccgattggaacaatcaaatggtcaacggcgatcagttggtatttctgcacaaatttggtgaaacggttgcacagcgcagtttcttcctaaaagtgaattgaaaatggatacaaaaaaatgaaagacccacgatctttccacctcaaatgagtcaaaaatctggcgatgatggaaataggcgtgggagaagattcggtagagtcgtcggcacaccgatccaattttggcgattgacgactctttgatggtggctctgctggggaagtagcggttgctgttcagcagagaggcggccccgtccaaagtgtgccgcgtgtagtcaatggcactgcactccttcgggtttttgtgcgccgcgcacaaaacttttgacaaaataagaaatgaaaagtggaaggataataatagagtttgacattttgaaaaaagcccccgggcctagatctgaatcccatgttggacatggacaaaaatccaggtccaggaaaaatcaacgcatggcatggcccgggccttgatttttgaaatttgttttaaaaagtaacaatggttctagtcggatttatgcattactcatacttgatcaatgcatgattcttggtctgaaacgaaagcttaaagttcgataaatgcaaagaaaagaacaaatactggcattataaaagaaattacaatgagaaaacgaaattcaactttttcgagtatattcaagtataattttttgtttattgcctttagctcagaatttagttatacataagattaccaagagtttaagcattcatttgataccaagaatggaagccttagtcaagaaagaaaaaagttatggcctaagaaactgagtatggtcattcataggacgcgtaaaaccgactaaaccgcaacaataaaaagagcaaattcttaagtattttcctggaaattaagatttttcgtacataacctggaaaaacccaggcctaagccaagctcaactaactattttgagacagaaaatcaataaggaagactcacaaatccactgctcagtcgcggtcatttgtgtgcaactttcggggtgacactgctcctatttggggaaggggttgataattcacatggttaaaatccaaaaaacatctctgatgaaattgtttcgcaataagtcaaaaaacaaaacctgtaaaagtacggccaacccgctgagctccaggcaaaactggcgcaactgttcgtacttccatacgccctcgtccacgcccgcggggcagtccaagatcaagtccagcccatgcgcatctctcccaatgcattgctgaatccactgctgcacagcgaaagtgccgtccatctcgtncaatgccaattcgccccatttgttccattccgcccggggtggtgccccggacagttgcgaaaaatttggccacatgaattttgtcttncttcaaattngggtgaatgaacgcaagaaatannatcgggggagggggagaaattgcaaaaaatataatgtcaataatttaaatattaaaacagacaaatatccctctctctttcccttcttcaagtgatacggtaataatttaaagaatgaccgattaaattgcagttcatttacaaaagttgttttgcattgcaatactttatttcattatttttgtgcctttcaacttcgatcacttaatt

SEQ ID NO: 2872 - DNA, 5681 bp, Heterodera glycines
ggttggtggggcggggggtctgagtgctcgtttcgacgtttcgctggcgggcaggtgcccatggggcatggggttggtgggggcggcaacttcaaagtggtccaataggtttgggtttggcacacgcccctcccatatgctttgggttctgggcggcatcttcaaagggatgcgcccctcccataggcatgggttggtgcggggcggcaacatcaaagagctacgcccctcccataggcacgggtccctgtccggcaacatcaaagggctgcgcctctcccataggcttgggtccctgggcggcaacatcaaagggctgcgcctctcccataggcttgggtccctgggcggcaacatcaaagggctgcgcctctcccataggcacgggattgtgcggtaaacacccgctcggaacccgctcgcttttggtactttatactactgccctcgtccacgcccgcggggcagtccaagatcaagtccagcccatgcgcatctctcccaatgcattgctgaatccactgctgcacagcgaaagtgccgtccatctcgtcaaatgccaattcgccccatttgttccattccgcccgggtggtgcccggacagttgcgaaaattggccaacatgaattttgtcttctttcaaattggtgaaatgaacgcaagaaataaaatcgggggagggggagaaattggcaaaaaatataatgtcaataattttaatatttaaaaacagaacaaatatccctctctctttccctttcttccaagtgatacggtaataatttaaaagaatgaccgaattaaattgcagttcaatttacaaaagttgttttgcattgcaaatactttattttcattatttttgtgcctttcaacttcgatcacttaattacgttaattatgtacaagtgccttttattcgtacacataaaaatcattttcggccaaaaaattggctcagcagtgaagtcgccccgtccgcttctgttgcctctgctcgtttggcaccgctcctcaccagggaacgcacaatggcatcgatgttggagccggcgcccgactttggctgttctaattgggaagaggcgccgtaccccgcgaaattgggaccaaaaacggagggagacgactgatcagaatcaacggaagagccttaaaagagggcaaaaggaatggaaacatggcaaaggtggaaggaaatacccaaaaaagtgcccataagcgactcgatgattgatctcgactgaggccgtgaattgccggcacccaatgggccttaaaaacgctcactctgagaagaaaatggtcatttgtcccttttaccgcctatttggagattgatgaaaaagacctgaagttgggggatgaaagtgtaggaaacgtcctccttctgctcgcccaggaaaaaatagctgacattgttaagagtgtaactgcgcaatttgtactcgcgaaggaccaactgaggaaaaaaggatggaaaaggaaaaataaattgaaatgggacagacggaaaagggaccacctgaagcacatcgaagatgatccgcccgtccatggagacgaatttgttcacccgattgcccatttgtttcgactgcatggcggcgtccctttgtcgacacattgacccgcgaattcgactcaacagacagacggttttgtcaatctgtgacaaaaataaaataaatgaaattggcgaaaggtacgaaccaaaataggaaaatgtattcctttagtacaaaaaattaatcgtgtgttgagaattaatacctttaaatgctttgcccgatccaaaatgtatggaagatcaaagttttggatgttgtaaccggtgagcaaatcgggatcgacgcaaagcacaaacgcggcccatttctacacacatgggaccgatggaaatgaatataaaaattggagaggaaaaaaaacactcgcctcgagcaattccttctcgtcacggcactcgacaatgtcagagccgacgaccgactcacaaccgccaacgacgaaacagttgcggacaaactcctccctttggccctccaccttgaccatgttggcgatttggatgatcgggtcacgcgaagcgtccggaaaagtgcctatttcaaggggaaatttataaaaaatcgcttacttaactcattcacccaatggtcccatgcattcgatgtcaaagctcagcgtacgtaacgcggcgatgtgggaccaattgggttcatctgcggagtgcacgttcaagtcgttgacatagattgtgacctgcacaattggaaatgcaataaaatgggacccatgggttgttcccacctcaatttggcaatttgtgttccgttgtttcgggtcgatgtaagtaaatttccgagcgggacactcggcccaaccgcaaccgacgaggccaaggtcggccatgaaacgcacttcgaagtccaagttggcctcgaaggcctggcagggcctaaagtttgccgaatggcccacttcgtcggcggcaattctctccaacacgtaaagtactcgagaacctattagtatttacaactaaactttaaactcattgaaaatagggcatgcaacttacatgcggtgattatgcggggtgaaagcacaaaaatcttcaaaaacaattgctggcgaagttcggcgtgaaagccgaacaaatttgagccgtataccaactcaatgccggtgaccatcgccgacgcatccttcggaacgccactttgtgcacttatctgaggaaaagttcgaacagtcgaatgatcaccccatttcgctctaaattgaaagagtcaaaacttctgagttgttggttttatccgaatacaggatcgggatcaaaaattggtcagaaatgatgtcacccaaaaacccacggcatgcaacatttttgtcaaataaaagaaaaggctacaacatttttatggttattgtttgtcctgtcaagattgttcagccaagtggaggccgaccacttaaaaaacaaaagtaaatttctgacttcaaacgggcgagaaaaatttattcttgaaacaggcatcgaaaattgatgatttttgggttttctcattgaaattttttaaagaaagcagctttcatcaccgagggaccatggaaaaatgaaaaaaccgaactttcgttaaaaataaagaaaaactactgtcaaaagaaagggcaatttcagcgatttattaactgaatcatatcatcatatatacaggacaatcaatttttcatttttttgcactggtccgtccgatgattcatccatcgcttcttcttttgctagttcgggccgtccgcacggtgcgaagtgacctgccatcggtcgatgtcctcttgcgatcgagtcggtgaatttaccttaattcgtaacattacaaataagtaaataagtgaaaatagtacgggagcaggcgcgagttcagactggtggtggagagcgtagtgcacatcaggtggagtgacgtcggtaaacaacgtcatgtcaatttggatgctggtggagtagactgatttatcggacattgcttaaattccgttaactgaataatgaggaaaacaatggaaattttttgtttataactgtttcagtgaatatgaattgtccttctttattcattacgccaatatgtttttgtgcgctaatttaaaaatatcagttccatgcgcacgcttccgtgtcaaggagctttaagaagccataactttttttggttctagtcggttttacgcgtcccatggcattttacgcgtcccatgacattttacgcgtcccatgacattttacgcgtcccatgacattttacgcgtcccaacaacatattacgcgtcccatcacattttacgcgtcccaacaacattttacgcgtcccatcacattttacgcgtcccatcaaaatttccatccaaattggtttatttacaaattaacattaaaaaataggaatatattttcaaacaggatagttgtgacgcatttcctctaaaatattttgaaatatttttgtgtttgagtggtaacgacgaaatgcgtactggtacaaatatgtttgcaacaattcagggttagtcccatgaaggtgttttaagctttgctttagagccctccaggtcgcttcaattccctgggtgtgtatttgagggttagttggatctacgaagtgtaattgatgatttacaaaacgatggttgtactgctgctgcatgttatttatcccaccatatgctgcccacccatcgctaacgatgctcgtgccgacttcgatgttttcggcaatgataggcagaagtgttgctgctgagcgatcagcaacaggaaagaacctaacactgtttgtgccacgttcaaccataccgaagacccattcgtaagcacgatttaacatccgtcctctattatatttggccctatacatttttgtttcatctatctcgacaaccctacccacccctcccagcttctcattcgtttcaatcctccttgcccatgcttggcataaatctctaagaaaattatagaaatctataatcgtttctttgtgagacacgccagtttctctcatcactgcatccaaagtgcttgctggatgagtggcccagaagtaacacagtctcaggctttggtgtagtgacagatgcatatggttgaaaaaagaaccaaatctgggtgaaaatcggcttgaactttcgctgttttggattgcttttcgacagtgacttcatcgccacttaaaatcaattttttataatttaaattccctattttactgttaagccctccgggttctgggcatatttgacaagtgatgcccggtgctgttgacattcggcacaagtcaacgcatttgctataaggccatagcgagcaagccatttcaatgtcttttcataccctcaaaataacccaagataataaataagttttttgcgcataccggctggcccatcctctccaagatattctctcacaagcgtctcataacttaaatcacccaatgcagctaatgccccgggaggcataacatcaccatcattcggttgcagaatggtaaacctttgccgtgggacacctagtgaattattcagcccatgtccattttgttgataatcatgatgctcgactcggttgttaatccgttgcagaaggctattttgttccggtgaacacaaattaaaatacatccaacaaagtgtgactgggtgatatgcagtaatcctttttaactaaaaatttctgattgttaatcctaagttcagcagaccaaattttccaagaagaaatcgctgattattgacttgcatgttgatcgtaatgcaagaaggtaactacagtaatgaccaatctcttccttgatcaccgtaacactttcgttccgcaacagctcaacaatattcataattccatggcaaagaagacaaccaattgatccatttaggttgacatcatttggtgtgcttaggccattttgtaatcccatgtaaagtgaagggcaggcaccctcagcagttaatctgccacgactaaattcaatcaggcatgcaggttgttcagctgggcctgggcgacatgtttttgtccaggcgagatgccgatggaatgtcgagcaggtgattgcgcactcctcccatttgtgagaaaagccatcggcaggactgttagttgcttattcgcat

SEQ ID NO: 2873 - DNA, 1787 bp, Heterodera glycines
  misc_feature (1703)..(1703): n is a, c, g, or t
  misc_feature (1724)..(1724): n is a, c, g, or t
  misc_feature (1740)..(1740): n is a, c, g, or t
  misc_feature (1752)..(1752): n is a, c, g, or t
  misc_feature (1772)..(1772): n is a, c, g, or t
cgattgtgtctcagatttgttgtaaaaatttttcctgactcaaaaatttgcggcaaattacggatcaaaacaaaataaatgctcagcaattactactggttgtttttcctataaatttaaatataaattgataaggatttaggaatagtcgctccgcattcagtatccattgcattgcaggaaatgaccggacttcccttttcaatttctattgactcatcaaaccataaaaccaaactttttccattggtggtgcgttatttcaagcaacaaagttgaatttccgtcaaacttattgacttggaggcattaagtggagagacttcggccgaagtttgattcatatttttttgtttattggatcattttttattttcatacagatttatgactggataattaaaattttggaacggcataaattagacattgcgctacttgtggcattttgtggcgacaatgtgaacgcaaactttgggggcgcagaacttgctggccagcggaatatttacacaaaattgaaagcgcaccggaacaacctcattcctgtggggtgcccagcacacattttacaaaattcagcgaagaagggcgccgacaatttgcctatcaatattgaatcgatcgttttcaaattggcatcggagttccggaattcgacaaagagagtggaaagacttaaagaaattttggcgtgcccgcatgggaaattccggcagccatggcgcatttctgccggtggctcaaagtcgcagaagaagagctgaataggggaggcgaactggcaagatttgttgcaacagcgcatctccgtctggtaggttgaattgtcaatcctttggagaaaaataggcttaggttcaaatccacccggcagaagacgcgaacggcagattagcaagattgctgatgaatcttttgctaaagagaagagggaagggcccaatcatcctgcgcgagtccatccatgacaagtacgatgagtgcatgaggaccggaaacatagaagctttcatcgtggagatcaacgttgaacttaacaacttggagaagccgggttgcagttgctaacgcggtcgaattgtgtttttatttaagagtccaaaagcttacttttagcatattttttgcgtttttcataactatgttccttaaacgaaattaaatcgaaatgcacccaataagattggcttttcaagttttgaaataagtaattttttattaactcaaatactcagccaaaaaaagtgctaaaaatttatgaaacaattgcgttctttttgatgaatttgatgcaaaagaggactaatatcaattctggtcctattaacatccccttttatagatttaacacaaaatacaaactgggcaaaaaattcattccctttgctgggagggtaacaaaattgtggaatcaactcgataaagaactaataaaaacaaattctttaaatcaatttaaaataaaacttaaagttcactagggtaatatgtaagaccgggaaagctagaatgtaacaaatttctaagtgatttggtatttcgacctcatttgactttgacctcaatttattattatttattttcacatatttttgtctttttttaattcctgtgatcatccatatattttgtcacttactctacgacacatttaccggaatagtcgtcagagtaagtggttttcgcccttctgatgactnttttattttttatgaataaantaataaatattatcanaataaataattntcgcatttttttccatcatnaaaaactcattacca

SEQ ID NO: 2874 - DNA, 5534 bp, Heterodera glycines
  misc_feature (5492)..(5492): n is a, c, g, or t
gaaacatataaatttgatggaaatacaataaatgctgtggatacaattagggatttaggagtaaacattgataacaaattacaattttccgatcatattaaccaaataacaaggaatgcgtatttacatatgcgttccttgtttagaataattaaatccaaatcgtctaagatttggattacgttatataaaacttatattaggcctttattggaatacgctccagaggtttggaatccgtctcttcaaaaaaatatttaaaaaatcgaaaagtgtcaaaaatatttcaccaaaagagtattttctaaatgtagccttccgccaattccataccaaaatcgattagaatacctgcaactgccaacacttgagaaaaggcgaaagctgtttgatctgttcatggcgcataaaattgtttatggccgaacagatctgaaactattttctatttttaatccatcagcacgctttaacatccccttttttatagatttaacacaaaatacaaactgggcaaaaaattcattccctttgctgggagggtaacaaaattgtggaatcaactcgataaagaactaataaaaacaaattctttaaatcaatttaaaataaaacttaaagttcactagggtaatatgtaagaccgggaaagctagaatgtaacaaatttctaagtgatttggtatttcgacctcatttgactttgacctcaatttattattatttattttcacatatttttgtctttttttaattcctgtgatcatccatatattttgtcacttactctacgacacatttaccggaatagtcgtcagagtaagtggttttcgcccttctgatgacttttttattttttatgaataaataaataaatattatcaaaataaaataattttcgcatttttttctcatcataaaaaactcattaccaattcattcattttctgttcgtcaattggcaccaaccgccaccaccgaccatcaccaaaaatgaatcatccactggggggcttttatcgttaaaagcgatcggtttacccccggctaatttgtgaatggaattttctgttttgctgggcttttctccccccccccccccgggggggggggcggggaattggacaattttacgtgacgtgtcccatcccatccctgtgggctgtgtgcggtacggcggtgcgctgcccgcccattggccgcgccgcttctgtccgcagggaccgcccatttttggcacggcccaccagcgcatttaagcgctgctgggccagcgaaaacagtcactttcaaaaattttttccagctcacaattaaataaaattcaattaaaatagtgatagggaataggaaaagacaaaaagaaaaaacattttttaatgggacagcgattagaaaaagttaaatgattttttttttggaaattatttcaattttggactgaaaaatttttatgaaatttcatttttggttaattcctttcatttaatattattttttgttttaggaatcatttatttttgctcaatttctaatcccgacaaaatcaccaaagcactcatctcaatttaacatgaacaagtggattgcccttgggtaagtgttaattgggggaacaaattcataattaaatgaggcaatttaaatcccaaataaattttgatcagtgatcacaaaaatgatttcaaatgttttcaattggtccaataaaccaaaataaactaattaattaaacgtttttaaacgggaaaccctgatataatttgactatctgctctcattttagtgtgttgatcgccataatcagcgcgctggacagcgctgttctgcgacaacggcgcattgttaaggcgggaaatgcaccgaaatcggagcaaaaggaaaagccgggtaaatggaataaaataaaataaattaataaattaacaatttttttcattttccaattttaatttaaggagaagccaacttgcgcaagaaacggcaaagtggaggacagggagatgaagcggaaaaaatgccgtacaaattcgacctgacttgccgattttattcttccaacccctttagaatggaaaatgacgaagtgccgccgagggacacatttgcaagcgaagctgaatatgaggaggcgcggaggctggccgtgttgcgcgttcgggcggatgaagaaaaggcacgcatcaagaagccaagcgaggagtcaagcttgtttcaaaatgatgtgaaatattttcattgtctcgacgatgaaacttattacacaaaggaactcgatccacaggttttaaatgcaaaggaataaattaagactccaaaaattatttttttaagaaaattatggcccttcatcacgcaatattggtcattaaaaaggaccgggcttccgcagcaggcgtttaccgaatgaccgatgtattcgttggagacgacccgattggcgtgcccgcatgggaaattccggcagccatggcgcatttctgccggtggctcaaagtcgcagaagaagagctgaataggggaggcgaactggcaagatttgttgcaacagcgcatctccgtctggtaggttgaattgtcaatcctttggagaaaaataggcttaggttcaaatccacccggcagaagacgcgaacggcagattagcaagattgctgatgaatcttttgctaaagagaagagggaagggcccaatcatcctgcgcgagtccatccatgacaagtacgatgagtgcatgaggaccggaaacatagaagctttcatcgtggagatcaacgttgaacttaacaacttggagaagccgggttgcagttgctaacgcggtcgaattgtgtttttatttaagagtccaaaagcttacttttagcatattttttgcgtttttcataactatgttccttaaacgaaattaaatcgaaatgcacccaataagattggcttttcaagttttgaaataagtaattttttattaactcaaatactcagccaaaaaaagtgctaaaaatttatgaaacaatttcgttctttttgatgaatttgatgcaaaagaggactaatattaattctggtcctattttttcacagcagttaaatttaagttttttcctattttggtggttttcggtgcttaaaaaaatcaacattatattagtagattccgattttttaataattaaaaaaaaattttccagtgatggtgggtgtgcttctgcaattcttgctcacaaaggaaggtccccaggtgtccgtgggatttccaaatgaaatttggtgggtggatagagcacccatgggttcttaagaaaagtgtttttattttctgcgaaatgagtctgagtgccgagttatgacgtgccaaacttttttttattgcaataaattaaataaacatttgcactgttttgtgttgttcggtggtgcggaggttgtgctcctgccttccctttttgccctcgcaggttcgaatccctcatatgttaatttattttccccgttttatttttgattttatgcaaattaatggccattgaaatcaattccatcgggtcaaaaatttttattcctcctccaagtcattcctaaatatgtccgtaaatccccaaaatattattgtccttttaaaaaaatatttttccaaatataatgatgaaactccaataaattctgtcgaaatcaatatttcgaaaaattttgccgcaactattgaaaaatgcattaaatttgatgaagaaatgcttttatcggaggatttggtgattgatgaggaagcaaattttgatgaattagatgacgaaagtgatgaattcgattatgattccgcagaagaatttgatggaaatcaaagtcccaacggttcaggtccattcgtgtattgtagatttgttttctgacttaatacataggtggatggcgtttacaattttaatcatgaacattactgaaaatttttcaaaaaaaaaatttttttttttgtttttttggacggtattaaaagaatttttttttttgtctccggtcggaaacccttttttttttgtcaggtgtgaatttatgaattaatttccttccaaaaaaaaacctttcgtcgtcgctcaatttgttccgggtcctcttccgccggcgtgggctcatcctcctcctcgtctttgtcaaagtccgaatccacctcgtcctctggcgcctcctcgtccgacgagtgtggtggagactcgaaatcctcatcatgctccaactataacggtgtttgtatattattcaattaaggatatcggtggtatttcataaaaatgggtgacagatccataccaacacccctgaaaaccccctgtatcaaacccatatttaggggtgcacatcattcccaacccccccccccccccgaaaaaatttttttcgggggggatgacgacgtgggggaaacgaatatgggtaatagtaccgatggtatcacaccttttttgaaatttttttaaaaaatttcaaaagtcataaaaatatttattataaggttttcggggtcgctgagcacgaatatggcatccatttcacccaattccgaacccctgatccgaattcgaacaaaaatcgaaaactcaaatttttcgaaattcgcatttatgtcttgcccatacccaaaatgttgaatccatgtggaaaaaattgaagaggaatttcaaacagcaatttgggaacaagactgaaacttacgacacctacttcccagaatttatttggcgtcagcgtttcggtgatcgtgaaaatgttttttataatttttggctgcatgtctctgagttttatccatgcgaacattgaatttttttttgtttttttttcttttttcgtgcgtttggagcgattttgttggataaatgtgaatttcgaaaaatttgagttttcgatttttgttcgaattcggatcaggggttcggaattgggtgaaatggatgccatattcgtgctcagcgaccccgaaaaccttataataaatatttttgacttttgaaattttttaaaaaaatttcaaaaaaggtgtgataccatcggtactattaccaattaaactttagattttttgttcgaattcgggtcctggtttcgaaatagttcgaaatgaatgccacattcgtgatcagcgaccccgaaaatcccagaaaaataaaaatatttttttatgtggcgtaaagtgaaaaagtaccctttttcttacatattttcattttttttaaatattttgaggatttttttctacatatttatgtacatatttgaccaatttttgtacatatttttgacatccctagtcatgttcaaagaataaaaaattggtttgaaaaaaagacacaaattaggtaagtttcaaaaaagcataaatttctcaatttcaacaacaacaaaatcataacttataagtctgtaacaaaaacaagaaaatattataaaatcaaaaacaacaacaaaaaaaatatttaatccaaatgaattgtcgtcnaatcagccgttcgcggtgtgtttcaaccattggcgaactgcc

SEQ ID NO: 2875 - DNA, 1298 bp, Heterodera glycines
tgtatttttcgtttttattacttttttcttaaggatattttccaaaaaatgtcaagatagtgaaaaaatagtgacaaaactccaaaatagtgatttttaactattttagtgacgaagatgccaaaatagtgatttctagtgaccgatagttacatcagaatcgaaaaattttaatacagaaatgcgttttttgagctcctttcttcaaaacaattgagcaaaaaaaagttttttcactaaaagttgcttccctaatgattacagaattgtggggttgactgtggccattttggcgctggtcgtcctcctcctcatccttttggcgagttattaatttaatatactgatccctaatgaatttgaatagtatttgttcgcgaaattgcgcagttttgtccgcctctaatttaaatcggtagctgagccaatgtaaataaatttataatagcggaaaaacaaaatggattaaactaatattaggcgaaggagtttctaaaacatttatcttatgtttaaaggattgtattttgggtatagtactaggaataaaaacattgaaatctactatgtatcagtagagtcaggccttttcagcttttcatggacgctaatatacatttaaaaactccacaattgtatgggaatctgctagatgtattgcttttttgagccgtaaatataattaaataaaaattgagtgaattttttaaatgtctcacaatgatcaaaaagcaatttttcgaaaaatattattgttaaatcttcatacatttgttgcatgcatacttttttaatggcaagaatgaaggcccttaattaaacattcataatttaaatcggtagctgagccaatgtaaataaatttataatagcggaaaaacaaaatggattaaactaatattaggcgaaggagtttctaaaacatttatcttatgtttaaaggattgtattttgggtatagtactaggaataaaaacattgaaatctaccatgtatcagtagagtcaggccttttcagcttttcatggacgctaatatacatttaaaaactccacaattgtatgggaatctgctagatgtattgcttttttgagccgtaaatataattaaataaaaattgagtgaattttttaaatgtctcacaatgatcaaaaagcaatttttcgaaaaatattattgttaaatcttcatacatttgttgcgtgcgatacttttttaatggcaagaatgaaggcccttaattaaacattcataatttaaatcggtaggtgagcccaatgtaaataaatttataatag

SEQ ID NO: 2876 - DNA, 5435 bp, Heterodera glycines
ctttctctatccatcccacgcaatttcgctgtgtgatactttttccatcccataattgtgtactgtataattgatgttcttgtatgtacaaccattgaggtttgtattaactttgcgagtgatatgataaacaaattgagacggagaattggttggtgatttttttgagtgaagggggtgtgggaattttagtagaacaaaaattttatcacacaaaaaattaattaatttgggcgagatacactggcccaatcgaaaattttcaaagattattgtacattgtttctgttttacagttacctaagacaaaaatggatgggagaggacaaatggggtgaaaaaagcactcccacaaatcaaacccccccattagttttggttcgactttttattcgagtccggggttcggattggacaaaatagaagtgagaattatttcagacttcgaaatcacaaaaaatatattttctgattttaagtgttgagttaatcatttttgaaaaatcagattttcccaggaaaaaattttggtgcattttaggaacagtacgattcaataccaatacaataatgaaagttgtttatattattgtagtttgaaatatacaagtgaatgaaatgacaacagcgagatgaatacatgacaatacatacaaatacagatcacaaatacgatcacgaatacacagaagatcagcttcgcgtcattctctcgtccatctcccgcaggaatgtcgtcagtgcgcgttcgtcaatgttgagcttcgccgccttgttttgagcatagctaagcgggggagggggatgattatttagacacacaaactcaaacaaaaaacccaccgcaaaatcacgtagtatatgtagaggtattggtccagggtctgcacactttgggcccgatgctgacggaggttgcgcgccaacgtgaggatgttgagccgatgtccacgctgcagagtattgtaggcaatgtgcagcgccaccagtgttccagtccgtccgattcctgaaaatgggaaattttttgcatttttattttccaacttggcacaaactctcccgctgaacagtggatcaccgagcgccgaaactgctgcacttggaacagcaaacgaagaggcgccaagtcgttctggggcacaccgcggtcggcccaccggcgccagtggaagtgatggacgcgcatggagccgttgggaaagagcaccgccagctttgtcctgtagaggtccggctccagcgcagtctcttcgatgaagtgcacggtgatcgtcttgttggcgaagtgcaattgctgcaaggggaaaagaggggggagggaatgattagaaaattaagggcaaaaaatggaaaaacccacctttttgtccggtgtcggccagtactggtggcacttggtcttgttttgttcgacggtgtcgcagagcatcacaatgctttcgatgttctcctgcacgatcattgtccagaagtcggcgcaggtcgtctcgagcgggccttgtgtgcagatgaagcgctgttcgccaagggccgtgatccagttggcgtggatgtatcgtccgttgtcgagtcgcacgcggccctgctcggcgcagatgacgtcccggtagcggttgcagtccatgtggctgtaaagaaattacctattttatttgtgtttgaaaatcgaaacagccaaactgaccgtgtgaattccggcgaagtctccggccgtggcatggcgttcagctccgtgtattcgttgaccagctccttcacgttgcgtcgcgttgtctcgttgacgaagattttcagggctgagcagaagtcgcgcgtgtcctcccagcctcggactgttggttgctccggcggctctcgtggaccttgatatgcagactgaacgccgcgctgggtgtgctgctgctgacgtgaacgtgaggggcggcccggtccgtcctgtcggcgtttcccactgcggccacttctcccggacatcgtgatgactgctgtaagaaaaacggagattaaaaaattatgaatggagtgaaaacacctcaaattgaggttgacggcgacgacgatatagagagaattataatagttaattaattagggcaaggcaatgaaagtttttgcaaaattcaacgccttttatagaggtgaattcacttaaagaaattcattccaaaaaaggcaatataaaagcaacaaatctccgcaaagtcctcactaatttcaaccttctgcctatttggttgagttcatcactttcaccactgttctccaatacctattctatttcaacgtcaacacccaccgcatcttcgcccgctgcttctgtgcgacgacgacccaattttgtgaggcgccccccccaccctttcaaattttctgtttttcatttttaattgttttttttcagattgtgccagacgacaacagcagcacatcaccgcacttcagcagaggaggaggcagctcatcatcatcaacaacaacaccaaacaatgagcgacaagaagaaggaggagccgaagaaggaggagccgaagaaggaggagccgaagaaggaggaggagaagaaagaagagccgaagaaagaggagaagaaggacgagaagggcggcaaggacaaggaggagaagcggcgcagcaagaagagcgggaaatcatcgaagaagaaggacaagaagaagaaggacgggaagaaaagccgaaaggatcgcaaaaaggaggagaagccgagcacgggagacgccgctgtcgcgacgacgcctgccgctgccgcgacgacgcctgccactgccgaagcggcgccgaccaaggagcaaccgccagcagccgtcgtggaagccgcaacgccaccagccgcagccgagccagcagctgacgcagccaaggaggagccgaagagcgcggagacgacgaccgaccaaccgcccggcgacgctcctgctgctgatggtgccgcggagcccaaagaagaacagccgagcgcggagacgaagactgaccaaccgcccgtcgacgctcctgctgctgatggtgccgcggagcccaaagaagaacaaccgagcgcggagacgactacggacccaccgaccggagacgctgctgctgctgatggcgccgcggagcccaaagaagaacagccggagacggacaaacccgctgcggacgagtgatcgatgatggtattggactgaccgcgccttcggcctcaattcgctccctcttttccccttccttcacttgtggccatgcccaatttcattgttgtacaaatgtgtccccctttctctatccatcccacgcaatttcgctgtgtgataattattccatcccataattgtgtactgtataattgatgttcttgtatgtacaaccattgaggtttgtattaactttgcgagtgatatgataaacaaattgagacggagaattggttggtgatttttttgagtgaaggggtgtgggaatttttgtagaacaaaaattttatcacaaaaaattaattaatttgggcgagatacactggcccaatcgaaaattttcaaagattattgtacattgtttctgttttacagttacctaagacaaaaatggatgggagaggacaaatggggtgaaaaagcactcccacaaatcaaacccccccattagttttggttcgactttttattcgagtccggggttcggattggacaaaatagaagtgagaattgtttcagacttcgaaatcacaaaaaatatattttctgattttaaatgttgagttaatcatttttgaaaaatcagattttcccaggaaaaaattttggtgcattttaggaacagtacgattcaataccaatacaataatgaagttgtttatattagtttgaaatatacaagtgaatgaaatgacaacagcgagatgaatacatgacaatacatacaaatacagatcacaaatacgatcacgaatacacagaagatcagcttcgcgtcattctctcgtccatctcccgcaggaatgtcgtcagtgcgcgttcgtcaatgttgagcttcgccgccttgttttgagcatagctaaacgggggaggggatgattatttagacacacaaactcaaacaaaaaacccaccgcaaaatcacgtagtatatgtagaggtattggtccagggtctgcacactttgggcccgatgctgacggaggttgcgcgccaacgcgaggatgttgagccgatgtccacgctgcagagtatcgtaggcaatgtgcagcgccaccagtgttccagtccgtccgattcctgaaaatgggaaatttttgcatttttattttccaacttggcacaaactcacccgctgaacagtggaccaccgagcgccgaaactgctgcacgtggaacagcaaacgaagaggcgccaagtcgttctggggcacaccgcggtcgggccaccggcgccagtggaagtgatggacgcgcatggagccgttgggaaagagcaccgccagctttgtcctgtagaggtccggctccagcgcagtctcttcgatgaagtgcacggtgatcgtcttgttggcgaagtgcaattgctgcaaggggaaaagaggggggagggaatgattagaaaattaagggcaaaaaatggaaaaacccacctttttgtccggtgtcggccagtactggtggcacttggtcttgttttgttcgatggtgtcgcagagcatcacaatgctttcgatgttctcctgcacgatcattgtccagaagtcgtcgcaggtcgtctcgagcggtccttgagtgcagatgaagcggttctcgccgaacgttgtgatccagttggcgtggatgtatcgtccggtgtggagtcgcacacgattgatttccgtgcagatcacatccctgtagcggttgcactccacgttcctgaaaaattgaaactgggaagattagacatgtatacaaaatgaaaacgacgccaaaacccaccgtgtaaactcaggcgatggcaccggctgcggcgctgcgttgagttcggtgaattcgctgaccaggtcctgcacggtgcgcggcgatgtgatccgcgtttgctgtgtgcgttgtggttgaaatgcgctgcagagcgttgaattctggaaaacggaaaaaaaatttaatgatgtgtatggaagggacgaaaagcgagaaaatgacgaatatgacgaaggcgaacctcggcaattacgcgcgcgagttgatctagtcgagatgataggagaaaatataaaattattaacccctcccgcccttttatattcaaatttgactctcgaaatggctaatgaagctatattttaaaattttaaagctgaaaaatgtactatttaacagtgaatttcgtctttttttttcatttttaaaattttgcttacgccaagaaatcgatatttttaaccaaactccccttatcgcaccaacaaatacaaa

SEQ ID NO: 2877 - DNA, 969 bp, Heterodera glycines
ccaactcatccatgcccaactcatccatagacccaactcatccatagatccaactcatccatacccaactcatccatagacccaactcatccatacccaactcatccatacccaactcatccatacccaactcatccatagacccaactcatccatgcccaactcatccatagacccaactcatccatagacccaactcatccatacccaactcatccatagacccaactcatccatagatccaactcatccatacccaactcatccatagacccaactcatccatacccaactcatccatagacccaactcatccatacccaactcatccatacccaactcatccatgcccaactcatccatagacccaactcatccatacccaactcatccatgcccaactcatccatagacccaactcatccatacccaactcatccatgcccaactcatccatagacccaactcatccatacccaactcatccatagatccaactcatccatacccaactcatccatagacccaactcatccatacccaactcatccatagacccaactcatccatgcccaactcatccatagacccaactcatccatacccaactcatccatgcccaactcatccatagacccaactcatccatacccaactcatccatgcccaactcatccatagacccaactcatccatacccaactcatccatagatccaactcatccatacccaactcatccatagacccaactcatccatagacccaactcatccatacccaactcatccatacccaactcatccatagatccaactcatccatacccaactcatccatagacccaactcatccatgcccaactcatccatagacccaactcatccatacccaactcatccatacccaactcatccatagatccaactcatccatacacaactcatccatagatccaactcatccatgt

SEQ ID NO: 2878 - DNA, 5983 bp, Heterodera glycines
  misc_feature (5856)..(5856): n is a, c, g, or t
  misc_feature (5896)..(5896): n is a, c, g, or t
atttttgagatatttcgcgaggagggagacgaagatgacgaacagccgaagaagacgacaaaaaccaaattgaagcttcggaaggagctgatcaaaacaatgtccattgaagaaggatttgcacaaagaatttccaatgacgaagcaaattaaattttgcggaaaatgggaaatccgaaataaattcaatcaaaatgacaatgattttcatatgtaaatattttttgaattttagcattgattgcatattttagaatctccttttttgtatttgaggaaggcccatcagttttgctttatttttttataactaaaggtgaataaaatatcgaaaattttgtaagaaccaagcaaaagaaattgagtttatcctttaggacaaaagaaggaatgaacgaacgacaaaattcgaattagacaatgagatatattagaaggaggattacaatgtaacgggacatatcttaaatttagtaaaaaataggggagtgggagcggaattacactccgaaaatggcaattcttgcgcttgagaattcctccatttcacctgccctgtcctttcattattagggcatccaaaaatatggatataaaatcgcgaaatatggccataaaatatggaccaaaaatcgcaaaatatggacataaaatggcaaaattttcaaaatatggacataaatttttcaaaattgagtttaaaatttcttcaaatttactagttgaccttgcatttatgttttcaaaattccttcaaattcgctaaattaaagtaaaactttcaaaaatggctaaatatggtattaaaaatcattttagaagcaaaaaggtaatactgccgatcaatttcgaatccctgacccgaactcgaacaaaaagtcgaaacttcaattttagaatttcgtgtttttcgcctacaaatggtttaaatagtcttttattgcagtattttccgtatttaaaccattttaggcaaaaaatgtgaaattcgaaaatttgaggtttcgattttttgtttgaattcttgtctgggaatcggaaaaggtcgaaatggatgtcatattcgtgatcagcgaccccgaaaaccttagaataaatgttttacgactgtataaaatttgaaaaaaaaatttcaaaaaggtgtggtaccatcggcagtattaccgaaaaaatatgataaatctaaaacttactcatttttagcagaaaatcaactagaaagcgaaactttactttttttttaccttatttttgacctaaatttaagatttttaaggaaattaaaatttattcatattttcgaaattttattaaaaaatgattttttcggaaattttccggtttttcggtgtcaaaaagccaatttaacggttggaggccgttctaatagagggtttttggaaaaatgccaaaatatggaaatattgacataaatcgcgaaatatggaaaaatatggatatagaaatccgtcctagaagcttcaaaccaagccaaaaacatgtttttcgtacgtttcaggccccccacagtccaggaaaaaatatggatttccatataattggacgccctattcattatttacttaacacaccgagtcaaaaaacgagacatgtgtcaataaagagagagtgctagagaaaaacattatctttttttctctaattttttgtcttcttttggcgtactatctaatatttttgttattaggaaaaacaacattcacttcgaacagcataacttttttttccccaggcagaatttcttttaattttgcatatcgatagagaaaaatataatacattcagtaatacagccattttttggcttatacattatttcatgagttataaggaaaacaatttttcgaaggcccatatcttttttctaattcatcaaatcgcttagcttttgcttagaaaaagcttctccccatcaagagctttcgaatgataccaagatttaccaatttggttggcaaaaagcttcaaaaataattcccaaaaatcgttgttttttaattttttggacaaaaataaataaaaatattcatgttgcacaacggactcgaacctccgccctttgttcctttactatcttacaaaaaccactttgccacacacacatttactctttgaactgggagcccaaaattgactcggtgtgttaaggtatgtaagaataaatggcaaacaaaaccccgccttttcaatgcacacgttttacagaacaaaatggaaatgtacaaaagaatggttaaaaaggcactttggttgagtttaaagtaatacaggcaaaataaatagaatactatattaacactttcatcggcacgtgcccatcggaattaaatttcaggaataaacccatcaaatcaccgaaacaaattcaaaaatctatagcccattcgttttcctgaacaaaatggtcaacaacctccttcatggaaaaatttgggattagttggtcggcagtgagacttaaataaattggttcttaggacaagtaattaaatgattgcgaaacttacggaacccgggtgacggggtcgaaatgtccgactcggtgcaaatgggtgagaatgtcctgtcggtcgtaagtgatcccggaaggagtgattacagggtctttgagcagctcgaaactgattttgccacacaaatagtccgggaggtcgcgcttccgtctacgatcgtcaacctaaaattagcgtcacaaacggttttggagtcataaaaaatgtttcctagggttttgattgtcgctgaatatgaaaactgacatccactttgatcaattcgtacccaggacccgaattcaaacaaaagttgaaaatacaagttttttgaaattagtatttgttcgaacttttcgaatacggaaacaaagaaaaccagcaaccctacaataaaagatcaattaaaccatttttaaacgaaaaattcgaaattcgggaattgaatttttgttcgaattcgggtcctgggtatggaatcagtcgaaatggatgtcagattcgctttgactcgaaaagagaggagggacaccaccgaaattattaccaaaatttggggaggcatcaatggacgaaagacaatttttttgtgcttaaaatgtaattttcatggaaaatgcttcgggagaaaaacctattttaacaggtttcttgtaaaaattttaaatagttataggaattagtcgtccgcggtgccgccgccgacagtgacgtcgggtgaagtgaactttttcaaatttgaatgaaacctgctaaaattggtgtattgtaaaatttaaaaaatgcatttattttgcaaaataccggcaagaataacctttctttttacccaaccccaaataaaaggtaccgattttcaattctccctttttttacctgagcaaagagattgttcagctgttttttgaaggtgtccccttgtgtcttcagttcttccgccttttcttcaacgtcattttcctttttgtcctccaattggttcacttttttggcgatgtcgtcgtcaattaattggtttaagtaactttgaagttcaatctcctgagttatgcgtttgtcttcttcttgacggaacctaaaaacaaagttcaaatgaattactttaaaataatgaaaaaactcaattttctctgcgcgctaaccgtaacaattgggttatttcgtcgccatatgtttgcttaagattgagaacgccttcatgagcccgcgacaacactttgatagcctaaaaatgaatggaacgtaagcattgaatttccatacaatttgactatttataaaattatgtaacaatttgttcccaattttcacacctcatcaaactgtccctggtgtacgtacaccttccccaggtagtaattcgccttcacattctttctgtccatgtaaagcgcttttctgcagtcgtccgctgcggagtcccattttttaagatttaaattgcaaagtgctctatttgtaaagtaagtcggatcattcgggttctttataatagcgcgggtgtagtgagaaagggcctccttaacaaacaaacaaaaacaattcgcttttattttccaaaaaataactatttacctaacccgtatttatttaagagctgggaatacctcatattttcctgcttggtaataacgatttcctcgttctttgtgttcggaagcagataattgcggtactgaagacatacagatttaaaaaataaattgccgagatcaaaattcatcaataaattattgcaattgttgagaatattgtttcgtatttttttaggtaattatttttaggggtaatctgagtcgcttattgtgagctctagggatttattttcaagctctaaaaacccctcaaaaacactaaaaatggaaaataggttttagaaaatgacaataagctattcaaaacaaaaaaaatttagcccaaattagtattgagataaataattttaaatcaaaaattcttatcgaaacaataaaaaattggagatgaattgttatgttcaatggtgaacacaacgaagaataaaaatagtttatttgtcggaggcaaaagaataaataataaaattggtgtgtcggtggatgaagaataaatgaataataaaatgatgtgttgaatgagtggaagaagaagcaattgagtgacaaagtgatgggtatttatggacgatgctgagagatgagtattgacacgaaattgagtacagtaaatggcgtacatttgaatattgagtgatatacacaacacctccccctttaagttggaatgtaatgagaaaaaaaaaatgggttggtgagtgaatcaatcaatttgtgtaatcatatcgtgcttttgatgtgtccatgttgagcagttttggtggacggcggttgcgattcgaccgtctgacttcgttctgattgtgctcggctgggaccggttgctcttcaggttgttcgtccgcgaaacgcacgcgacgttgacgctgaggactgttcggttctgtcgcgggttcttggtgaacaatttgaagatgttgctgctgatgatgtgaatcttgagactgttggggaattgggaaaaagtgacgcatttgattggtatgtctacgcacaacggcgtttaagattggaacatgaactttccaaaccacacctgcgccttcaacaactttaccctgcaaccacatgcttttgttgtaccgatagttgagtatcagcacgttgtctccaatcgcgaaagttcgacggtgaacgtcgttttggcgattgcactgctttggcatgttgttgttgtgtttggtgttgtttgctgggtgtgaaaagctgttgagagtggtggcaatgggacgttgaagtgccgcttcgaacgccttgatccatggaagaccaaacaaattcattgccccttttggtgcgacatgacattctaattgaagtgtgactccttgataagtgactgagcaaatgaaatacccggagatttcgaaaaagtgccccgaatatgatttggcttttgaaatgccctttttgagtttggggctgcctaactgttcccataatgcttgctgaataacggccaaacgtgatccagaatcggccatcagtgatgctttgttgccattgagttgacaatcgaccatgatccaatccgaaatgtcgtcttcgatgttgaaaatggacattgttgcatggttgcggtgtgaattggacttggatgatggcgctggcaggcggcattttgattgatggtggccacgacgattgcagtttgagcagatcggtgcctttggacagtcgctgatccagtgcatttggttgcagtaacggcatggcgacggaggctgctgcggtttgcgctgaaatgngatgatcgttgattgttgctggtggtggtcgtcgtcttgnacgagctttgcgacaccctccgcttttgttgttgatgatcccttaattttttggggttttagagtgattgaatttggcacatgagtt

SEQ ID NO: 2879 - DNA, 5263 bp, Heterodera glycines
cttaatttgggaacacagaaatttgcatttgttcaaatgaacacgcaggccccagtcttggagacgggaaaagaatttattaagaagcgaatggtgttcctccagtgttggtgtggccacaatgaagtcgtccaagtagcaaaaaactccgctgagtccggcggtgagctcatccataagcttttaaaaaatgctgggagcacttttgacaccaaatggcaagcgttggtactgaaaaaggccccggtgtgtgtttattcccactaactctttcgactcctcgtccaacgcaatttgcaaataggcgtctcggaagtcgatttggctgaatactgttgagtcttccaacgcagcgaaaatgtcatcgatgcgcgggagtgggtggcgattcagttccaaacaatcgttgaggccagttgcaaagtcaatgcacacacgcacatcgccgttcttctttcgaactgcaacgatcggcgctgcccacttgctgtaatcgacttgtttgatggcaccgcaagcgacgagccgatcaagttcggcgtcaactgctgatttggccgcatgtgggaccggtcgaggacggcagaagacgggttgcactccggacttgaggtggaggtgcgcacacattttgttgcaaaggcctaagcttggggagaaaactttggaaaagaaatacccagagatttcgaaaaagtgccccgaatatgatttggcttttgaaattccctttttagtttggggctgcctaactgttcccataatgattgctgaatgacggccaaacgtgatccagagttggccatcagtgatgctttgctgccattgagttgacaatccaccatgatccaatccgaaatgtcgtctccgatgttgaagacagacattgtggcatggttgcggtgtgaattggacttggatgagggcgatggcagacggcattttgaatgatggtggccacgacgattgcagtttgagcagatcggtgcctttggacagtcgctgacccagtgcatttgattgcagaaacggcatggcgacggtggttgttgcggtttgcgctgaaattgggatgatcgttcattgttgctgatggtggtcgtcgcctttgacgagctttgcgacaaattccgctttcgcggttgttgatcccttaattttggggttttattgtgattgaattggccacatgagttgaatgtgccaatgagttggaagtgttgcgaagagagagaaacgcgcggcactcttctgtgagcttctcgaatgagattgcttccggcggtgtcttctttttcgcttcctccaaaagtcgcaaacaacgctcacggagttctcgatcagtgtccgaaagtcccgtgaggaagatcagtgctttgatttcgtctttggtcagatccatttgtgatcgctcgcacattgcgttgacctggcttgcgaaatctaatggggattgtgaaattgattttgtgagctgaaaacattcaaatcgacgggtgaaaatggattttgtttcaccaaacatagccttgagcttgttgatcgtctgcgccagtgtgaaatcagtgggcttgcttggaagcacactttcggcatagcggttgtactcctccgatccgagcttgccgagcaggagccgaacttgcatctgatcggggaggtccttcccgtcaacttggatgaaaggcccataacggtcgagccaattttgaaatgttgaatccatttctggattgtatgaaaattcaccaagttgggaattaatggtggaataaattgtcgattgattgggaacattggaatttggttgggtattttgaagcaaattttgaaatgcttgagtttgttggtcgactaattgctttaggatttgagcaaagtcaacggccatttttgtcagaaattgaattcaattggagcaatgatttgatgagtagtgaatttgaatggtggtaagagattgaaatgactttgcttggtgtcggccagcaagtgctgcagtggtggtcaggcacagaaaaatgagtgggaaatcaataaacgacctttggtgatgggaagatgcacaaatgcgctgagtgtagcggtcgcaatgacttacactttcacaaatgtgtctttccttaaaacagtgcactcagaggctttttacggcgtaagtgttgcaaaaaggcttctcggcttgcttggcgttcagcgggctatgattttgccttgacgtttcaagccgatgtgttacggggtgggcaaaggtcgaaattgatggaaaatgagtgaaataggtgaagtgccgaccgatgcgagctgctgacaaccaacttcgcaaaaaccaaaatgaatgatgagagaataaaataaataaagaatttgagatgctccaatcgaattgttgacaatttagccaaagttgatttgcgccaaatgctaggcgcaaaaagatgatgaaacaaaaataaatcacttcgctgactgcgccaaaaatgttatgttcaatggtgaacacaacgaagaataaaaatagtttatttgtcggaggcaaaagaataaataataaaattggtgtgtcggtggatgaagaataaatgaataataaaatgatgtgttgaatgagtggaagaagaaacaaatgagtgacaaagtgatgggtatttatggacgatgctgagagatgagtattgacacgaaattgagtacagtaaatggcgtacatttgaatattgagtgatatacacaacattaatcattgatataaatacaattttttattaaacagatggaaaaattttttaatcagaaacgataaattaaataaaagcagaaaaaagatcaaaccaagatgcaagtgccgagggcagaaagaaatatgccacaccacgaaacacgattttaaagtccacaaatttttataaacaaatgaaaatcataaataattttaaaaaatcataaccatattttaaatttaacagaataattaaatataaatttagcgttttaaattgaataaatacaaattctaatattttaagagcaaaatattttcttagtatgtttatttatataattaacaaattagaaacccttcccttagtccttcattcattctgtttttttccttcctatttgtgcttccccaatttgctccgtccctccgacaaatatttgttaatttattttccatttgtgtttaataaatttatttggtgttcgacattccacaaaactaatgaaaatatatcgaattaaaaatgaagataaatttaaattaagcatcaaagcttattgaaagtcaataaatttttaaattttacgcctccaacactaaaatttggaaaaaattaatttgagtgcaaaatttgttaacagattttcaccaaaaatgtccttttttacgataaaataaattttaaaattaaattaacatttttaggtttagcataaggtaattaacgaaaacccccctaaataaaattttattaaaaaattattattatcccagcagccaaaatacacatttaaaacaacaaaaattaatttaaaaatttttttttgttttacaacaaaaactttttctaatggttatttggcagttgtgggaaaagtattttaaatttttaatatcgattcttacccaaatgcattgggcaatatcaaagtaagaaaaaaaattaaatatgttaatcatgaaaaaattattatgtttaaaatcatcaaatcaaaaagaaagaaattatgtttgcattttatcacagaattataatggatttcaatgcttaatagctttattatgcatatttaacgatgtcaattttcaacaaatttaaccaattctaaaagtttgacaaagttaaaaaaaatacctttttttacaaagaagaattaaataaaataatgtaatgaaataagttaaaaaatcctaattataaaatctttgggaagaatatatttttgaaactattaatcaccacattttcgcttcttttgattgagtagaaatcatttaaatatttaaaaaaattaagatatattatactatttgccatttcataaattaaataaaataaaatgataaaatacatagtatctaaatatttataacaaattaaaattaaaaaagaataaagtttttgaaattctagcatttaagaaaaattaaataaccttaacataatggatgtgtatacagaatctttaaaaaataattttataattaatttaagtttatggattataaattaaattttgcctcaagagtataattaaaaatgcttaaaatacttgaaaatttttcgtatttataaagtaaaacaaaaattcaaaaataatagcaaaatgatcaaaatcaaaacttttttttttaatttataagcttataaatttacaaataattgctctttttcagaaatgagctttaatttctcattaaacaagagttttaaagaataatctacacatcttataacaaaaaattaatttaagtaaaaataaaaaacaaaaataatataatttatttggaaaactgcataaatttaagaagaaaagtttatttagaaaaataaagaaaatttaattataaaacactatacttctattctattataaaaattatttttaccaaaaacatgtagaaataatttatttatttttcatcaaataaatttttaaaaatagaaaacatatggattttaattattccatttaaaatttaaaaaatgccaaattgaatcactttatcataatatataaatgtatcatataaataattgcctaaaaatttttcactttttctaatttttggcactaattagaaatttttaggaaaattaaaatcgtgaagcattaagttatcaattcataaataaattttagatgcaaagaattttttttaatttaatttttaaatacatttgtttttgacatttaaaatcaaacaatatctgaaataatagcccttttcgaaataaaaatcttcaaaaatttataatgttgattattttatttaaaaaatgctctaaatgtcatcataatatttgtcactatgtgatattttttatttatgctaatagccaattatgaagaatagttatttaaattctattttgaaattgcatagaaatttattttatatttaatttcttttaaatcttctaaacaatttttatcttaaaattttctgctcctttagctacaaaaacaatttcttggatcttgacagcttaaatcagaaaaaaatatccaattttctgcgatgaaagctttaaatata

SEQ ID NO: 2880 - DNA, 8320 bp, Heterodera glycines
tcgggcagccaaatgcgatggtgtggtgcataaatccctctgaggccctaatggatttttattaaaaataaaattttcctattattttttaaatctttgataatacagtaacaaaagtgatcacgctaccgtaccccccactcagtggcattccatgccagccgatgatcaatccaatttgcattgatccaacagcgggtggtcaaaatttgatttcgctcatccatttccacaatttggttcaacagaacgccaaacgtcacattggtggccaaccaatggtgcaacgacggacgcaccttttgttgaaaaataggaaaaatttaaattatatttttgaaaattcaatttaattactatacatttttctcataattttccggactcaaaagcgtttggtaaagatgttcctccgtccgtgaagccatttgtccttaaaaagtaaaagaaggaatttaatttgactaaaaatattttgaaaaattaccaaaatcagtaaaaaaaaaataaaataaatttgttcccattaattcaagcttaaaatttcaattcatcattctaatctagctttttttttcaagaaatttgattctctgcgcatttccggccatggtctaatttattaaaaagcataaattttttgtcgtcttcaacaggctgctctctgaaattgaagaagcaccgcgtttcaaatttcaagtgcatgaatcatttttttatacttttgtatgcttttgcacttgaaaaggacaattcattaaaaactttacatcccgaaaatttgatcaaaatttatcatgcttttaattattggtttctattttttaaaagtattttaaattggtttttcttttttaaaccattaaattgtgcccaaattttcccatacgagcctcaacagctcctaggcgtaaaaaaaaaattttgaatttaattaattgttttgttactgattcgaagtgccctctgcaaattcgcttccatcagtgccgtctcagcgccgctcatccgctttgcggcgctcgtcgctgccaattcagtccgcacagctttcggcttcgtcacagccattgcaaaattgttgtgacgatggtgcgtttcggcgccaccacgtcggcccggaatcagcagggcatcgtcatcatctgctgtcaaaatatttatgcttttttttgtattacaaaaagacgaatacggtgctgtgcaaaatatactgtatttaccaaaaaaaatgagtgaaaatcattagtaattgcttaggaagtctaaaagcaccaaattgactatattaatatattttaaaatttttaatcatttttttttgataacttgaaataaaaaaaggtcatacgaaataacaaattctaaatttatccagaaaacccaggttttttgtgccttacttggattgttttcatatttgacctggacctggatccaggcaaaatccagcctggatccaggtctagtttgaattctaaaaattatttttagcttaaaaaagaattttgtttatacacatatgtaggtataattagtaaagtgcagtcatattcacctctttgaaatgaaactaggttgttgttgtgatcatcgccagaaaaatcggctaactgaaaattaaaattttaaaattttttctttttttccaattcttcacaacctcaactctgacatccttcaatttaagcaatgtttccaaaaattgaagtgccggcacccgtctgttgctgatgtttttgttgttgctgctgaagttggcactacagccccgaggcatggtaaatataaaaaatgagatgaataagaagaaaattgaaaattttaaagattcaatttgattctccagcatctaaaatttttaaaaatttcttgacaaaatttttaaaaatcttttttttttgagttctctgggaatgccacaaattaatactatgaattataaagttcgacctgggcatggatccacaggcttgacaaaacctggggttttcctggacctgaattttcctgggtttttgtccaggacatccaggtccaggtccaacatggaaccaaagcccaggtccaggctttttcaaaatgtcttactactaagaaatatgtaaatatttaaattaaaaatatttttattaatgaggtcatacaccaattttttggtacggttttggccaagtgttttaaatgaatgggcccaaatgcactttaagtgagtgccgttttcccatgggcattttcccccgcccccattctttcttcatcaaaatggaacgcatggatttgatagacagattcactttgattttaactcgtgggaaaattcgatttttttttagagagaagttccatttttcaataaaataaaggaaagaaaaaaaatgggtgaattttttagtggaatttttttttcattttttgtgaggaaatttcacatgctggatcgtttcataaaactgccaattttacagatttttcgagaaaaatcagtcataacttctcttaaatacaacctaaaaaaataatcttggtataatacgatagctcttggcttgctctattatcatgaaaattttccgaatattttattaagtttttagaaagttatgtctatttttttaaacatttttggttagaactttgtaaaaactcaatgaaattttctgaaattttgcaagccaagagctacagtatgattcttattctttatgttataattaagaaaagttataagtgatttttctcgaaaaatcggtaaaattggcaatttttacgaaacgacctagcaccgaaattccatcctttgataaatatattttttagctttgtgaattaataatattattatttttttctagtttttaattcaaaaaaaaatacattttaaaggaaaatgtatttttatttaattaaacaaatgagaaaatcgaaatttttttcttgaagaaagaaaattgttaaaaattttttgttttaaatgaacgagacaaaagatgctgatgatgatgaagaaccacagcacagaagaagcaaaactaagagctttaattaggccgacaaaaaagaagaattgattttccataccctcaaaaagtatgtaattgagggatttaaaaattttatacccgttattatcaaaatcgaatgtgaatgcaaataattttcaaaccccgcgagggcaatttattcaccccccttttgtgttgctgctgccgccactgctgtcaaacttcctgtcaacatcggcagcagttgaggatggcattaaaattggcggcacaaattgtgttatttcttgttgccctcctatgacaaaattttcagtttttttttaaatgtccaaacggcattaggtttaagtttgtcttaatggaaaaaaaattgttggacatttatttaagtaagccataaattttcaaatttcgcatttaaaatgtgtgtttttaaaatttcagcagattttctgataattagaggtgtctattgtattatattttgacatgacataaaaatgtaaaatcaatgcctagcgaaaaaaaatttatagcgatttttaaaatttttcaaaaaaaattgcttttctttatttcccattaaaaatgcctttcgcttgctcattttatgtgtttgttactgctccattgaataagcagcagctaatggacaagtgcagtgaatttttttatcaaagcattgaacacaaaaaaaaaagaaaagaagcaaaattgtcactataaaatggacagacactttgacaaggaataaagagaaaaatttttaaatgctaatttaaatatgaaaaaataataattgattcatttaaaatgaaaacatttaattaatatttaatttcagtctctataatttatgaaataattgattaataaaaaaaaatttgtaagaaaaattgttactacttattaaaatgggcacaaacacttcgacaatgaatacagaaaaaaggtttaaaatgatataatttaaatatgaaaaaaatgtttgaattatttaaaaagaaaaacatcagccataatttaattttggtctccataatttatgaaattattatatttaaaaatattttgtaaaaaaattgtttaaaatgaaaacaccaatcaaaatacctagattttgatttacataatttatgaaattattttatttaataaaacttaaaagtcttttaaaagtgcgaaaagaacattggtctcacaattgcatgttttcaacacatttgtgcttcttctccatttttgcttcatgaataaaatattacaataccttttaaacttttaaaaaatattttggcatggaaaacaaaaaactatttatattattgacccccattcttcgagggaatctaagggcgtacttggaaattgtagtacttttgttggtaattaaggtccttatttccaagaactaaccaagaacagaacaaaaaaatggtatttgacactacaattcgtcctttgtgcacctccaaacgttgtgtaactactcgtccttttggtagaaaatgacaaatgtaaaaaacaaaataataattttaatatttatacataatttaatttattgtagtgtagtacttcatctgctaattgcatgcgaatttgcataattcacggaaactaatgaatgaataataaataaaataatttacgacaaaaaatgactactgaattttattaaaagaattctttgattctaattcaataattttttgtttttatttgaatccaaattctaagcaattcatatttataatttcaacattttttcagccaataattcgaattatgtttattaaatcatgaagtataatttactaagatatttacaatgtcattaaaattaaaatattatatgtatccatttttgattaaattatctaactaaatttattgaaggtaaattgatttttccaaatccataatcttgttaaatcttcgattgtcatatcaacaaaaataatctggcgatcattttatgccttttgattggcttaacgacaatgctttttgaatgactttgaacagctgccactctctctccctctccctcttctctctctcttaactctctctctctctctctctttctctcctctctctctctctctctgtgtctctccctctccctcttctctctctcgttctttctctctctctctctctctcgttttctcttctatctctgtttttctctctgcttatatcttttgctctctccatttcactaggacattgttcatttctcttttttctacactattttcatagattacttttctttttttcttttccattaactatctctgtctttcactttttctttcattcatggtctctcttcattgcatagatttgaaaagagtaaaatgtgaattggcgattgactgtgtctatccatatgggataaaccaactgcattcatccgacggggattagtgagccacaaatcgcttccctctcttccctcttatactgttggcccatcaagaaacggggcaagggctgctgatgggacaatgaaattttttgatagattgattgacatggtgtggagaagcattgccatcatcatcatcatatatcctccaccttccattcgtctcgagacaaaaaaatgatgtccggacaggaaacttttgacatgatgatgtcaactagtctcacatttttcataatcgagtcaaactttaaaatccgtgaaaatgcggtaaaattaaaatttaagtttaaaattttggagttttcgggtaattttttgattttggttttcatttatcttactaatttattgtttgtttttttaacagtacaagacaaaccttctcctaataattagcccttaaattgttcatttatatatcgcctcttagtacaataactctttgttaaaaaaacgagtgaaatttaaaatttatcattcatccatttttcattaaatttcgggtgaatttttctttgttgcaaatctcattgttttttagccattaattgatccatttctcgccctcttattgtcttcttccaccacttttttcccaagcttcagtgcaaataaataaataaatcagattaggaaaagtactgctggaattggaccaatttgtttcccctgaaggctcattttgccctgcggataaataaatttattgggttttaatggacaaattgtctttgcccatccatccaaagtccaaacttaccatcaactcagcagggatattttaggttttttttcgaatttctatgaaatgttgctgtttcatttttaagaatcaaagtgtttcacagtttgtccaattttgtttgccctctaaacatgaaacatttgcataatttggccaattcttgggaaatcctcgccgttgatttaattatatcattttataaaaattcataatttattatttcagtagacggaaaattgatcgtttattttccaataaagttttccatttttgtatttaattcatttttctttaattttaatatatttaaaattagtcacttttttcattgtgttagcccgaacccattgagaaattttgtgaggggcaaatacgaaacaatttgtccaccgagaagaaagaatgggggagggggtggggcggggtgcctcgcgccacacaaagcgctgatttttaccgcaaaagcgtcgcgccgccaccgatttcccccggggaatggttggccgagagagctgaaaattgtgaattcaaaccggaaataccgccagttttttttgttacgggtggctaagaggggctaatttattccgtttaagttgaccggaaaaaatcctgcagtgccatccatacataaacatttttactcactcacataaatgtcgtataaattagggcagtgtattttttaatatataaaaaggattaaaatatttgttttacggagagtgttctgaaaacttcttttaattcctgaaaaacgaattctgaattcatgcaatcagaacaattattaaaatagtaataccttccagaaagaattcaaaattctggattaagagagaatttctcattttccggaagacttctgaatgtagcttttcaaaacaatattaaattaatatcctttccggaaagcattcagaatttgtaaattttctcatttctctaaagtaaataattcagaattatcttcagccggaacgattttgaatgcaggtttccaaaaaagttatttattcttttttccggaaaacattccagaattctggagagagagagagtttctcattttccacaataactctgcagctttccacaacagttatttattcatttctggcaacaatccaaaaatgtggagagagagagagaacttctcattttccggaaaagatctgaatttagtttccagaacagttctttacttagtatcctttccggagcattcagaattctggagaagagaacttctcactttccggaatcttctgaatttagctttccataacgagctttccagaacaattatttattactttccggaaagcattccagaattttggatatcatttgttttccggcagaattctgaaatatgattccatccggaacgaagcttgaattatgaagttcttattccttcccggaaagattccagaattctggaaaatgacacgcagcttttcagaacagttattattcttttccggaaacattccaataaatctataaagaacgaattctcaatttctgtataaattctgaaatgtctttctgtccgggaccaattctgagttgaggaaccatccctttccggataatccagaactctggagagtgagacagacgcagctcaccagaacgttatttattcctttccgggaagcatttcagaattatggagtgagggagagacgcagctttctgttcctttccggaaaacattccagaattatcgagagagagacgcagctttccagaacgttatttattcctttccggagagcattccagaattttggagagagggagagacgcagctttctgttcctttccggaaaacattccagaattatcgagagagagacgcagcttaccagaacgttatttattcctttccgggaagcattccagaattatggagtgagggagagacgcagctttctgttcctttccggaaaacattccagaattatcgagagagagacgcagctttccagaacgttatttattcctttccggagagcattccagaattatggagagagcgaacttggcattgtttttcgggagaattctgtaaatggttccatccgaaatagaattcagaaatttaaatttcct

SEQ ID NO: 2881 - DNA, 4687 bp, Heterodera glycines
  misc_feature (4666)..(4666): n is a, c, g, or t
  misc_feature (4678)..(4678): n is a, c, g, or t
ggaacttgtaaaattatgggcaccaaaaattttaacttcaacagaattgccagaaagggttaaaccgtaccccgtgccggaaaaatacgaaagcgaattgaaaaagcaaatcgataaaatgttgagagctggcgtaataaaggaaagccatacgccgtgggtgcataatatggtgcttgtaaaaaaggcaaatgggcagttaagaccatgtgtggattttaggccattgaacaaagtcactattcccgacccttaccctttaccgagaatggaaaaggtcatttttcgggtcgcaggaaaaaagttttattcgagtcttgatctcgcctcgggcttttggcagataccattggatcccgagagttcatataaatgcggaataattaccccatggggtgtttatcaaatgctaaaattgccttttggcctgtgcaacgcaccaagcatttttcaaagaacgatggataaagttttggatgacataaaaaatgtaaatgtttacattgatgacatattgatacattcgaacacattagaagagcatttggaaagtttggatttagtttttaatcgcctacaaaagtacggtctaaaattaaagggagataaatgcaattttcttcaaaataaatgccattacttggggcatattttgtcggaagcaggctatcaaccgtcgttgggcaataaagaggttattgataagttcccggaacctacaaatgtgaaagaggttaaacgatttttgggaatggcatcgttttttcgaaaatttattccgggttttgcctcaatcgctcaccccctcaataaattgacaagaggaaatggcacggaattcgtatggggaggagcagaaaaagccgtgatggatgaattaaaacagcatttgttgaaagcaccttgcctacgcccgccaaactacgacttggccttttacttattcaccgacgcatcagcaatcgcttatggcggggctttaatgcagactaaggataataatgagatgcatgccgttagcttttggtcccgtacactcactccaacagagagtaaattaccacccactcatggggaattagcggcaattgttcatgcgatacagaattttcgagcaattctgtatggggcagaattaatcgtactcactgaccatcgaccattaacattcctcttccaaaaagccagtacaaatccaaaattaaaccggtggctcatggctctgcaggaatttgagccgaaagtaatatacattgagggtaaagcaaataaagtggcggatgctttatcacgagtccctatcccatggaaaatgtggaaacaaaattaaaagaggatgtcccttatgtgttggcaatagaaagtagtttgaatagacaaacatttgtaaaagaaacaaaagatgatcaaattatgtcaaaagtaattgccaaaataaatgaaaactgggcagagccaatagagaaggaactggaaatatattttaaaaaccgagataaattgtatgtcgaaggcggaataattcgaaaacatccccagggccaatttgtggtaccaaagaaattaaaagttgccattttggaacaaattcacaaggctcattttggaatcgtacggggaaagtcaaaggccagaaggtatgtatggtggccaggaatgtcggaggacatcgaaaattttttgaaagaatgtgaggtgtgtcaaagaaatggcccaagcccgccccgattggatccggaacaccgttggcccgcagcaaaataccccttcgagaggctccatgccgatttggcaggtccggtttggggaacaaattttttaataatggttgactcgtattcacgctatccatttgtctttcagacaaatcaaccggtagcgcaactttgatcgcatttttccgggacatttttgccttatttgggtccccaaaaaccttaattaccgataacggcccacagtttatttcggtagaattcgaaaattttttgtgtgaggaaggggttacccatttaacctcgccaacatatcatcccgccagcaacggagaggcggagcggttcgtgcgaacctttaaagaaggaattaaaaaattgttggatgaggggagaaacctccgtattgcacaattcatccttttacaggaataccgatcctcaccatgcccaattttgaaaggaaatagtccggcacaaatgtttttgaaaagagaaatgcgcacgagtttggataaaataagaatttcccaagtggaaagagacaaaggcactcctacgggcgaccccgtgagagataaaggggctcaaaatcagcaaaggcagttgccgaaatatgagccaggagattcggtatggatgcgcgaccaacaggacaaaaagtggacgccggccatactgcttgagccaataggagagaggatgtggcgtttggagatggaagggggcggagaaagaactgcgcatgtggagcaaataaaagcgcgtcgaatggtcgccggacgagcctagcccgcatcattctccggcaaaactgttttttatataaataattttccttttttttgcttttgtaagtctaaaatttttgatttccattccaaatttcgtatttttttgtaattcatttttgtttctgcaagattttcttttgtcgctttgtccctcttctcgaacctttccgacccaaatcatgtcaaccaccgaaagagaagtcggcacttcggtcgagaatcttgaaaatgtgccaccacagcagagcaacgtcgccgagctcgaccaggacgggatgaccaagcaacgcaaaaagcgcccggccattgcaccagtgactgttgagatcggacatttgctggaggccttcaaatcatcattgtcggccgagatccgttcatcagtcgaacaacttcacaaggagttgacgggagaggtgcaccacgcactgaacgcactttggaccaaaatggagccggtgctcagcgatcagtcgcgctgcattgcggcgctgactgatgcgattgacgagttgtcactcaagggaaccaagcaatcggtaaacccatccacggatggaggtccagctgagttggccaaagaagcaccgatgaacccgcagggcggaggtccagcccctgagctggctaatgaggccccgttaaacccgcagggcggaggtccagcttctgagctggctaaagggcgtaccagcccagctcgttcgaccggaagagcatggcacggaaagcaacatcgacaacccgcacgcaaagccggccgtctaaactacctgatgcgccaattggagcgcgaggtcggcggcagccaaatggtccgatccccgcatccgtactgggaaaaccgccgagggaatggttatggaggaccgcgcggtgggggacgcggaggctacaatgcatatcgcggagaccgttctgagcgcgtcggcccgtcaaacaatggacgttgaatctgtggtgtggtttggactccggaaggggggagagatgttgaatccccttttgacaaaatcatttatttaatttaatgatcaattttcacttatttattttgtacaacttttcttctctctcttcaccaatttcctctcccatcctaaccaatcgttacactttactgtaaacccaagccaagccaatttgtgtccatcccagctcactctcgactccaccccctttctcttttgatatttaaactgaattcattccttgcattattaccctttttttctactcactttgactcattcccattttacttacctttctcacttttgctaaataaactttcattaacaaacttaaagtcttgcttttgattgggaaataagtcgggaacacaacactttaattttctgtagtcatttgatatgcatctgctatttttctagtcacaaacaccaatatttttcggcccgaattttataggcgtgaaaagtactgatttcaaacttctttctattcggagacacccaaaatttgaaaaacgtctgtaatttagcctcttttaaatcttaattttttgaaacccgaattgagaaaatatgaatgtatttctgcgacgccttctatacttaattcggccataatgggccaaaaattcataagttaagaccaaaagagggattttagtttcagccggaatttctataaaaatgttcgtgtgtaacctatctttgtctattcggataagtaagaaattgaaatattcgtattactttgcctcccttaaagctttataatgaaagcgtcgttgtctattttggatttgccgttgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccctattgtttaattcggcctttcctataagcacaatgtgtttgatgggctctacaaaatattgctggcgcaaagcaattattttcttggaggctttaattttctgtagtcatttgatatgcatctgctatttttctagtcacaaacaccaatatttttcggccgcgaattttataggcgtgaaaagtactgatttccaacggcggggtattcggatacacccanaaatttgaaaanaggtctgta

SEQ ID NO: 2882 - DNA, 3664 bp, Heterodera glycines
  misc_feature (3491)..(3491): n is a, c, g, or t
  misc_feature (3557)..(3557): n is a, c, g, or t
aaatggagccggtgctcagcgatcagtcgcgctgcattgcggcgctgactgatgcgattgacgagttgtcactcaagggaaccgagcaatcggtaaacccatccacggatggaggtccagctgagttggccaaagaagcaccgatgaacccgcagggcggaggtccagcccctgagctggctaatgaggccccgttaaacccgcagggcggaggtccagcttctgagctggctaaagggcgtaccagcccagctcgttcgaccggaagagcatggcacggaaagcaacatcgacaacccgcacgcaaagccggccgtctaaactacctgatgcgccaattggagcgcgaggtcggcggcagccaaatggtccgatccccgcatccgtactgggaaaaccgccgagggaatggttatggaggaccgcgcggtgggggacgcggaggctacaatgcgtatcgcggagaccgttctgagcgcgtcggcccgtcaaacaatggacgttgaatctgtggtgtggtttggactccggaaggggggagagatgttgaatccccttttgacaaaatcatttatttaatttaatgatcaattttcacttatttattttgtacaacttttcctctctctcttcaccgatttcctctcccatcctaaccaatcgttacactttactgtaaacccaagccaagccaatttgtgtccatcccagctcactctcgactccaccccttttctcttttgctatttaaactgaattcattccttgcattattacccttttttctactcgctttgactcattcccattttactcacctttctcacttttgctaaataaactttcattaacaaacttaaagtcttgcttttgattgggaaataagtcgggaacacaacagattggtctccaaatagtcaattcgcttttgccattgaaatgtttgtccaccaacgcattgaaacgtggcgaaagaagtgccaatttgaggccgagttgaggacggtcaaaactggggaaaatgtccatccaaacgtcgttgcaaatccaactgaaataatgaaagtaaattagggcaaataagaatttttgacttttgaaattcttttaccgtcggttcattttttggtaattactaattagcacaatttggccgagttccgaatgaggtcaaacaaatagcagaataattaattaattgcgttggataaaacctggtttttagggttttcctatttttttacggattgtatttgatgaagaagcaccaaaatcacatttaacgaatttttccaaaaaatggaaaatttttgacagaaaattattcataacttcacccaaaatgaaaccaaattttaaaatattgatatcattcaataggcccaactgttttctattagcctataaagtttcaaaaaagttataacttgagaagctcaaaaaatcaagttttttacaacatttttggtcataactttcttgaaacttaacgaaacctttttgaaggcacgatgacatttcgcctactaagccaagatctgacatttcgcctactagacatctcgcctactgacacttcgcctactggacatttcgtctactaagccaaaggcttcacatccatggaaaacaaagagagtgattaagaagctaatggagatgcacactttctgtgttctttgaaaaatttatttgctttttttggctaaatttgattagcattataaatatagcgaattatatgtcaaattagaatatatatttggtgaaatttgctgtcgaaagagctaggtattttaggttagcaggcgagatattcaataggcgaaatgtccagtaggcaaaatgtcagattttaggtgagtaggcggaacgtccgatttggcttagtaggcaaaatgtcagattttaggtgataggcggaacgtccgattttggcttagtaggcgaaatgtcagtaggcgaagtgtcagtaggcgagatgtccagtaggcgaaacgtacgcacaccctttttgaaattttgcatgctaatagaaaacaactagagctattgaatgatataaagaattaaaaatttggttgattttaagtaaagatattgaaaaaaattgctacaattgatggttttttgaccaacatcatagcaccgaccgaagaaacggcgagcagaaaaagggaatggcacagtgaattggaatggaacgcaacagaggagaggaggaccaccaaagagaatattttgcaaaattatgaccatttgccgggcgttttaccttatccccccacccacaaatcaatcaatcaaataatcaattggacggatagagagagggaaaggatgaaaatagcattggggaaggaggagagacggaagagaaagagaggaaaaggaaaaattcgaagcaagaaggaggggagaaagaggaggaaaaggatgaaaatagcattggggaaggaggagaaagagagagagagagaaaaaggaaaaattcgaagcaagatttttgccatttttatacgtccgatttatttaccaatttagacattattcatcaaaaaaggcatttgatcactgatttaattatgatcggtcggtcattacttaattaattcatttcttcttctactgaccactgtttttgttcgttctaaaaagccaaaagaacacatttgtgtgatgatggaaacgtggcgaaagcaatgccactttgagtcaaatttttttaagaaaaaaataagttttgggggcccggcgccggaggaaaaatttgaaattttgactatttttacagattttcactgaaaattgttcattttaaaaatgccttatcgttttaattaattctatacaaaaatagttataataaaaagaaataaaaaagtacataaaattattattatgattattaaaaaattttaagctaaaataatataattttttttgactatatggcataaggaaaaaaattgaaaaaccccgaacgatttggtcaaccccgaaccccgacttttccaaccccgacggtcggggtcgcaaccctagttcacatcattggtcccataattttcgactttttgttcaggtccggtgtttggagttggtcaaaatggatgccagattcatgatcagcgacaccgaaaagcccctaacaaatttttcatgactttcgaaaaccaaaaatcttcaaaaaggtggcactagccctactattaccggcatttgattttgtacatatacaaatttgaattttgcgcttaattaaggccattgtctccgccaccggaagaagtggaagaagaagcgggacaaagcatcacaaaagggccgtcttctgctgacaatgagtgacggacaaacgaacaaaaacaatgattcagcagcagacgaaatgaattaattgagaatgaacggccgatcataatttatcagtagggttataaattatatggactaaaaaacgcaaaatatggacataaaatatggactanaaagctcaaaaatggccatatatggaccaaaatatggattagaaactgccaaaatatatcttttanagcctaaaaaattcagaaaaatgtatttaatattccatatttgctaaaacagactccaaaataaagcgaaaaactggcccaaaaaatggattttaacatttaaaaaa

SEQ ID NO: 2883 - DNA, 4390 bp, Heterodera glycines
ttgagtcccagagattggaatgccggagaattgagtcccatagattgaaatgctggtgggtttagtttcagtgattggaatgtcattgaaagttggtgggttgagtcccaatgtttagaatgccgcagatttgagtcccagagattggaatgccggagatttgagtcccagtgtttggaatgccggagaattgagtcccagagattgaattgctggtgggttgagtcccagagattggagaaaagccaagaaaatgatgcgagggcgcgaagcggccgagccagtcgattttatcattcataattctataacacaatcgtactgcctagcgggggatgcgccgaaggcgctgaccccgctatgtctgaataaaattatcgctcgattttaattttaacttcaaatatttagaaagaaaatattttgcattctgtttgtatttttcaaaaataaggaattaggcgggatcccgcgcaaaatttgcggatcccgttgcgggattggaactcaaaattatttgcgggacgggatctcgcggaattaatctcgcaaatcccgcaatttcttaaaaatgcgggataaaatatagcaatatgcggtggctttttttttgtacttaaacttggctaattgtgagatggaaggcggaattgaccccttcgcttaacggcactgccgtcccattcgtttatttgcttttcatgtttcaaaatttcaaaaccatcaacaaataatcgagtacgtgactaacttaaccttctttatttagcagtgctatcaaaaaatgcattctccaagatcagagacaaactcttattcattgcgtgttcgtaaggcgattgcatttgatagagactattcaccagacccaccgggtccggcacgtaagaaagcgaaggtgcagggaaacaatgcaatgccaaagagggggccgaggaagcaaggagcagcgaaccaacagcagaatttggccggaagagaagcggcgccgaaatttacggtgccgacagtgcaggattcttatttcctcgcgctgaaggcagggacaagggcaacggtaagtattaagaaccgaggaatcagtcaatgcttaatccattctaatgcttaaattcagaacttggtcgacaaatgggttcgcgagtatgaggagtcccctgaccaggcaattgtccaacttctgcagctaattgttgcttcctgtgggtgttctgggaaattggatgccaacatgattcacaacatgcagtggaagtttggtttggttttgatatttggtttattttaaccataatatgtgtaaattagggacatagtcgaacggctcagcgagtattttgacgaagactccggcgactatcccctgaccacacaacaatatcgtaaattccgcaacaattttgcggaatttctccaggccttcgttttgcgaagcaaaaacaacattctattcgatgtcactctcatggacaatctcatccaaatgttgacacttttgtcggacaattcaattcgtgcatttagacacaccgcaactttcgcatgtgttactttttaaatttattaaaaagtttcttttgtcattttttaattccttttagccatgaaactctcttcttcaattgttgatgttgtcgttgaacttgtcgaattaaaagacaaaaatgccattcaaattgatactgaaaaagcgaggattgtccacggaaccacaaatgaacgtttagaacgccttttgcaagcaaaaaatgaggtaaatgccgttggtcgaattcggaattcgaaataattttgtctcattttcagttggacaataaaattgacgaactttcttcgatgctccaatacattttcaaatgtgtttttgttcatcgatacaggtcaagctttcgatatgcaaccattctttccttttttcagggaccaggttgccgatttcaggattatttgcatctctgaacttggagtatggatccgaatctacccggctttgtttttggacgattcttacttaaaatacatcggttggagtctttttgacaaggtagtttttgccggtttacgagtttctgaatgagcaaattaaggttcccgaagtgcgccaaaagtgcatttatgctttgcttcctctttacgaaaataatgatttgattgcaaaattggagttgttcacgcacaaattcaaagatcgtttggtgagtatggtgttggacacggacgtggaagtggcaacgaaaacatgccaactgatgacgcacatttacaggtgccaatgattgggacttattgccctctccgattttaaaatgacggtccttttcattttcagggcgttccccgctcttctcgacccgggtgcttgcgtgccgctttatgagttggtctattgcaacaatcgccagttggccacggctgctggagaatttgtcaatgcaaaattattttcgacggcggccgatgtttgcttgactaaattcattccgcttctgaattattgccttttcttcagaattccctgctcacttcctccacttctctgctcactccgccagctgaaaatcgccagctgattaaggatttggtcacatttttcatagacggcgctgtccatcgtcacccggcctatttggttgattcgctgatcgacatttgccccatgctcaaggattggtccacaatggtcgacattttactttcggatgaatgtaataattctttattttcaaaaggattatgtacctataaaaatttagtcgaccaatttgacactcagctgatttcgattatgtgtgctgctgtcaagcatgctgcgacgggcgaacacccgccaaatcgcattgtcgtctcaattcggcgaggcccgggcgcggggacggaaaaagtccgtgaatagggggcaaccttttcggaacactttaaatggggtacttagtttttggtgaggtgttaccattttcagttatgtaaataaacgacattcaaggctcctagatgtgtattttccatatgtgtaaaaggtgttggggtcaaccaaaactttgctgggtattgggggtaggagcggccaaattttctaacaaacgttcaaattggttcaaggtttcaataaattttctttcctccgccagtgaccaccctcaccccgcaaatttttttaccattcccttcataaaaatgccattaatagaggtgtaaaacctaaattatgttttgttcagaaggaccttcgaatgctgcatgacggacgagtacatctttcggaagtgttcattcccaaattgccaagattgctacaaaaggttcaaaggattcctttcgtctttaaattcatttttcagtttatcgcagaccaagaaaaagtgcgtgatcttatcggactctttttgtacttcgaacttgaaatttactctgtttcccgtcatgatcaagttgttctttcgggttcaaaaaagcatttgaattgtttggtttcagcctctttatgatctgatgatgcttctcgagcgcattgttgaacaatactccaatgatgagattgcctcaaacattgcctccgtttttcaatttatttcgactaatatgacattggcacgatccaccgaaacaaacagatgccgaattgtggacggagttgtgcaaaatttgcggcaacaattgcaagtgtttctggccaatgaagaggacgaggaccaacagcttgacgaggaggacgaagccgcacttttgtccgccttcagaaaaatggttgcgttcgccaggtgcagcaaaatacatttctacagagctcaatttaaataaatattgtactattgcaattttcagcacaatcgacgtgcctgtaaatgtcgaattttgggacatgtgcatggctttgtttcaaaattcgcatcgatttcggtcggctgatttggttgaaaaggcgatgcttttgtgctttcttcttctcagctgggaaatgaaacgatttgtggcggcacaagaacatggagaggtaaactctgcacggttttattcatttctctttattctcactgataaggagactatcgaaacattgaagaaaaaacgcgaccaatttttgaggacgacaaagtccattctgcgcgacttcgctattggtgttgagactgtgagtttcctgtaattttttgtcattaatccaagtttaggcgttcatgtgcatttgtgacattttgattttatttaattggaaacttgctgctgacaatggccctgaccatcccatccattctttggcaattaaattggacagggaaatggcctttcggctcggtgactttgtcatggacaatgtcttcgtgttggaagagaacgattctggtcggtttctggaatttatattcaatagcttatagtttcaattccttta

SEQ ID NO: 2884 - DNA, 3448 bp, Heterodera glycines
tattccaatactgtcataatataagttttatataacgtaatccaaatcttagacgatttggatttaattattctaaacaaggaacgcatacgtaaatacgcattccttgttatttggttaatatgatcggaaaattgtaatttgttatcaatgtttactcctaaatccctaattgtatccacagcatttattgtatttccatcaaatttatatgtttcttttgggttttttgaacccaaatataatacaaaagttttttgcattgaaacttttatttgccatttatttgcccattcgaataaattatgcaatgctttatgcataatttctgtgtcggctcttgctttataacaaatatataatttaacatcatcagcatataattttattttcactcctgatggcaaagcatcaggaagatcgttaatataaatcaaaaataataaagggcccaggacagagccctgggggacgccagaggtaacttttttacttgaggataaagaatccccaattttaactcgaaaagtcctattactcaaaaagccctttatccacattaaaagtttgccctttataccaattttttccaatttgtataaaagtaaattatggggcactgagtcaaatgctttttgaaaatcaatataaatacagtcaacattttttccatttataattgcctcgtaccaatcttccacaactgttattagttgacttgtcgtagacctatttctaacaaaaccaaattggtattccgaaattttattgttttttaggagaaagttgtaaatattttggctaagaattctttccataaccctgcaaagtgagcaggttatagaaataggcctataattttcaggattaaatttgtccccttttttgaaaagaggaaaaactattgattccttccagatatctggaagagaaccagagtctaacgaaatcctgaataggtcagtaataacagttgctaatgaagaatggcagtttttcaatattttatagctaatattatccggggaggtcccgtttttattcggaagttttttcaaaagtttttgtgtctcgatgatgttaaagtctatatctgatataaaacattgattaacaaaagtattgcccaagtttaggtagcctgggtcaacatcagaattgttaaacgaatttgcaaataagttggctaataattcacatttttcatcaccatcatgatagcatttgttttcaaagactaaattcggtatttcaaaggggttaacatcgtatttttgtaggtatttaaaaatggaatttcttccctttgaaatagcctttttctcaatttgcgagtgaaatttatttgtttgtatttttatgtgtaaactaatgctatcataaagtgctttttttgttgggtcagttttacattgcctatacagtctggctttctctttgatggaggccaataaatgcgttggatatttaggggtcaaatcttttttggtaatttttttcattggaatacactcgtttaaggtttctagcaatgtattattaaatgcgttgtatttttcgttcacactaaaatgctcgttagataaagcgctaattctagaagaaaccataatattaaaaagagaaacattcgacggaaaaaaccgtcgattgtaaaagaagtttgttttttgtagtgtttttggaatagtcaatgtgaaaatttgcgctaaatgatccgatgaaaaaacaccaccttcaatagtacattgctttacaatttgatcatttgccggcaaaactaagtctaaccacgaatttcccctggtgggtccactcgtggcattgaaaaaagaaagcttactaaaaaagtggcaaaaaatttcaccaaatttactcatagaaatgggctgcccttccttccataccaggtctttattcggaaaattaaaatcacccaacacaacacaattatggctatagaatgtttctaaaaatttaaaaggttccttggtttgtctatatgttgtcttgggtggtcgataaacaagcacaaatctaattgattttagtttttgtaattgaaaaaccaagatttcgcaattatattttgtttcagaaaatttaacaaaaaactcaatttctttcttaattaaaacaccgcaaccacccccacgtgttaatttttgagattttctatgacaaaaaacaaagttataattttcgattatccatggactaaagaagattgggtttccctcctttgtccatgtttcagttaacagaaaaatgtctatgtttttatttaccaaatttaaagctatttcatcaattttgttgtaaagtgatctaatattaactaagcaggctttaacttcccctattttcggtattgggttattgagtctaacatgcttaagaccggaaaagtgcgaatttataaatgttttatgagtgtgatttggtaaaacagcaagtcaattggtgttatttttaaatgccgcaatgtctgacctcagcatcactttgtccgcgtacaccacccactcgccgccatcttcctttcttttcctgctacactcttcttgcagcacacgtcgggccttgagttcctcttggctgagtgaagggcgaattcggatgttgctcatccccaatttttgattgatttgcgcgcgccctttgttccactgtgccaaggtttgtttctgatgtttggagcacccgaaaattactttcatcaacctcgggcggttttgacctgtctttgcttggtctggggaacccattctgtacacagtgattgggctctcgatgccaagctcatcgagaacgcctgagatggcagttcggtcctcagcgactcgctcggacggcttttgtttctgcgattcagggagacccattacgacgacgcttcgccgacgctcatggtcttgaatggcttcttccatcattttctgttgtttgaaatgttggagttgaaggtcttgttcggagatgacggtctgttgttgctgaacctgctgtaaaagttcgacacaaattttcaaaagttgtttagtgatggggtcgacactgttgttgtccatttgttgggaaattgccgcaagttggtcactaagagcggtgtatgggtagtcagaggtggacttttttgatgcgttgtctgagagaggagaaagatgggaagaaggacgctttccaaacatgacaaatttgaaagaatgacaaatttgaaagaatgacaaatttgaaagaatgacaaatttgaaagaatgacaaatttgaaagaatgacaaatttgaaagaatgacaaatttgaaagaatgacaaatttgaaagaatgacaaatttgaaagaatgacaaattgaaagaatgacaaatttgaaatttaacatcatcagcatataatttaatttctactcctgatggcaagcatcaggaagaatcgtatataaatcaaaa

SEQ ID NO: 2885 - DNA, 2654 bp, Heterodera glycines
tctgtaaaaggggatgttaaagcgtgtcgatggattaaatattgaaaatagtttcagatctgttcggccataaacaattttatgcgccatgaacagatcaaatagctttcgcctattctcaagtgtcggcagttgcaggtattctaatcgattttggtatggaattggtggaaggctgcatttaaaaaatacccgtttggtgaaatatttttgacacttttctatttttttaatatttttttgaagagacggattccaaacctccggagcgtattccaataaaggcctaatataagttttatataacgtaatccaaatcttagatgatttggatttaattattcgaaacaaggaacgcatacgtaaatacgcattccttgttatttggttaatatgatcggaaaattgtaatttattatcaatgtttactcctaaatccctaattgtatccacagcatttattgtatttccatcaaatttatatgtttcttttgggttttttgaacccaaatataatacaaaagttttttgaattgaaacttttatttgccatttatttgcccattcgaataaattatgcaatgctttatgcataatttccgtgtcggctcttgctttataacaaatatataatttaacatcatcagcatataattttattttcactcctgatggcaaagcatcaggaagatcgttaatatagaccaaaaataataaagggcccaggacagagccctgggggacaccagagccaacttttttatttgaggataaagcatccccaattttaacatgaaaagtcctattactcaaaaagctttttatccacattaaaagtttgccccgtataccaattttttccaatttgtataaaagtaagttatggggcactgagtcaaaagctttctgaaaatcaatataaatgcgcgagttttgtgcacatctacaaactcttggctttcgaatgataccagggttgtttgggtccgggtccgggaagtgccctaaaaagggagctcaagcacttttggtcggtatttttcccaaaaagaaggaaaaagaaaaggaaattaaaagggtggaggcaagccagccgatggtcaagtggttactgtgcttgcttttggtggcgtggtctctgtggttcgagtcccattgtgatgtttgtttaaaggaaattaaaagggtggaggcaaggtcgagctttttgcaataaaagaaaggaaggaaaatgggcattgaaaggtgaagtggcaagcggccagatggtcaggcggttagtgtgcctgccttttatagtgggttcgggtcccactgcttcagagtaatttgaaaaaatattatatataattctactttttgttttgtttttttatttaattaactttatggaaataaaatattagttattttaaattaatgaaataagatttatttaaaaacaaatttaaaactgaatttaaaatcaaataaaataggtaaataataataaaaaaaataatataataaataaatctaaataatatttaagataaataagtatttacaagtacaagacaagcaatccggtgaacaagtggttagtatgcctttctttgttggtgtagtgtatagggttcgattcccattaattctgattatcaaactttttaattttttttttgataagtacgtttaggaaattaaaaaaaatttacataaagagtgaaataatatgttttttatgcataccgaatgaactcaaaagtaaaaatttgatccttttttggacaaaacttgtaacaaattgaaaattaatttaaactatccttggagcgcctatcatcagccagaccggactcgctcagttcagccctcacgattcggccccagcatgcttttccattataccttttttctttatcatccaaatccaacattgttggtatcatacgaaagctcttcacatgctctattagctttacaaaaaacgaaaagattttcaagcctcgaaaaaattttattaagaaaaacttcaaaatttcatttttttcgcaattttcatgtataacttctttagcaattgtctaatcataaagcaatagcttagacaaagcttttaaacatgttaagatttcaaataataccaacaatgtaacattgttggctttggatgaccaagaattaacagtataaaaattgacaaaaaaaatgtttctgatccaatttaacagaataaattttgatttatggcttacggaaaattaaaaatcgataaaaatttaaataaaacaaacaaaatttagaacaaaaaaatatgaaagaggaacagaaagtggaagaggaagaggaagagaaacaaaaagaggaacagaaaaagaaatagaagaggaacagaaagtggaagagaaacagaaagtggaagaggaagtggaagacgaacagaaagaggaagacaaagtggaagagaaacagaaagtggaagaggaagtgtaagacgaacagaaagagaaacagaaagtggaagagaaagtggaagagaaagtggaagaggaacagaaaggggaagaggaagagaaagagaaacaaaaagaggaacagaaaaagaaatagaagaggaacagaaagtggaagaggacagaaaggggaacagaaaatggaagaggaacagaaag

SEQ ID NO: 2886 - DNA, 1618 bp, Heterodera glycines
tggtgggttagagatagtatagatataagagaatgaattacgagagagagagagagagagagagagagagagagaaagagatagaaaagaaagagattcaagaataaaggaataaagtggaaagaaggaagttagagttggagagtgaagtgggaagggcaagaatcaaagagggtgggggagagagagagggagagagaaaaggaagagaagatagagaaaaatgaggttaagggtcgagagagagagaggcaaagaagagagacatgaaataaaagaaagacaatgacataaaaaataggaaaaattgaaaatagagaaaaatacaaaaaaaaaacagtaaaaggaaaaggaagcaaaacgacggaaaataaattaaaatgggggccaattgacactgacaaggcatgacagatattcattcacaatggaatttcaattcttgacaattgggaaaatgatagaaaagagaggggtggcggggatacaattacgttttttggccctccctgccattttttcacaggtttttaggagacggaaataacgcagcgaaatttcggaaaaaataattttagaaatataggtaattactccgttatgtgtacgatttattactttcaatattaaaccatagtaaaaactaaagcccagcgcgggattccgatttttttctggaaacaacgggatttgcgggattaatcccgccggattccctcccaaaacaattttgattgactccgacaaaagtaattagatttttttgtcgacaaacagtaaaagccgaggcagtacgaattgggtttcgtctcaattttatatggatttgtaaatattccaaaaaaatgtttcattacagaattttcggaaaagcaagccaccagcagagattacgtgtaatagaaaagtggagtgtatggcaaaaaaaaaattattttggcactttccgctcgaaatgcccttgattgcccccggcgggcatttggcatttttttcgctttgttccttcccttcccccttcccgtcgccgtgggggtgaggacgtggaaaggtacaaacgtttaaatggtcccatggccacccccaaccttcattataaggaatatgtaggccaaaggcggcgaccctgccgctgccagtcctcctcccctatgtggagtccaattccattccattccgtctcctcagtcgctccgctccgtccctatcccccgttgcgcccccccccccctccctccaccggggggggggggggactcaaccaatctcgagactctcgaaacgccgccgcagtcacggcggcggcggtgatgatagatgatgatacagcgcagagcagtagagagaatataaacaaacaccgcctccgcctccaccgccgtcttcccctcccttttgcgcgcctccggggtccggggatgagttggatggggctgtggtggctggcggtggttgtggtctttcatcttttggtgctttgcttaggtgtgtggtggtggtggaggtgcttctttcgttgctcactctcttccatcatcatcatttataaatcgtcgtcttcaccgtcatcatcatcatcagcatcatcatcaccggcagcagcatgtagcacttcctc

SEQ ID NO: 2887 - DNA, 4460 bp, Heterodera glycines
ccacaaaatgtccagcccacgaaatgtccaagtctcgaatttgagtttttttattattcagatgggcctaaggttaggcaaggggtaatataaagggtatattcgtattcagcgaccccgaaaaccctaaaaatcctaaattatactcattttgtttttataaattttgaaaaattttggacatttcgtgggtttttactcttttggacatttcgtggcttggacactttgtgggggtgccgttggattttgtggataatggatggtattaaagaaggtgatgatgcgcgtgttatcccatccattaacggtcgggatgggattgcccgtgtggtcaccgcccgccaattctaaaatgaaaccaaaaaaggcgacaggcgagggggagggtggccaaaccgccaaaccccgaaaaaaggaaagtgctaaatatggaaatagagaggaggaaagtggcggagagtaataatctgtttgtggtgatatggcccgagaatgtggtcgatctatggaccaaagtctcggccccaaaacggagcaggacaaaatgtcgccgagaaaaaaggcgcccgcaataaaatagtaaagttttcctaagaatttcaaataaaaaaaattctcaattttctaatagcaaagcatttttcatttatgtatgtatgtacatctaagtttttcaaaaaaaattgaaaataaacttttttttaattttaaatgttttaaagcgacgttttggggggaaccgcccacttcggcgccggccttttcggcgccgttgctaacaacttttttcctgatcaaccaaattaaaaatttttgttatcattcgatagctcttcagattctctattagcctgtaaaatttcaaaaaatttcgtcagtttacaaaaaagttatggccaaaaaacctcaaaaattaactttttcttggctttttcggcgccgcgtggcataacttttttatttttgaatcattcatttctatttttacatgtaaatatagagcacacatagagctttcaaatgatgccagattggctaaagctaactgacaaataaaaaagttatagcatttcaaaatttgcggcgccgaaatggtccgcgccgaagtgaccccgacccgttttgggctgcattttgccccaaatatgtgggtgatatggaaataaaaaattgcgaaaaatttcgacgcctgtctcacaaccttccatatttcgcgatttatgtccatatttccatatttgtccatatttggcatttttatccatattttggcatttttcaaaaaacctctattagaacggcccccagcagctaaattagcctttttgagcccaaaaaccgaaaaatttttcaaaaaatcattttttcgccaaaatttctcgagaatattgaataaatttaaattttcttaaaaattaataaatttatgtcaaaaataagcaaaaaagcgaaaatttcgcttttgtggttgattttgcgctaaaaattagtaaattttagttttatcatgttttttcttctaaaatgatttttaatacaatatgtagccatttttgaaagctttacttcgcgtatagcgaatttgaagaaattttgagaaattataccctaaagttggaaaaaattatgtccatatttttggcattttatgtccatatttcgcgacttttggtccatattttagccatatttctcgattttatgtccatataaatccccgccctaatcataggaaatgagagaatcagagagcactctctgaattaatagatgagaatgatgtcatcaccgggaaaaagaaaaaaataaaataaaatttttcatcaaaaaatagtaaattaaaaaatttcccaccaacctatccaagaatttgatgggtcaatggcaaactcgtacaaaggcaactcgtacaaaaaaaatttctaaaaatttcaactaaaactttataatttttagataaataatctaactggattttttagcctagaaaaactttttaaaacacttaaattttcaaaaaatttaagaaattaaaaaaagcagctgaaaaactagtaaaaaactttaaagaatcttttttaaagtttttctaggctaaaaaatccatttagattttttttaatctaaaaattctagtttttagttgaaaattcttagaaattttttttgtacgagttgccatgacaccaatttgatgacttaacagggaagagcacacaaaaaaaaaggaaaaacgaaaacagagggggcgaaaagggggaggaattttgtttatgttcactgaagaaattagcaaaatttatgaatggaatggaaagatgaagccgagaagaaacaccaaagctcaagcaagaacagggatggaaaaaatgtgacaaatcaccgggaaaataaatttaaaatgaaatttaaaaattcccaagggggagggggggggtaacttgggtaaatttgactacttctattcatcaaactcaaattttatttatttggtatcattcgatggctttaaaaatttcaaaaaatttggcacttataaaaaaaatttatggccgaaaaattgagaattgttttcaggctattacttgtttttttgtacttgtgtaaccactttttttttttgaaattgtgaacgctaatagagaaatttaggactatcgaataaaatctaaaatacacaatatttgattgcccctgaataaagatagatatttatgtcgaaaattttcggttaaaacagtacaaatcgtccttctttagtccatttggatgatgaataaacaggaaaagagcgctaaaaatggaaaaaagtggtgcggggagtaatttgttgatttagaggtgtcgatggatgaatgtggtccatgaaatcagaaaaaaaacatcaagaaaatgaagaaccaaagaccataataggaccggaaatgacaatcaccccttggggaaaagaaattcgttttttttgaatggaataaaaattaaggcatcccgccacacgaacttgacattaattttgaccaatttcgagtcccagcccgaactcggacaacaagtagaaatttaaaattgatttttatgtgtgagaatattcaaaaatacgcattcaaaaaacaacaattttttactctgaaatgtccgtcaaaacaacaacaacaacaacaacatcgggagaatatattttgtttggtattgtatatgtatgtgtatatatgcgaaaaaatggtcggtgtgggggatgggggggggggtaaggtaaataaagcatcaaaatttaaaaaaaagaagcaacaacattacccattagggcgaatgaatgaatgaatagtcaatttggtcgcgaaaaaatgatcgctttttagaaaaaaaaaacaaaaaaaaagtctccaaaagttgtaaccaatttaattaatttttgatcctatatgaatgtggtgtatctatcatacaatacgatgatgcacgcaccataatgaaaaaaagagatgaatccccaaacgatgcgctctaaaattttacaaccaagaaaaatggcgaaaaaaaaaattttttttttttttgaaatttgtaatttggctaaattagaaaaattggttttcttttctttatgcttgtgttaagcacatatcaaataaatttgatgttttgtaaaaaaaaaacaaacatcaacaaaaaagcgatcatttttatgatgacacacataggtaaatgatacgacgacgaacccaacaattattggtcaaataaatagtcacaaaaatgaccaattttcaatttttggcggcggcgccatttttgttttgtttctgccgctgctgtttcggctgtttgttgctgctgttggtcggctgtttctgtcccttctccaatttcgcgtcctgtccacgtccgccttcggctgccgctgccccctcttctccctcctccacgtcgtcaagcaaattgtgtccctccggcgctggacgcattgcgggaaagaacagcacctggacaacggggggaaaaatattgtaatttgaaaacaaatattggttattataggtaaaaacgaaagagaagggatccatctctcctaccaacaatcataaaccggtaaaaaccggtcaaaaatgccggtttccgggccgggctgacattttcaaaacgaccagtttccgggcccggcctctcaaaaaccggtcaaaccggattttttccaaaaatcaccggttccggtttccgggcccggtaaaaaccggtaccgggcccggctcggtctctaatatatatacatctatattttttgtgttgaataataataataaaaaaaaaattctacaaccttttttcccaaaaaatacaaatttttcaaaatttcctgaagggaacggtggaagaaatcttttttttggtaatccttcagaattgcggtcccgacgaaaaattaatttaaaaattttattttagttttttttagggtg

SEQ ID NO: 2888 - DNA, 4485 bp, Heterodera glycines
agtcaagagcatcagctcggccatgtgcttgtccgtcttctctattccccccatcgtttgtctgtctctgttctgtgcgtctgcggttttcacggcgcctcaggcaattaatgagtttcacaacaaatgaaacttttcatttcgaatgcttttcctttgttagccctttctctgctcgtttggctgctccgtgccgaccagggaaagcttgaaaagcgaaacacggcggaagtgacaatgagaaatggcaacgcaatggcactgaatgagcagtgggagtttaaagcacagccgcaagaattggacagaatggcagtggcgataatggcaagaaaaacattggcatttgtcacaaaaaacattcattggcatttgctgtttttttttgatggccaatatacaaaaatgcgtctttgggcctactaaataaaggccatctctgctgaaggtgcaattgaaaattggtcaattgctaccacccaaaatcctcacttttttttcctattttgggacactccaaaccccaaaaaggcgtgccgcctttttaaacactaattgtcatgcatttaaatgtttaggtgatggactcttttggtgaagtgggccattgcattttgggcgatttgtcgggcgccgatgcgacgggggcgcagcaatggcacgaagcgatcgaccgacctggccaaggcgtgacggaatggcacccactgagtgccaattggtgaaagctgtcgcaaatgatgccctttttgctcttttcaaatttatttggttaaataagaattttaaagaagaataacaattagttttgtgtttgatttttctggtcccaatttcgaccaaagaaaaaacaaaacaaatatttgtccatttcagtttgtatgtaaaaatatgtaaataaaagtcccgatttttgttcgcaaacacaaaaaagaaagtgtttttcctactatttagatcatggagaagccaggaaaaaatatgtatttacataaaattgacagccatagttataagttgtatgcactaaaaaatgccaaatatgcgcataaaatatgcactaaaaacccccaaatatgccctaaaaactcgaaaaatgcccaaatatgcactaaaatatgccttaaaaattacccaaaatggcttctaattctcaaaaaatgccaaaattgtgtaaaaatacaaaattgaatttaaacatcaaaacaatggctaaggagcgttttttggataattgcaaaaaagtttgatttttaaatttatatatgcaatttcgaattttaaaatttttatcatacatatgctaaaacaaaattatatttttctaatatcaacaattttttttcaaaagttcttacaaaaaattcaaaatttttcgcttttcaaaggtatattttttaaattccaaaaaggtcgatccttaggggatgtatttttcatttttattgcatttttttatgaatatttgccaaaaatgaccgaaatatgttctaaaaacgcaaaaatggcaaaatatgcatttattctcgaaaaccccaaaatatgcttttatatgcactaaaaaccttcaccaaatcaaaaaattttaacgcagaaatgctatttttgagcccctttcttcattgcatatgcgcagaaaaaatatgcaaaatcatacaacttataaccctaataataacaaacaaaagaggttgcttacgagaagataaatctttcaaaagaaaaattatgttttttggaatttttaaatatttctacaactttaaaaaaatcataattttgacattttaaatcccgaacgaaacggtggaggaggcaataaattgtacaaaaaattaaaattcaaagcctacataattttttttttttttttgcaaaatttctataaaattttttttgacaaatttttcattttcaaaaataatttttgcctctttgatgttgtgactgtcggtgagcatcatggtcagccggtcaatgcccatgccccagccggcggttggtggcaacccgtactccaacgcggtgcagaaattctcatccaccgcctgggcctcgtcatcgccagcctcacgagcctaaaaaaaaaaaattacaaacttacaattggtgggaagaatgaaaaagtttacaaataagccaattaattttgctataaaaatggaaaatagatttgtaaaaaaaaattttgtacgcaacagtaggaaaaggaaagattaatatgtaacacggaaaatatgaaaaaaaattgttttttttgatacaactctaatttttaggacccattagaacccatctatcgtcaataaagaagcggaaagcaaatttccgcttactatctctactcgagaatcgtgagactcttgaaaaacggcaagaaaatactaaaagagcgacgggggaaatttttcagtaaaaaaaattctgtgcccactttcgcctgctgttcaaacagttcacgctgacgcagcgggtcattcagttcggtgtaagcgttgcacaattctttggtgcatgcgaacagctcaaagcgctcggtgaggccgggccgagagcgatgccatttggccaacggagacataatttgaggatgcccagtcaaaaaggtggggttgatcagtttgggctaaaaaagttacaaaatttaaataattttttttaaaattaccaactactcacctcgatgaactcgccgatcagcttgtccaacaggcgagcacagctgcgcggctgtgtacagtccacgccgtgttcagtggcgatacggtcaaaaaagtcgcgtgcctctgtgcaaaaaaaaaatggaaattcaaattgggaaaacaaaatgttacattaataaataagcggcaaaaaaaacatgacattcgagtaccaagggtcattattggagcacaaaggcccttaaaatgaaaaacaggacccgccaataaatctctttgaattttttttttttcataattcaacaatcaactcttttttatctttaccttttcatccaaattttaataaattaaaatattataaaagagagtaattatatatttaaagataaaatttggattaatttaatttattaattattttatggattgaatattgttatttgtgtaattaatgttaatgacgtatttgtcctgtataattaaattgtactttttcttcaactcatgccgctctcatagttctcaatcattagctgtaagatgatgctttaaaattttgagcgaagaaattgccaaatatcctaagaaaatatttattcattgttaaatccatttataatattgaaataattcactcactttcttaatgtccaaattaatgtccgatcacagaaaatataacattatttgaaattcccttgttctaaagaattaatgcgttttaaaagttttaatttatctttatattcattttctgataaattatcaattgctttttcaatttttagtccgcttgaaatttattccctccattttatttgtttatttgttaaataatttaaaaatttaaacttttactgggaaattatgaaatgattagcattcatttaacaatgaaagaagatgatttttttaaaaaaataaatgagtttttttgctataaatattttaaaaataatttcactttaatcaatccattaattatattttattgtttttattttaattattttcttttatgctatcatcatattttctgttcgaccaaatttatctgtatattttaaaacattgttaattttttctaaaaatttttgatattgtgaaaataagatcaaaattttcagaatttatttaactattttatttcctgtttaaaaaatatttttattaaaacttatgttaataatccttgaaataatattattttttatttatgttaatataatatttttaatacatttagctgttttcatttcaacttcctattaggttgatattcttccaattatttctttaatgtcaaattatttcatttttaataaaatttgatctttaaatatgttatgttcgttgatagagttatttgtatatttaaatttaagattttaaattcgcgttaaaaattaaattttctaatcatactattgtcctttatttacagaatatttaattttgaaatagttcttgtgattttgattgcttgataatttatttcgtttaatttatttatttatctttttaataaacttattatattttaattatcttatgttgttccgtcatctccattttagttgtcctttttgttactttagaattgttaattaatttcttgttttttaataatattaacgtgatttggaggtgttttcctacaaattcataaaatcagtaaatcatacacaaaatacacaacaactttaatttataaaagcagagtttttctaataaattctcgtgctgtttttgaattttatcatgtcctttcgatcggaacttgtttattttctaagctatgctctatttgtatattaat

SEQ ID NO: 2889 - DNA, 1785 bp, Heterodera glycines
  misc_feature (1775)..(1775): n is a, c, g, or t
aaagcaaaagcatttctaccaaaattataagctttttatgcattattaaatcattagcaataatttaattataaaattttcaaaaattggcacagaatttgattaattaggctaagagcccttaagtgtgcttgaggcgcccaaatgagtccgacccgggcactaacattcagcgaccaaacgaaggggccaactgcacaacaacagactggccgaccagtacaccgacgggcacatccaccagggaagcgcgagttgtggcgacgatgctgcgctgccatcctcggcaaaatcagtgccggaatcgcaacaattttgtgatggcacattattactgttagttgattttggcagaggctgttttcgttctgggaacaccaacagacgctcaacaaacggcaaattggccaagtcaaggccttcgcgcacctaaattttacactaataaattttaatatggaagcatttaaaagtgaatttttatagtcaagcaatcattcccggtaaaaccctggcaaaatgatgctcctgattctacattcctaccgtaatccatcctcttgtagtagaatgtattatggcactcagaaatgcttatgcgactattttataatctactataaagtagtgaccacaaattcgattttccggcaaatgtaacggtaaagacttctaattaccattaccggttgtttaactgtggaaaatgttaaacgtgtcgatcacaaatatcaacatctttgatcaatggcactcttctctatgcttaatgttagcacctccatgtaatcgtcgcgcatttcgttctcggcaaagaagcgtgtccgctgctcctcaaattcgttggccgcctgcacacaggcgaacacgaagcccttggaaaagcgcattcggacagccgcaaatttgtgcaaatcaacaatatgcttggataggtcctaaaaagtgccaagaacaattttttaaacaaattatccaatttttcaaaaatttcattaatccttaccttatatccgcattcgtcatacaaaaatctaaaatttggttagtttacagcaaaagcatttagcagtgttacacattgccggaactgttggagttgactcgttcgtagtacacttgggtggtgctgaccgcgtccccattacggtacctatgaaattaaaaaatgaaaattaatttaaaaacattcatttccaatcgctttttcttcaaatatttttgttagtttaaaataattttggcttattaaattaaatcattttaaatgaactttatttaccctttttaataatataggttattcttaagttataaactattgtctatttgaccctaattttatttttgcctattcaactcaatgaaccctttaaaaatggcataaattcgtaattttacatttcaatatttttccttatttctttttctttaatattttaaattcaatattggccattaattttaatgttttcccaattttatcatttttcttgcctcagcactcgccgtgttcgtcgcatgtaatgatagctcaaacttttccaccaaaccactggaatcgcgttgcgcatcttctcaaccaactccaacacttggccaacactataacgcggcgccatgccaacccgcacaaagtgatgcctatgtttatttcatacaatattaaaaatctctttttaaaacataaatttttaatgttttaaaaaaaattaaagatttttttgaatattttaagtgtaaattattattttattttaccagccattcactgnagataaagca

SEQ ID NO: 2890 - DNA, 7479 bp, Heterodera glycines
aaaaaagtgcaaaataggtgcgaaaataggtgttaaaaattggaaaaatccaatgtatttatgcataaaagttccaaaagtgactaatttttttataaatttcgcccgcacaattcaattggtcaagaaaataaataacaaattttattttttattttttttcatttcttaattgtgtatttgaaaatttttgggtcgattcatacgggtgtatttttctgaaatttttgtgatcgttttataggggatgtatttttcgtttttattgcacttttgctatgaaatttctggaaaatgccaaaataggtgctaccccccccccattttaggtgtttttaggtgctaaaaagttgctccaaatcaaaaattgttcggagaaaatgtgtttttcgtgcttctctcatcaagtaatacccgcaaaaaaataggtaaaaccctaaaaatccggtctctagtcattagtgcgtccataattgacttgcacccggacaatcggacaatttaaaatttgacactaaatgagaaaaaaaagattataaaaaatggaaaaacaaaaacaaagaacataagggcaaaacagcagatgcttttggaaatgtcaacgatttgggtgacttttgttgatagaaacacttgccaatgcttaattaaaagcctttcccatttccttgcgcaaataatttgcccgttttctcgcaaaacaattcctttccattaatttgaggaatgacaaatccatggacattacctaaccatccaacaaaatcccaattcaagcgcaaatccgcaatgataaattttcatttttataaattatccaatggaagaactattcttttcggttgatggcattgagtacaataccgtgaaacggatctcaaattgcgaaggtcaaccccaatttcgcggtaatttttttctcctttccattattataaatttaagttttaaaaaattgattcaaaaaataaaatttaaattttcaaaaataaaatgtatttttgcacgaaaaatgtatgaaaaaaactcttgaaattcttcgaagtggagaccccaaacgttatctctcagcaatatttagttaatttaattgaacataatattattattattattttgtttaattttaatcaattaccacttttttgttagttgcagcggtttctattgtatgcatatggaaccttttgcttttttctatttattttattaaataacgaaataagctaattctgtaaaggcggtattaatctgaataaattctgatatatcgaagaaactttaaaaaaaaaattaaaagttcattttattaaatttccaaattaactgagaagagttttgggcgtccgtcacttttgccaaagcgatgccttccattcatttttggattgcccccaaggcttttcgacgcccggcagggcggcacaacaacacaaacattttttagaagtgtctttgtgccggggacgtttaagatggattgattatttgccctttggttggcgagagttagtatgggccaataaatttggacttttttgacagttttggcacttttttagggccacagacggaggagggcgtgccaatgccaatgttttggttggcatcctcaaaagcagggaaagaagaaaggcaaaaaatgaaaaagaagtgccaaaagaaaaagaaaaaatattcactgacattttattaatgaaaatgaaagaaataaattgcaaaatttttgttttaagattaaatttacaaaaccttttaaataattaattgaattaaaatacatattttgaaatgactaatttttacatgggaagataaaaccttttatgtctctttcatttattatttaaataaacaaattgtaacagaagacaaaatattgggaaatttgcaatacttaacagtttaaaataatttccatgtcattttttcaaaaaaaattttcaattggtcgcttccgcgggctaaaagcaaaaaaaaaaaccattctttgaattcggcttttcaattaaactgcaaaataattgttaatgaattattgcagaaaagacaaaagacagacatattattaatggtacttagtaaatagattaacaggaaaatggttgcaggtgaaaagacgagaaataattttaattaaattaattccccacctaacaatgcaaattaacagataaagggaatgaggtagcttaaatgtctcacttcatttttgtaaaggcactttttacgaagaaaataaatctatgatcactgttcaggcactgttctgcaaattgccatattatgttgatcatccctgcctaatttagcttaattgccctgaatggactcggcatatttttccgccatggccgtgttggccaatgccgattttgccccattggtcgtcgcattggcaatcggtgtgccgtccgcgctgctgtactgtgttgagttgggagtgatcatcgcaaatttcggccattttcgctcatcgttttttgtgcttgtcattgtccgcggaatttgcgtaaaacaaatattttgaaaaagacaatttctattttgaattatatttttaaaacattttcagagcctcgtcaattatgtgttcaccttttttgctcctcgcttcggcaaaattggccttttcttgccgctttatctgcgcttgcctcgtcttgtgttggcacttttgctttttgttggctattactccttccatgtggagaattttttgaccgcatttttactgctcaaccgcttcacctccattctgatgccgatgaattatgaaaaggtggaagactttccatggtcgacaattaatatccataaaaccgaataatcaccaaaatacaaaagccaatcaaatacaaaattcaaaagaaggggtcaacaacattaatccaataccacacacactgcatccggcttttggacttatccccccgccccctccgtttttcccaaaattttcagtccctacctacaccagtattattttaaaaataattaattaggaaacgttcccggcttttctcgtcccgacaaatcccgaccctcattttcccctttttttcctaaaattcgaagtcccggtctattctagtattattctaaatccagttttttatcgaaaaactattcttattttagttttggaatcgttcgcttctttttttcttggccctttctttcattttgccgttgccattcactgctccaattttcggctttgacatgttcatccatgttcaatctgacaatgtcactttcacacttgacgaccataagacagcaaatgttcgatttttggcactaataaaattagaaaataaaataaaattgcacttacaattaggagattaacagcagtgagttcgccgcttggtccgccattctctttggagtcatttgtctgctgctaaatttggcaacactttttgcctacaaattgtgccgttgtcaaaatgccggtcttcaaaatgatgccagttcaaaaattgagcgcaaaatgaccatttacacggtgttcaccttttttggccaactgatttttgccattttcatggtcagcaaaagcaattttaatttcttaattgcaataataaataatttcaaattattatttttttgaaggttttcgtttatgtgaccgccacaaattttgttgacgaacagaacaatcgctattcatacgcacagaaatggtttaacattagcttggagatggatgacttgctttttattgcaaatttcaatcaatacccgtgggtgaacgatttggccacggtggccataccggcatggtaattaaaagaaccaaattgttaatttcatcgtaatagtttattcgggttcgcaatttaattagtcaaaaagaataagttcgcaattttaatggccgatttaggcttttgctgtgggtgtcgtccaaaatgcgcgaaattcttgccgaaaaattcaacaaatttactagccacttaaagaagcaaaagttgggaagcattcaactgacggctcagtccaaaacaaacaaagttcaacccaaaacaatcaaagttcaaccagcggcaaagaatgttatgggataaatggaaaaggaaaaggaatggaagcataattaaagttttaacgtttattttgataattatcttaaaattaaaaattagtcatcgtaaaatatgaattttaaatttttttttcttaaattggttttgaagttttaacaaaaaatattaaagaaagccatggaagcataattaattggctacgcgataggcgcagcggtagaaaaaatcggtaattctgaccatttttaacagattttcaccgaaaaatggcaatttttaggtcaaatttaaactcttagggaaattctgtggacggaacggcgccgatagatgccgccgtgaaaatttttgggatttttaataaattttgttaagaatgttttttcaaaatttcaataatttttccccttcgccagcgacccccccccaatggtcatccttaacagtgtaaaaatttctctgtttccgagactaaaaaccagagaccgagatgcgaaaaacccgataagtttctcgagtcaagaaccgagactctcgcacatccctaatagtaatgcgcgtgtagctgaatagccaattcccttttttcgaaatttaaggaatgctaatgttaattagccttttgtgtggtgtataccgatactgaaaactaataaaattaacttcataacattgctcaaaacattcttgattgcatttgataaccctaaatgttttatataaggctctcatccgtccttgggtgccaggacgtccttggattagggcctcgccgattggaaaattgaaaaagtccttgtttacagagcatcttaaattccaaaaagcgaaaaaggggattgctattccgtcgccacgacgcattgccatgttcaagtcgttgatcagggcagttttaatttttcaaatagtaaattatgaaatcactttatgcctatttttaccttttaatccctaatttaacccacaaaaagaaaaataatgagttttattagttaattagccgttttagttcgatattctccggtagtaagtaattcattaatgtctgctggttgtgattttttctaatttttattttaaattgcaatcttcaaaagatgctttcacaaatatttatctctattattcttttgccgttcttttcaattccatgcatccattgctgagataatgttaaaaatagagaatataggctaattaaaataaaagaaaataataaattccaaaaaataaaactgatactatcttaaattttagttaatagttaaaaaataataataaaattataaatttttaaaaaatcagtttcagaaatgatcacttcaaacaaaagcgaaacccaacggaagaagaaaagcatggacaaattctagcaatttatttcaaaaattggacagtaatggacagtatagaaaacactcgaaggacaaaaggaaattgtgaaaaatgcaggcgtaactatagtaacatttcttcagttaattgtttcattcactattaatgtataatgacaaataatatcttgtcgtagatgaaccaccaaaaacttgaacatgctggtcatctttatgtctttgataaacttagtgcgtatggttttaacaaattttggaggtgtgggaacaaaaataacaaggacatatgttgaaacaagtcaatgagaatgtctgtagagcaaaccctgcgcgattggaagcaaacgcgtcattataggttaggcaatagcaaatgcaaaatattttgtatgtatattcgacaattttaggaataaaaggtagagccattgaagccgccgagccgccatctgcacttcactcaatttcactccaaaaggtgggaacccctgtgttgtctgaattccgaacaaaaaaaatgcaacaaagcaagttgtgttaatttctctgcgctcattgaaataccttagctaatcaaaagagccaatgaaggaattactaccgcaatttcgcttcatctgagccagtacaaatcccgccacaatagcaaatctatgcacggaacgaaaatgaatttggtgaatgaaaatggaccccccgtaacggttgggtaatgtattttcttcgattcattttattttttgttaatattttgatttttgggcagatgtcttagaataaaacctagcgccacatatttaaatttaaattcgtcgaaaagtttaaagccaaacccgaaagtgaattcattccgaacagtaaatcgtagccaaaagatatttgggccacatgaagacgaactgacacgatcctttcctttattcgtacaggcaaagagacaatgccgtaacacttgacctcttatccatatatgtcaattacatgctttgtctgacggcttggcttcaaaaattcttggtccaatgttgtaacggccaaaattttgttgaaaatgcagcaaaatcagctgtgctcctccattgagcattgcatttgcgtgtagacgaagtgcccccccggccgcaattgtagcatttgaaagtttcaggctgttcggtgtttgagaaatttaattgtcgacgctggtcaaaattttggggaaaattcaaatgttgtaagtccggttgattgattcgattttgccggttctcagtacaaaaactactttcaaaaacccctttgtcttaagcttgtcgggtgagatttagtttccattttgcgaacacagacgcgataatccacccaggagcgccacgtcgtatcaggagagaagcgatgttgctcacacaattaggaaacggggaattgtatcccaaaattcaaacacaattcaaacaaaaatccttttataattaaaagtccaaacagcgaagaaattgaacaaacataaaattaaccaaaaacgagcgaatatccaatctgaataaaaagtgaccaggggaagaaaagtcggcagcggaaaacaatcaataaatgaaaaaggcgggagattcaaaattgagaacgaaaggacaaaattaaatgagagagaatacaattaaataattattaattaagtcaaaaattgggaataaaacaaattaacaatctatcacatttccatgaatctctcattttagctggtcaatttctttaagtaaagactttttaaaccatttttcttgttttcttcggcgttaaaataatataaaaattaaagaaatactacgtttgttataagaggactgggtaatattgccgatggtattttttgaaattttcaaaaaccgttaaaatatgtttcttgaagttttcgggatgctagtcacgaatatgaaatccatttagctaattccaaaccactgacccgaaaaaagtcaagaattctttttttcatcaaaattctgctttaaattctaaaaattttggttggaaggtacaaaatcattttagttttataatgaaaaaaaaatatttgtttttct

SEQ ID NO: 2891 - DNA, 4014 bp, Heterodera glycines
  misc_feature (3920)..(3920): n is a, c, g, or t
atatttaaatgtaataaaaaaaagcgaaaaaactaacgctttgtacggaattgtacgcaaatcaacagcgttgctcacttttgttccaatcggcgcaattaacgttaccttaataacaaaaaaaatagcgaaaaataatagtagaatccaagctaatgaattcaatttgctcttggattcaaggacgccaacaaaatatgtttttgcaaaataaaatttcccttttcaaggacttacagaaaactcaagcaaaatgttattctattgctgacacatgggccaacttaaaggacatatcttttaatcctcttctcacccgaattgtcctttgggccgaattatcccatgctgagtgatgagtgagtgatcatcattaagctttaaagcggattcataaaggcctattaaaggaaaggatgaatgggaatggccagttacatcagaccatggatgtgtccgaatgccgatttccaatggcacaattctcgatatttgtgagctcggaatcccgatttcttatagcctaattttttaatccgttgaaattccgatttccgaattttttgaaggcgtcgccaaaacagccctggctcagatggtaagagcaccactggcttagagagaagcggatcaacgcaccggcggaggccgagggttcgattccctcctaggtattttcttttttcccaatctttcaagtacgtcataatacaaggacaatttctatttacaccagaatagtgttaaccttgttgccacgttgtgccaattgttcggtcaaaaagtagaccattcgttccgtgccgccaccttttgttgggggcaatgcgtccaaaattggcggagtgacaatggcaatgcgcaaaggttttgatttgtttaaaatatcataaacattttcgcactaaattaaaaagatatattaaaaataaaaattatcaatcgattttaacgagttaaatctgataagcagaaaaaaaattcataagtaaaattaacatccatttataaaaataaaaaaattcattttcgcttaaaaatccaaaaaggtaaatttttcttaaaacaaaattttttgttaaaaaggtatgcttttaaaatctcaaaatcacttttctcctgggacgttggctgataatttgtaatttttaattttcaacactgttgaatgtttgagaatttgagttaaattttttattttaaatttttacttttgtgattttggttttacaactcattaactcactaacattaatttttgttcttgattttttgcttctgctaatgacccattagcaattgatgacgaaccaacagcaggcaaaagtgatgctttgacatttttcaactcattaagtcggctaattgtgcggtaaattttcacatattcattagcaatttgttgccattgatttgatgtgccgttgtacgatttgacaatgtgcaattgacaaaatcgaagcgcttttttcgctttcaaactcttagccgcttgatcactgctgaccgcaacattggcaccatcaaacagttgctgatgtgccgttaattgggacagtaactcgttgtctaccgtactgccaccgggctgtgcatgcagtgttgtcaatgctttgtgaatgtacggcttcatatgaacaagatgttcaatggtgttgaaatggatctgaaaatctttgatcatttgggtcaatgattgtcaattcgtgattaaataatattaatttatttatttttaatttcatttactttggaattttcaaattttcccgcattttttgctctttagtcaataagaaataaaacaggaattttggcattaattaacagaatttatttagtgaattttctcaatttatttacaatgtcgaactcattggcacgttgtcgaatttgttcaaacatccaaatgtaaggaaaattccataagccgggaagtgctctgttctcgcgcattgcggggcttaaagcattttacaaaagattattaaatatattttattatattgaattattacagtaaaaatattttaataatttgaaaaagaaaccagcataaattaatatttgaaattgtcttaattactttgaaaaataactgcattattaaatatatttttcccctgttttatacatttgaatttgcttttataaaaaccatttttttagtcaaataaattatggttttagaaatattttttctagcacatttgtctattctaagcttttaaaagaaaccaattagaaaaaactgattactatgcgctgattaatttggctgaagtttttgagtcagctgaggcgaacaaagtgacctatattttagcaattaaatattcaattagacccagttcaactcaacacgacccaagtcagcgtagttatagttgttttttctgagaaaagttactgcgcttggcgctgagttgggctcgtgccgaattggcccttttttattggcacttacgtcgtgcccatttttgaccaacatttcaaccaaattgtacacatattcggccgacaattcttccactggcctttcttttgatggcataatgccatttaagcgtcgattttttggcggaatgctctcaaacataggcgccacaacagcaatgcacaactgtttgctgttcgtgtccagtgctattggtggaaaccttccatcaaacagcttaaaatagggttattaattttttatttcattaaaaaatattcgtttttatattccaactcaacgatacgccaaaaatgaaaatttaaactcaaggttttatagaccaagtctccgtatttcaaatttttcgcaataattcaccagataaattataattaattcttttgtgctaaaatagtattattaattaatttattaaaataaattgctttttatttaccatccgaaacattatgccaacaatgcaaatcagcaaaggtgccacaacagccatgcgcaactgtttattcgtgtccaatttgttgattgcgttcattatattgggcaccgaagttttatgggccatcgttaatgtgctaaaatcagaacgaattcccataatgtatcctaatttttgtattaaattagacgaaaaaatatgtcgaaaaattgtcgaaaaatatgttttggtcgaaaaaattcttttttttctatttataccttttaaattttaatgggtttttaaagcgaatttttggataaagcaaaaaatatttgtaaaattcgctcaaattcaaaaattgctcgctctgaaatttttttgttatattctaatatactaagaaatttttgtttaaatttaattatttaaatgttaatttattttaaaaatttaacaattaaatacaaaaatattaatttaaatgcttttgaatatttttcaattacattcaatcatcattttaactaaactgatgcggtgagcataaccgttacgcaataattcattaattaaaataataataaaaaaaattagtttattaattggtgaaaaattaattagtcttttttgcatattaatgaaagggaggacaataaattattattgttcttttcattagttttattactaataatttagtcatatgaactggggtaagcctcaattaaaatgaatttgaaaatttaaaaaaaatccgaatttttgtcttgactgaattacttctcaatttcaataaattgtaatttgttttattttttttaatttaaaaatttaattaatttgttatttttttaataaaagaacagacattaagataaaaattatcttaaattaatttaataaattagcaaaattttgaactaatccttttaaacaaatttgcttgaaaacttatattttactaactcgaaatttaaaataaagccaaatacaaatattttacacaaatcaacattagtaataaactatttatttaatctncatttatacaaaataaaacaatacaggtggttagttataacaaaaaacaatatagccagaattactaatttaatattgcatatctgatatacac

SEQ ID NO: 2892 - DNA, 2257 bp, Heterodera glycines
tattaaattagacaaaaaatatgtcaaaaattgtcaacttacctatgttttggtcaaaaaattcttttttttctatttataccttttaaattttaatgggtttttaaagcaaatttttggataaagcaaaaaatatttgtaaaattcgctcaaattcaaaaattgctcgctctgaaatttttttgttatattctaatatactaagaaatttttgtttaaatttaattatttaacataaattaaaatgaaaagaaatgttaatttattttaaaaatttaacaattaaatacaaaaatattaatttaaatgcttttgaatatttttcaattacattcaatcatcattttaactaaactgatgcggtgagcataaccgttacgcaataattcattaattaaaataataataaaaaaaattagtttattaattggtgaaaaattaattagtcttttttgcatattaatgaaagggaggacaataaattattattgttcttttcattagttttattactaataatttagtcatatgaactggggtaagcctcaattaaaatgaatttgaaaattaaaaaaaaatccgaatttttgtcttgactgaattacttctcaatttcaataaattgtaatttgttttatttttttttaatttaaaaatttaattaatttgttatttttttaataaaagaacagacattaagataaaaattatcttaaattaatttaataaattagcaaaattttgaactaatccttttaaacaaatttgcttgaaaacttatattttactaactcgaaatttaaaataaagccaaatacaaatattttacacaaatcaacattagtaataaactatttatttaatctcaatttatacaaaataaaacaatacaggtggttagttataacaaaaaacaatatagacagaattaactaattaaataattgcatatctgatatacacaaattcaaagtttaggcatatacgaatgttcactagacatattatgctaattatatgcaacagggatgatgaccgtttacataataagtttaataataaatttaatttaaatagaaaatagcaaaaaatttagcattagcctgaaaaaatattcgaaattttcaactgtctaaaattaatttcataaattccaagtcaattaattgtgttcatcatcctgtaatatatataattcatataatatttactaaactactaatgatcatgacagtttgctatgaaatttttgttcaacatgcggcgatagactttttcataattttcggccattttgtccaatgaccatttttcttcgacagtttgtcggaccgtggcacggtacaatttggccgcttggttgatcaaatgcacaaacttggccacctgttcaacaccaagccgatctttgtagtcaaaagtataaccgttgcggccaatttgcacaatctgtgattgtgataaatttaacggtcgctaaataccagtaattacagtggcattattaattacctagtaatggaactttttaaatattagtatatctcttgggttttgcttaatcttacggtaatttcaaagaataaattattttatgaataatataaaaaccgacttccggcacggcaccgcgccgatttgcaatcgccggcgttccggtggccatggcctcaatcatggacaatccgaacggctcgtcccattttggcgtgaacaaaaatgccaaagcattgcccaaaaaactgctaaaaatatatttgtttatgtaattattatttcttttttaattaaaaatcataaattaaaatgtattgaaaataatggcaaacgcactctctttcgtcaccgccaatttcgccaacatattcaaccaaatgttgattagcattgatcaacggctcaatttgcttgtgccaatatgaatgcttgtgctcgtccaccaattgtgccgcaattttcaatttgatgccggaccgaagcgcaaattcaatggcaatgtccacgcccttttccggtgccattcggcccatccatgccaaataggggcactcggatgtgccgggattaggtcgaaatgtcagctggtcaagcggaatgccgttgtgcaccgtgccaatccaattcagatcgaaaatgcctaaaaatttgtgggttacattctccatgttttttttggcattttcggagaatttcccaccccgaaaggtatgaaaagattaaaatttattgaaattgacatattgtattgggctatcgt

SEQ ID NO: 2893 - DNA, 1731 bp, Heterodera glycines
ttgttgggggaatgcgtccaaattggcggagtgacaatggcaatgcgcaaaggttttgatttgtttaaaatatcataaacatttttgcactaaattaaaaagatatattaaaaataaaaattatcaatcgattttaacgatttaaatctgataagcagaaaaaaattcataagtaaaattaacatccaatttataaaaataaaaaaattcattttcgcttaaaaaatccaaaaaaggtaaatttttcttaaaacaaaattttttgttaaaaaggtatgcttttaaaatctcaaaatcacttttctcctgggacgttggctgataatttgtaatttttaattttcaactttgttgaatgtttgagaatttgagttaaattttttattttaaatttttacttttgtgattttggttttacaactcattaactcactaactttaattttctgttcttgattttttgcttctgctaatgacccattagcaattgatgacgaaccaacagcaggcaaaagtgatgctttgacatttttcaactcattaagtcggctaattgtgcggtaaattttcacatattcattagcaatttgttgccattgagttgatgtgccgttgtacgatttgacaatgtgcaattgacaaaatcgaagcgcttttttcgctttcaaactcttagccgcttgatcactgctgactgcaacattggcaccatcaaacagttgctgatgtgccgttaattgggacagtaactcgttgtctaccgtactgccaccgggctgtgcatgcagtgttgtcaatgctttgtgaatgtacggcttcatgtgttcaaggtgttcaatggtgttgaaatggatctaaaatttagtgattttttcggttgaaaagatcacgaccgattaatttgatgatttcaggaatgtaaataagaattggatcaacggattagtgatatttctaggactattattaagacgcgagcattaattagcacttctgattaattagcctatcaatatttgttccaactaattaggcactaattgaccgaatttatttatattgtttacaatgtcgaattcattggcacgttgtcgaatttgttcaaacatccaaatgtacgggtgattccatatgccgggaagtgctctgttctcacgcattgccgggcttaaatcattttaataatatttaatttaaaaatccatttaatttaaaagtggcattgttaaaattaataatttaaatgaatttaataaaaattatttactatgcgcttattagtttagctgacgtcattgaatcagatgaagcaaacaaagtaacctaaattttaaattaatttttttaatattcaattaaagttaaagctattttagcttttatatattgtatatttttcggcacgaaaataaaactaaaatttatttaaagcgcagctattgggctcgtaccgaattagcccttttttattggcacttacgtcgtgcccattgttgaccaacatttcaaccaaattgtacacatattcggccgacaattcttccactggcctttcttttgatggcataatgccatttaagcgtcgattttttggcggaatgctctcaaacagaggcgccacaacagcaatgcgcaactgtttgctgttcgtgtccagtgctattggtggaaactttccatcaaacagcttaaaatagggttattaattttttatttattcaaaaaaatatt

SEQ ID NO: 2894 - DNA, 5037 bp, Heterodera glycines
agctgctggatttcatttcagtgtatgaagagggccttttaagaacgaaaaaaattgacaatttttgctgtcacgcccgcgcgccacgcgagcagggcagagccagcagcaacgtcattggccgcaaatgctgccacaatctgttgtaatatgtggtccatttaatttattggttaattttccgcgttgacattcaattggttccgggtgccctgctgagcatttggcagcgcgggcgacgtcgacgggtatggtgccggggaatgtctcggcgtgccaacgcgcttcctccctccctccgcccacccattcggcatggcatattcaaatgtggcacgccgaattacttccagataacaaatttttatatatgcacacacatgagtgagtgcaaaagatattataattttatgctgatgaattctgatgaaattattaaaaaaaaaaattacataaaattatattaaaaaaatttaatataaaaaaatatttattaccaataatttattgtgtttctgacgaatatagggattccctggttctggaatttgctttgcataaatagtggtagaaggtttagccgacatttgcggaccactattttggaattgaactatctaaaaacaaaatgaaataattttttttcaaaaattgtgtgacccaaaatagattttttttttaagcattaagacgaatgaaaatttagaaaaaatttttcaaaaatttcgtttttaagctcccttatggtgctaaatttttggtcacttaatttcatccttaaagaggatcaacttgatcaatccgtgctgagacgatgcgaaaaaaaactcagtgattgataaaataattaaatttaattatctattcattaaattcatgtaattattatacatataaattatattgaagtttttttttaaattataatattatttaaattttaaaaatgaataaaattttatttgctttgaggttatttttaatcaggaaaattataaaactgaataaattatggtttgtacgggtacggcttgcttaaggcctaacagcggattttacctgtataaatgaatcatagaaaatataattccttatacaatattgactgcaaaaaagacgtgtaagtgaaattttcgtatgggtatgatttttttttttgatcggagatagaatactgtaagcatacctttttttttgcattttccgcccatagatgaaaaaagatatttgtgcaaaaaatttttaaacaaaaattgctaatttttatataattcttttttcaatttatatcaatcagcatcaaagatagcctcgagcaagcactaattaagtatcagctttctgtcattaatttaattttttggaaatattgaaaattttaaaatggattcatatcataacattttttgacagttcagctgcaaatgtcggtccgcatatgtcggtcgcactacggataaaaggcaagctgccgtttattaaaattgttcaaaataggaaggataaacaaaataaccaacagaaaatagaaacaattcataaattcgatgcaattaaagaaaaattgaaacagaaaggaaaatatcaatgggaaaatagttcaaaaattgagacaaaaattggaaaattattaggcgcaaattgccaaaaatatacaaatggaaaaaagaattgatgccaaattataataaaagtaagtgaatttatttggaagttaatttaaattttattttgtaagcacaaaagaaatattccaatgaagagaaattaaaaatgttaaagaaatatttcctaatgaaagaagcaaatccaaaaattagcgacaaaataattgccatgaaattggcaatttcaagccgaactcttagaaagtggaagagggaatttgaataaatgttgatctagttatttttaagacccactattctcaaaaaatatttgctgattttttatgcctaaaatccctcaactattaattatgttgaattttttagattatctacagcatttttcttcaatttcaaattagaattcaattagcttaaaaattttattaatttttctgggatttatttatttttatttaattacaatttactggctttttcaggaattacctaatctatcggttaagattagggtagagcggtaatcggtaattgtaaaaaaaaaccggtaccggtaattttcgggttgaaaaactggtactttttggctgggaaaaccggtaaaaaaacaggcactagtaccggtaccggtcaaaaccggtactaggtactcagttgtaccgtttttttcagtaccagtaccggtaccgctctactctagtctctagcgtcactacagcacaaatgacttctaaattgatcgacatatttttggcattttgtcaaaacattcctttagctttttcgtttttgccttaatttaatgccaaatgaacaaaaaaaaaaaattgacaataatttttccacgaaaattcgacattatttttttcaaattcaattaaaattctgcataagatttccaattttgtaaaaaatatagttctcaataaataaaagtcaaaatctcaattttctggcaaagcatccgccttttctcttcacaaaaagggttctctttaaaacgtgaacctgaatgtttaaaaagtgcgcaataataaattaattatttccactaattaccctgtatacttggattggcataatggtgcttctgtaatatttgcttttggttacggtacattccacttttgccttcggtaaatcgcaaagtttgtacgagaggcacggtgaagggatagtgaagatgccatttgggtaattgttgatgaagcgggaacaatgccgaatggcgtcaaaataataatgccttttcggcatatggccaattatctaaagggcattttttcattttatttaacgaaatattaaattaatttcgtgtttttcattttgttaattttgtgcttctcaatgtttctgtaccttcattatcttcgtgtcgttcagaaaagcacttccgtttcccaattgtccatcaaaatttgttagcaatttgtcattgtaaccgtttgttgcgtttgctcggatctgtcacaaaaaagtccatcatttttaaaataatttcaaaacaattaaattattttttttaattacatcctttgaaaggtgcaaaattgccatatactcagtggacaattgcaccggtttgtctttccctttataatgacgcgttaaatgcacccaaaaggcatcaattagtggcggtctgagcacaagcttttcactgttgtacaattttttggtgaaaattaattcacgaaagttgttcacaaaatctgaaatatgaaactcatttaataataaattagaaattttaattcaataaatttcgaaagtttaaattttattggcataaaatcgtcaaaattaaagcggtattatgagaattaaacggagaatgtgaaaacttgaaaatatggtaatattaaagtataaccaaaaattattccacagaatggtattgaatttttacaaatgtttataacaaaattatcatcaaaatgcggattgccccttttacaggaatctcttataaatgccgtgtttcgtaaattcgagccccctcccctaaaatgaaaaataaagccctcagggctctattttagggaaatacggtatacagtatgatggtttttgttatttttccatttttctacaatatttgattttataaagaaaacaaacttcttgaagattcttttttgtgccgtggtaataaaatgccactttcgagtttatttatgtaaaagaatggtgccctcgggtgttggagaagggcggcatttaatgcgtcgccaaacgaagtaaattgtgtcgtgacaagcaaatcgtccaagtccaacaatgaaatgaatttggcactttctcgaaactcgtaaaagcattcgtgggccatggctaattgccccgaatattcaatttgcaattcgggatcaaaattcatcgctttcaaaattggtaatttgaatccctacaaaccggaaaggtaaataattgattaaaaacaaatttttattgatttttgtgcggaatataaaaaattaagaatttttttgcaaatgcatttaagatttgttgacaaattataaaaaagccctgaaaaagcctgctggtgtccgggtctggaccccggtcgggttcccgaaccccgtctaaccctagtttaacctctggaatcaaatttctttggatcttgctatatctgtgaacattaagttcttttgtttgcatatttattgtttacttaataaattcttgtatttcattttataattcctaaaattttttcaattttgatcagtttaaaccgaatggtgctataaaaatttttggaggcctgagaaaagcatcgtggagcctccaagtagaaaagtgttaaaacaaaatctttcagattttttgaaaacaatttaaaattggaatcattcgaaagccttgaaaaggagaagcttttaaaacatttttctctaccactgttgcaaaattgtgtattggatttaaaatctaggagaaaaaacgttaattcgaaaaaggaaatttctatttttttctattaactgagacaaagccgaaaaaatacgccaatgagatacgtatttttctctggcactatccctttttggttcatctctcgttttttgaaatcgatttttgttaattcagtcgaaaaaattaaatttcagaaatttcatttctgcccccaaaattgctcgtaccattctcactgcaagtcgcccttccgcctcgtacgctttgatcagtttgaacactgcactaagtgcggacacaatgtgcaacaccaccaaatcgacgccaagcgatttgtacacttccattgcggtgatcaaaagttgccatttttcaaacgcaaaaattcggctaacgcaaatgagaaagttgcgcggggtttggtcagattttcggataacaagctgaaaaaggagaaaataaaaaagaaagtgccaaaaat

SEQ ID NO: 2895 - DNA, 4196 bp, Heterodera glycines
cccggcactttgcgggacagcgacaatttcactttattggggaatcggtcactcatttgcattgtgtgattgactaattttgcagtttttgcttcagttggctgcgattgccgggacggacgcttcaaaaggtttatggatgtgtggagggacggggacacgatgaaaaggtgggccatggcaggacaaagctcaaaagaggcgccgcttggcctttgaggtgttcgtgggcatttaattcggacggaagcattgcacgcgcggacattagcacttacggtcaaaagacaaaatgccaaacatttttaatacaaaaaatgtcaacatttgtttagcttgcctcgacggttccgacgtttttccactgaacaaaataattcaacgggagggcggacaatatatgaaatgtgtgcaaatggacgcaccaatggcggacgatgggagtgccaaaggggcgacaaatggggaaacattggggtggcgcaatttgacggacagcgaactgatcgaaatgagcacaaaaaaggcaagcgaaggacggaagaaaagcgactgatttaaaaatgaaatggcattccaatacggcacagttagcaaaacaaaatttggtggaatatttcggagtcgggcggagggcggcgccgcttttggcacgcggcacaaaaacagtcgacggaaaggaaaaagggaaaggtgggtttttgccaccttccagtttattgaaaatcccctccagaaattcccttccaaagacaacccgcggactgtgccgactttctgcccttttgcccgcgtctctccggctattgccattttatgagcggccctttggagcgcggactcgtgttggatgcgttttcggagttgcgcgagttgcaaaagcgatttgatcagtttgggggcagtgaggacgagctgagtttgccgatgggatgcgaaagtaaaagtgatcggaattgtttcaaattgcggtcgtttttagaacagccgagcatcttccaaaagttgcaattgctcgtcgaattggcgtgccagcaaacgtgcaaaagatgtgccaacggtggggaaattggcacatacattttgaaatgaaaatgataaaacattttgaattggcagatgcccaaaaggaatcggcgttgacgagtctcgagagcacttcccattgcgggaaataaacgaatggacagagggggggggggggggggaatggcatcaaaagacatgttcaattaaaatcaatttatgccaatgttatcgtttattgcgcaccggtatcactctgatcagttttgatcacccggggcttcgatcattttcgttttgccctttttccgctgatcactctttccgtccgtcctttttccgctgatcactctttccgtccgtcctttttccgctgatcagtccgtccgccgtcctccctccctcagttttccctctcgatgtacaccgttttgtgccgtcgtcccccgtcccgttcgattttgaccacgcggtgccgtctccgttcgccgctctcttcgctgtcgtatttcctcagtttgtccagcaccttcagatggacccgcttcttcttcggatatccgtcttctcggtccacatccaccttcactttcggcactcgtacgtccacattcacttcccttcccctctctccgtccctttcgtattttacgacttttccctcattataatgccctcctcccacgtcgacgttcacatttttcctgtgcccctgcacattcacattgaccaatttgtcatttcggtctctttcttctccgccaacgtcgacgttcacattctttcgcgacggcgcgtgaatatttaccaggccgagcacgtccacgtccgtgttgcgtttctgcaaaatgccaaagagttttttgggcctttcattttgaggttggcatccatggcccatcatgcgtcccaattctctcgtaatggtctcctgtctttccctacttccccaattacttccctaattgcttccctaattcgtcccctaatcctcccctgattcatccatccctctcctctctcgcccccccacgcttttcacctttctcttcagttcatcgtcttctcttccttcgactgcgaaattgagcagaatcagctgaacagtgaagagacagaggaagaaggagcagttcattttatactcaaaaattgaattggatttccaattaatttttgagaatgtcgccaaaaagagggggccaacgctcttaaaaatggtcggccggggagggggcgttccgccaaattgcgcatccatcggcgagtgttcgccggatcgatcgctttgatcagtgattaattgttaaattggaacgcctctcgcaaatatttaccatttgattaattccaatggccccaattcacaaattcacatgagtgtcctccccccaatggttttgcagatgagtcattaattgttccaattccttccaaggcaaaataatttcactttaaactttttaaaaatttctcgcgtttctttttttatcgaaaacttcgcgaaaaatccgccgatggaattactcaccgaaatttacagcagcaccttttttggaacattcactttccaatcggtcggtcggttaatcaaaaagtgtcattttgcgaaaaatgcgaagggacggagagaaaaaaaggcaacgaaattaaataaattaaattaaaatgagcgatggtttggacagattttgcgcaaatagcgaagattggcgaacatttggcgccgcagacatttgcgccgcgacagttgcgccgcagacacttgcgccgcccagccaaaatgacacttgcgccgccgacatttgcgccgctgccatttgcgccgccgacacttgcgccgcgacagttgcgccgcagacacttgcgccgaccagccaaaatgacacttgcgccgccgacatttgcgccgctgccatttgcgccgccgacacttgcgccgcgacagttgcgccgcagacacttgcgccgaccagccaaaatgacacttgcgccgccgacatttgcgccgccccccccccaattttgattatttaaagcataattttctcaatcaattttaatgtttaaagttaatgtagcattcggaattaaaacttccattccaattacattttaaataaaattcaacattaggtaattatcaacaaattttactaaaactataaattaaacgcaaatgacaactaattaaaaaaacacaacaataaatcactaattacaaaggtaaacacttaattttttgtctttggtcaacgcatacagtaagagcaatgacaagttttttttcttcttcactgccgagagtagcaagaaataaaattatttttttaatgaactcaatttcaatttttccggcttttaaacacaattttgaatggtctgatcaattcggaataggttattaactagtgaattttatattaaacttaattagataaattttcggaaaatcccacttaaaattattatgtcagattcataaaggcaatgaaagatgaagaggaatatcaaaacaatcgtgttcggcttttcgaaattgatcagacaaggggcattgccgatcgaccacgtcttaaaaaatacatcgaaaatgactcagctattaggcaattggtaattgcttatgacgcgaaagaagaaaaaaatgacgatgatttgatccgacatattcatgcattgcaataccgtgtggggatgaagggattcgaaggatgggattagaatattgttgaaaatattaattttgttgcgttgttaaaaattagtatatgtttgtttcgcttatgtcaaaatagggggggggggcggcgcaaatgtcggcggcgcaagtgtcattttggctgggcggcgcaagtgtctgcggcgcaactgtcgcggcgcaagtgtcggcggcgcaaatggcagcggcgcaagtgtctgcggcgcaagtgtcgcggcgcaagtgtcggcggcgcaagtgtcactttggctgggcggcgcaagtgtctgcggcgcaactgtcgcggcgcaagtgtctgcggcgcaaatggcagcggcgcaagtgtctgcggcgcaagtgtcgcggcgcaagtgtcggcggcgcaagtgtcactttggctgggcggcgcaagtgtctgcggcgcaactgtcgcggcgcaagtgtctgcggcgcaaatgtcacatcacca

SEQ ID NO: 2896 - DNA, 4351 bp, Heterodera glycines
aaaaaagttataaggaaaaaacctccaaagtttttggtttttttgtaatttcatattataacttttttgaaaattgtctaagcgcgaagcaatagcttagaaatagcttctaaacatattaagctttcgaatgataccaagattgttagatttggttgacaatcaaaaaagttatagtcaaaaaactagtgctggcgccgaaacgccgcctactccgaattgatatgccaaaagatgaagtataatggatgaaaatgccaaaagatgatgtaggaaaaataccaaaaacggaaggaagaaagggcacaataaaaatttacaaaaaaaaataacaaaaatttctcaaaaattaaaattaaattttcgaaaaatttaagatttttattttttagactaattgtgaaaaatcattgtaattcataaagaaagaaaatttatgtataagaaaactgatatttggtatctcagttcatttgagattcgtgtaaaaattatttttaaataattatttttgaacatgaaaaaagtttttgacattttcgaatttatttaaatttttcgaaattgggaacgacaaattatttaaaataaaggattaataaaatttaaattggaggagatgaagcgcgcacacacacacaaagcatcaaaatggagctaattcatctgcggcgggcagaacaatggaagtgcgcgaaatttaggcaagaaacaaacaaaagttcaaattgatcgattcaatttttgtgctttcgtaaatcggcaaagcgatcggacagccggcgaaatgatcgatcagccgacgacgccgcgggcggagaaaattggcgaaggtcgtcgcgcgacaattacaacacacacagattttgtggagctgagaatgagaatggtaagcatgaatgacgacgacagagcacaaaatataaattaaaattatttaaaaatgggaaaattattacagtcgataaataaaaataataaaaataaataaataaatatttagcaaaaataaaattttatgaaaattggaataagtagtcgataaataaataaatattaattattgtaaaaaaaagaaatatttagcaaaacgttaaaatataattaaaaatgaatttaaaaatgggaataaatgacagacgataaataaataaacaattaaaaaaattaattatttaattaaataaataaataaaaattaataaacaataatataaataaaataaaaaaataaattattaaacaaataaatataaatgaataattataaataaaataaaataaaaaaagaaatgaatgaatagagttttcgtgattttagtcttttgaacttttttcagtattttttaaatttacatttttctcttttaagcacctaaaaatccgatcaccgcaaaattaatgtaagttcaatcaagtgagcctccggatgtttgccaacttatgctgctgatccgtcgcgccaacaattaattaattaattagaaaagaaatgtttgctcaaaatccataaataatgttttattgttggatttagccttttcgtagtattttttttggattatttaattctttttttcatgcttaatcttcttttgtcaataaatttgggtgctttatgagcttaaaagtctcttggattaggaaacccacggctttcaaatatcattatttgtaagaattttctttaatttcaactactcgaccaaatttttgaaattttattggcttccggcattgccggactcagaaattttactaaaccaaatttaccaaaatgtaaaactgatcccctccctgccctccaaaaattattttttgaataatgagctaaaaaatttagtgacaccgaaaggcagaaaaaaaaaattcgttccctcatttaggagaaatgtttatgaaaatcttattttttgagtcaaaataattagattttaagacttttaaaagaaaaataatccatttttgccaatttcggggtttttgttccgcacattttggcattttcttttccatacaaacaaacagttgcccttttaaaagaaaaccgtagaatcaattctaaatttaaaaacctaaatttttttttgcactttttgacattttttggtgaaatttgattcatttttttgtgcgtgcccttcggcgggagaccgaccgcggcaccttttgtgtgccatggtgagaaaaaatagggcgtatggcccggcaccgccgccggcgccgccaaaattggatttgaatttgcttttggcgcctatttgtggcgatgtgtcgtcaatatttgccatcaaattctaccaccatcattcgcacaaccatcaacagttaaatattgatgaattttgtgtgggaattttctcgcttttccattgtctgttaaggcgagacattataaatttatatttttcaaaatttgcattactgtagcgacactatgccaagaaaaaaaattcgccattttttatgtaacataaacatattttcttggtctgaatggagcaacaatttgaagttttcgagtggtcccctttactgtattctaattcatactgtagaaattttcggccattggaaatcaataaagcccggattttttgtggcaaaaattcccaaaatacataattaactaaatagtgacaaaaaatgccaaaatagtggcaaatagtggcgaaaagtccataatgacataatttccagcaaaaatttagcaaaaaaaatttttcgacgcctccgaggaattatgaaccataatgcgggaatctcgacgttcattcgatattgttggcttacatagcactcgccgggtgcccgtcaattttgcatttttttttttattttcaaatttaaacccatgccaaatgcaaacatataaaaaatgccgacgacagcgaccggcgcgggcgcggcacaaccgcaacaacaacaacatttccgatccctgccaaattctgtgacgtctgacgtcgtcgcctcccaagccgcccattccgacgaaagatgccatttttagagccatttcaattaaattaatttgaattgttaaaccgtcgcttcccccccccctggccccgaaaatgtggcactttgcccttcccctaataacataaattaatgcgccgacggtgcttctgcccttttgatgaagtgccaccgccgccgcttttcccgaccaaaataaatgacagccgcttcttctccttccagccggccgttccccgtcagatcccttcccgcgccgtaggggggcaggagtgaagcgtttgttggcttaatgaatgacttttttacttccgggaacggcacggcatacacacacacatttttcattttgccgccccgcccccctcctcccccccccattatttttgggtccgtgtgccatcccttttcttgctcaaggcaatgtgccgggacagggggggggggggggggtgcttcttatgaactttccgctcccacattattcattcattcatttgtttctttatgtcactcgccccggaccgggggtgccgggccacaataagccattcgttgtgccgcacaattaatccgccgccccatttttggagggtgcttctgccctccggcgacgacgcggggcggacggacttttaatttttttttgtgacggtcgaaatccccgagattagccatttttctatcctcggtacaaagtcacatttcgtgctcgagccatcttttgaattgaaaacaaaaggccaaatgctcaattggcacccattgtgtaaaatccgtaggtagtggggccattggcataatgttgcattcaaatttccttatttgtgccctctaaatggctcccggacaatgcgtcaatggacaatccgtaagtgaacaatccattagcaaattttattttaaaacccaaaattttatataaaattagaataggaatttaaattgaaaaaaacttaataaataataatttgattttattttataaaaggaatgaataagcatttcaaaaaaacgataattactaattactatagaatgatggattaaattgattaatactggaaatgttgtaaactcatccgatttttcaaaattaaattgaataatctcaatcgaaaaattttagccattaaaatgtaccgaaaagagtgccaacggggacgagaactgcagattattggtcaatcattgattgggtggcaggcattaaatggcactaatttggcttaattcgaatcctcaaaatcaatcaagcaatcctcgaaaaacaatcgtacttttgccgctagccccctccacgcggggcactccgttccgcccgcccataaaggacccctcgggggacgtcggcggaggcccgggcggg

SEQ ID NO: 2897 - DNA, 1874 bp, Heterodera glycines
cccccccctccgggcggcttttcccccggagggcagcgattgatgacgaacaaaagtcccccctccccccgggcggggaaagtgatggcttttcaagttttgtccagtgttgagctgctcagagccgtcatccgttggatttggcggttctgtgatgtgctcagcaaatgaaagcaaaaaaaagaagcaaatcaatgccgggccatccccaaaaatcccaccaaaatccgccgcccaatcaatcattgtcttatccaggccaaatgattcagactggggataaacacaaacgtgatctgcccaactgaaaaaatgagccattgtttagaaaaaaccgcaaaaaatgaaaaattaaaaaaaaactaaaaattatattttaggcatttgaaaatagaacggaacggaaaaaacgtaattttttcgaccagattccaaaaatcgaagctctcgactttggggctttccgaaaacccctaaatttccccaaaatcgaggcctaattatttttttaaataaaactaaatgtatcaaaaatttcccgaaattttccaaaaaaacagcctgaaattctgtccccaaaacgaaattgtcaccacctcacaacaaaaaatgacgcaaaaaaccgtcgtattaatagatgccaattagcatcaccccagccagcatgtgtcattttaatcatttctttaaacaaaaattttttttgtcattgtgccaattttgaattttctcgtgccaacattgcaattttgatgccatttcacttgagatgccaattacaaattacctcagcttccacccattgtgggtgggtgaagcatttgtgccaagtgcaacttctttacgggcacgcaatgcgaaattatattacaaaattaaaaattcaaatttaattaacgtgtcgtaccaaatgccatggcattctcattcattcattcctttgtctgacatctgtcacttaaaattcgttcaaattactgctgacagccgttcaattcaggcacaaaatgtgaaaagcatactgtacaaattgaaattggcaaaatgaggaacttttaagccgacaaaagacggctacggcgacaacaaaaagagcacacatctcattaatacaaattagaaatgaatttttaattgggcaaaattgaattttgttttcaaattattgccagccgttccaccgatataaaaagcttctgtgccaacagttttataaggcatttggggcatggcacttttggggattgggacgggaaaggtcaaagtgtgggtgattcgggtacaattttggcccagatttaaaccggggatcgcctgaaggtcgggggagggagttcggggatagtgattaaagaaatcttgacattaccccttttcctgcctcacattccccgttccccgctttccactctcggttcccccgcttttccattctcccgttttccttcccgcttttccattcccggttccccgcttttccattcccccggtttcccacttttccattcacttcccccgcctcccattccccgttcccccgcttttccattcccccgttcccccgcttttcattcacttcacccgcctcccattccccgttcccccgcttttccattcccccgttcccccgcttttcattcacttcccccgcctcccattccccgttcccccgcttttccattccccgttcccccgcttttctattcacttcccccgcctcccattccccgttcccccgcttttccattccccgttcccctcccccgtcttcgattccccgtccccccgctttccattctccgctctcccgctttccaatttattgcgctattgtatgtatatatatgtcaccccatccatcccatcgacctgca

SEQ ID NO: 2898 - DNA, 6613 bp, Heterodera glycines
  misc_feature (64)..(64): n is a, c, g, or t
gtaaattatgccataaaaataataatttagcaaattatgccaaaattattaaaaataataattntggtaaattatgccataaaaataataatttatcaaatatggcaaaattattaaaaataataatttagtaaattataccataaaaataataatttatcaaatatggcaaaattattaaaaataataattttgtaaattatgccataaaaataataatttagcaaattatgccaaaattattaaaaataataatttagcaaattatgccaaaattattaaaaataataatttggtaaattatgccaaaattattaaaaataataatttggtaaattatgccaaaattattaaaaataataatttggtaaattatgccataaaaataataattttgcaaattatgccaaattattaaaaaaataatttggcaaattatgccaaaattttaaaaataatcattttgtattatgccaaaattattaaaaataataactttgtaaataaagcaaataaaaataataatttagcaaattatgccaaaattattattattattatttttggttttagaaccctcaagcgaaattgctggtggccggctcttttcagttgggcgtactcactgaacattcggacatcgatgccatttgtgtgggacccgcttttttggaatttcacttttttgggagtgaaaagtgtgaaattcaccggagcagaaggagttgcccggactggtcactttattgccggctttgtctggtcggcacttttactaatggcgacattaattatcattcttcgaagcaaaaattaaaatttagcatttatcaaaaatcttagagctcgacattttgaaaaaagcctagacctagactccatgttggacctggatttcctggacgaaaacccaggaaaacccaagtccatgaaaaatccaggctcctcgagacctggatccaggtctggacctgtattttttgaaactcattttaaaaatcaaaaaatatttcaaaaaaatcaataattgcttgggaacaaataaatatattatttacaataataatttgtttttaatatatttaatcattttttgaaaacttgaaaaaaagatcggtcatttgaaataataaattctaaaattttacccaggaaatccatgtatttttgtgttttgcctggacctggattttttttcacatttgacctggacctggatttcatgacaaaaacccaggaaatccaggtttcgaaaaatggcctggacctggatacaaaaaaatccaggcctggacccaggtccaggtcgagctctagctaattcttatttaaatttgccctttagctgcaaaatgtgaatgtgagcacaattcggagcatcgaagatgctttggtgccgttgatcaagttcactttccaatttgatcaaaacactccgatcgatttcgacattggtctcgtcacttttgatccgaatgagcaaatattcaaatcaaaaatgccattaaaatacgagcaaagcaacgcattgtcagcaaaaattgccaaagaaattggcgagttatctgaacagagaaaacatttcggaggaggagaagttggagagaaaaacattgatgagaagctgaagaagaagctcagatcactttcaagtgggcgacattttttaattaaaggaaaataagaaaattttattaaattaatattcttactaaatggtatataacagctatgcatttttcgacttacagttcgggtggtttccttgtataagacccaacctcctgagattttcatattcgctgttgacaataagctatatagagtttaatttttttctttttttaggtttcgaattcagctcaataattttaaagcgaattttggccactgaaaatacagaaaatggaaacggaaacattttacaaatctatcgcacttttttactgatgatcaaattttgggcaagaggtaataatttaattttcacagaaagtaataataaattaacaattcttttgccattggcactttcagagcatcacatttatgacaacaaattgggcttcttcaatggcattagtctctcccttttggtggctaaagtgatgcttctttacccaatggcatcacttccttttttcattgaaaagttcttcttcaccttctccacatggtcattttgttttaataatttatttttttaaaaatttttaataaaattaattgccaattattttttgaaattttaaatgtataaattattctatgcatttttttaggccttggccaaccccggtaaagctgacagatttgccaagcttgtccattcttcgctggaacgcatccgatgagagtgacaaacggggggtaatttactcgagacggggcctaatgcccggactgacaatgccaattgtcacgccgggacatattgaacaaaatgccactttcaatgtgaaccgatccaccgcaacaatcattcgcgggaattgcaaaacggtgaatggaaagtcgggacggaattagccgcgggagagaaatttgttatcggaaatccgggatatatgtaaaagccgagaccgggagcagcagtcaaacccatatccctcacaaatcagttttgtataaacaatgaaaaacaattatttatttttagctattaaaatcattcgaaattggccgatggatttgcaaaattttgccaaattcttctttattcggtacgccttctcaatggtcgcgtcaaattgatgaaaaagcattgagtttaatctctgaatccactcatctcccactgttgcgattttatcgtccaattcaagcccaattagccaaattttttgataatgttcactttaattaaatttaatattatccaaataattgaatttttacacgatttgctatttgtgaaattcggttttttggagagtgactttttggattagtccgacttagagaagggaccataaatgtacggtccccaaaatgtttggtaccctttgtgtgtagtgtatccccaaatgtgtgccgatttcgtgccgttcagtttttgtttctcagtaagcgaattctaacgattttcagataaaaaattggaacatcccagtaatatagttgaagccgttcacccaccaaccaccgcttaaaatagtgccaatttcaatttgtgccatcccaccgttacctttttgacactggaaatgcttcattttcatcgcccttttcattctctcccaaaatttgtcccttttcaacgatttgcttcgcatggcccaatcgaatgcgatcaaatcgttcgacatcgatcagcaattggagacgaattcgcgtctccacgtagcctcaaaagtcgtaaaagtcggccaaagcgaaggctttgcaattaatgcgaatgaaatgggaaaactgcgaaaaatatttgaaattttaatttgtagaaatattatttttttaaattactttttcttcgaactttttatcttttaacagattttcccatttttcttcttgcaaattttgcaaatccatcggccaatttcgaatgattttaatagctaaaaataaataattgttttttattgtttatacaaaactgatttgtgagggatatgggtttgactgctgctcccggtctcggcttttacatatatcccggatttccgataacaaatttctctcccgcggctaattccgtcccgactttccattcaccgttttgcaattcccgccgaatatccgcgccgagaaattcattcacttttcgcgccgcaggcgccgctttttcgccttttttaaattgctggtgtaatagcttatgtgcgtgctccttattagcgttcatttttttagctataaaaaatttgcaaattgagatatgaacaaaatcaatatactattttgtagacaacaattagcttaacaaaacggtatataaaacattttattatgttaacaacaaaattttttataagccattataaaaaagcgcccttttttatgcaacgacctagtaccccccgtttgtcactctcatcggatgcgttccagcgaagaatggacaagcttggcaaatctgtcagctttaccggggttggccaaggcctaaaaaaatgcatagaataatttatacatttaaaattcaaaaaataattggcaattaattttattaaaatttttaaaaaataaattattaaaacaaaatgaccatgtggagaaggtgaagaagaacttttcaatgaaaaaaggaagtgatgccattgggtaaagaagcatcactttagccaccaaaagggagagactaatgccattgaagaagcccaatttgttgtcataaatgtgatgctctgaaagtgccaatggcaaaagaattgttaatttattattactttctgtgaaaattaaattattacctcttgcccaaaatttgatcatcagtaaaaaagtgcgatagatttgtaaaatgtttccgtttccattttctgtattttcagtggccaaaattcgctttaaaattattgagctgacttcgaaacctaaaaaaagaaaaaaattaaactctatatagcttattgtcaacagcgaatatgaaaatctcaggaggttgggtcttatacaaggaaaccacccgaactgtaagtcgaaaagtgcatagctgttatataccatttagtaagaatattaatttaataaaattttcttattttcctttaattaaaaaatgtcgcccacttgaaagtgatctgagcttcttcttcagcttctcatcaatgtttttctctccaacttctcctcctccgaaatgttttctctgttcagataactcgccaatttctttggcaatttttgctgacaatgcgttgctttgctcgtattttaatggcatttttgatttgaatatttgctcattcggatcaaaagtgacgagaccaatgtcgaaatcgatcggagtgttttgatcaaattggaaagtgaacttgatcaacggcaccaaagcatcttcgatgctccgaattgtgctcacattcacattttgcagctaaagggcaaatttaaataagaattagctagagctcgacctggacctgggtccaggcctggatttttttgtatccaggtccaggccatttttcgaaacctggatttcctgggtttttgtcatgaaatccaggtccaggtcaaatgtgaaaaaaaatccaggtccaggcaaaacacaaaaatacatggatttcctgggtaaaattttagaatttattatttcaaatgaccgatctttttttcaagttttcaaaaaatgattaaatatattaaaaacaaattattattgtaaataatatatttatttgttcccaagcaattattgatttttttgaaatattttttgatttttaaaatgagtttcaaaaaatacaggtccagacctggatccaggtctcgaggagcctggatttttcctggacttgggttttcctgggttttcgtccaggaaatccaggtccaacatggagtctaggtctaggcttttttcaaaatgtcgagctctaagaattaccaaaaataaataaatatttttgataaatgctaaattttaatttttgcttcgaagaatgataattaatgtcgccattattaaaagtgccgaccagacaaagccggcaataaagtgaccagtccgggcaactccttctgctccggtgaatttcacacttttcactcccaaaaaagtgaaattccaaaaaagcgggtcccacacaaatggcatcgatgtctttggcataatttgctaaattattatttttatggcataatttacaaaattattatttttaataattttggcataatttaccaaattattatttttaatagttttgccatatttgataaattattatttttaatagttttgccatatttgataaattattattttttaatagttttgctatatttgataaattattatttttaatagttttgccatatttgataaattattattttttaattaatttacccattctttcaccactcgttcaattctttcaattgccaggtcaattttcaattttctttcattttcaaccattccaaaaccattttttgacaaaaattctgtcaactaaatttaaatttaattaaatttagaaacaaaaaactatttatcatcaaccatttttattgttgcgctatcattttcaaccaaatttgttcgcccagtaaataatttaatttcttgcaaatgcaaagatattccaaaatttcctaaaatttggtcttctgtttttgtaaactttgacatttcgttgtacaatttttgatctaaataggaagttcaattcatttttattttggcatttaccctgctcaatttgtttggtcattagcaaaaagtggccgaaaaactcattaaatttctccaattcaaattcgtttctaaaaaatgccgtcatcagcagtttttctcgctcttcgtcattcaatttaataagccatgctttgtcgcacaaaagctctaattgtctcaaactggtcctcctaaattgcaaatttttcaccattttgcctattttctctctctccgataaaagtgccaatgccatttttccga

SEQ ID NO: 2899 - DNA, 2180 bp, Heterodera glycines
ttaccaaaaataaataaatatttttgataaatgctaaattttaatttttgcttcgaagaatgataattaatgtcgccattattaaaagtgccgaccagacaaagccggcaataaagtgaccagtccgggcaactccttctgctccggtgaatttcacacttttcactcccaaaaaagtgaaattccaaaaaattcctaaattgattaaaacatgctaaatttggtcacaaaccattggaatatcaaagaatggtcattctgtacagctacgaacataaaagtgaattttcaaaattttgagttttcgactttttttcgaattcgggtccgggatcccgaattggttgaaatggatgccatattcgtaatcagcgaccctgaaaacccccataaacatgtttccaagacttttcagaacaaaaaaaaacccatagaaaagttagaaactacaaagaaatgttgggcaccttggcatttatgctttttcttttcttttttcttattttacctccaagaaagaacacaaagtcccaaaaagcgttggcgcccccgccgaaattgccctgctgctgttgcgaaagagcgtccgttttttcgccggcggaattcgacggaccaaccacaatttgcctcacatcttttggaaagtgaaaaggtcgaagaattaaaagcggaactgatcaaaacggacagatctgctgttcaactcattgtcagttaccagaaggattgaccggcggcggaagcggcggcgcactttcattggccattttttgctgcaattccaacagtttctggcactttcccttcgcttaccgccttttcggttggcatttcgtcgtgcgaatgcgcagcggtgccccgcttctcctcctcccctcccccgccgttgtgcttttcctcctcctccgcttcttccggtgccgtgttgcagtggtggctgtcgcaaaggttgcacccgccgtgtccgttcagcgactggcactgcgcattaaagcgctcgcaagtcgtactcgccgttgaacacgcagtggtgataggccaaataggcatggcgactgtctgtggacgaaaagcattgccaagcgccgcagaaatcgccggccgattttgttggactgaccgacacggcacgtcgcattcagacacatggaccacgcataggaaatgcagctgatgttccgcttctcctccgtggcccgcagagttccgctcacgtcgttgatcaaatcgtacagctcaatttcccatggacccgcgtggatgaacgaggaggagcacttgaggaaatggttgaagaacccttggaaaatgggggaaattgagcaaaaaacggggaaagacccaaaagtggtgggaaaagcgagaaggaaagggcgaaaagcattggaaaaagcattttactaaattattggaattttggaatgattaaaaatgggggaaaatgaagcaaatgaaataaagtgaaagcaaagcaaaggcaaatgattcaccaaatcatccgatggaatccatccaatcatattaatatgcacaaattggcaaaaaacaaatcagataacgaaccggacaaaccatcggtgaatcatttcaaagaatggagagaaaagtcaatcgcatcaaattgaattccccgggggcaaaaatagtcaaaaatgaagaattattgtacgagtctcacgggagacacaatttgtcactgtcaaatttgatggcattatcctttaattaagattaagcttccgatgtttttatctttaagagtcctctgccaacaatcgttattttaactgattatgcgaacaacaaaaaaaatgaagcaattaattggagaataatgggcaaagaagaaaaaggaaaagcattgcaaattaaacggtaattttcccgtcaatcagcgcatttccgctgggctcttccgtcccgcattttccgacacggatggcccctccggcaaatggacttcgccaattcgccccaacagccaaaatgtctccatcacacctttgccctaatgaattaatcaggcaatttattaacaaaaattccccccccccctaattacctttataatcacttcgccccttggctccgtcacatatcctccgattacgctggtcaagaagcgattggaactagaaaaaatgtgaattttgccggctaaaatgggaaatgaattt

SEQ ID NO: 2900 - DNA, 4932 bp, Heterodera glycines
  misc_feature (4845)..(4845): n is a, c, g, or t
  misc_feature (4851)..(4851): n is a, c, g, or t
tagtgagtaaaaatcccaaaatagtgacaaaaagtccgaaatagtgacataattttcagccaaaattttgcaaaatccgtcgtacctcagcacaaaaaatgcaattaaattgcggctgacagcgattcggcactccgtccaattgcgccagctgaaattttaattaatacacaaaaagtgcaaaaaggaaaagcaattggacaaacaaagcacaaccaaggcgaaggaaaagcaaagaaaagggaaacattcgaaaatagaaaaaagaggtgaaaaagaacaaaagaatagaaagaaaaggaaggcattgcaaaaggaaccaatgccaaagcgaaaattgggacaaaattcatctaaaagggatccatccccccttttcgtcggttatttatccatcttcccctattctttttattattaattgctatgaaagttcgtttgtaatttcactttctttttagcctattccttagacttttaatggcaaaaataaattttaaaaaacatataaaaaagaaaatatttacagaaaaaaattattatcttttttcaccaaaatcaaaatttatccgaattgaaaaagcaaaaattatgagacgaataaaactaaaggaaaagcggcaaaagcaaaaattgaggaggaggagactaatgtaaatacaataatgctatttaatttgggcgattctaacgcttactggcgattccgatcatcacttcggccatcttcgcgccctgaaagttaaatataaaatgccatttgaaacggacaaattcaaatggccaagagtaataatgaaacactttctgcccctccccccaccataagtgccggcgagtcgaccacgtgaacgccggcggtgcgcagcgcctcaattttctctcgcgcgccgccctttccgcccgcaataattgcaccggcgtggcccatccgacgacctaacaaatattaaaaaacaacgaaaaagaaacggacgacctttcggcgccgttactcccgcgataaacgaaaccaccggcttcgcctcgctccctctgttgttctcctccaaaaatttggccgcattttcttccgcgtctccgccaatttcgccgatcataattatgcccttaaatccattttaaaacagaacaataaaaatgagttgccttcgtgtccgggtcatttataaacacctgaaaatcaaaattttaatggattatacggaaaaaggcaaaacacatcaagacagtcaatgaagttggtgccgttgaatgggtcgccaccaatgcccacgcacaaagtttggccaaggcccgtctcagtggtctgttgaacggcctgaggaaggaaaaatgagtgcctaacaaagccaattccaaggaaacatggaaattgaagccaaccaaatccatgaaaagggagggggtcaacacacaaatgtacctcataagtgagtgtgcccgatcgcgaaacgatgccaataacgccttttttgtggatgtgacccggcattatgccaattttgcattcgccaggcgcaatgattcccggacaattggggccgagcagccgagtccgattctgcttcagaagacggttcttgacacggaccatgtcctaaggttgggggaggaagggtaaatgccgaaagaaaaggcaaaactcgccaattgggggattccctcggtgatgcacacaaccaaagggatttcggcgtcgatcgcttcgtcgatggcagccgcggcaaagggcgctgaatttggacgcattcattaaaagcgaagcgatcaaacatttacccggcacataaatcactgaagcgtcggcaccagttttttcccgggcatcctattcaaagcaaattaaaaactgacaatgattgtcataggagaacggcaaacaaaatatccatttagaattcctttcttgacaaaagcgggttttgcggtaaatttcttaattcagtgcaaacaaactttgactgttgcaaatatcggctttcccaagtgctcagtgcccgcttttgagggcgacacaccggccacaacattcgtgccgtactcaatcatttgctggccgtggaaagtgccctgtttgccggtaaagccttggacgaccacctgaaattgcatttggtgagcgtggtaaaacccattgagatgtttaataaccttcgtgttttggttgatttttagattttgtcgcgtcgaagtataaaagcgaatcgaagtggcaaaagccaacagtggcgaacgaagagacgacattttgggaacagaaaaatgaacggacccacagacattaattaaccaatcacagaacaaatgaagataaataaaatatatgtattcccattataataaaatggaacatttttggtcataatgaataaatttcttatgaaaaatttgggaaaaagttagacgcattttgacgagtgtttataattctccgtcatcaatctcgtggtaagcgtcgttcccttccgctgccatttgcgtcgtgtcgccccgttcctccgcctcaaaatattcctccatcagtctgactttgtgctcaattattctttctgcttggtcgcgctcttcgcaccccttaaaaggataacattttgttaccatacataatatcataatttgggggtcacctccaatgcctcgttcaaatgattcacacattttttgagtgccgacatcactggacgcgcgtcgtacacattttccagccgatatcgaagttcgttcagcaaagaggccgtttcgttaaggaccacggcactcagctgagaagcgcacaggtggagactgaggcagcgaagaaacatctgaaaagtgaaggggaaaagcgacttgatgagtttgggtggtcacctgaatgatggagaaggaaggagtgcgctcgttgaggacagttgcgaaccatttcatttcattgtacaaaattcgatctgtcagggataacccccgctctgcttcatttacaccaatttcttcgccttgactgttgcgacgaggttgctgaatgataaataatgaaaaaaacagatattttaagcacaaaaaacaaaacgccaaattaaataaattaagaaagccgtgtttaatgctcactcacttcaattctcttagtgatcagtgccacgatgttgaacgtttcataggcacaaatcagtgttcggggatcaaattttgtttcccacccattgttcattaacagttcgccaaatttgcatcggatgacgcacagagactcaaaaaatccttccaaatgtatgccaaaattattcttgagacatgtgcatgattgtgggcaggccaacagaatttggatgagttctaatggacgaaaaaaatccacaagtccttctccaaaacgagcgcgctttgctcgtggtgagtcgatagaggacgtactgaggaaggacgaaggcaaagctgaaatataaaccaaaatgcatttatgtgtgaaaaaacagttaatttaattagaataatttgtatcgactttaatcatccatatttaccgacatactgtaggccgatcatatttgttataaactccacagaaataaaaatttttggaaaaacttacaggaatatgatatagaaaaatgccaggcaaaaaagcatcaggaaatgcagcgccctttcacaaaatttcggtttacccagcctttgtacaagaaacacacttttgttattcatcgtccctcgcctacgccgcggggtcgagcagttcgggtcgcacaccgccacaaccgcattccgcaatcgttgcaatgccagttcgataatgttgattagtttactcatgtcccaagcggccaaagcttcaacgaagtgggcaaagtagacattgtccgtcggttccgtctccaatttggcacgaattcgaccaaacatacgaccgattttgtccttgggcaaattgctggcaattgtcaatgcggaatccattagcaaagtttccttaaaaaaagtcaaaggtgaaaccacaaagaaaaccaccgaaaatttgtcgagttcccgcagaatgctggccataatcttagtaagcgcagcattttcagtggcatatttagtgcctaacatgtcgggatggatgatgacccacaaaaggatggccgagtcgagcacattcttcagaaccagcagcttttcttctgaagaactcacattatatgtaaacccaataacatgacctgtctcgccctctaattgttctgccagaaatgtggatgcccctgtgatgttcatcgtcatgttgtccgttgtttcgtccgcactactctccgccccgcggcattggcgcaatgctttccgcacgccaatcaccaaaatttgaatatgcagaactaaaggcattcaaatcaacaagtgcacgattcaaatgtttggcactcgcctgcctcgctgatgggcataagcccgagtgggtagaccaaccggtggaagtgcagcgaggcaagtcgcgaatgtttacacataaaataaatgcgtttgaatcgtccagagaaattgtcattgaaacggtcgatgtgatgtttcatcgcctccaccagccgaggacacaatgtggcgaagagacagcgaacaatttgagcctgaatctgcgcagacggctcataatcgaggcgcaagaaacaatccggcaaagtgataaggtcattgagctgaaggaaaacgagtcaaaagagggtactaagaaagtttctccaaaataaaaatcttctgttccgactttgatgtaacgatgcccgttcaatttgttaagcattttgaaggctgacaatcgaacacgctccgaacgatcgttggcaccccttttggcgagaattccagaggaacgtgggtggaattaanggcggncgggcatggcaacaaatggtcaaagccttcgtagacagccgcacgcacttcgggcaccgagtcgagcgacagctggtcgac

SEQ ID NO: 2901 - DNA, 2396 bp, Heterodera glycines
caaaagtaattttgtaagaaaattttaattttttttttctgtcgggccaacaattcggaaggattaccaataaaagaatttaataaattttaacctaatatattttttgcgaatcaaaaggctcaccccaatttggtttttcatcgtcccatttaaactgcaaaagtgccaaaccgccgctctgattggcattaagccattgacccatcccaccaactttctccagaagcaacttgatcagttcgcgcggaaacatgtcccaatgagcgctcaggtgctccggcacctttttggccgccatcacgcgaatcggcaaacagtcgtccatcagcataatttgtaatgcattctgttggcgagcgatgtactcttcacgaatctgccagaaagaactaataagcctaacaataagtaaaaaaagaacaaacgaattcttcgtcggaaataagtgggaagaatttcagcaaaattgccgaagctgcaagacggacatcctcatttggcaccttgggatgaggattgcagaagtaataattttcattaaacctccaaatttcgccaaagtactggcattgtgacgcgaaaaagcaccgcttttaagcgtttggtttgtttttctttgtctgataatgcatcggtgatctataaattgatttccacaatgctcatcaatctctgattgcgaactttatacccaagcaaatcgttgtgaaaaaggacgagccgtcattaccgcaacatagaaaaggtcttccaagatttcgttttcgatcagtgcccgcctcgcctctcctcggtcttctgcactcactttggccgcatttttccaggctcgcaaaatcgtgaggccccacttggaacagcttttgctaaaaccaagaaaatagaaaacctaaacatttcacacctgtccggcgcattgatcagcaccgctttcttcactgcctcccaaaattctgagcactcgactttgccagagagaaagcccaactcatcgacttcatttggagtgccgtctatgcttgctttttgttggtgaagtccttttttgagacgcatcggttacttttttgataatatataaatttgatttcaagtgaattaataaaagacaaacgactgaaattaaattaatttagatcgaactgccggtaatagggttccagagctttttgagttcaattcattctatgaatccacataaaattaatgagttcaatcaactaacaagcctttgcttcatggactatttttttccattttggtaattcgaaaactgtcaatctaaagaaataaaaatggattccgcgttttcgaaactgccaaaaaaagtcatgcttaattaattaattaacaacagaacaacactgattcactgataaaagccgtgtgaacaagaaaacatttgaatcatttttattaattacgcgaaagaatggcaaaatgtttatagtaaataaaaataaactgatcgatcaaaacagcaaaaaacagattcataattctttttcgataaattgttaaatttatttcattttttttcaatagccgggtggcgtccgcggcggtggacaatggaaacaatcgccggaagtgccctttaagcccggcgtgccattcgttcccttttaaaaatgccatttcttctctgataattaaatttcttgcttgtttcacctgttgccctcgtcgtccgtctttccccggtctaaacaaagcaaatgtttttcttgggaattcgctgagttttccttttcccacctccccgcgtcccccggcggtcctttgactccctggacggtaatgcccggcaccccttggcagccgggcaatcccttgggccctttggggcccggctttcccggtgagcctcgtggcccttccgtgatgaactgacgaccaggaattccaggtggaccttaaagaatgaaattctgacattacacaatgtcggaattaccttgcggccccactgggccaatgtttccgattggaccgggcgatccttccatcccaggctcaccgcgcttgcctgaaaatggttgccaaattttgaactcttttgatgcccaccatcaattccgctgtttccgttggcaccccttggcccgggcggtccccttgggccctgagggccagctgggccggccgaaccctgcggacagatcacgcaaggctctttaactggcacatcgtgtgcaattatcttaatatacaaatgaattaaaaagctaaacttctcattaaaaggtttaattttgaacctcccctgatcggccttcctgcccggaggctccgggcagtccatcgcttccgttttcgcctaaactgacaattattttgatattgcatgcctttcactaatatccgttttcatgcttctcttttcccttttt

SEQ ID NO: 2902 - DNA, 4191 bp, Heterodera glycines
aacgcagagaatggccaaacgacgggcatagcttaacccctccaccggcaaaagtggccgaagggaattggaaaagcaaagcattgacaaagcaatgaacaggtcgagagtctcggcccgagaaaagtctcgggaaatcgtcggttctcgaactatacattaaaagacactcgaaaagtgaagttttcaaaaattcccggttaaagaaaccaacgaaaaggggaagaaattccgaaacaaaagattactaattattaattaattaattaattaattaattttttctttgtcaaaaagggcaaaaaagaatgaagaatacaaaacattatgtaattaaaaggcccactcgatttccttctgcttttcctccctttcgctgttcgatcggtcggccaatttgaaagagtcttcgcttttggctgctgcttttggcaggaaatgcatttccttacgtaagtaatgagtttaaatgtaattcccatgggtttcgattcaatttatacgcaattttcgcctaaatttgcctctcgatgaaaagggcgcacagaaaaactggatttatctgctctatggaattcagcaaaattcccaaatttaaatattttcaaccgatccaatcgctcatcggcaaaaccttcgctttcgctgaaccggtctttgaattgggtgggaaggcagaagaaaattacattttcaaatcaaattcccgcctaaagaaagtgaaaagaaagggtcaaagaagcgaaaaacggcggaaggaatggcattttgagcagagaatggcattggcattgtttgccatctttcagttttgaattcattctcattgggcctttttggcttttccgtgccaatcctccccccacccaatttccgccaaatccctccaatggattcgcccgttcgatacctaaaatgggccaatggcggcacctcggcgtaaaactgtggcaaaatcgtcgcaactgaagaaaaaacaaaatgtggacacattttcgggcaaggatcaaacgaatgttgaaatgtgtcttctgtttttgactctttcgcacatatggcaaacatttaaaaaggcaaattacacattttccttctttctctcgttttatggcatcaaaaattaaaggatttcaaaaatttgagcgtaattggagttattctgctgcgagtccatgcattttgtgccttccatcaacataaggtgccgacgataaaatgttgttgtgtttggagaaagtgtacctctgctgagcggcgtcggcactctcaccgagagagacaaatgttagccccgggggaggcgggggcggttaagtgtgccgagggaaaagctcgggggtaggggaggggggcaagtcgaatgctgggggagggcttctccgagggtcagattgtgtttccagcagcagcagggagcagcaatggcaccgctggcaaaggaaaggcgacactgttttagcctttgggcttcacgccccccaggcaaaaacccacggcacggccgaccctcaaggcacacgaatattaaaaatgccttcctccaattgtcatgtttgcacacccatttgatggaccagcagcaaaagggttaaacggaaaagggcggggaaaaagtgccaaattattcgcgaatttggctacaaattgtgtttatttgggaaaagggtcatcttttctcactgatttgctctgcttctgatttattcctcacatctgttagtgaaatgctccaaattcccttgggcaattttcagtttatgacaaagtacgctttgggagagaaatctttgccccccccaaacgattgaccaaaataaacaaacaattaactaaaattgaccactaatggactgcattgacggctttgacattcgtctggagaaagtcaacacaattaaaatggtaaataatgcaaaaaatttgaattttaggacgttttttacccaagtgagacgataaatggcgtggtaatactcgaaacaaatgcaccacttcggctgagaggtgaggccaaactcagaagcaaaaaaggagtcaatttaaggcatcagagtgtttctgcgggggcgggcgcgtgtccaatggaaagtgctgaaatcgggcgaatcgaagtgagcgcacagagagagagagagagaagagggaaaaagattgattagctaacaaaaggcttaaaatgggaaagtgccaaaaagcaatttttttttggcatcgtttggctttttccaccccttttcatatgctcgagagtctcggttttttcgagtcggaaattaatctcggccatcagttgcggaaaattttgactctcgagcactcgttagcctttaaggacattgaaggacgaccaatatttgttggatgaaaagttgcttttgtggggccgcgaccgacgcgacggcggcgacgacgaagaaacggcgcagattctgccgcgggggacgcacgagttcagcttcggtttccgcttgcccgccacacaaatgccgagttcgctggaaacgaaggcaaatttagggattaattgggcaaaaatttgttaatttaggccggcacagttcgctattatgtgaaggtaaacaaaagaaaagttgttttgacttccgattgcattttcaaaggttatagtcgacgttccttacgccagttcgcctcagggcattaagtgaaaattaataatttaaaacgattatttcgaattgtttagatattttacactgatcggcccacacattgactgtatggaggagaaatatttggtaaaaatactcaaaaaataaaatatacgaattaaataaaattaataattttttggacccatctctgtgcccaggaccaccaaattcgttgttttggctgttgcaagagaggagtgattgccctcagagcggtgagtcattctccccatttcccaaatggtcattttctaccctcattgtctgccattttctcttttctccacttttgaggttcttgaacggagtgcctattgctgtggcgaggtccttcgccttcgtttgcaaatggaaaatcgccaacatttccccgccattgtttgcgtgcgtctaatccaggcaaaaatcacttattaatagagaccggatttttatgtttttacatattttttttgcggcttagttatggcgagagaagcccaaaaatagcattatctccgaacaatttttgatttagagcgacttataaaaacataaaaacacatattttggcgttttggcacataaaatatgttagcacatattttggggtttggcacatattttgcacatattttggcatttttgagaaaaattgcaataaaaatacaagaaaattgaaaaatacacccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcattttttggggtttttagcacatatttcagcattttttagcacatattttattacatatttcaggatttttagcacataaaaatccggtctctacttattaaattcaaatttgttaaattacttaagcacctcgagtaccgtatcgaccgtggggtcattggtacggtagcggacgcaaaaaacagtgatttttcgtataatattttatttttcaaacatttctcaatttagttcaatcaacagcctttgaatggaggtagcatttcttagaattaaatttgaaaattttaaaagtaaaattaggtcatttccgatcggcgaacattcgcaatttcgactcgacgccggccaagaactttccctgaaaatccccgtccttcctccgacaatggttaaaaattaagaaaaagcatcttaaacatattttcttcaatcttttgctattttgcgtatttgtcccttttttttgtccttttctgttttttttgtcaaaagccatttggcccaattgtccacccctttctcttttcgcttag

SEQ ID NO: 2903 - DNA, 1111 bp, Heterodera glycines
aataaattttaaaaaatccaccaaaaaataacattaaaaattttcagcaaaaaaagcctagtaattttttcctttttttttatcagccaaagaaaaataatttgtatttttttgatgaactaatgaaaatgattaatgcttttttggcttcaaaagtttttttttcttcaaaacattttgatttgtttagataaaattttttatgcctttctgaaaattgcgtaaattatatctactaaaaatagtaaatttttcttttcttctttttctgtcaattctattatattattggaacgcaattattttgaattatttattgttaacataaaatgaaaaaaacactgcaaaaaacaaatatcccccccccccccccccctccctttggtaatcccttcctattgaatcggtcggtcgcattttcattttaccatgaatcatgcagaatcgctccactattagaagggggggggaatgtggactgaaccagttgggtttacaaaaaacgatttatttgcatgttttattggttttatttgtaaagttttgaatacatattagtatgactattgtcgggaaagggggatctgctgtcaatgccattagtaggtctccttttggcgacgacaaagactcgcgccgttcggtgtcgccgccgggcacaaagcgtgtacggaacggcggtggcggtggagacgatgacagcgcacgacgcaatgacagggacagcaagcggagcggtggacgaagggaacgtaagttggaagctgggtgcaattttcaccggaaacttattcaaaccaaaaaaaaatgtttgaatttttttttttgggtagggggaggggaacagcggcttcattaaatttttcatttttttaatcaaaaagaaaatccaggcaccgctcgtcatgacgaggaggagcgagaccggagtgacagggaccgggagcgggaccaccaagagcgggaacggcgacgcattggactgccgggcaagccgaagtcggaccatgtgctgagtgagtggaaatgccattcaggggggggggaggggtcaaccagccaaatcccgctataattggggtggaaaccccgacatttgcggcccaacttt

SEQ ID NO: 2904 - DNA, 2008 bp, Heterodera glycines
gcgggggccggaaacgcaacagagaatggtagggaagggatggagcaggtcattggagtttctcacagagtaaataaaaaaatccaccaaaaaataacattaaaaattttcaggaaaaaatcctagtaattttttcctttttttatcagccaaagaaaaataatttttatttttttgatgaactaatgaaaatgataatgcttttttggcttcaaaagttttttttcttcaaaacattttgatttgttgactcttattgttagataaaaatttttatgcctttctgaaaattgcgtaaattatatctacggtcggtcgcatcttcattttaccatgaatcatgcataatcgctccactattagagggggggggggggggggggaatgtggactgaaccagttgggtttacaaaaaagcgatttatttgcatgttttattggtttatttgtaaagttttgaatacatactagtatgactattgttgggaaaaggggatctgctgtcaatgccattagtaggtctccttttggcgacgacaaagactcgcgccgttcggtgtcgccgccgggcacaaagcgtgtacggaacggcggtggcggtggagacgatgacagcgcacgacgcaatgacagggacagcaagcggagcggtgggcgaagggaacgtaagttggaagctgggtgcaattttcaccggaaacttattcaaaccaaaaaaaaatgtttgaattttttttttgggtagggggaacagcgactccattaaatttttcatttttttaatcaaaaagaaaatccaggcaccgctcgtcatgacgaggaggagcgagaccggagcgacagggaccgggagcgggaccaccaagagcgggaacggcgacgcattggactgccgggcaagccgaagtcggaccatgtgctgagtgagtggaaatggaattcaggggggagggggtcaacagccaaatccgctataattgggtggaaccccgacatttgcggcccaacttttgtggcgccgagatttgcgccaatgtccaaaatcggattctaaattgaatttttttttaagccctgatagcataaacagcattaaaattaagaaaaaactctcttctaatttattaggaacattaattctgttgtttaaaaattgtgttatttttcaaaaattcattgaagatcacaaatgatcagatacaatcactttcaatcgcttatttaaatttccccgtattgaacccttttgtggtggacttaaaaatatgtttttgcagttggctcgcgcaccctttggttcggccgtattccctcgggcgccaccgagtcggacatcattgactcggtgaaggaaattggtcttcctgaaaaggtgtcgttggtgtttggccgtggttgtgcatgtgagtgatgaagcggttgctgatgcaaaaatttttgcttgaaaatttcagacgtaaccatgccagaccggaagttggccttcaaaattttggatcggctcgctaaaaacatccgtgtgcagagcaaaaatgttaaagtaagtctcatccattggaacagtttcattgtcagggacataccccacccaaaaatgcgtaaaattttaggtcgattgggccaccatcccgtatctgaaggacaatatgcaattgatggatgcttattgggacctgaagcagggctacgcgcaaattccgttctccaaattgccggacggcaccgtcgactcgctgatggacggcgcgtggttggagctggatacactgccggcacatttgaggggtgagaattttcaagtgtaaaactgtagatttcaatttctcctggtaattaaatttaattgggtctttctaatggattgtaattgatggggtttggcattttgatgataaaaccataagtgtttttcttggcgaaaaataagagagcatttccctgaatttttgatagaatttttttgtttcagaaagcgatacacaaacactgggctcaacatgcggaacaa

SEQ ID NO: 2905 - DNA, 1928 bp, Heterodera glycines
  misc_feature (1862)..(1862): n is a, c, g, or t
atcagcacaatttgttgctttccacttcggctgccgtcactcatttagtgcaacaacaacaccagcaacaacaagccgcgctgggcacaacaacgccaatgccaacaaccgtcacgttgccgcaggcggcgatgccatcggtggccaccgctgccgctggactcatggtatgaacattttatgtgtttgtgattgcactttctttagggtttctcagaattttgactcgtttaaatttttttcgagttttttgataaaaaaaattttctaaatttttttttttgtaattttcttatatggaaaattttctaagattttttcttgaaaaattttctgtttaaaaattttaaaaaatcctgtcggggtccacctttctctctcccaatttgtaatattttccccccgtttagcccgcagcaatgttcacgcaagctgctgccgctgcagcggccgctcaaatggcatttgctggcaatttgttgccgttcagtttcccaccgccgaacatcccaccgccaagcgtaacacgtcagtcccagcagcaacaacaacaacaacagcaccaaacagacacagcaatagcgcagcagcatcaacaacagcaattgacgactccggtgagcagcgcaattgccgcgctgatgtcaacaccagcgtccgcgccaccaacatcgcgtatgaatgcggggagggcaaatgacggggacagggatggtctcgcggttgggcggggtgtggaaggcgtacgtggggtacgaaccccaagaagttaaaaaattttctccggcgatgccatcggcactgccggcaatctctccttcaaattttttttgtgacggactcaattattgtggatttttgggtccttttttctgctttattcatttttttcataaaaatttcatacccccggcccattctgtgtgggtgtgggggtacattcctgggaagatgtggatgtcgcgatttgcgaaataatttgtgttttcttctccctcctttccccctacaaataaaatccctttattttccaatgaaaaattatcccccccccctccttttttctcttcattttacacccttccgttcccgcccgccgactggccacaaaaggcttttgatttccttgcggccttgcttcttgctttcattcccttggatccctttgcggacacctttttcccttttcttcgccgttcgattagccatctctttacgtagcttttgcctttgggtgcacaacgttttccctcgagaaattaaaaaaaaaattagatttttcacaattttccaaaaaatcgttaagaattttcaaaatagttttcgctattaattcgggattatgggtcaacatccattggccaatttcgacatggataaaaaaggggagcaaaaatgtcatatgttgttggcactaattgtaaatgactttttagttggcggttttgccaatgtcggcttctccaatgcggtggcagcaggcggcggctacccaactggcggatttggcgaccccagcagaggcaattggcgaagtcgtggcggtccacgtggtggtggcggcggcttccagcaacgattcagtaggcgtttcataaaccatgtttatcaccatgttaaccggatgcatgcgacccaatttcaaagattcgcctggaggcggcggtagaggcggcggcgcttttcgtcccggcgctggtggcggttttcagccgttcactggtggtgagcgagggcgtggcggtggctttcgcggtggtggccgtggacgcggttgggacaatggtggcggtggtggcagtccgatgggcggcagaggcggacgcggtggtggtcgtggtggtggcggtggacgcgggggncggtggtgccttctacgccggcgggcgaatgccattcggcgacggaggtggcgctaaaaatctttg

SEQ ID NO: 2906 - DNA, 2164 bp, Heterodera glycines
  misc_feature (2095)..(2095): n is a, c, g, or t
ccccccccccccccccccccccccccccccccccctcatcacgacaaatatttctaacaacaaaaaatttttcattcataggggttggtactggcgccaatcgcgagccgtttggaggatttggcgctacatttgcgccccagtccgagtcagagggcaatgtgccggcggcggctatggcatcatcaaccaacaacatcagaaattgtggtagtccgacaccaaaaaatgaggtggttagacatcgaggggggattaaaaaaatttaaaaaagtctaaaatttttggaaattggcgaccctttaccaaaatttaggacaaccctccctgaagaaaacttttgaatttatttttgtttaagcctggtgtgcaaccgcctggtgctgcgttgtccggcccattttcaaatgcttctgccggctttggcgatgtgtcggcaacaatcaaatttgagccgaatagggtaaatgagaaaattacggggaaaaacttggaattcatttttttaaaatttgtttcagtttaatggcccaccgccctctacggcttccttctcttccgaagccgcgtttggaagcgatttcacaaaaatggagccgaaaatggttggcatattatatatatatttcggcatttgaatttaaagcaattgaggcaatcaatttttaattaacaaaaatgaaataaaattaattgtttgccacgcgctatttattggcattttgttaaattttcattaaattagggtatatacttattatttattattgtaactgtttcctcccctccctgtacaggctggttttggtcaaactcagcagcagcactgctccgagacggagtcggacgccccgcccggcttggactgatgatggtcgccatggggccaacaatgactgactgaaaaatgctggccaaattcttcgtcgtacaccacacattttcgtcttgatgacttttccttttttgacacactttaccacatacacaaaaaaacacttaattggcaattcctttttttctgtttattttaccgttttgtgagcgaatgtttccacaaaaattgacttttctttgtttttttaattattattattttcagtcggactacacacacccaatttttttcacactcattatttgatgctttgatttttgtttgtttgaccatttttggccattttttcaaatacatattatacctaattaaatttgctttgctttgtttgtatgttgttatgttttgtctccgctaatgagcgcgtgtctcgggaaaataagctttttttgaatgcaaaaaagtggcaaaatgtggtgtcatgaacataataaagcattaaaataataaacaatttgttgagctggaagagaaacaaagcgaataattaattaagaaaagtaataacatttcaattagcaaaacataattagttgcgtaaaattgcctaattaattagctaattatgttgcggcccatgtttccattgttattgtcttgtcggtgatttttatgagccgaaaaatgctctaatgaaataattgacttcgccaaaacaaagaaacaatgccccgaggcaataaacaaaatgaccaaatcaattgcttataaaaaaaatttaaaaaaaatgaaaaatataaacagaaaaccttgtcaaaatatatcgaaaattcattaaaattcgaattgcgattttttccatagaaaaaaaacacaaattcaaaccgttataggtcattctcggccatttaggaaaacccaggtccaggaaaaaaatcccgagctctagtattatattatccccccatggcttaatgatgatgatgatgatgcctcatttggccataattagttgggacgggaccattggccaattgatcagcaaacattccgatcacacgcaccgattagtcaaccagcaatcattaattagcgaagcatttgctgcgtgctgtcacatcctccgctgccgcgctgatcaacagcagaaatcatcaaaagtaacaaaagttcacccatccatcatcttcatcccgttgcgcgacagaaagtgaaagtcagtcaatttgtgccttccattagccgcctaattaactnccccgcgcgacgactaatttgaccaagcactcctactgacgctgctaatgatgatgatgatgatgatga

SEQ ID NO: 2907 - DNA, 1496 bp, Heterodera glycines
  misc_feature (1377)..(1377): n is a, c, g, or t
  misc_feature (1468)..(1468): n is a, c, g, or t
atgatgagggtgatgacgctgattgcggcgccggtgcctgcctttttcggtgcagttgcgcaacagtttgtcacagcgggcgctttgttgcctttgtcctcccctgaggggtcggtgagaccgtggccaatcgctgccctcctccccccataaagcgttccagctttttctgtatgctttagcttcccgttttggccaaaggggaggaccgccccccgccccgttgtgcagcgtttttggccaagggcccaccccccgtgcccccggggggtgaaaaatttgatggtataataaaagggggcccccgttccacccctcagggaagtgtcagtcggccacaatttttgagccttcaaacaatgttttgtaaacggactgacaacactctttgcccccctccccttgtcattggcgtttttggataaaaaatttaaaattaattattttaggaatttaaatttattttttaagttatgatgaaaatccagtggataactctgtttgtggtgcgttaagtcttaattgggcttttgttaatacatttaaaaatgctttttaattataaaaaaaagtattaaattaaatttttccaataatttaaatattaaattttatttatttaattaaaatatataaaattttgtttaaaataatcaaattaaaaaaatgaataaacaattaatttatttatttaataaacaaatatgtatattattttagttgtccaccaccatttcggcaattttttgtgcttcttccgtcaaattgccaagggcaattgccgggccaccgaattcgtacgtaaaaaagccgaactatgcgcaacagcaagcagttcaaaagcagcagcagaacggtatgccaagctcggcaggacgtgttcaaacatcggttggcattttttaaatgaatttattaattattttaaatttgaaaatattatttaaatttacttcaaaaataacaatggcattttgatcaaatttgtttaatttatctttttagtttggccctaaaatcacatttgctaatggaactgtgttcacatcagtttccgaccaaggggtccaattaaaatggaaaatttttttaattttatgaaatttttatttttacaggttgaagcttcagtccaaactagtgaaaggtgactaaacaaattattaatttgatttaaataacagtcataggttgattgatttaaaataacaaaaataaatattaaaaactggaaactattaaaattttaatgcattttttcttcaaatcgcacataaaactagagcatattttcctgcaaactattgtttaaaagctgagatttttcctgcaaaaatggaatctttcactattaaattagttgtttaaaaatattanaataattataatatatttaaattgatttatttttttagtggaattgcttcagcttcaacaaatgatgctgctccttcttcatcatcatctngtgctgcggatgctggcactagtgaaag

SEQ ID NO: 2908 - DNA, 2002 bp, Heterodera glycines
taaaattgttcaataaataaataaatttatagaattatttaattttttttaattaattcatataaatcatattttcctgcaaatttttgttcaaaatgcgagtttttcatgcccaaaatcccggttaataataaaatacttcaataaataaataagttatttaatttaatttagtggtactgtttcgtcttcaacaaatattgttgctcctgctccttcttcatctgctgctgatggtactgacactgcttcaaatacgacctcaacaacacccacaagcagtagcagcagcagcagcagcagcagcaatagttctgttcaagctgaacaaccaacgcccattgaacagctgcaaacagtgaattgtgacgggccgccgttgccgtgcaatttggcgggaaggtcggcacaatttgaaatcaaaatggaatttggaatttggcgggaaagtcggcacgaatttttgaaaaatttaaatgaaaattcatatacaatttgatcgtaaaatacggcaggatttttgaacaatttaaatcaaaattcaaatgcaatttgatgggaaggtcggcacggattctttgaaaatgtaatcaaaatttatatgcaattaggcggtaaaacacgcaataatttttgaaattaaaattaaaataaaaattcaaatgcaaattggcagtgaaggccggcccgaaattttgaaaaatttaaatgaaaatttaaatgaaattttgctggaatgtcagcatgaatttttaaaaatttaaatgaaaattaaaatgcttttttcatttcagaaattcttaccattgttattgaataatttcttattccaattttaaaattcaagcaaaataaaaattattaatttgcaaaaaaaaattaaccatttattattttaatttaaatttaataattttttgatggacataaaaatctaaatcccagttaatgatggaataaaatttatctgcggatttgaaaatgtttaatgcgagttttaggaaggatttcaaccctaaattgaatggcggtgatccgaatcagcctgggatcaaagcgcgcttaaatgccgaggcatttcgctatttgtcaggcgaacttgtcggcatattgagtataacattgcattttaatgaatgaattggtttttaattaaatttcctaattaattgaaataaattttaattataattttagcagttttaatttaatctaattaattaatcaaatttcagactatcaagtgaaacgcgccaaattgcctgacattgatcagtgcattccgaaggcaattttttagaaattatttatttatttaaatgttaattaatttttaggccggcggatgtttgagaataaatcatttgcatgttaaccgttataagtgctcgaagggtaaacacattcaaaaattaatctgttttttatttatacaatttaaaatttgtttattcaaaattaaaaattaaatgcaaaaaataataaaattaaaaataataaattttcaaaagatgttttcttcaaaccttcacaacccaatcgtttgattatggatgtgcgcaacattgaccttgagtaagaaataaataattaggaatttataagaattatataaaaattggctaattaaaaaagcagtttttgaaaaggcattttcaaaatattttttaaattcatatttattcatgaaaatgaatttttcggagtctctgatcacaaatcgacacccgtttcattcattttccgaattcttgacttttcccgatttgtttttttgacaaaaagtatttttgtaaaacgaaaaagttcagccattggtttttataattttcaaaactgctctttttaaagtagagccaaaaaaaaataattattattttaattattatttactattttatttaaaaaaaaaatatttttccacagcgtaaatggcgatttgggaggccaaattaccatcatgcatccattggcattgtttggccaagtgcaagtcactgct

SEQ ID NO: 2909 - DNA, 1463 bp, Heterodera glycines
  misc_feature (1440)..(1440): n is a, c, g, or t
aaaaaaaaaaaaaaaatttttttttttttttttttttttttttttttttttttttttttaaaaaaaaaaaattttttttccccaagggtaaatggggatttggggaggccaaaatttccatcaagccctcccattggcctttgtttggcccaatgtcaagtcccctggtcaaaaaagaaattaagtgttaattaatttttttttaggtaaaattttaattaattttttaaatttaaaaccattaaaaggtaaaagtggggattggaagttttgttgaagaacagtgcaacaaatgaggcaaaactttgggtggttttcttgggaccaatttttgttttaatttgaaatttgaaattttcaaaagcaaaaacaaaattcaaaaattttagattcaatttcttttattgtttttctttactctaattaatttaattaaaaaaaacaaattaatttataataattaaggatcatttttcataataatttcaattaatttattgttgtgttgtttttcttagaaatgatttttgattgctaattatacaaattaatttttaataaataaaaccaaaagaaaacattaatatgaaattgttttaaataatgcgtaatcttaacacatttattatattttatttttaatttattattaatccaataatttcaggctcaagtcgttttggccgaattgacacttccatccaatatggcggcttattaggcgacattgccaaccaacagcttaaagtgagtaaaattataattgcaaaatttaaattttgagtttaattttagtatgaaaatattttaaataaatttaaaagacaaaagttaattagcaattttatttatgatctaattaattaaatgaaatttatttaaaaaataattaataatgttattttgaattagttcatctataaattaaacatttctttggacattaaataattagtttaatttttttaaataaaatttcatttgaaaatgcccttggcaatatttccctaatttaaatttgttaacatttttcaattttgaattcagcaaaaaatcaacaaggttgttcgtcgccaaatcacttcacaagtaccacatttgcatgatcattttttaaaatattttttaaaataaataattaagcaattttcaatttttttagctttgtaaacgcgtcccacaaatggtcgatgagcaagtgaatccccaaattgctggcgttgtgccaaagaaaattgcgttcaaatccatctcatcggttgcactgaattcgtcatgtcttgcagctttgacgggcgacggcggcgcagtaatttaaataaaattcagaaaaaataatcaaattaaaatttattactaaattattatcattttaattgccatttgaattttattaaattttattgttattattatgcaaaagaatttttttttcttctnataaatttttttatttctttaca

SEQ ID NO: 2910 - DNA, 976 bp, Heterodera glycines
  misc_feature (487)..(487): n is a, c, g, or t
ttaattattattattttgtccatttcaataatctttaaaatgctcttaattcgccctccgtttctttcgtatgattttttctttcctcctcctttctttctattattttattatttttcgtttgaacccaaaaggcaatgatcagcggaagaatggggggaggaagaaaaagaaaacgagtttttttttgggggggggacgaatcactgaaaattctcccgttgaaattgggggaggggggtgatcgaatattttgttacgtatcgacggatcaattgactaattagcaaatgggttttggtattcttttcccgaatattcccttcctttgccttttttttttggcattccgtttgctttttctctcttttcatttactcatttctctttttacctttccattggaatgaattcccttttttacgctgtatttgtcccttaaatggaaaattcattggactcgaatgaattttcacatttcgtgtanaagtgacccccccccccccctcctctccccaaccaaattacctatttcttttccttcctccttctaccagggttgttccgggtgacccgaatcccgaaacccacatttttctcgtcccgaaacccgaatcccgacccgatgattttgggtcgggtttcgggacaaaataggcactggtaagaaaggggtctgggtgaaaattaggtagataaggaaattggtggaggagaatttttgaaaaaaagattaaataatatattacttttaacgcattccttttgcctttcattatttggcgtttgggttcgattccgcacctggtaagaatatttttaatattttcttttacatttttcaattgaaaattaattaataaaaatatttcaacttaaaaataattatttttccttttttaaacagtctaaaaccgtaaattttaccaaagatctggttagtttttgacaaaatctgtttacaaatctcactcaa

SEQ ID NO: 2911 - DNA, 2255 bp, Heterodera glycines
  misc_feature (2189)..(2189): n is a, c, g, or t
acagtgaccagttgagtcccgccgggaaatgacacttcagtccccgagtctgtaacttttcaggggatggttgtcgcaaaatcgagaggatccgataacattattattgtaattatctaattatgatcaatatttctttttcatttcccttttcccttttctcttttccctattttcccttttttctttgtcctccttctccttctcattgtagttccttccttcctttgtttgttgtttattcggttgatcatctcttctcccgcccctaatcactaatcacttttatcaccactccattcacagcccaacaaaaatcaaaccaaatcacgacgtgtccattattggtccactccctcccttccccctatttcttataaaattattggcaatatttaaagatcactttcttcttccttctcattcattcattcctcctccctcttcttctttttcctcctcctcctcctcttcctcttacccttcttattccttcttccttccctccctttttattactttttctttttctgttttcttcccttccgcctccttctttctctctctctcctctctctctctccccccgtctttcctccgccgttggattattgcgctgaatgccaaaaccgcgacagacatttcgtacattttgtagcaaacaaattccgttattccgtttaatcttccgccgagaagacgcgcatccatttgataagctgaattttcccaatttgccggcgcattggcagcacaaaacaaatgatgagaaggaagtgagtttggcattggcactttcgcttaaagttcaaaagggcggttgggtaattactgccctaattgccttaattaattgaccttttgtcgctaattgtccgtcatccgatcaaaaatcacttcccctttttgtctttttgtcttttctttttttctctttttcgcctttctttggagtgccgtccgtttgtttcgtcatccttccctttgcgcatcactgttcaatccgccggctcctctcaatccggaactcgtggcttaatccaaaactcgcgggacggtctccgccgggaggcgacgaattaataccctcgggggattctctctttttgcaaaggcaatttttaaatgtggaaggaaatgattatgagttgattaatctccaagtcacgcgaggcgactcataaagcggcaaaaataaaatgcgaagggaaattccaaaaaaaaagaaaaatgattttaattttaaattaaaaatcaaaaaaataattttttttttttttttaatcctttaatgtaataaaataacagtaattattattccaaaatgtttctctcttttctccccaattatgccaatgttttcttttcccttctgtctttggcatgcttttcccaccgtttttcttcgaatttatccaaaaaaagaataaattctccttctcggttgaccattttaggtgttctttttgtagttttgccaaactttgccccttttttgcaaccataggccaataataattagggggaggagcaaaattagaaaaggcggggcagtgccgtggctttgtaaaagaagtgccgccgggcagtgaaagccgcgcattcctaaaaaatcccccgggggtggggcgtaattggcacgcattccttggccattatcgccacaatttgccaaagatggaaaaaaataaaattgctaacgaatcacagtaacttatggtctgccattgaaaatgtttcgaaaatgcaaatgcattgcttcaattagcagttcaatgccttgcttcttcagcactgtctccgctccgtcgtcttccgtcaattcggccaaactgctcgccgccatggacaattcctcctcctcctccacggattgtccatccgcttcggtcggcctcgtcgacggtaccgttggcggcacctccgccattacggtgcccgtggtggagtccgtttgtgtgccggtcgatttgccggctggcactcaaattgtggtggagacgcaggtgctcacgtcggacgtggaccaaacggtggccgaggtggagaagctggacaaggtgtggtggcacggcaaaaatgcccaaaaaaaatttcggcagctgaaattttccccaatttcactccgatcacttctcttttttccgtttgacagttcattctttgcttagcaaggtcgcatcatccancaagttgagcaggcgctcacctaggtaggcggcccttcgacggccgacgaacggacggcggagaca

SEQ ID NO: 2912 - DNA, 1229 bp, Heterodera glycines
ggggggggcggcggtggggatctgtgaatgaattggactgatcagtcagtgagtgattgatcggtgattaattgtactgatcagtcactgatgagtggtttggactaattgatcattaagtgaatgattggatcgccgatcactgatttggaaggtctgatcggagttaatccccgaaatgggccgacgagtcttattcaatggtccaaataatcttttgcagtttttgccgaaaatgtgaagggcacggcttccaacggccactgaaagggcacgcgtcctcctgtccctacaacaattgcacgtgcaaaacggtgtggttttggtccccatccgccgtcctcaattctctgttcattcagtgcaaaaatgtgatgagtttgcgtgccaatgccatcattcgtcgctaccgcacgcgcaccaacgaatgcggcctcgtgctgaagccggtgcacttcaaaaacggaaacacgcgactccgcgtgttccccaaattcatcagcggttcgtttggcactttcaaacgaagtgaggcgcaacagaatgccaattcagaggaagaatgtctgccaatccctccggcgcagatgggcgaattgcggacgaaaaattgcagtggcggagacggcgagacggagcagcggacggtcggcgagctcggcggaattccgctgggacagaaaacgctgagtctgcgcaatttaacaagcgccgggggcagcaaacgatttagtgccattgaggtactataaaggaaatgagtacgctaaaaagaggaagagagagagagagagaaggtaatatgtagtgagagggtgagagtgagagagagagagacagcatggtagagagagagagagagagagaaagtgtgtgaggagtgggagtgagaaggggacatggtagttggttgagagagaaagagagggagagagagatgagggaatatggtagagagagagggaaggcgattacggtagagagagagtaatgcgtaagagtgcagagaaaaatttattgcttatttcaggacgatgaaatgcgtcccgtctcctccccaaaacgggccacctcccatgatggcaattttgtcgagctgttcacttcagccactagcgccggcggcgatgagccatccctcgtgccggccgggctccacctgctgcccttcgccctgccgacgagttcgacttcttccgatgcattggcacaatgccaaacacaatcgg

SEQ ID NO: 2913 - DNA, 3872 bp, Heterodera glycines
cgagacggagcagcgacgggtcggcgagctcggcggaattccgctgggacagaaaacgctgagtctgcgcaatttaacaagcgccgggggcagcaaacgatttagtgccattgaggtactataaaggaaatgagtacgctaaaaagaggaagagagagagagagagagaaggtaatatgtagtgagagggtgagagtgagagagagacagcatggtagagagagagagagagagagagagagaaagtgtgtgaggagtgggagtgagaaggggacatggtagttggttgagagagaaagagagggagagagagagagaaagagagggagagagagataagggaatatggtagagagagagggaaggcgattacggtagagagagagtaatgcgtaagagtgcagagaaaaatttattgcttatttcaggacgatgaaatgcgtcccgtctcctccccaaaacgggccacctcccatgatggcaattttgtcgagctgttcacttcagccactagcgccggcggcgatgagccatccctcgtgccggccgggctccacctgctgcccttcgccctgccgacgagttcgacttcttccgatgcattggcacaatgccaaacacaatcggcgtgtctttttgccaagacaccgaatcgaagtgaaaatgccgccaatttggagtttcaccagcaaaacattctgtcgctgaacagcgcgagaacggcgacggagggagggcaaacgatgcaattttatgggaacaattcgacggcgaatgtgccgataaatttcgcaattggggcgacaaataatggacaaccgcagcagcatcaacagcagaacatcgttagtctgctgggaccatttagcggagcatcgacggcaaacgacggacaattgggacaaaatgcgacgatgggaaacgtactgacaatgacgacaaattcaatgggcggactgttcatgtgcgatcagcagaaacagcaaaacctatgggtgcagcagcagcagcagcagcagcagaaacagcagcacattcaggtgatcaacagcagagaggacatgttgatcactgatcagtggggacggacggagcgaaatccccgggattatcccgggaatttccatgcaaacagttttctatgatttgtcactcccgccagtggtggatttgggtggaaatttggaatgactttttattgaaaggaaaacgaaaatcttttttgtaaccaaacggaaaccgacggagaagggaatattctaacggaaaaatggacaatttaaaggaattcggcccagcaatgatttcaattcaacccaacccaatccgtaaacagaaaataagtgttcgattgttgcgatggcgattgaattctcttaattttgggaatgccccctcccccatttttttgttctatcgatgtttttctgtttccgatatgtgtccgttttccgtgccgtgccgttcgttgactgtcccttcccccagggtttacttgcccaactcgacccttctctgctcgtccagctgctctctccgttccccaccgtccctcaacagcatttgcttcctcctccgccttcttctgtaaacccactcactcaactcgttgaacagctccaacaacttcagcaacacagccccgcttcttcgctgctttctgccgccggtgtgtgccgaaattcggcgacggaagggaaaaaaggcgcatttggcaacacaacgacggaagtgccgtcgtttcacagcccaacagccgcaacagcagcaggtgggcaacgaactgataaatggacaaatgggcacagcgcgtccgtcctctcacttttcacttttataattgagttatttactcctggatcaaaactcggaaaatcgagagagatattgtacagacttttgcagttgggaagcaacgatttaaatctcgccaactaagccaaattcagacatttcgccaactaatataaaatcattttttaatttatataatgtttaatgttattagtcattgctctgaattgttaagagagcaaccgacacattgctgaatcgctgatgagagcctggtttctcatagataaacaaatttgcatgaaattttattattgtttcataattaaaatcagttttaatctacatagttggcaaaattagttggcgaaacgtccgaatttgggtgagttggcagggaccagagcgtttgggcccccgtttttgggcccccgcgtttggacccccgtttttgggccccggggtcgtttgggccccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttgtaaatttttcagaaatggctaacccaattgcaaccaaaaaacaaaaagtaaaattgtcttacaaagaccacctttgcaccttcgctaaaatgagttctgatgggatgacaaaattttggagatgcgagttcaaaaaatcaatttcacatagtgagttggcgaaacgtccgaatttggcttagttggcgaaatgtccacttggcgaaatgtcgtcgtgccaatcacggcccctctaactgcgaaagaggcgaacagagtttctttaattttttggagtttgattaaacactaagtaatgcccaatggttgttgagcaaatacgccatatgttaatttaaattccatctgtccaacagcatctcttcccaacattgccttgtcccatttgcctccgtccgtcgccgtgccgcgtttgtccgccgttggtgacaacgaaacgacgcggcccatccgtctgacggaaacattggcattggcaccggacgcgtcccattggctggcggacccgcattttagccaattcgtggccatcgtcggacagttggaacggcatatgctcggcattggcccgcgcgagcagacgacgcccgcgacgcaaaacaaaagcggacaaaacccaccctcatttgtgttctgaagacaacaattaactgagttaatcgaatgctactgactgattatggacatttatcagcgattgatccccaacattccgatcggagaaaacaatgagaaccaaatcagaacaatcggacaaatacgagttcctatgttttcccttttcctgctgctgctattctcgtccttttttagtgatattacatttttaattggcttttgtgtcataattaggccatattcacattttatgatttgcaattggagggctaaattttctttaaacaataaataaactgattccttccttttttcctttttaccatttgttttactttacacacttttgcacacatcgggcggaggagtgtcacaatcgacgggtcaaaacgcacaaaaaaaatattcggatttgccgcaggggacaaatggaaagaaagagaaagtgaagggccttttagggtcattcactcactcatttcactcattcattcccttcctttttcccccttttccctttttcgctgtcctttgccccccgtcgttctctgacctctcattttactaagggcaaaaattcaaaaacggtctttttctctttgggcgtcttctcaggcgaaacaatggaagggcgggggaaaggttttggcgggcaaatttatgaaaaggcgaaaaaggggagagaaaaaaaaggggggagagaaaaggagagggtaagaaaaaggcagaggaatagcaagagaagggcagagtgatgagaaaaagagggatggaagacgggaggacagagagtgggggggg

SEQ ID NO: 2914 - DNA, 1447 bp, Heterodera glycines
cgttcttccctcccctcccctcccatttcttatccaatctttgtttttctgcttctgttccttcctattgacgggcgtgtgaagtgcctttgggcggaatattttgaattttgcattatggcaaaacgccaacatttgcccattgcgaaattccgcccccatcgaaggacaaaagaaaaaagcagacgggcggagatggtcattctcattcattcatttcattttgctatttaagcacgcctttgctttgcaatttcactttcctttccattcactcactttccgtttaccctttgatttaatgcaacaattccctgccctttcccttcccttttcttccgttttttgcgtttcttccattttttgtttgtcctttcgcggcccactgggtattctcctgtccacctcggcagagacaatctgacgctgatcagatcggtgactagacagtacccagcgggacacgaagaggactttggaatgtgaaaaaaggggtggatatgaatggaaaacattttcttgcatcgcttcactctggagggactgaactttgtgcagcggcgcattttctgcaagaaaccgatgcacatgtgcaggcccaccagagaatgtgggagagcacttccaatttgaattcaaaatgctttatttgtgttattttactacaataatactgatgcagtgcaacagcaaacgccaaagtggccaactgcttttacccgattgaaatgtgatgcctgtacatttacaaatttggtatcacagttcaatccggtgccagcggttgggcacaccaaaatgagagaaataaaggcacggtgatgactcaacaattgtcaacaaaaatgtgaggtcccctaagaattcctaaatcgaaaatacaatatttttggttccattaatctcgttggttcaccattcactgacactaattccttaatgggtgacggggaggaggcggtagtgaaaggcttacccgcaccgaaccatttgctgaaaattgagacaacaaaaaggggcataattatccgacgacataaggacaaattatttatttcgatatataaattattatctctaaaaatcaaaaaatgtgaatacaatgagttacaaattaagcgaaaagttggaaaaccatcacaataattttgctcattcagcgggaaaacagaagataaaaatatttaacagaagcggggaagggaaaagcgttaaaccccttattaaggtcgtagtttttgatgaaaaagcaccccagttatctatttgttatgcaaattcagcaggagaagcgtctgatatgagttgaggcaggtcataagtgccaattccacctggtggtcaccccgggagctggggatcagttgaacctagagggaattcaaattggatttaaagtgggaaattgggaccaaagacgggtggagggtgacgaggtgcgagtaaa

SEQ ID NO: 2915 - DNA, 3932 bp, Heterodera glycines
  misc_feature (3833)..(3833): n is a, c, g, or t
  misc_feature (3860)..(3860): n is a, c, g, or t
  misc_feature (3899)..(3899): n is a, c, g, or t
ttcttttttcatttcaccatcaaatggtaaatctttctctcaatgcaaaaacgatttctctctcttctcttacaattctttccttttttcgccattttccattcatcacatctctctttcacttcagaagcccccatttcctcaccagtcgcctctttttccttcgggttcccaggtttcgcacaccaggtactcgggccctcggcctttttcgcttcgctctagtctcatttctaaagaaacaattttcaggcaactcagtgactttcttcggagttgagaaaactgcacaattttcgtaataaaatcgccagtattggtgacactcaaaacaataatcgccaaaaatggtaagggatcaagcgtttgggaaatgactcagttgaaaaatcctggagataatttcggtatcaatggaaataaaccattaaccaatccattcgtatttcgattcagaaaatcagaaaacaaaaaatgaattacggtgggagaaagcagatatgtcatttatccgagtggccagtataaaattatttttgcagttggcccttatggtgaggattatatttgatttaaaatgtttattataatgtagcattaaaattgaaagatcatataatagggcaattttataaaaatgaattgtgctttgttgtttaagacggcccaaaacagtatactcttttgactgacaaagaaggcaatctcgaatggaatttctacaaaaacatacacaacaataattttttaaaagaaaattacataagcactaaatcggcagaaaaaataacgattttggcggagaagggacccgataaacgtattataagcgaatttgttaattacgctgaaatgaagaaaacgatggatgaaactaacggacaattatgcaattcaactttcatcaattttgacgcacttacggtatgcttgaatcacaagcaaaagtgacttctttgtgaaagtagggatctgtgtgagtctttcttagttaatgcattttggtggcaaaaaatgctataatattgccaaaaataatgctaaaatgttgccaaaatatggagcacttattaaaatcttactgcttagaatttttcaccgtaaacaaaattctgataaataggtaaaaaatagaataactcgtacctattaataacgtgtcaatcaaaaattcctgtctgtaatttactgcttatttacattcttccgtcatcattcagatcgcacctcctgacttaccaagattaaatgccgtagaattgaaccaacaaagcagcgggaataaaaatgggaaaacaacaaatggaaaaggccaagccggggacttatcgcatagagaattgtcgaaagtggtggtcccgagttgttataatgttattggcgatggtgattgcttctacaggtaaaaacaacaagacagccagctgatttattttcttcttacagatccgtttgctattcaatgtttcgagttgacaaaacatcaaactctgacgaattacgaattgctgtaggcaatacccttcaagcaattgtaaataacaaagaatatttcccgaaaaatcgcctcaaaaatcacgaagaatttgtaagagagttagagtatgcattgttggagaagccatcaacagaatggtttaataaaaatctagaagcatatgccaaattcgtggcaataccggcacgaaatggaaaaggccgatgggctcagcttgaagatgcgcgtcttatttctctttttctaatgcgacccgttgtaattcttcatccaattgcggaaaagaaggtgcttgtagaactacagccaaaatatgacgattcgtcgataatgagacgcattgaagtttatttcccagacggggaaacaatggtatgtttttgttcaattattctggatagagtgaagcggggcctgggaacttttggaaaatcgggaccggaacttgccgggacccaaaaatcttggctctcggaaccgggaattgcaatttcaacgacaaacagtagcgaaaagtctgaattttcaacccaaagtttcaaaacttgaaagtctccgaatgaaacttttagagttccaaaaactctcggaaaattaaggaattataaattaaattttcttttttaatttaaccataaaaaggtaaattttattcaaagcaaaaatgatttatatttatttcttaaattcttccttttttgccatttccatcatacatattcttcactcagacccccattcctaccagtgcctattttcctcgggttcccggtttgcacaccggtactgggccctggccttttcgctcgctctagtctcattctaaagaacaattttaggcaaatagtgactttattggagttgagaaactgcacaattttgtaataaaatgccagtattgtgacactaaaacaatatgccaaaaatgtaaggataagcgtttggaaagactagttgaaaatcctgtgataatttggtataatggaataaaccattaccaatccatcgtatttgatcagaaaacaaaaaatgaattaccggttggagaaagcagatatgtcatttatccgagtggccagtataaaattatttttgcagttggcccttatggtgaggattatatttgatttaaaatgtttattataatgtagcattaaaattgaaagatcatataatagagcaattttataaaaatgaattgtgcatttgttgtttaagacggcccaaaacagtataatcttttgactgacaaagaaggcaatctcgaatggaatttctacaaaaacatacacaacaataattttttaaaggaaaattacataagcactaaatcggcagaaaaaataacgattttggcggagaagggacccgataaacgtattataagcgaatttgttaattacgctgaaatgaagaaaacgatggatgaaactaacggacaattatgcaattcaactttcatcaattttgacgcacttacggtatgcttgaatcacaagcaaaagtgacttctttgtgaaagtagggatctgtgtgagtctttcttagttaatgcattttggtggcaaaaaatgctataatattgccaaaaataatgctaaaatgttgccaaaatatggagcacttattaaaatcttactgcttagaatttttcaccgtaaacaaaattctgataaatagttaaaaaatagaataactcgtacctattaataacgtgtcaatcaaaaattcctgtctgtaatttactgcttatttacattcttccgtcatcattcagatcgcacctcctgacttaccaagattaaatgccgtagaattgaaccaacaaagcagcgggaataaaaatgggaaaacaacaaatggaaaaggccaagccggggacttatcgcatagagaattgtcgaaagtggtggtcccgagttgttataatgttattggcgatggtgattgcttctacaggtaaaaacaacaagacaggcagctgatttattttcttcttacagatccgtttgctattcaatgtttcgagttgacaaaacatcaaactctgacgaattacgaattgctgtaggcaatacccttcaagcaattgtaaataacaaagatttcccgaaaaatcgcctcaaaaatcacgaagaatttgtaagagagttagagcatgcattgttggagaagccatcaacagaatggtttaataaaaatcttgaagcatatgccaaattcgtggcaataccggcacgaaatggaaaaggccgatgggctcagcttgaagatgcgcgtcttatttctctttttctaaagcgacccgttgtaattcttcatccaattgcggaanagaaggtgcttgtagaactacagccanaatatgacgattcgtcgataatgagacgcattgaagttnatttcccagacggggaaacaatggtatgttttt

SEQ ID NO: 2916 - DNA, 1600 bp, Heterodera glycines
gacttttcagtaatttatcaaacagtgctctatccttctgtatttttatttttgttgcaccgttctcgacagtgggcgatttttgctacaccgcttgaaattatcagaagcaattatgtagcatttttagtggccttttcaatgatgccaaacttgaagaaaagtgcccgcagttactggttgggtattagctgaaatgcatttaccccccatttttaggtggtcatatgtttagcataaaattttatttctaattctcaatatttgcaggccaaaaattctgacaaaattcctactaaagtaattttcagtgctgatcaaaaaagtcttttacagcaacttagtccgatcattccttcatagtgatcgggacaccccaatatacagtgaaaatcgggaaaattttcgaaaaaaattgctaggagggtggaaaatttctctgtgggtgacagattcctatccaaaccataatttttggtgaaaaccttaaaaaacgggctcaaaaaaaattttcgatagaggccatggtttaaaaatacgtggaaagggggaggtggtttaaccgaaatttttgcgaacccatctcaacatcgaatttgaccaccattttttgagggatctttttcaaaaaaaaaacttttggagaacaaaggggggataagcggcggtggtgttaggagtagcgaggaaaaatttttcttttttttgttgaaaatttgcaatttgttaacagattttttctaaaatataccaatttttgcaattttatgacaattttttgcaaaaaaaaataattggagttttggggggccggcggtgccaataggcgtcgccgaaaagtttttcggaattttaattaattaatattaaggaaattcttcaaaatttcataaattttcaaccttcctcccttcgttgttgaattaactttttaaatttttacaaagctcggagtccccaattccccgaattagtgtcggggagtcggggggcaaaaagtcgggggctggggacctcggggagcgacatgtcgggggtcggggcggggaataggcccaaaaatgtcggggatcggggtcggggagctcggggacggtgagcaaccctagttttcagaatgccggcctcgtcactatcgtcactacacctcttaatgcgggtgcagcaattcgcgaaattttgcaaagatccatcaaatgcggatatattgagattttgtgtttaattaaccatttataatgcatatctttcagtcattatttttaaatcaaatttaataaactgatttttgttgcaaatctatacaaatttatgtctgttttattaattttgttttttttcaaattgctaccaatttctatgcaacttttcaagcttaaatattcttatatataatcattttttatttatacaatatccaaaaaaatattaaaaaagtaagtgatcccacctcccccccccctcctcttgcacagctatgctaaataatcaattgcaccctactcctccccctcccccggtccgattaataaagtgctgccttctatgtattcccgcgtaagaatgggcatttagtgcttatgatcatgcaatgaaaatt

SEQ ID NO: 2917 - DNA, 2771 bp, Heterodera glycines
gattgggaattaatacattacaatttttttaagtagggttcgagccccgccaccgcccccgggggcgggacaggttttttgggctcgcccccgcccccgtgactctgacccccgcatcccccgcccccgtgaaaagccacccccgccccacggggctcgaaccctagttttaagaaactataaagaatgccaaaaccaaaattgttggttgatcagttggaacttttgttgagcaccggcaatggcgcggatgtgcactttttggttggggaagacgaagaaaaggaggcgagtgactgacaatttaatagaaatcgagggcatttaaaaactttaaaatattgatcagttaattttgacatatcctgtagtaatttaaagcaaatatatgtggtgtatttgtctactaagaccaagaaatccatttagccataaaagaaaattatggcacgtgacaaaggaaagaaaagtcgcttttttttcgtcgggaccgcaattctgcagggttaccttaatttcgacctatgtctaattccgaacccgaattcgagcaaaaagtcgaaaattcaaagtttcgaattaaagggagggacggttggggtaccatcgatagtattaattatcaaattttttgcatcatcgtttcttgcatggtaatttaaacccattgattggaggaaaagtgaccaccgactttatcattaggtcaaaagaatgagcctgtaatttcaggaaatcgcttaatttatcctaaaggcatatatacatataatacaatttgtgatcactgcaacaaaacaacaattttatatacatcagatgggctcaaattcattatccaatccacatcaattaaatggatcatttctcaacaaatcgtccagtcatttctgcttctgatcacttggattgatcactgcgtcaagaggcctaaaaatcgaaaagcaataagtttggatatctgcataagaagcctcattcactgacccatctcaaatgtcgatccgattccactggtccataaagttccatccaatcgcttccttctcccatttggcccatttgctttcgtcgcgcacaatcggacaacggatcagaagaacacggtcgatatcgttcatcttcttcaacgtcaattgctcccgggtcaattcgttggtcagaacaaatggcacaaccagatgatcaaaagacgaacgaaagcgaatgacagcgatgaaattgacgggagatgaagcggcgtaaaattcctaaaatagggaaaaatatgaaatgatagatgaatgaattttacgattagatgccccaatttgggtataattttttttgtcagcgaacgccaaagcccgtaaaaatggcaaataggtaaataatcacatcaaaatcacctctttgaaggcttcaatccttggcgccaaatgccagccaccgcattccaaccagcatttgaacacctttggcacattgtccggacggggagtgaaaagccatttggccaccgcctgtccttccgacgcctcggcactgtcatcgcatggaaatttggtgaagaaaccactggaataggcattgacaacgcgaagtgatggacagtcgtcgagaattgacgggacgaattgacgcaaacggcagaaactttctttggacaattggatgccacgaatgtttgtcgcgatcatgggccaaatgttgagcaaaatcgactccaaagtgcgttgatcgaagtacgtgtcgatggtcaaatgaatggggcgggcggcgagaattggacgaaaacggtggagaaaagtgatgacattgttgttgaagtacctgtgaaaaatgatggaattgttttacaaacagaaaaaaaaatcatcaaaatctcacttcaatgaaatggctttgaatccgacgactctctttggcaacggcttttgcgtaattccaaacgattcccaattggcattgacaacatccatttccttggtgccatccgcttcgaacttcattttgattttcatggatctcagagtccagtagcgagtcttgaagtgttcatccacgtagaagtcaaaacggtggctgatcatcgcaattccaaggccaagttgtgaagccggaagcaattcgaacacacaaagccaaccgtcgccagagataaaactgaaaaaaggaaaacaaaatttaaaaattgaaattgaaaattggcattttaattttacattgctttcgccattttctcctccgcttcgtttcggttgtcagacattttattgaggcaaataattaagacagttttcgtcggacttcaattggcttagcaaagatgaaaaaattatgtgaaatcggccgtttcctttttaaaatgtgtggacttttggtgctgccccgccgtgaggcggctcctttttgtgcactattttcgtttttaaaattggatccggattttttggcttttttaaataaattgtgaaaaattcaaaacaaaaaacttttattgagctacaaatgcttttaagccccgccgtgaggcgggacagttccaaaatttgcaccacattttactgtggaaagtccaagtaccttaattggacaactacgtgtcaatgagcacagtcaccgttggccagttgtgaaacagaaaaatgcgaatatcagatgggggtgcgtcccatcctaaaaattcctttttttcgtctaagcatccctcccctttttgtgcactattttcgtttcaaactttttaaaccaatatttttgttgctttttgaaaaaaattgggaaaaaat

SEQ ID NO: 2918 - DNA, 1194 bp, Heterodera glycines
catccgcttcgaacttcattttgattttcatggatctcatattccagtagcgagtcttgaagtgttcatccacgtagaagtcaaaacggtggctgatcatcgcaattccgagcccaagttgtgaagccggaagcaattcgaacacacaaagccaaccatcgccagagataaaactgaaaaaaggaaaacaaaatttaaaattgaaattgaaaattggcattttaattttaattttacattgctttcgccattttctcctccgcttcgtttcggttgtcagacattttattgaggcaaataattaagacagttttcgtcggacttcaattggcttagcaaagatgaaaaaattatgtgaaatcggccgtttcctttttaaaatgtgtggacttttggtgctgccccgccgtgaggcggctcctttttgtgcactattttcgtttttaaaattggatccggattttttggcttttttaaataaattgtgaaaaattcaaaacaaaaaacttttattgcgttacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgctcttttctaaaaattcctcttttcgtctaaccatccctccctttttgtgcactatttcgtttcaacattttatcaattttttgttgtcttttgaaataaattgtgaaaaaatttacgcaaattattttcgcttttaattatgatgtacaatgcttttaagccccgccgtgaggcggctcctttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatgcgggtgcgtcccatctctaaaaattcctcttttcgtataaccatccctccctttttgggagtcgggggcgtttgg

SEQ ID NO: 2919 - DNA, 1131 bp, Heterodera glycines
aaaattcaaaacaaaaaacttttattgcgctacaaatgctttaagccccgccgtgaggcggctcctttttgtgcactatgactttttgataaaaaaattttcgctttatatgatgtacatgctttaagccccgccgtgaggctcctttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggctcctttttgtgcactattttcgtttttaaaattggatccggattttttggcttttttaaataaattgtgaaaaattcaaaacaaaaaacttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgtcccatcctaaaaattcctcttttcgtctaaccatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggctcctttttgtgaactattttcgtttttaaaattggatccggattttttggcttttttaaataattgtgtgaaaaattcaaaacaaaaaacttttattgcgcta

SEQ ID NO: 2920 - DNA, 3038 bp, Heterodera glycines
  misc_feature (2966)..(2966): n is a, c, g, or t
ttaaaaattgaagtctaattcgttccattgggtttcactaaaaaagtgctttttgggtaaatttaaattttttgatttcaaaatatttaaaaatacttaagaaagttctaaaaaataaagctcaaaaaggtataaatttgtttttaattacatatatttaaaaaatagtaaattttttattgtaaaattacataaattgccaaaatttttatgtttcttaagaaatctttcaaaataaaagctctgattagatattaattaatatattaagtttagaagaagtccaattcaatttttaacttcatttttaatttttcgccatttttcatttattaataaattatttaaaagtgtaatttattattattattattatttaatttgcattttgcagataatcctgacgaacaagcggccgcaattcgtcgagaagttgcaacgcgggaggaaacattgcgcgaacttcccaaattgtaatgtcaaaaataaaactcgagaaatttccgagttttcgggttgtttaggtctcagttttggtgccaattcttaattttggattcgaaaatcacgcgtttctctgtgaattcggttcggtattcaaaaaatttctcgaattttttggaccccggcctctagtccaggagaggtcatcttgttcacggggctcaatgaagcgacaatttcccaaattttctcgaatttttttggagtttttggattcgtgtttccggtcaattctcagtcccgttgctctcgatagttccctttttacgtaatattttatagagttcggacccgtatacgccgggttttcccgtatttttcgacgatacgagtttttacggactatggtttttacgggttattttagcccggtaagtccgtactccgtatacgtgccctaacacgtaaccttttccctaaccagtacactcgaacaatttgctaatattttgcatatatgtaggaagcgcatcatgccacgctttgtggtcaaggacatggagacgttgttcatcgacgaggttcgccagtccatcaatctgttgatctccaacttggagtcggtgccggtggcgcctcggcaaacaatgggccgcaaaaaggagaaaagccgaggaaacaggtgagtgccaaaatcacggggccaacaccaattaaaattatcgcgcaaaaattttggtgtctgataactcagtagtcactgatcggagaaatggctaacatatataattataatgtggagttgatcaaatgtaaatccgattaatcagcgtctcgttcccgttttaattgctgatcagtaatgaatcgtaatgaccaatttctttcgttcaaaacatgatcaatcaaaaattgttttaaattacttgttagtgaccagctttaaacacatttgaacagatttttcttttatgttcaacaacaaaattttggttcattagtgtttgacttttttgatttttttggtgtgctaattaactaactacgtataattcactaattaattaattaattacgccttaaacctcagcaaaaatgtcttaacaagaatatttgttatttttgtcaatttgtgaagtgcttttttgttcatgtttcagatcaagatcaattgaggatttgtcgttgttcaattcgtaagtttttttgttaatacaaaaaataagtaaaaaataataatttttctaattacgcttcggaaaagtttgttcgttttttgaactttttaatttttgttttaattactattaaaaaatttttgtttttaataattttaaaaattttgtggctctattaacactaattaacccaaaacaaaaataacgatttgtttgctgaatttgtatctgaataacaccatatacatttttatttgaatttaattttaagtattttaaattatttatttaaaaaataataatttttttagtttgaagcgcagaacaagctcaatgtcgttgaacaaaacagagaacggggacgacgaagtcagcctgaccaaaaatgatgtcgtgctcaatttcaacatggaggtaggtgttttgatttgatcaaagataatctataggattagggaacgattaggataagtgatctggaccatttgtgaatgattatcttcgaaaaggcactggtctgagactgtgactgatcggaaccgtttgatttaagctaatttgtaagtgtgattgcaatgatctctaatcagtgatcggctagtaagggtgatcaggaatccaagtgatcactgaacagtggtgagcctggtttgtttctggtcagcctaggagcgatcagacttctgagaattgggttgggcccatgttgactgatcattatgtaatttggcattgatttgtaccaattgatttaaatttgttttaaaaactctttaaaaaaattaaatttttaaggttgttgtgatggaagtgcagggactgaagtctgtgcagccaaatcgagttgtttactgcacaatggaagttgatggatgttctaaattgcaaacgtatgcattttaaagaattattaacttaatttcaattaatttttaattttttagagatcatgccgaagcctcaaaaccatcgtaaattttttgaaattttttgattttgtaaaagatgattactcaatattttagttgggatacacaaggcgatttcacgacaaaacaaggtgatgatttaactaaataattgatacaattaaaggaatttaaattgactatttttaaaattaattttttcaattttaaaattaaataaataaatcattttttaattatccattttaattaagtgctgccaaccgtcaaggtgaagctgtacgctgaggtcaaaaacatcgtcgcttttgaggataagtgagtttttgaattgattcatcagtgattatttatatgcacaaaaaatcgtaaaatattcagcaaaaattacaaaatatgtgcataatttttccanaaattgttaaaatagctaaataaatatataaacatttttgtaaaaaattaaagtagaataaagtttattatt

SEQ ID NO: 2921 - DNA, 4388 bp, Heterodera glycines
aaaattaagtttgttggaaatttttcggcccttatttgttagaggtcaaaaggaccattttaataaaggattttttgaaaaaatgtccaaatatgtacataaattcccaaaatatgaacaaatacataaaatacgcatatggatcatcgtcctataagctcaaatcaagctttcgagccctattgatcagcatcattttttgatcaaatcgaagatgatcatttttcgaccacttttgatcagattttttgtgattgctatgctaatctgatcaccatttttttgttcagagagctgggcaaagtagtgatccaaccgacgccgaactgttcccggcagcccgaatggtacaaaatgacggtgccaaaaagcagtgccgacaaaaacttgaggtccgtggcttttgaaattaaaggtgcaatggaacaggcaaatatgagagagcctggacctgggtttttttcatatctgacctggatctggatttcaaagatcaaaacccagggaaatccatgttgccgaaaatggcctggacttgggcctggggatccatgtcaaattcgaactctagataaaactttttttttaaaccaatttgatttccagttaattttgcagaattcgtctcgcaattcgaatggaaaaaccgctgaatttggtgagtttttaataaaatttttaaattttaaaaattatttagcgccaattttgaaactcagttaaaaaataaaatagattaaaaaatttttaaaaataaaaatttttttttttactttttgaattcagaaaaataaatttatatttatgtattttagaaaatttgcggctacctttacgggttggtggctcaattaattaataaacctaattaataatgattaattaattacccctaaaaattataattttttctctctctctctctctctctcttcagaattggccgaattgcgtggaagaaatggaagcggcgcttcttctgccttgtccaagtgtcccagtacgctttcgcaatgtgcacttatcgggagaagaagtcggacccgaccgaattcagtcagttttaagttaagagagttacggcacacggcaagggaaggaccaatggcaattcgtacaaaaaaaattaattaaaaaagagatttttaattcaaaataaatcttttgtttaaaatcttgaaaaggtgcaaaatttaaaattattttttgattattttttattcttattacaaaaaaaaatcttttttaacatttgaataaaaataatttagaaaattttctatgaaattccattgtcttttttaattaatttttttgcaaaaatataaaaaaaaagcttgaaaatttatcgaaaaaataaacaattttcaatttcaaaaaaaaaattgcacgaaacatcgttcgtcacatgaaaaagagtatggcaaaaagggagtaaaaataaattaattaatttataaaataatttggcgctatatggaaagtggccgattttgaatttcaaaaacaaaggggggaccctattgtttcgcaaaatttttttgtgatagtcataaaaatttattctctgtggtttttggggtctccgaccacgaatctttcaatatttgaccaattctgatttgctaatctaaatttgaacaaaaaatcataattttaaaaattcaaaatctcgatttttatttgagttcgggttagggattcaaaatgcatgtcagattcatgatagcgacctctaaaaccccggataacaaattatcatggtttttttatcataaaaaaattttgcaaaacaaaagggtcctccttattgtttttgataaaattcaaaatcgaccacttttcatatagcgccaaaatatttttaataggattctttaccattaaaattattgtgccgaggacttggacataataacggggaacaggcccgtattatccagaaaagaaattcgtgaggacacccgggttttttttttctatgcgaaatatgggatccggtgtgccattaggcgcggccggggaaaatttaaacattttgaatcaaattattaagaaaattgcaaattagatatctttttaattgaaaattatttttagtaataatttatggatgagaaaatcaggccgtttttatcccaaatattagcgtcttcaatctaaggtcctcaattctcgtcaaatattattttcaccatattgaatggaaaacaaaactctggtaaatcaagtttatttatagaaattcttcgacaatatcaatgaaacaataaatcacacgctttctaacaacacaaaagtagaattcacaataaattttaaatcacataaatgggaaggatgaagaattaaattatttctttgcttaaaagaaatattaaaatattataatttgaaggggatgaaaaagatcacaacctgttaggcacggggagaaaaaaggttttaatgggaagaggacaaacccgtgggtttcttttagacactaaaattatgtagagtttgtcctctgagctataatatgggaaggcataaaatgaaaatgaaggaacgataaactgccaataaaaatgtttctagagatttttaacaaaaagaaaattaagtagaaagtgaaacaaacggcaatgaatgaaaagcaaaagatgggcgagaaagaggagaaagaaaattcatagtgaagtcaatgaatgatttccaaaagcaatttggttttttctcaattgcttttagcagttacattggggttcgtagcatattggtaaatcgggcccacagtgaagatgcctcaaaatccaatctcattagaaaaggctaaactatttttatcgcaggggatagaagctctgattcaattgtttaaaaaaacaaaaaattaattttgctatatttaaactcagggtgatatggcagtgctttgtgcattgttaaaaatgactttgcctatcgcttaaaaatatggcaactgaacaagggaaacgtataattaagggaaaataaaaggaatcattaaggaaaacagagttgcaaatccgatgaatgttaaaagcgggaaaagcttaaaacaaagtttgggcaagtaatgccgagcatggcaatgggctgttacacggggcgaatgtgagtcaaacggatttagggtaaatttggttggagttcgaagtcgtggcacaaatctctctacggctcccgtcaattttgcccctggcccctctcttcttctttttctggcgattacccaacttcacacaagcaaagacagcgacaagcagcacaaacacaaaggcaaacacttgcagggcgacgatcagcccagagagaaacatctgcagagcgggtaaaagcatcggtaaaagccagacgaacataaaactaattagtctaattaattttctttctcctttttagcagtgataagtaagtgaggatgataggatgactcatcagacaatcaaaataaaaaaaacaaatacaaagtgcaaaagagtgaaatgaggggcaaaaaaagatgacgaattgggtggttaaagtgcagtgatcggactgacaatgagtgttttgttggtgtgggttgggcaggttaacaaaattagtgacttggacggacagaattcactccccccgcctgttcaccagtctactcagctgtctaataatgtccccaaaaacggtgcttgacgagaattgagtgccaggcccaccatcttttctcagcttttgaaaaggcaaggaggggccaccaacacgccgacggaagccgcctacctgagaagtgagggcctgcccaatgcccggacgacggtacgccgacggggcgtagggactgtatcgctggtcgcttggctgggcaggctcctcagtcccatacaacaagagagcccagtcactgaatattcctgaaagcaaaagttcaaaactaaacaaggaacacaatggcgaacgatacctccgatgtttgggttgttggaaatggactcaaccagcaatgtccaaacaccacgggggtcctctccccacatctgagatttgattgacaatgagacggataacaatgtccaagattaagataaacctgcacggtgaggaatggccacttgtggaagccattttgattgaaatcctaaacgattttcaaggtttacgaccgacggcaaaggatgacgcacttgcggacggggcggcaaaaggacggagcgagtgcccatcggcgaaaaaagagtcaatttcaagtcgcctcgcttcccaaaacgaatggtcgtaatcacttggacatgctccaaatacaaaacaggtgtcccctgctgacagccgctcacttccaaagtaaaattcaaagcaaaccgtccctggatgggtcttggcctgaaggcttaagacggacctgcagg

SEQ ID NO: 2922 - DNA, 3368 bp, Heterodera glycines
ataattattttctatttttaggtcttcaaataactcttgaattggcttacatatttcgagcttcctctgaaatctgatcatgaaggggaatttttgattttacaaaacttctaaattaaaattatcgcgcttttgtaggcactgtaccgtgccaccggccaatcgtataagccggtgccaccaaaacagtcggcgatgtgcacaaaagtgcaaggctttgcggacaaagccagtaagcatggcatggacgagctgatacaggtgagaaaaatgctgatcagaacactgataaaaatgccaaaatgcaataaccaaccggtgatccgagaaaaaaaatacccaagtgattgggaatagattgagactgaccaagctgattggagacataaattttgacaagaatattattcaagagtcacaaatgctcatcagcttttatacgggagatacagtaacttcgtttaaaaaattttatcgataaagaaaaataatagggcaatcaattttaatcaataccttattatttgatctatggatttatccaagacagacacataaagaaaatgagagagagctccataaatgttagaccgattattcttacggtacatatgtgatatactgtaattttctgccaaattttgctacaggcggaccctgtccaaattgggcatgaccatctgtttgccaagctgcaatcgctgacgttggacttccgtctgaatgagcacatctgttcgctgggatggttctcgcctggccaagtgtttgtgctggacgagtactgtgcacggtgtaagtccaacgggttacggtaggtgcctgggctgttgatgatttgcttggataatctcttgaccgaatgttgctgtcaatccatatcattcgagatttggtcgagattttttgaaaatttccgagtctcaggcctgagactccaaaaaaagccccaaggcgcctttcaaagactcgtgaacaaaaggcctcgaaaactccgccacaatttcggcctaagcctcgagaacgggaagcctaaaaaaacacctagacactttaagatatggccaaactcgagatgaacacctctaaaaatccggcaccctttttcaacctaggcccaagaatgagacccaccgagacttttttttggcctaaaaccgggaccatagctctgaaaatgcatagattttcacggaccgattctcgagattttccagatatggtgcgcggatgccatcggcacgtctcgttgctcaacgatttgttgaacaaagcggacgatggacatttggtggacccgacacttattcattactcattcgcattctgtgcatcccatgtgcacggcaatcggtgggcaaaatgccaaaaaactgggaatgaaagtgccagaaaattgtggaaattatttaacttatgccaattcgccatttcaggcccgacggtgttggcactgtcacattggaggagaaggagaagttccaggacgtgaaggagcgcctgcgcggtctgctcgagaaacagatcaccaattttcggtacgaaatctttttttggtttttgaattttaatcttttcttttagctattgttttccattcggacgccctgagggtacggtattttctcgattagattagtgaaaatttgacgctaaacgaacctgacttctattttgaccagtttttaatccctaaaccgaactttgaaaaaagtcgaaaattctaatttctcattttatgattttcgttttgttcaaatttaggttataaaattggaattagtcaatgttgatgtcagaccatgatcagggacgacaaaaaccccgcgggcgcaatttttcattattagaaattattttaccaaaaaaaaaacttaaaaccaaaagggtccaccctctctttggtttttttttttttgtataaaattcaaaggatacgatatgactttgcagcgaaaatttcgtgaaatcgaaatttgccccaaatttcaggtgcgcttaaaggcactctgtcactgttggagcgggtgctgatgaaggacgtcgtctcaccggtgccgcctgaagaagttggtgatttgccaaaaaaagaaaaatgcgaatgccgaaatggtggctaagtgtgtgtccatgcggcacacaaaatcggcaatcaaaatcagtacaattctccaaattttttttttcgtgattcgggtcctgatcactaattaacattgtcagcttgaatggcattctgatcagtttcaaaacaattgttcaacaaaagaatgccatttgcagcgattgatcggttgatttctcttcactttgatcaattcaatgactctgatcatcttcaaattcgttctgatcagcaattgcaactatgtccctgtgtttttttgccaggttcgcgcagtgatcagaaagtgcctggaggacgcggcgctggtcaattacacgcgcatttgcaacgaggcaaaaattgagcagcgcatgggcctggacgtgagcccacaacagcgcatcgaggacatgatcagggtgacggagctgtgcattgatttgttgaaagagaacgaggaacaccacggcgaggtgggcacggcacgggggggcgagagtcggagggtgggtgccgtagaacgaaaatactattttgggatcattatcgatgctagatcgtttcgtaaaatccgccattttagctattttttcaacaaagtatggtataattttgcttcaaaataacaaaattttacattcttggtatcgttcgggtagtccttattttttctattagcatgcaaaatttaaaaaaaaatttaaaaaagccataacttaaatgaatttgatttgtaatttttgcaggcccgatctcgcctaactttaggtcgcttatttttatcagaaattttcaataatttaatttaaagattggagggggtttagcgctttgcgttctccatttctatcagaaaatttttgcaaatccatcgaattttttcgtttttaaattctttaaaaatttttcaattaaattttttattttatttaaagattgacaacgttttaaattgatcttttaataaattttttattcagcaacttcgtgaggtcagtaagttttttgtttgtccacacacaaaaatttttcatttttcattcgcttttttgctttaagtgccgtgcttattcaaattgtgccattgtcagtgtttatttaagaaaatttgtgatgagaaagagaaaagagagggagcaagaaatagaaggagagaggaagagagagaaagaaagacagatagaaacagaaagagagagagatatagagagagggaaacaaagacagaaagagagagagagcgagtgagagaaaggaagac

SEQ ID NO: 2923 - DNA, 3522 bp, Heterodera glycines
tattatatatgtctcggagacattaattcgttgaaaatttgtttgtttgtaaaatctttatgggtgctttatccaatgatttgattgtattgttgatgcaatttgtattgtatcgagttggttgcatgtcctttgtgagatagtttttgtttggtgctgttagttttcgacagtgatgatctcgacagtgttggtttcgacagtaaagtttattttttttaaatgttctaatggtataagtattattaaattttggcactcaaacctgacattagttagcagatgttcgcacatgatttgcaagtaaatttttgtatttttgactacactcaatcaggagatatttatatagaaaaagtgaaaacgataaatttttgacaaaaaattctatacaaatcttttttttattgcttacttcaattataaattttgtatatgcaaatcatatattaatactaacgcacttatttgttagtggcggtttaagaaatgaccaagcagcgttttaaaccgattcatactctttaataagctttgagttttagagctaatttatattttttgagctattgcctatttattataaagtaccattttcaatttcgttcatatacacaccgagtcaattttaagcccctagttcaaaaagtaaatgcatatgtggcgaagtggtttttgtaagatagtaaagggacaaagggtggtggttcgagtccgttgtgaaacatgaatatttttatttatttttgtctaaaaaattaaaaaatgacgaattttgggaattatttttgaaggtttttcccaaccaaattggacaatcttggtatcattcgaaagctcttggaaagtagaaggtttttctaagcaaatgctaagcatttttattagtttgaaaaaagatataagcgtttgaaattttgttttttgaataattttagatcggagcgtaaaaaaataaaactcgagcgttaaaaatattcataatatttttctctatcgacatgcaaaatatgaagaaattctgtaaggcggaaaaaaagttctatagagcgaagtaaattcagtttttctctattaacacagataaagaaatagtacgccaaaaagagagatgtttttttctctgcactctctctttattgacacatgtctcgttttttgactcggtgtgtgtaatagttatagcttgtttccaaaaaacccctccagggcgtgaaaaaaaccctcgatgcttctaattcgagaaaatcggctaaaattcgtcccaaatgatcaaagaatccatctatttgatcctttaaaattagcggttcttttgccaaaaaaaattccagtcgaattggggcgatggtccataaaagacaatttaatttgaaaacgcttttcagttctgtggtgatcagcgaggtggaaacacttgtgttccggtaaatttgttttattgacacgcatttttaaaccggttttttgaatggttttttaggaaaaacatttcgccaaaggcgcaacggtacgccgtgcattttctgtcccgcgtcattttggacgctggcgaggccgagttggcactgcagttgatccgcatctatttgaagctgttccacattttggtgaatttacctaaacgaattgtcttttttttatttttccacccaaaatttttgtttgaattctttcgagggtcaagcgacctttgcctttttaaaaggttaccccacatttgcgtcccggacatttgcgtcccggacatttgcggctcagacatttgcggcccgacatttgcggcttccccaaatcatcattaataatcagacattatataattatttttattttccattggcttgttcatggcccaagagcatcaatttttaaaaatgcttaaaataaagtacgggccaggggtggggcgcgaacagaatagatatgtttttctcaaacaatacatgttgcagcactgtgtttcaaataagttaatttattttgatttagcagaacataaaagtgggggagaatacagagagaaccgcattaggattttgcttcgtcatttaaatacattacagtatcgccttgcggaccgggtcggttgggcgccgccgattgggcgccgccgattgggcgacgccgattgggcgccgccgtttgggcgccggtacgattgggcgccgccgattgggcgccatggggaaatttaaattcattaaccttgcctcaacttagggttaaggactttccaaggacgggtataataatttacaaggacgtaacgtgaaagtttcattaaattcaaggatacaaaaaaatcataatatgcaatgaaaaatgattgtagtattttttcattattattttgtttctgttcatcagtttcctcatttcaccgcatgtgcacttttttgcggtatgcttttttcaaaaaactttttgggaacattggttccggcggttgccgatcagcaggaaaatttttttgaaagatttcagggtacttatgtatgcactttacaaaccataaaaaaattattttttaaaacatttctagggggttttcaaggtcgctgatcattctattttgaccaatttcgaatcccggacccgaattcaaataaaagacgaaaatttatttttcatcaaatcaacctttgttgtcccaaaatctattcaaaagaatgtagatgattaaaaacattatataaaataattgtttttcgcgaattctttttcaaggacattaaattcaaggacagcttcaaattttaagttacagggcataatttcgaggacccatgccattaaaaaaggagtcatgaaggaattttgtgactcaaatagattttaaccccataaacattacgttttttgagtgctgtttctcgtaattcaggtgaatggctaaaaatttttgtagtaatttcagttttttacgtttttggataatatgaaaacgaaaaatttggctgccgcatggcgcccaaacggcggcgcccaatcgtacccgcgcccaatcggcggcgcccaaacggcgtcgcccaatcggcggcgcccaatcgacccccaccgcccccccccttttcatgtaaattagcagagacaaaagcccattaattgatcggaatagatgcatacgcatttgttagaaaaccagtgtttttctttttattttttgcttcatttccatttttgtttatcctttcgcttatgtgccttcttccccacccctccacttccgtttcattgtcaggtgatcatcatcggagatgccggcgttggcaagacgtgtctcagctaccgtttctgtaacggccgtttccccgggcccaccgaggcgaccatgggcgtcgattttcgcgagcgttcgctgctcatcgacgacgaactgatccgtgttcagttggtcagtgtccgcaatttgttttttgaatgcccacgctttggcgtttccgttgccctttcagtgggacaccgctgagggagtgagcgcttaccgtcagtccatcgtgggccactattatcatgaga

SEQ ID NO: 2924 - DNA, 4619 bp, Heterodera glycines
tgaaatttagcatgctcataacgcgtttcaaggtctatgttatgatatcatgattgtgcaatttggttgagtctgagaaaagttatgagttgatttactcaaaaatttagataattttgcacttttcgtcggttgacatagcaccaaatttgccatagttttcgaaaatttgaccctcatgatcagaattctgcaatactgtaaagctttaatatgttccaaaagtcccatcaataaataaaaataatgtaatcattgatttttttttagacgattcgacccagagatttggtccgcaaatgtcggggctaacattccttcctcacgccccatgtgtatcgttcttgaaatttatagcttgtctacctttcttagttgcttctctcgaaaaaaatctctatctttttggtctcgcgatgccatgagttcagttgaagagttgccaatagtaatcgtgtccaatcgtgatctcccaatcggtgtcgtactataggcggcgcccaatcgacccccaccgtcgccttgtagaagggcaccataaatgagtgaactgtaagcttgttaagcattgagaacattggaaaataaaaaaattttgtgttaattatgtattgtaaatagtgaaaaataatgaagatgaaatttggggaagccgcaaatgtcgggccgcaaatgtccgattttggcttgggccgcaaaattcaacaaaaattgggccgcaaatgtccgaaaatggcccttaataaatgggccgcaaatgtccgggacgcaaatgtctggacaccttttaaaagcgcaaattttttatgagtgtgtatgataatgcgctaataaaaaacgttttttctttgggttgcaaaagatgcgctcgccgagcatccaaaactgttgccgttgctgatcactggactcaatcgggcctttccatacgccaagggtttgaaaaaaaattagaaactttcaaaaaaaaataatcaaattttaggtcgcacatcggaggtgctcgacaacgtgggcagtctgtacaccattgtgcagaccgccaagttttccacagcgctcagtgtgctgcgattgcttttccaaattcacagtgccaggcaaaacggcgaaaaccaaaaattttttaaattttttttccagcgatggcctctccgatcgcttttacaccgccttttaccgtcgcctgctcaatttgcagccgggcaaccagcagcacgactcacaactgttcacactggcgcaacaagtgctgcgcaacgatttggtggagtgccgcgtccgtgccttcctcaaacgcttcttccaggtgccgccagaaaacatgggagggctcggcactcgagcacactaaagggtccggaccaattggcggcacacttgttaaaccggatgaaatgcccattttgtcggacgggcatattaaatttttggcttttttctcttgagagaaaaagagtggttccggtggctcagtggttggaactgaacattacgaaatgggtggaggaggcgtgggttcaattcccacccggggccaaccaaataagtaacactttgtcacggtttgtttaaagggaaacctttccaagttgtcaaattccgctttcccattgctatgtgacgaagcgggccaaagacttgggaaattgtcatttgatttggtcggcatatggaatatggggaatacgcctttccttggcatttcccatcagatgcgccggcacattttgtcaatcgcattcctatgggcttaatcgaattaatttgccgtaaattctaaaacaaatactcccgaaattattgtttttttttttgcaattttagccgtaagtcaactattcctggggctttaactgagttcacttacctaattaggctaattagttaatagtttttttcagattgctctttcggccaactcggcattcgctgcggccattctgctgatgtgccattccgttgtgcgggaacgaccgcaattgctcaaagtgggaagggtcgcgggaccataaccaaattgggcgttggcaaaattgcctttttgtcaacatttactaacattttgtgccaaaaagatcatcctacacactcactatacatgaaaaaagggagaggaaaagacttgatttgcgattttgaaccaattttggttttttgaaaatataagattttagggtccagagatgccgataggtgtcgtcgtgaaagtttttatgttttttgaaaaatttaagcgaaatttttcaagaagatacccttaaattccaacaattggccaatttgcttttttcgccctaaagtttgttaaagcatgctggtgaaccgtgtatatgcttttaagcaccgacaacaacgagacgacgacggggaaggtgggcaaaatgaccaaggggaggaggagaaatgggctgtcgaagaggcggaggaggaacgttatgaagatgttgatgaagatggattggttggtggcgacgacgacgcggcggtgccaccaccaaatcagcagaagcagcacaatggcaaccgatggcggtggcatcaacccactggctggctgcacaggaggccagtgcggcgcagcggtgctgccgcctctgccacaactgttggtgcgtgctgagtgtggtggcgggggacggacggtcggtgcatgcgctcgacatttcttgcgaattttgaacaaatttggattaatttagttgcataatgggctccggcggtgccgatccaataggcgctatcaggaaaaatttttttgcttattttctttacaacattaaaatttaaaaaaaaaattcccggttgaataaatgggtcccgcgatgccgcgcgatgtcacagaaaactttgcttccaaaatttatttgtgtatgttcacaggttatgacccaactgtccgcaacccattgtttgcgggtgcagaatgggcagtggacgacgaacttcgcacgctctgccaccattttcaccctaccgtttccgcatttactcgagcattggttaaaggttggtcgatgaattggttcaaacggttgcagcgaatgggggcggggtcgcaaggcaaggaggggtcgcaatttttggaaattttaacgacgcatttgaaacgtcgccgcacaaaaaaaaactttttcagaatttcaagaaaatttaaaattgttttttttttttgaaaacctaattgtaagtattaataaaaactaaatttccagaagaaaaacaaaaaactggatttatttccttggattttcttaataaaaatttacgaaacgacgttttatcctgctcccatttgtcgaccccgcccccttagaaattaatgtatgatccgtttccattcttgatgcaaaaataaattgattgaaaaagcgggcactccccgccaagcatattgcatttttttttttgggtttgaatgcatgggtttgtttgcctttttaggccggccgattgtttacgctggcaatccgctgattgatctttctcaaatgcgttttctggaccggttcgcattcaaaaacccaaaaatggaacggaaaaaattgccgacggcgtcagcagcagtccattgcaacgggggagccgatttgacagacagtggaagtgagggggaggaggaggaatttgacaatttcttggatgcgtatgctgttgatgacaattttgatgatgatgaggatggtgctgatgatgacaacattgattgggatgaggaagaaggagaggatgaattggaatttgagtgattttttttgtcatttcggatcattttttttattttcagttgttgtttaattaaaatattttttccatttggcaacacattgttggctgctctgaatttatttgtcattcatcatttttacatgaaatcatacgttctttctttgtaatttttccattctttttttggcagtgtttgttgtgcgcttgctgttcttctgtgtcccccttgttgtgccggctttttttcttccccagccatacgaatgggcaatttgttggtagatgaagtgccaaaaaaattaataaaatagaaaatcaagcgaattggcaagtcggaaaagcaagaaatgaaacaccggtgaaaatcacccgaatgggtagcttaaaattgtgccgtttgttcgtcaataaagtgccaaaagcagtcatgcattgttaaatttgtgtgtatatccttttgtccgacaaaatacctgcttttccgtcccaaattcgctgaaaactgcccgagagtcatagcaccatttttgctttactcgagtgccttgaactggcaccctaattatgtaaaatggtgtgcccccaacacagccgtggtccggcgcccgccaatgtcgtcgtgccattgcagacaacgaaagtgcacggcagaagcgggtcaagctggtacgcgacaaagtggtggcctacgggcaggacccggctgaacgtgaccgaatccacgcgctgccactgctccaactgcagggtgtgtctgagtgttgtgtgtgctgccatgccaaaaaaatacaaattgtgctcatacattttttagggggggttgaccccccccccccccccccccgctcgcaaagggggcctgcgaggagaggggggggggggggaggggt

SEQ ID NO: 2925 - DNA, 1618 bp, Heterodera glycines
tagctgtatcaattttttttttttaatttctgatccttttttaattttccgggagctggagcgggagggctcctccatacgaatgccaaacaccgctactgaccacaccgccccctgtgttcaggcgaactccaatccggcactctgtcggccacccaggttctgtacgcgtacgcgcacttcgcactgctggtcaacgaccggctgaactgtgtggccgaaatgttgcccgaggcgttcgacgaggcggcccaattggacgccaaatacgccgccggcggaaccgggaagaataaaccaccgctgttcggcttgccgttcagcgtcaaagccaacttttttgtgagcactctgatcattaagggtctgtgcaaaactgaacgaacaaatttctagattttcccgtaggtgcctaacaagcaccgccgggtcccaatgcgagtgcccctttttttcttttctgaatacgggccagacatgagaccctcgcccgaacattccatgtgtttcagttgaaaggctacgactgttgcattggcattgcccgttggttgggccacccgcggagtgtcgactgttccctggtcacccttctgcgtcagcttggcgccgtgcccttttgctacgccaacgtgccgcagacgctgttcagcttcgtctgctccaaccctgtctacggcacaacgggcaacccgcacgacccgaagcggtgtggcattttttaagaatgaatgggatacacatgccatgatgcattcatcctcccctcctaaattacctctccctctctttccagggggttcaaaaaaaacacacatacgggggctctgttttaggaaatccgttagattttcggatgttagtatgcttaattgtgccttcttttattgcactgcacagaagccctggcggttcgtcgggcggtgacgcggcacttttggctgccggtggcacggctttcgcaaccggcggtgacattggcggctcattgcgtattccggcacagttttgtggcttggcaacactgaaaccgggccaaagtgccttgtttatgatctgcacagatatgcaatgattttcccaaaatttcagaccgatttgaaatttcaaatgcccatttgggaatgccgggccatgcccgactggggttgggcactggagtttttgccaaatcagtggaagaggtgtgttacggacagcagcaggctgtttaacagatattgattgttggcatgcaaagcttcatttgttcatcctgtctacattatacaatctgatcggcactccctttgatcactttcttttctttcattcatttaatagcattctttttcgatccatcatcacaaccctttttttggtctgatcacgacagcctagttttatttaattaccacacaattctcttttcatatctgatcgctgatcacccccacccttcctctgatcagttccgctcttttttggcctggtcactactttagcttcattgtttctttgattaatcatcattcgtgcttctgtctctgcttctgcgctctgatcactccctcctctcccatccactgatcaccttatgcttgattctcccccgatcagttgatcatgctgctttcca

SEQ ID NO: 2926 - DNA, 1019 bp, Heterodera glycines
  misc_feature (122)..(122): n is a, c, g, or t
gaaaaatcaaatttttcgaaatttcgattcgaaaattgtttttttcattcccgtttagttgtgcccgtgtggtggaggagagtgtgcaaatgttgcgcagtgtcggcaacgaaatggtcctnttccaaattccggaaccaaaatgcgccggtccgtccgtttctgtcctaattttttttgggaaagttcaaattcaaaaaaaaaaattttgaatttcaccctttttgtatagcctccattctctacaaaaatctcttgcccgacggtggtgcgtatttcaagaagctttttgcccaaaaccctgtcgacccgtaccttcaaaagcaggcatttctgttgcgggtgggtcaaaactcaattataattattataaaattaaattcaattggaatagaaattaatttaattttcagtgatataatttttaattattttcccgacgcaaattcgtcttaatttatgactttacacagaataagcgccctaacaaataagtgttctaactattagcttgcatttttaaaaatggaaaaaatgaaattaaattttgattcgacgcagcaagcaaaaggtatcaattttttgtttaaaaagtgtccatgatgtggcattttttgcgggacatagtttatgctggcaccataatttccacatatttttgtgtacaaatattgtctgatcactcacaatttcacatgatctctgttttgatcagatcccgatttttttccgctgggcggtcgcttttctgcttgatctgatcagtccccagctggcggtcattgtccgctcgtacgtgcgcagtgcggacgacgcgcgccaggcgcacgccgagttggacgcctacgtgcacaaagtgcgtacgtgtgcgtgcaacgcgagggcgcgctgcaaattaaatttttgcctaattacagtagcttaaccagggggttacacaaaatgtggatttctgccaccaaatttgtttggccaatttaaacgttttttcaattcaaaaatttaaaaaaaacattaaa

SEQ ID NO: 2927 - DNA, 1767 bp, Heterodera glycines
  misc_feature (17)..(17): n is a, c, g, or t
  misc_feature (48)..(48): n is a, c, g, or t
  misc_feature (53)..(53): n is a, c, g, or t
  misc_feature (129)..(129): n is a, c, g, or t
gaatagaaataattaanttttcagtgatatattttaaatattttccgnacgcnaattcgtcttaatttatgactttacacagaataagcgccctaacaaataagtgttctaactattagcttgcatttntaaaaatggaaaaaatgaaattaaattttgattcgacgcagcaagcaaaaggtatcaattttttgtttaaaaagtgtccatgatgtggcattttttgcgggacatagtttatgctggcaccataatttccacatatttttgtgtacaaatattgtctgatcactcacaatttcacatgatctctgttttgatcagatcccgatttttttccgctgggcggtcgcttttctgcttgatctgatcagtccccagctggcggtcattgtccgctcgtacgtgcgcagtgcggacgacgcgcgccaggcgcacgccgagttggacgcctacgtgcacaaagtgcgtacgtgtgcgtgcaacgcgagggcgcgctgcaaaatttcaaattaaatttttgcctaattacagtagcttaaccagggggttacacaaaatgtggatttctgccaccaaatttgtttggccaattttagcattttttcaattcaaaaatttaaaaaaaacatttaaaaatcagttcaacgagcattggttggagcagaagttggacgcgctcattgtgcccgcttttcccgtcccagccgttgggcaccaatggccaagcgatttagtgagagagaatatttgttggcacagaaaataatgtcaagccgagtgccaaaatttaaaaaatcaaattttcgaattttgggttgcctgcgctttcgccactgggatgtacaacatgttggacatgcccgccggggttgtgccgacgggcaccgttcgacgagaggacgacgaggcgctgatggacgacacgcaatgggccaccggtgggtggtgatgaacagtcaaaacagtcaattgccacgactaattatctaattattcgagttagcaaaattaatttatacaacaaattggcaattggctataatgttatattaatattattatttttcggtaattcataaattaattattaaatatgcctttacaatttactgaacaattattaataccattttattggctattagctaaaaatttaatttaaataattatttgcatttccctacaatattttataatcgatcgcctaattactcaattaaagacgggaatattctgctcaaatggatgcgttccgcggctgccaactccgttgggctccccgttggtgtacaggtgggcaaaacccggccgatttcacaaattttttgtaaaaaccgatttccaggtggttgcaatgcgttgggaggaggagaaatgccttgggctgatgaatgccattgaagcgatggccaaagcacagaaaaagtgaacagaatgccaagaaattggggaaaattttcaaaattgatcgacaaaaaattgtgttgtgattgaccctctgctgctgcttgccttttaaaaagcccaatttggacacttatatattcattatttgtcttcaatttctgaactttttttcttaatttaaatgattatttaaatatattatttttcaaagaatcaaatcctcttcttgtaatttaaaatatttaaataaaattgtattcattacatgtgtaaatgtaccaaaggaaaattccgttttcaaaaatctttataaattggataatttgtcaaattttatttaaacattttcaaaattcc

SEQ ID NO: 2928 - DNA, 4071 bp, Heterodera glycines
agtcatgaaaggtcttaaaaaacacacggtggttcgcgcgacgaagttagacgtcgcgttcaaacccggtttggatgagaaatttaaaaactcggtacaataagattttttttgatcatttatttcctatttaaggcaaaatcaaagttagcgcattttaaaagaaaaatatggaattgacgaatatgaagcgaggaattggatgacaaattaaaattgttaacattttcaacatttatttaaaaaattcaacaacaattataaatcataatttttcaatttaattttgcagtgattttaattaaaatatttaacatatgacaaaaactggaattaatttttcattttttcattttttgctatgaaaaaaacaaatatgaaaatctcaacaaaaaatatcataatctattaatttatttaaaaaattttcaagtgatcggatggctacgcactttgtgattaaatatataaattttcaaattcaaagatatatggtgctccacgaaaaatcttagcggtagtctgagcaccccgtaatgaaacgacaggaaccgtcatgtcgggcgttactttgcacgcacagtcttcttaaaaataataaatatacataatgtggaaaattaatttaaaaaagacaaaattaaaatattattactaaagaagactgattttaagttatatttttccctcatagaaatttaaattatatcaaaatcgcaaaacccaaatttattgaaaatacttttcatcggtttatcatacctataagtgttccgtttaacgtgaaaaacgtttggaagttcgaacgatttaaaccaactccaacaacgtccccttcggcatacccccacgttctaattgtcgccggtcccccaaataattccaaacctttaaatatatgtttgaataaaattaaaaaaacataccgacgatgtctccatcgctatcaaaccctattccttcggaccaaccaataaattcacttttttttagatttttcgaattgagtccaattccaaaggttcttaataaaaatacacattaattaatgatggctacattagagatattattttttctagtaattaaaaacgatctttatataaaaatttcatcgcttaaaatacaaaaaatcacccttggtcaccgaaaacgcattcaaaatataagactgtgggaaaatttgaaaccggttggagaggcggcatggaaaaagagcaaatgtcttaaccgatttaatttaagcggaaatatattataaaataccatatgggtgcccagtgtgccgtaaaaacaacgtcatattgtgaatacttaaaataggctaattagttaaaaactataagaaaatcgaattttattcgttaaaagccaaattatgaaatggttttcttttgtaaaccataacttttatatatattttcaagatggtaccattttaataacattttcacgtgcacaaaaaattcgttcaattaatagaaaaaatgaccttctttttcacgtgaaagaccttctaattagtttaatggtatgataccaaaattatttcgaaaaatttcaacgtgaaataaaataagttttgagaagagaaaatttctctcgtagacattaatggtatggactataaaaaatttccctttaagttattctaaatttatcaacaaaaagaaatgtgtgaaaataaattattttccaaaaaataatttttccttttttctccattctccccatttgaaagagtaatgatcggtaacatcattcttgtctttttcttctttctctttctttcgggttgcctcgcttctctcttcacattttcttccttcgtcctccattctttgctcccatcgctctctgtcgatttctcgttcctctttttgttgctcccaaacatgttgccgcctcaacatgtcactgtgccagtcgcccctcacttgccgtctttcctccgcgtcccgcctctgttgctcgcgtcggcgtcgctgttcagcctgccattgtctctccgcctcatccattgcggcaaaatcttcggcggtcagttgcaacacatcctcaccttgtgctgaaatttgcatgtcgttttgttgggcgtacatctgaaataatattttattacatatttttaaatgtaagagctagaataagtcgaagttaaccccccccccccccctccccatgcaacttctgttttggaacccatacccattgaaaagttgaaaaacggcagatgagttatgcgtatttttatcttcttaaatactcaaactatttggattgtaatgtgtgacgaaacactaatttagtccaaattcggcaaataaaattagggaatggccttcaaacttgcaaaactttttggtcttttgtgcaattaacgctcaaatattacaaaaaatcatgcgattctattggtaaagaaaatgttttttttttgcaaaggaagttgcgattttattagatatgccgaaataacgaataataaatttctcgatttctttctatttgaaaaggactaaaaaaaatttctttttcgggtctaaacaaatgtgttagagcagttatcctaattttattatacaacatttttgtgtcaaatcgataattttgcacttgttttcggaattcatttatctttgaaaaagaaaggtccgataaattctctgcttcttgacatttaaatatatttatttctttgagtccaatgttcaatttttgcatagctaaggcctggtttccatactcatgcatagtaagtctaggtaatttttgaattttttcgagaatttctaagaatgaaaagtataaattttcgatttcgggggcactaaatgccgctatgtagaaaattttcacccgtttaaaaagtttatttgcaaaaatttcaagattatttgatcgtttaagtatttttccggcaaatttccaattttttgtaacatttttcttaataaattcaatttcttggtctattgttgtcatctgggattgttgttacttctagtgttatgacatcatccaaaggataaaaaagtgaatattgttcttcttttaataagatgttttggaacaaagcctcggctgtgttttcgctagggcatctaagagggcaataaaacgattcaaagccgaaagaaatcttcagaatacttttgaattttccctgttcctttttataaatttcttcgattatggatgcgaggatatctttaaaattttcctcggcattaattatgaaaggatttttaaaataaaatttagatttatattttttaaagccaaattttaagtcctcatgacaaaatgaatcaattatcaaacacccatccattttgagtgtggcccttttagttttttcgttcttatatacccatatgctcccaaacaattgtttggagcctattttcataatttaacatttggctctgcaccctccgggactcgaaatgtaatcttcgggcttccactaatgaattttgcgatagttcttcgaactttgttgcctggtcaaaagttttcaatctttcgaactcacgccacgcagattccgcctttactgactccaaattgatttggtccatgattttgaaaatttcccaaattgaatctgacattttaagatacaattcccgaaccccattagcataaggagctttttccctagattttattgcacgattaagcgtttcccgagaagatttggcaaaatcaccaacttcttctgctaacgccgctacatccctccaggctctctctgtctctttttttgcagcttccaccaaaatggtattagctttttctgatttttcagaattcatttttttatttttcattatttttgttttcttttatattattatattttatatgcaataaattcgtccctaaattctgtttggggtcttggcctttccaaatgtagttgcttttctcgcattgtttcttttaatttattggccaagtctccaatgcctaaatcgggctgtgagtaagcggtccgataggtttgcccaatttcttgccgataatttttggctatttcgattgattgttttgcctcatccgcta

SEQ ID NO: 2929 - DNA, 4924 bp, Heterodera glycines
  misc_feature (42)..(42): n is a, c, g, or t
  misc_feature (62)..(62): n is a, c, g, or t
  misc_feature (151)..(152): n is a, c, g, or t
aggaaagcttcagaatgcttttgaattttccctgttcatttntataattttttctattatgnatgcgaggatattcttaaaatttgctctgcattaattatgaaaggatttttaaaataaaatttagatttatattttgtaaatcccaatnntaagtcttcatgacaaaatgaatcgattatcaaacacccttccattttgagtgcgccccttttagtttttttggttcttatatacccatatgctcccaaacaattgattggagtctattttcataatttaacatttggctctgcacccttcgggactcaaaatgtaatcttcgggcttcaattaatgaattttgcgattgttcctcgaactttgttgcctggtcaaatgttttacatctttcgaactcacgccacgcagattcggcctttattgactccaaattgatttggtccatgattttgaaaatttcccaaattgaatctgacattttaagatataatttccgaacaccattagcatacggagctttttccctagattttattgcacgattaagcgtttcccgagaagatttggcaaaatcgccaacttcttctgctaacgcagctacatccctccaggctctttctgtctctttttttgcagcttccaccaaaatggtattagctttttcttatttttcagaattcattttttatttttcatttattaaatttttttttatattttatatgcaataaattcgtctctaaattctgtttggggtcttggcctttccaaatgtgtttgcttttctcgcattgtttcttttaatttattggccaagtctccaatgcctaaatcgggctgcgagtaagcggtccgataagtttgcccaatttcctttctataattttttgctaattctattgattgttttgcctcatccgctagttcttggcacatttccgcatcttttctgtcaaggcatttttgcatacctttttttatatttttaatgttattctcctcattttttattttgtcaaatagcgtatggatttttcttaccccatttaaaagcttttcatgccaaaattttaccccatgagcattaggatttttgtcttttatgttttgagcttcaaccatggtattatgtgccgagaaagaaaaatctttggcctctttcgttaacctaattatatctccaaatacggcctcaattgttcgccgtgtactacctaattgttgtttttcttcttttgtaatgcagcagcaactttctgccacgttcactataataaagagcaaaaataattttaagatcatcatttttattaataaaaattaacaagcgtatttatagatttaaagactgacaatatcgatcaaagagtaatatatccccttctttcctccgaattctttcaccctcgccccgattttcattgtacacacggccccagacaaacctttcaactcctcctaaatttaaatttgtacggttttttcccttaaaatattaccattccattttttttcccccgcacaccgaaaaacgccacattttccaaaactcctgtatcatccgttacggacaccttgaaataaggtgtcagtgccttctcaacaccacatgaacacgcccccttacggcataaaacgcaagccttaaaaactgatatatttttttcatttttaatacaaaccctgtactccgcatgtactacgttctcaattctcgctctcacaataaaaactcttccgccttcaataatctcgaaatttttaatttcagcgattgtttgcattttctggaattctaccaaaaataataaattaaaattgattaaatatttgggtcaaaaccttcactttaaaaacaacatgaacatttaatatttattataaaaaagcatgcgaaaaaatgatggtaattttaaaaattcttccagtttattctccgcaaccacccggcgtgaagtgtcaaaaagtgagggtgggagtctatagaacaatgaccacgatccgaccaaatctctaaaatatttttttaaattgttttttctatgttccaacctatctatacgttggtagaacatatcaattaaaacttcaacagggttcaaaagtagttctctgccccaggctttgcccattgctcttagcatcgaaacagtgtacaaataaagacggctcgtgaaagattcgtttgttgtttgactcctgccctcccaataaaaccaaaaggaaaacataggcgaaatgaatccctctcctgtatagctcgcctcaacggtaacatgtagcacggttgtaacccttcctatagccgtcccggttcctgtgtcgtaaaaaaatcttaaatttctctcaatcatgcagaaacagaaaagtggggtgcggtgataggtggcaatataatcagaatagcggctttcgtagtccctgtgtattataattttataatttgaagcctcaattaacaatgcctccacttctgctctgtttttctgccagaaaaaatcttctttttcgagagcctcctcaaaatatttttgaaacgagtacattttaactgaaaaattaataaagaaaaaaggtcgaataaataattattgtaataaacaaaaaataatgaaagggaaaaaatgaaaaaattttatttaacagggaaagaataagtgccaataattattgaaattctctggtctaacaaattcacttccccaaatgattgctgtctgtgcatgaactcgttgaaaacaatgtctgggttcgagtgttggaaggggcgggcagggatgatcacggggtctgacagggcactgcaataaaggtccactgaaattttctcaattttccagcccggctcagcttctcggctcattgcatcccccattaattttttcaggatttttttaaacattttttcgggatcttcgttttctgggcatttaaaatagaaagttgtcacgtgctcttttatcccaaattttttattttcgtttgtgtgactctccacttcttcgaaacatttttccaaattaggactattcttgaaataatttttggtatttttcgagcggcggacttcttttgaagtttcttggaagtttttctttgacatctaaaaaataggaaaagaatatgattaatttaaatattaaatgttataaacattaatacaaaaaacacaaaatttttaaatctcttaataatatccaaagggcaaaacattaaaatgatcgtcgataattccttttttctgcaccggcgtatattctttttgtacatcttttgagagaacccggaagtcgtttgtcggcccgatcttctccgggtagtgaaaaacttttttgacccctttcttgtaatccagcaccatctctttgaacaaatcatatttaaattcgtttcgtctatccaatgtcatccctctgattttggttttgtgccaaatcacgccatccttctttcttctgagtttcaaggcgtactgcttcggacccgcggacacaaactccaaaatttcgctgtcggcatactctcgagtcatctcccttaaaaccgcaatttaaatgcgtttcaaaaattatgttctaccccaaaaatttcccctccaccaacggacagcgccccttccgatgagcaaaagctagagaatctaaatttttggtgtttattttctttttattccttttcacctgtgtcacaatagagcagtttacacccctccttcttgtagacctgctccatgtactcgtacagctttagcctcgcagcactcgtggtccacaatgacaaaacaatattcgacactttatgctccctgatgaactcctcctttttccggtacacaactcttgatatctcttcgcttatttttactgggcgcccaaactcaattgtattgtctctccccaattccatccaacgttccatactgcccacaatttccgtacttgaaagggtgttgcgcatcgaaaattttccccacaaactgtttaatcccttaaattcgaacattttttagagattttttataatttctcaccaattttgcaatcattcttagtccgggattaaacccaatcttatcataatccaaaccgatgtcatactttgccttgtacatttcgatgaatgctcttttttcatcttcacttttcacctccgccggccaccccgacgcttccacctttatcttcaaaaacatccgcacatatcctttgaacagttgactgtcaaactgttcaaaatgatacgctcgatagaatcccacaatcctatatcctagctctaaagccttccgcaactcaattgatgtgaatgtccccaaaaatgctctctgcgtgggacgatggttacattttttcacatcttttgtcatcacaaattcattcttggcccttctcgcacaagaccaacaattagggaagaggagcatttcatcgatgtgcacggggaggagggggtacaaaagatttttcggggggattactttcactttcaacagtccatcataaggtacgtcgtcgggtgttgtccaattcacattaaaattcctgctcactacaattttcgggactccaacggggtatggggtgtcttaagcgaaggaaattagcaaaaaaagcaagcacatttttaccataattaacaaagggatacaaactaatgatatcaaacattgatatctcaacttcttcggtagcctttgcgtacaaacaaaagggcatcgttcttcccccggcataagcatccctcggattaattggtcccttgtccggcacactttcaaaaaactttttcatctccttattcttcttcaattcctccttcacgtcacactcctaaaactaacaattaataaatattttctaaatttttttctacccaaacttctccaattgaaaaattttggcacttttccctcaaaatttcc

SEQ ID NO: 2930 - DNA, 5053 bp, Heterodera glycines
actcacattccgtccacattgtacacaccttccatgttctcaatctttgcgatgattttgatgtttttgcccgcctagcccagcacttctctgatggttatagcctattccgaatcccggacccgagcaagaagtcgaaaattcaaaattcggtggtttttcgtttctatcaatgcagaatgacatttgctttttatatataaaaagaaatcttttctgtctgcgataagtgaatagacaaaaaacatatattttttaaccacgattttccaaaattatttgaaggatagggcaagggaaaaattttggaatttttggccatttttaatagatttttccaaatattggcgactttggtcaaaatttgaaatttttgggtccggcggtgccgacaggcgccgccgggggaaattttgagatttttgttgaagttttcccatttttttattataaaatttcagccccagccgttgccctcgctacgcccttgctccccgaggcaaaaattgcaaaagccaaaccaacgaatcggccttcaaattatttgctggaccgctgaaactcctcatattccctttcacgctcatagcaaaaaaaataaataaataaaattttaatagttattttgtatgttaaaaaagcgtgttttgtaataggtaattatcattgatcaacactgacgtggaggagttaataaatgcttttatcgttcaatttctgtttgatacgcgaatttgacatcgaagctttttctgtcatcaatcatgtttttacgggcaattgtgcaaaggatttaaatcggcttttgaactggtcaaaactcggaaaatggactatgtgctatctgagaggttttgatcccgttcaaacacaaggaatttccaaaaaaggaatttattttggcagagccgaaggcataaagtcacttcgttttttgtgctaaaatattagaaaattcaagtaagttgcggcaggcactttaaaccggtttgaatttgaaatggcaaactttgcatttaaaatatgctgttgaagatctaagtagtgtagaaatgagggggagagaggaagaaagaggattttctgtgatggattttgggggcacagtcccatcgacttttatgcgtccaatcaaatttttcattaaaataaatccattaaaacaaaaaatgcactataatagccaagtaacagccggcctttttctctcaatttgtcggcaaaaaccaatactagccgctttttctctccgttcgttggcaaaaagcagccagccggcatttttctccattcttcaaactccggttgctatgtttcgactagctatattactgctgccctgccctttaattttgtgtatggaatggcaagactttatcattgacaaattcggatatcgaagagcgcaaccttggcattgttgcggaatttgtcctgacaataacatctatgacaaaggtcgttgtgttaacgaatctagctacgaaacggaaaccgatcgttatattcgcataaattaacccatatagtttgaactattgagaaattttgtaaatagattagtcaatgacggaaaattgtaaatgcactgaaattagacaaaaaaattgatgggacgcataaactggacttgagcccaatttacaaaaaaacgtaattcttcagcccattgttcaaaaaaacgtaaaacttcaaagacggacctaatcagccatttttaattggccaaatttaaaaaagcataaggtttttatttgcaaataaatatcaatacaacaacaaatgccaaaaacaaaggcacaaaaatataaccatattattttttcaatcgtcaaaagctcattggacacgtccttctattatttgatttcctgcaaacgggttgtgtttgtagagccggcctgagaacaaacggggcaatcagtattcaattaagcgcaataattactgagtgtttaaattccaaagacactgacccgatttccatccggtgataagcaccacaaagtcgccgttgtggatgaacccgcgctccttgccctctttgatgccgtacgcgatacgattgttcacgtcctccgtcgcatttgacagctgcttcacgcacatgtttgatggtaacacggtgatactgcaattttattattttactaaaagatggccctcaaaaattcaaagaagtgaaaaaactcacttcttggtcctcttgactgaagttgatccgggcgacgtccattccattttcgatcatttggacaagcatttctacagaacgacaaacgggccctgaaaagggacagttcttggccagccttagtgaatattcattttcttcaatacttatggtgcaaatgattcccgtcttgcgcacgttggccataatttataagggccgagggtcgataaaatttggtatatttttatgtatgaacttggaatatcgaaacaaaaatttattgtttcactgaggcaaacgaaaaaaaaggcaaaaaaaaaaatcggtttgtaaatataaaaaatgaaatattgtgtgtgaaaagagagcatcaacaaatgacggatcgaaaatttcttttataaagattttgacaaaaatgaccatggtcatgaccatagctatgagagtgggaagagaagcaaaaaaaagaatcgacatgccaattcaaagcaaaatttaaaaatttactttttaaaatgtaaattgttatcgcccaccccatattagagaaatcctgaaagaatgaaacaattcatttattgaccattttctttgtattcccaataaattcacttttatgttcgtagctgatagataaatcgataaagaaaaaaaaaaaaaaaaaaaaattgccatcagaagggcgggaaccacttactctgatgactgatcacggtaaaatagtcacagagtaattgaataaatatcaagtgagatcacaggttaaaaataaacaataacgaaaaatttatatgaaaataaaatcgaggtcaaagtcaataaaatgcctcaaaagttaataattctttatacattggtgctttcagaatcaagagtcaattctaataattttttaaaggtgtttaaggagctagacattaacgttttatcaagggcattccaggccttgactgatctgttaacaaaagatttggaagattttttagattgtaatttaacatttaaccggaaaaaagacttatttcgagtatttaggttagttcttttaaacagagaatttgggtccaaatgtgtaaaaccatgtaaaattttgtaagtagttaggaggtcaaaaatttttcttcgtttttcaagagtagctaatttaaaaaattggagccgttggtcataggtagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaattttttaatttgaaaattatgttaataattaggaaaaaagtcgatttttaggggtgtatttttcaattttcttgtatttttattgcaatttttctcaaaaatgccaaaatatgtgcaaaatatgtgccaaaccccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaaaatgtaaaaacataaaaatccggtctctatatattattatttaattaattttggttttaaaacaatgcacaaaaatggagctttctcttcaactttccacaggttgtaccacgccttttgtgagattgactccgaatgtgaacgaaagcgttccgtgctcagctctctcccgctgatgggagttgttgcttggctggaggagcacacaatcacttttaagtcagtttggattagcaaatgttttttccaaaatgcgccgttaattattatttttgcatcgaattataaaatgcatgaccaaaattctcgcctgtcattagcaagattcatttaatttctttgtgctcctttcaggtccaaaaatgaatttgagttcccttttctggatgttttgggccgaaatctcagaatagaaaggcgaacaatgccgggagaaagagcagacaaatgtgtaacggtaagcccattcatttccttcaagtccattagcattagcatcattagtgtcataattgcatttcagaacagttcgtcctcctcctccaccgtcgccattgaacccgtctgatcggaggactcaaatcgcttggtcattcattcatctcttacaaattcacttttattgcactttttctttttacgtgtcaccaattcgtagaaaggcataccgtatttactgtaattagcccccggtggctctatttttcaacccccctcaaaagggcggctctaattcaggggggtgggggctttatttttcaacccccctcaaattcattttcctcttacataatgaatgcggattgtaggaatttcttaaagaagcggcgataatcactcaaaatttgtcctttaacgggtatttgtatttttcaatttcttttgttatcattttccttattttcaaattattcaaaaaaagttttggacatttgagttaaatataaaatttattcgttgtagatacgaaatttactcactataaaatgtatcaatgaacaggctcttaagtggaatggatgacgtaggtatgttgcaaagcgagcttaatgtgtaatggatggatatttacatat

SEQ ID NO: 2931 - DNA, 1221 bp, Heterodera glycines
gggtgataagcacaaaaatgagtaataaaaaatcaactctcattctctctcacggtctctcgttctttctctctatctctctctctttctgcctttcgctttcttttttttctctccctttctcacgttctctctctctttcgaatctttgttaatgggtgtatggtggccaagaaaaaataaatcagtaatacctggcgcgggcacactttttgtacagcgaatttgactttggcccattcccttaaaaatgggaaaatttaaatttaaaactaatttctcggaaagaaatggttaattgctaccagaaaagtctgttgggtttgccaaaaactgatttttgcgtcttgcgctgcgtaggcggccaaatatttgccgtccaatgaaaatgccaacgctgtgatcggcgcacggtgcgcctgcactgtctgaaaattgagggagtgtgtcctaattcaaatgatgtgcttttgatattcacttgtgccttcgatgcgcgaagttcgtgcacaatgatggcaccatttttgccaccaaatgccaatctgcgcgtgttgggacaataggcgaccatataaaatctgaaaaagtcaaatttgccgatgggatttggtgggtgtccgacttggcaatggcggggaacagctcgaacagtgagcgttgcttcagcagcgaaaggtcaaggcaatggacgagcacttcgccgacctaaataaaaaaaaagtggaaaaagtgttaaatgacgagtctaaaattgtaaattaagagcaccggaatgatcaaatcgacgacgaaattgtattgtttgtcggacagttgttcaagcaaacggagcacttcgttccgtgcccgcatcagcggactttggatggtgtgttggatggtctgatgttgggccaccgcattgtaacgggcaacctgaacaatggacgacgataataagagcgagagtgaaacaaaaagtcatgaccattcgtatcaccagcaccagggaaggcaggcattccgaaacccaaaaatttccgggaatcggaattccgtgccatccctgactgacgccaccaaataaataactgacctctgtgcttagcgttgtgatcagtgcttgaggccttaataaaaatcaaaaaatgaattaagtttttcgcattaacaaaaaagaaaacacctccgacaagcgatcagtgacagcgcatgcctggctgtttttgacgcatccgc

SEQ ID NO: 2932 - DNA, 5640 bp, Heterodera glycines
aatggatgacgtaggtatgttgcaaagcgagcttaatgtgtaatggatggatatttacatatggaacaaaagtgaatcagcagatgaacaatgggaaccacaaagtaggaaacaatggagcaatgcgagaattcgcgaaatttggaccgaaaattaaattcgggaaaaagaagattatcatcacgcaaagtgccattgagggagcaaggaagggatgagacaaaagagatcatataaatgggcgacaaacactggttgggtgtagtcagttgggcggggattttcggaattaaataattgcatggaaatgggggggggcaggggcacaaccataaataacaacgaagaaagtgaatggagggatagaaaaaaaaattatgacaagaaaaattaaaaaagcagaattgttattgtaaaataattaagcagcacaacggagggggggtggggaaatggaggacaaattaagagacaaaaacacacaaaaaaggaaaattggaacatcacaaaagctaaacatcaccaaatctacaaacagaacaacaaaaacaataacaaaggtaaagaaaaaaaggtggtgccaaagctggtgaccaaaaagcaaattttggtcggacaaaactctcgagccagggatttattttgatagcataccaatttgacaccaaaattgttcctcgccctgaggcgatgtcttgtgtgaccaaaccaaacagtaatatatataaatgagaaattacagaataaagtaaaggccgtaaaaaatgtttgcccattgggcacaccgaaaattgaatataaactatcatcattttttatcatatggtaaagcgattttccttcccattcggcagcatcagtgtaagcgatttggaattgatccacaccaatcgggcacggaacggctggtaactgccgcccggactgatcacaggaaattcaccttgcaatgattagtgggtgataagcacaaaaatgagtaataaaaaatcaactctctctctctctctctcacggtctctcgttctttctctctatctctctctctttctgcctttcgctttctttttttctctccctttctcacgttctctctctctctttcgaatctttgttaatgggtgtatggtggccaagaaaaaataaatcagtaatacctggcgcgggcacactttttgtacagcgaatttgactttggcccattcccttaaaaatgggaaaatttaaatttaaaactaatttctcggaaagaaatggttaattgctaccagaaaagtctgttgggtttgccaaaaactgatttttgcgtcttgcgctgcgtaggcggccaaatatttgccgtccaatgaaaatgccaacgctgtgatcggcgcacggtgcgcctgcactgtctgaaaattgagggagtgtgtcctaattcaaatgatgtgcttttgatattcacttgtgctttcgatgcgcgaagttcgtgcacaatgatggcaccatttttgccaccaaatgccaatctgcgcgtgttgggacaataggcgaccatataaaatctgaaaaagtcaaatttgccgatgggatttggtgggtgtccgacttggcaatggcggggaacagctcgaacagtgagcgttgcttcagcagcgaaaggtcaaggcaatggacgagcacttcgccgacctaaataaaaaagtggaaaaagtgttaaatgacgagtctaaaattgtaaattaagagcaccggaatgatcaaatcgacgacgaaattgtattgtttgtcggacagttgttcaagcaaacggagcacttcgttccgtgcccgcatcagcggactttggatggtgtgttggatggtctgatgttgggccaccgcattgtaacgggcaacctgaacaatggacgacgataataagagcgagagtgaaacaaaaagtcatgaccattcgtatcaccagcaccagggatggcaggcattccgaaacccaaaaatttccgggaatcggaattccgtgccatccctgactgacgccaccaaataaataactgacctctgtgcttagcgttgtgatcagtgcttgaggccttaataagaatcaaaaaatgaattaagcttttcgcattaacaaaaaagaaaacacctcgacaaagcgatcagtgacagcgcatgccttgctgttttgcacgcatccgcttctgtggtgaagcagcaaaagtcactgaaaagcggacagattggaccttcaaatatttttgagtgcatccacaccccatatacctaaaactttggcgattttcaaattttatgatgaattattttattataaaaaattttataattttgtttgaaattcttggggagaggaaacgagctgctcccatatttgttgtactataatatttgaacaattgaactgtaagcactaccatttatagaaaagcactgaccttttttcttcgtcaacaccggcggctgcggatgccaaattgagaaggcccaaaatggtttttgacaggtccaaatggggctgccaaagcacaaagcctcggcccagcaaatcgatggccgcccggcgcagcggcgaattggcgggaagtagcggcgattcgggcaccagcaacagctcgagcaatgacagtgccgtggcacggcacaagtcggtgttccgctgcaaatcggacggaaactcggcacccatggcgcccaggaggacaatggcggtcgcctgattcctgtgcacttggtgcacaccaccacacaacagcatttggtcctcttggagctgtaaagagatggattattcatgcaaacaattgaattttgatgagaacagagagtgacggagtggtcacatttttgggtgaaccccaaaacttgccgccgaatttttaaaaaattcaaacttttttcaagaaaaaaatcttagaattttttaaaataagatttcaacgaattaaattaggtattatcaaattgtattccattatttcttcaaattgatcacagactttgtttgcaattgcggtggacgaggcgcactgttggtacgggtcgtccagcgaagagagtgacgaggagttgcactgggcgacggatgacgacgccagggaggaggaagcagccaactgctgctgctgctgttgttgttggctaacactaaagtgtttatgctggtgatgctgattgtgtttgttgttgctggtcagtgaactcctcggcgaggacctgcagttgttcggcatgtcattgccaactccgctggtgtccaccactgtctcggttgttgcaccgccgccgccgcattcagcgccaaccatcgacgaggggggcagcaacgacggcagagcgcccgagctgactgttcgcggcggaattggcggcacagcaggacgaggcggtggcgccagtttcgtgacggcggttgctgttgttgtactgctcgcggtcgacgacgcaacactgttggatgagtttgctgccgacgaatccatttgaaaaaaagagccggttgcggacaaatggtggtggaggtgatgatgctgatgacccgtcgtcgttttcaaaatcacaggtaacggcttttcctcaacaaaagcgacatggtgttggtggtggttgtcctgcagagtgccaatgttgttagtgttattgccgtgggaatggtgagcagcaccagcaccagatgtaattgtggacaactgcgacgtggtccctgcaccgccaaaatgggtcccaaaaatggagatggacgggtccaaaacggtgggtaaaaagttggaccaccgctcgatcagccgacgtcgacctgaaccagtgaaattcaggggaattaacgagttcacgaggccccaccatcgcctcccatccgcgtcagttcgcggatgagcagtgcttgcgctgcgtctcttatctcaatgcaattgtcttgccacctgcaaagagagaggggtgagattttgggcttgctgtcgatgaaaaatggacttattgatcaaatccaagtctcgataggacttaaaatactgttgatggctttaaaaaaatttagggtccgtccgaccgtccccattatccccaaaaaatgactttcttgccaacaaatcgatgcgcggtgttgcgtaggcatcgctcggtctgatcagttcagggagcagcacacagtgaagtgctgcgacattggaccagccctgtcggattagttggcactcattttccggcaaaaagtcggtggatttgatggacgatgttcgcctgatgaaaaaagggataaattggtgggaaaagtgggtgaaataaattgtagaaagactcctcctggaagaggagcactactcacttgagaggcggctttttgatggccaattggttggatttgcttttgagtgtcataagtgtgttggacagggccacgactgacaacagatgagcctttaatgaacaacaaaatgtaagtggcaggccatgccgaactatcgctgaaatcccataccgtggtcagggcacgactttcatgccaatggatgctgcgcgagaaatatttgtaggaaaagtcgtcaagcgcggcaattttgcccgaacaatggggcgtataaagtgacaaatttcctgtgaacattttggcatttaaattttgatttttcggtgtttcgacccgttaaattacaaaccctttttggtgatagtgccaaaacagatgggcagtttcggccggcacaacttcagattatgcatgcacgccctgtccacctcctcgtcaaggtcccacccatgcaacagggagaccaacagtttggccgtgtccatgtacaacgactgttgttggaccaaaaatgtgggggacagcagcgaagcaccacaccgccgatggttgcccttgggttggcacaggcggcggcatttcttgcagcgaagacgaggccggagggaaaggcgccgccgccatcaaaatggggatggcaatgatcggcagcgatgccgttgtcctgatgatgggggtggtggtgcaacggcgaagaagcggcagcaattcgtcggctgatcaatgtgtttagcagtgcccgcccgctgtcagtgccggcgcctgagagacactcaatgtttggcggcggcggcacagtggcagcgaaattggcaccaccatcctccgactcggtggcacagagctcatagtcgagcaggagaagaccggctaaaagacaaaaaactaattcaaaggagggaggagaaaaaggaaggcaaaataaagagaaaatgaaaaaaattcagagttaaaaacacaaaagctaattcagtgtttcttttcatcaaagtttgatgtttttttcatctgtttgatttttttcgattttcaggcgtgaactggccgagacggaaacagcgggggcgaggggggggggagttgaacgagctgttacaaaagcctttattttagtggcaatgaaaaattcattttttatacttttttaatatttaaatttttaaagcgccaatcataggaagaaaatattactgatcagagaatcgatgttgaagaggactaaatgggccttgtcggaacagttgcgcaagtgcaaaacttccagcggaggcgacaaacgaataagcaattccacagaggcggaaagatgatcagcaagggcaacggcagaagcg

SEQ ID NO: 2933 - DNA, 8375 bp, Heterodera glycines
cagggatgtgcctaggtttcgcttttcgcatttcgcctttcgcattttttggcgtttcgcatttcgcttttcgcatttcgctttttggcgcgaaatgcgacttttacacccctaagaattggattaaattcccacaaaatttttcaaaattttacctataaattggctaattttcagtgaaaaactgtttataaatgatcaaaatttccagtttttttccccggcggcgcctatcggcaccgccgcgcccccaaaactcctattttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcgccgcctgccccctcttcccaaaaagtttttttggaaaaagcgcgcctcaaaaaagcgttttattgatttttaaatttggaataaaattttaaaaaatgacttttgctttatgattttaactattaaaaagttgcagaaaaaatttcgcttttcgcattttcgcatattttggcttttcgcatttcgctttttttttcatttcgcatttttcagtttcgcaaatttcgcttttcgcatttcgctttttatttttcaatttggcccatccctgttgagcatgctatgttttttgcgatggtaatgcatacataattataaacatttaaaaagccttgaaaatgcagttgagccaaaattaatataatatattcgatagccctaagaattccctatttatctaaaaaaattccaaaaaaaaaattcattgagttttaaaaaagtcctggacaaaaattcctgtttaagattttgtcgtttgagccaagttatgaatttttatggagtttgaacttatcccatttctattattaataaaatcgcatcaaattttatttacaggttaataagggattcaaatgcacatataataaaaatggctcatgatttctgttttaaaaatttttatgaaatttttatctatgccaattttatcggcttaaattttaaaaaagcattatcaaaggtgcgattttattaataataaagagttaaattcggtaaatctttttgttttaaattataagcctaaaattggcataattaaatataaaattttgaaaatttttattcattaccatttttcagaatatatcattcgagcatattaataacatgccaataaaatttggtgcatttcagagccctttctgaaaaaatatttatgcattaattttgaaaaaaaataaataaataataataataataattaaaacaaataagcattgaaatagtttcattagttctgtgcgggggagtatgtctataaaatttagtgccggtctgttgtacggcacggagccagcaacagtgtaaattcagcaacggcggcgccgcggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagtttaaaaccgcaaaaaaggcagaattttcaaagttttttatttctatctttttttatagttcgaaattttctgtaatttttagtaggctaatagagcctgtgaagagctttcgaattatatcaagattgtttgattcggtcaataacttcaagagttatattgactcaaagttggctcagacggagttggccagacggagttggcccgttccgcggcgccgggagtgcccgaggtactggcgcgccaactgctcggcttgccagttctgctgctacttgctgtcattgtggtgtgaaatggcgtgatttgtatgcatagagaagagtaaaaatagaaaaaaaaattttctgatttttaattctacttttcttatttgaaactaattttttactcataaatttttaattggtttttatttcaagagatatttatccatttaattaagaaaaaaacaaataattagataaatgaataaaatacattggtgtgtcataatcaaatataaaatgaataaacaaacaaaaagacaccgccacaggcattaattaaatttttgattgtttttattaatttaaatcaaaatttgggcaaatttattttgtctatttagaagagatatttttgtacttttagccaaaaaattatatagcccatgctggtggataatgcgttcaaaatacagacacgagagggacgacttacataaaacattgacacacataaacttataaaaaaatgataaaaatttgctgattggaattggccaactgatcagctgcagagacagatcacccactgatcactgatctgccccttttctctcatggatggccaacaaatggtacgaacacaaatggattagggatgaagcattattggccaagaatggacttggactcgatcttttaatttaattttatttgttgaataaaatacattggtttatcatataagcaatacaaaatttacaattggaaaaattaaacaaaaagacatctccacatgcagtaattaaatttttaattgtttttattaattttttcgacgttttaaatcaaattttgtcaaattttcgtcaattttttgtttatttaagagaggatatttttgttctttatgccaaaaaataatagcatatgctgctgatggatgatgtgttaaaaatgcgtatttaaaacaatgacacccctaaatattcaaaaaataaaatataaatttgctgattggaaattggccaactgatcagctgcagaagacagatcatccactgatcactgatctgccccttttctctcatggatggccaacaaatggcagaacacatggataagggatgaagcattattggccaagaatggactcggactcagttttttcatcggcggctgttcttcagtttgtaaacttttgaaacgtttttgcacttcagcaactgcataattcaacaagcagtggacttcgtccacccgaatgatttcctttgtttccggcttactgttgccccaaaaatgttactttattgttttagcgtccttaaatactaaacagcaaaatgagtcattctatgcagattaaatatacatagaagtaaaattcaaaaaatttaaatttcgactttgttcggattctggtccggggttagaaattggtcaaaatggatatcttatcgtgatcagcgaccttgaaagctagaatttgtgctcaacgcatcaaataaccctataaatttttttttttttggatttttagtttatttttttgtgggaccaataaaaactgtttttgggacgcgttaaaatcgactagaatgatcatcaatattgttaaaaacaaattaacccaaattatagaaatgccattagagggatttgtagcaattaccaaatgaataaatgatattttgttgtattgtctattttatttttattttttaaaaaattttgatatttaatcaattgagacgcagttggcccgtttcgatcaaagttgtttgagtttgaccgttttaaaagaattttttcttcacatttcgatttttgaactggctcaaaaaccgatttaatcgcttctgatcaacttatttcacctcctagatcgatttgacacatcgagagccgcatcagttgctaagacagaacacaaaattctgctaggatttgggggtatttgaatttgatttgtggcgttatatttcaattagccgaattttttttttttttttttcttttcgcttccaaattttcaatccctcatcgaatccacgcaccaattgtgtaagtactctccgcttctccgagccaacacgaaaagcattcattattcataaaaagtgattccgccactttttgggcgtattttattgattctcaggatgcaaatagctttcatcttaaattaacccgtacatttaatcgaatttctaaagctcaataaagcctagtatacctgtatggttccatgtttgacctggaaaaaaaaacctgagatttcctgtacaaaaatccagggttgcctaaaatggactggtcctggtgataagaaaaatccatgccctagatgtacgaactttccaccctgccatctcattttttaacgaaaaaaactttggttaaaaccttaggaaaagctataatgacgaaattgaccttcataaagcctcggaaatggaattttttaaacggaaattgaatttgtttttaaaaaatacctatattggttttaatgattttttgacaaatttcagttacacacaaagtctttttagacgcctctaataaattttctatgttttatctctacggaaatttgttaagacgactaccaaattttgcgcaattttccttccatgtctcacattttaaattaggtgcacaaattattcgatgcatcattgaaaattttaattttttagcgaaattttcgccaaaaatggccaattcggaactgaacacaatgccatcaaatggtgatttgaagcacaataatgctgcggaaaaggtgcagcaaccgaacgacttgaagaaggtcaacgagggcggaggaggaggggcagaggctggccaagacggaacagcaccaacagcagcagaacaggcacagaaaaagccaagcccagtgagtgttttgaaacacaaaaaacagggcacaaatcttagaggttttttatgatccgatgtccattttgcccaattccgaatccctaacccgaaatcgaacaataaggtccaaaaatgaattttttttttttgaatttagactgtttgtttcggtttaaggattaagaattggacaaaatgaatgccattttcgtctggcgcgacccaaaaacctccacagaaaaatgtttcacgattttaaaatattaaaaataaaaattacaaaaaaaaaagagaattttgacaaaaaaatgagtttaccaaactaattgtaattggatttttgccaaaattgttttattttttgagatttattgtaaatgtgatgcactttttttgtatttataaaaaaaaaattacccaaaaacgatcaaatttttgctcgaaaaattgggaaatttattaataaattaatactttcctaaaattcttaaaaaattaagttggcattgctacgctcgttgttcaatgacgcggcactgttcggcaatgtcggaggcccaattcaggcgtacattttgccaagaactgacgcacattatgtaatttacggtctacgtcagttcggccccagcacgtttcgcagcgggttttcgctttggcatccaaatccaacattgttggtatcattcgaaagctcttcatgctctattagcctgcaaaattgcaaaaaatttcgtcaagtttaaaaaaagtttgagccagaaaagttggaaaattttgttttttgaactcttctgaccataacttttttgaaccttaacgacatttttcaaaattctgcaggctaatagaggacacgtagggctatcgaatgataccaacaatgttagatttggatgccaaagtaaaaagttataagcgaaaacccgctggggccgaactgacgggttccggtaatttatcttctttttttttttggaaaaatgcgggagagaatttttcctgctttgcgaaccttttttacatagttcgaaaccagacctcagaacttgaaaggggtcgaacttgatgtcaaaaacttattctcctactaaagtttacccattttttgaattactataattgcatttcatataataaagccccgaattagggggaaaaccccccggttttcgagatgggaaaggattccggctaaaaatctgtttcaacttgaatttgggtcctgttgctgaacccggttcctggaaaaatctgtacacaaaattctggcctgatcgaacacctttcataataaaatgtaaacgatttattgccgaaaaaaaatttttttttttttttttcaattttcagagtgaatatttgtgtgatcgtgatttgcgtgtccaatttttgtccggcttcactgggtccaacgcatttgtggtggtcacacaacaggacgcactgctgtggacggacgggcgctattttgtgcaggtaaaacaaaaatattttgatagatttcggaaattttggaacaaaaaaaaatttatttttattggaaatcttacaaattttttcgttttaaaatttcatatttttacaaaattttttatacggggagggggagggggtgaaaaaaatggtttataattttttgaatttccaattttccaaggcctccgctgaactgcgcgatgggtggaccctgatgaagcagtgtgtgccggactccatcgacccgattgagtggtgtgtgcagcatttggatgccggtgcacgggtcggatttgacccgaatctgatcaccatccgtaattgtttttcattttaatcatacatttattattactgcaaatttgaaaattttttatccatggacaaaaaaaatgatggcaaaattttttctaaaaactgggtttatgagttttttttttggccgtaacttttttacacttaatgaaatttttttgaaatttagtagtataaactaagaaatgcttgatttgattaacagcgaaaaaaagttatggcccaacaacaacaacacaaaaaaaaacattcaattcggacagcatgaaagaatttatgaatttaatgtgtgtttttttccgcccacagaaagtgccaacacaatgatgaacaaactgttgagcattggcctcataccagtgccgtacacacagaacattgttgatttggtatacgacgatttgattgcttttaaaacaatttttaaatacgattttgttcgcaaattgccccaaaaaaaaaaaattccatgggattttttttttgaaaattttttttttcaatttcagatttggacagatcggcccccggaaatgcctaaaaaactgatccatcttggcgagactgagtgcggtgagaagccggcgtccaaactgcgtcggctcgccctgctgatacggaaggccaactgcgactccattgtgctgtcccagctggacgaaattgcatgtaatgaatttgtaaaacatttaatggagaaaacggaaaattaaatagaaaaaattaattgcaagaaaaaaaaacagaaatttatattttacagaaattaactctcctataggtgtacacccaaaaacgtcgccgccgaaacgtcgcgggacataacgtcgccacaaaaaaaaattaaaatttttcaaaattttaagaaaattaaaaattattttagcttttttgaaaatctaagtgttaataaaaactaaatttgctgatttttaagaaaaaaatcaaaaaaaaaaaacttgaaaaaaattttttccttaaatttcttaattaaatttttttttgaatttttctagaatttttccgaaccaggctaggtaactaaaaaatttttgatattttttttttaaaattaaaaaaaattttgtggcgacgttttgtcctgctcccctcctatagagttatcaagaaaagtcgggccgggtttcgcacttttggatggatgggtaaaagccagaaattcgttgtttttttggaatttataaaagttcatcttttttaaaaacagaaatttaaaagggggagcaaaatttgaaaaaaaactgaaatttcttggaactaaattgcctatcccaaaaaatagaaaattaaaaaataataatttattttaatatataaaaaatagggttgttcaacttgcgtggctttgacatcccgtacagtccggtgttttttgcctatgcctttgtgactgtcagtgaaaaggttcggagaaaaaaaaatttttttttttttaatttttgtaaattttcccctccctcaaggcctttctgtttgttgaccagcgcaaaatcagtgccgacgtggcggaccatttgaagaccaacaacggcagtgtggaaatgttcgactacgccaacatttttggctttttgaaacagttccatcagaatcggatgaaggatgtgcacccggaacggcatagggtacgagattttttaataaaaaaaaaaaacacgcgccgtgtaacgaaaattgtgccaggaatttttttaaaagtatttttgtcagctggatttgaaccttgaccttccaaattgacggtttttaacccatctggacaaactttcatcccttttttgcccttgaa

SEQ ID NO: 2934 - DNA, 2111 bp, Heterodera glycines
atatgcaaattttgcatagaaaaaaaagagaaaattcccattttttcatttgttttagccgtcaacctggacgggatctgtcgcgcaccgttgtgggcacatggctgtaattttgaccatggcgtcggccacggggttggccattttctgaatgtgcacgaatatccacgtgcgtttgttttaatgtgtttttgtttggggcttatttgtttgtatacacagttttaaggagtgagctataaaaaaaatttcgatttttttcgaaatgccaaaaaaactttttttcggcgccctggatgatgctgatttagagaccagggatgtgtcggcatgccagtttctggcctatttccactcggaattcccgattgccaacatttttttgagccgtttgaattacaattgccgaaatttttgagggtgtcggaatagaaaaagtgggatttttaatttttgtgtgccactaataaatacccagtgccgtttttttagcctacattggctaccgcgtgcagagcaagtacaactacttgcacaagggtgtggtggtgaccattgagccgggctattatgcccagggctcgttcggcatacggttcgagaactgctacgaggtggtagatgccaatgccaagggcacgacggcatcggtaaaaccaaaagcagcaccaacgacgccgacaaagacgacgacaacaagtacaacaacgccttcaacagtgccatcgtcgcctgctgagggcaatgccggcggcagcaacgccaagggcagcggcgacgcggtcagcagcagcgacagcagaaagttcgccatgttcgctccgctcacgtttgtgccggtgcagaaatcgttgctggtccgtgaactgctcgaccagcgcgaggtattgtggttttgagtgggaaaggtacaaatcgccatggctctttgattggttgtttggaaatgtttatttttttggcatttttacaattttgtaaattggtttatccagtcaggaatttttaaaattttttttaaccaactttgggtaagtgtaacagtgtagtttgccccccccccttctttttggaaaatttaaatttttttttgccataaaacaagttccaggggttttttttgtccattttccctccaactttccccccaaatcacacagattgattggctgaatcgctaccacaaccaatgcctggaggcggtgggtcgctacttgcaggagaaaagcatgcaggaggagtacaactttttggccgaggcgtgcacaccattctgacaatgagatgatgttgatgatgattttgttgggtcaggggctcccatttgcgagacttttttgtctcgaaaacttttttgacaatttttggtgcaattgagacaaatgtctattctgaaaatcctggaaaatcggtgacatttgttggtaccgtgcccttaaaatgagcactttttgcccctttccaaccccctcctttttttgtcctgctgggtgctgtgatattataataacgagaaattatttttgtgcaaatgtttaaagaccaaaaaattctgtgatccaaaatgcctatgtatgtaataactaataataatatatggtgcataattttgtcatttgaaataaaaaaaaattggtgtgttagaatcggaggtcgtcggatgggaaggttcccaggcctgataatttggaacaattgggacgggacggtatttaaaaatttggaaatgctgtcgatgcccaccaccttccctcattttcgagaaaataggaacccaaaaaaggcacagaaatatgttttctatgattttttttaattccacaaagggggggggggcgggacgaccatcgactgcattatccacaaatttgaacaaaaaatccaggaaaaacaaagaaatgtgtgtattatgtcaatccgtgtctctaatacaaaaaccaacaacagagagagggagaggagatggagatcagcagtcaatccaggaaagaaagaataattggtgtaaaacgacaaaaaatggggtaatactgtagttagtcccccccccccctttttggaaaaaaaatttcaaaaatttttttgccctaaaaacaagtttgcaggggttt

SEQ ID NO: 2935 - DNA, 1440 bp, Heterodera glycines
gggccgatttttcctaaggaaggtaaagccgggtcgtttagggaggcggctctttgcggaccatttggtttcttggattgctgctatggaaattttgttggttgacatgaaatgaaggatgttatccaatttgccgccgattccgttggcgttgaattggaggatgttgagacagttgttggatttaggaggaggttgttgtggtagtgtttgggttggtgggtgagatgcccagttgaattttatagtttgagtagttgggtgtgtaggagggtaaggggcccatttgcgtgcggggccagggttggggtatatgtctccggcgattagaagaagccgacgcatgatggccgggtcatcagcgtcggcagggagaaaaacatgccagtggtgcaggggaaggagcggagttgttgaattgaattgggccttggctggcggttgccaggtcgttgccgccccgtagaggcgcccagtgtgagcaacggggtccggcggtgccgataggcgccgctgggggaaattttaaaaatttgggtgcaatttgtgaacagattttcaacaaaaaaaggttggtttttgcgattattaagctcaattggtaggattttcatttaaaaaatgataaaatatgtatcatttaaaaaaaactatgaggaatcatattttctttataggaaacccacgagtatacaaaaaaaaaattgaaaataatctaatttctgtagagggattgaaccaggggaaagaagaagggaaagtcaaggagactagccattaggccatttgcacacttgggcagcgttacttttaaagaatatattaattattattttttatttttccctttgactccaattttcttcactaatttttcactcagaccccattcttaccagtgcttgtttttcccggttcccggttgccctaccgggaccgggacctcggatgaccgggaattcccggcccggtcccgtggcactctagtttttactttttttcgacaattagaagttttttttaattttaaaagcatgatttggtccccgcccaacttccccccgcaactaaaactatgtaagtataaaaccggcagaagacaagacaatttttctggccattaaatattttcctacacacaacaaaagatttttggcttagtgcactttatgagtccaatcaattgactttatttattgtaaaaaaaaactcgggattgtcaattgattggatcataaagtgcactagagccaggcttttacaacaaaaaaaaattaacattcaaaaacctatcacttcgtcaagtagtcatcagggacggggcttatctcctccgggtccatctcacaatcggcattcgccttcaccgtgttgcgcacttcatcctgtgcattcaatctgaaattgttttttttaaattttgggatcaaaaataatttt

SEQ ID NO: 2936 - DNA, 2124 bp, Heterodera glycines
  misc_feature (6)..(6): n is a, c, g, or t
cttttntggaactgacaaataaataagccaaaacaaaatatttttacaacaaaattgtcatcaaaaaaaaaaaattcagatcactttttgcaaaaaaaaactgcgccgctgatcacgatcgccaaaatggaggcacacatggaaatggtgttgcgcacttccattctgtccattcgatctggaaattttttttttttaattttgggatcaaaaataatttttaggggtttcgagggtgcttgctgcttacgaatctgaacttggacttgcccaatccgaaccccggacttgaattcgaaaaagtgaaattctttttcaaagatgcattttcttgggtaaaagcttcgaattcatttaacacctattttttgttcgaattcgggtcagggatttggaattgggcaaattcgatttcatattcgtggccatcactctcaaaaacgctaggaaactgatttttaacccaaaataaaaaagaagttagggacgacattctttaccttcaaaattgtcgttcatgttttggacggtgtcgctcagcatggtcatttgctgtagaatgagctcgtcgttggcaggcggcgcttcgagcggctgcgcgggcggcgcatcgagcggctgcgcgagcggcgcatcgagcggctgcgcgggcggcgcatcgaaattcgccttcaccgtaagtccagcgcagaaaatggcccaaagagtgaagggcacgctgaattggtaaatataaccggcacaactcccaaatacactcacgtccaataagcggaaatcttgtcgatggtgtagaaagccactgaagtagcgccggaaagtccggcaaggacaacagcgttggcagtcagcttaaagggtttgacttggagctgaggaagctgaacatgtaggttgcctaccgccttgatatcatgttttttgagtgtgggcaccaaaaaacagccgctgagcagcgtcgcaccgtacagtcccaatgcgatttttgagtcggtgcaactgaatcctgaaccattcattttcatccattaattgtcaaaaaacctgacacctcctccgattttgtagaccaaataggacgcgtaaccgaacggaatggtgacggcagtgttggccagcaaataattgtatttgcaacaatgggcgaaagaaggaaactcttgtttctaaaagctgaatggagtaaattctctggtgtcagcaaaccttgaggaattgaaccaattcctgatctttgatggccatcgttgagcccacgaaggcgccaatggaaggaacggcggcgcacaaaagtgcgttgcgggtgtccacagaagtcaaagcaagaagcatagtaaagacaaattgaaaggtatatcgattgaatacggagtgtgaatcgctaacaatcggtttaataaaaacgataataaatggacaaactgggggaggcactccccttttgccatagttaaagtggcttttgttaatgctaaaaaattaccaaaacttttgaattagcggagttttggcgtaatgcagcagtttcctgcaattgaatacctaacaggtttctgttggtcagacattaaaataacaggctttttccaccttaatcaattgtacgcaataaaagtctattggatgcataaactgaaaatactatcatagtgtccaaacttcccggttctaaaattacagtcgttgttttattaatataataattgttattttattcaaatgtacactgagattctggagcttgtcaacttctttgcacgctttttccatcttcgcgttccccgtttgaaggttttttcaatgcccacattcgtatattttacaatccaaaaaatttacacgattttcagattggaatgttctgcgaacattttgcaaataactgttttctccgcttccacctttattggaatctcaatcagcccaaacaatgttcgttatcacacaatttccttactcatgcaacttaagatgaagaactgcgtattatacgtgtgtcgaacgaatacaccgacgaactgttcacaaatgctgcgaatgctgttggtctccagttggatgagttgcttgcctgcatccctggtactggtaatagacaatagtacctttgtatgacaccaaaaa

SEQ ID NO: 2937 - DNA, 4135 bp, Heterodera glycines
  misc_feature (22)..(22): n is a, c, g, or t
  misc_feature (48)..(49): n is a, c, g, or t
gtataggtttgtttttgtatgncagagagtctgataatgtacgtgacnncaggcgaagtgttctactgtcttggtgactattcgcctccggtgcctgtctgggtcgggtcagtctgtgcggatctcaagtacaacgagacgtccaatgtcacttttccgcctccgccaattccctcgtccattttgcccactcataccatccaaccgcttattccgcgtgccattggcggtgtctctgctacggtcgactttagtgttgtaaactatcgcattcagttgtcgttagtgcatccgcgtgagcttggctacgctaccaatccggtcagttttaaccccgtttttaatcatttgcccgaattttagtcgagtgattttgtgatgttccgttacgttgtccccggcactccgaattacaccgtcgaatcttttgcatcaactcgattcggttagtatgtttttgcatttttctattaattttcgcttttaggctcgtatcgtaagcgtccggactacgaatttgtcacccatcttcaacgttcgctgttgctgatgaacatgaacatccattcgtgctcggatgagagcacttaatatttttgaagcgtaacctttgatgataggtctatttgtcgaaatgttattgtatttttttgttgttttttgataaaagaaagttgtttttaaaattttatacctatatgtctgaggaaatatagacttaaaacattaaagtacttttgtttgctttttatcgacctctcttaatttgaatttaatttttttgctaaattctattcaaattttataaatggcattttgtttctttttaacaattaccttttgtttttcatttaccttttccgtgaataacttgatgaaaaaatgacttcccccgcggaatcgctcaatttggacgcagcggaagtccccgaattgcttaggaaggaactcgatacgcttcagtttgttcttccgcttcgttttggctctttcgcttcacatttcttttgtttctcttcagcaaagcattgggtgagaatatgcaacggtacacggaatgcaaagagataaaagtggacgaaggactgcgaactttggaggcgaaggtcggcagattggcactgtccataaattcgcacaaaggcattttgaagcgggagcgaatgcgattggcaggtttggcactttctaattgtcctgcctgaatttgtgactttcgtcggcacagaaactgcgaaaagattggggctggaccaacgcattgcgcacaatgttcagcggacccgggataatttggcaaagagcccacaatttgggcgcgcccattccgtggattttttacacgaagtggcgactcagaatgaccaatccctggcggaacaatgcgaaaccgtcgaaaaattgcgaaaattgttggaccgactgagcaattcagacgaagttctttcttgggtccacacatttacaccaatttaaaaagtattaaattgaggagccgtcattgtcgcgaaatgacctggtcgatcatctcactcgatttgaccgcatttttgagcaagttgcttcgcaagtgtatgctctgaatgattcggcagaggcaatttttttggatatcattcatataacttactgcattagtatatggtctatttgggttttattgaacaaagggagcatttttgcttctttgcaaatggatttaggactccggtttttgtttaaattagctttcggattcagaataggtttagatagatgatagattcatgatcagcaaccccggaaactttagagaaagatttacaagacgtgatatcattttgttaatttttattcctattcttttcaattacttttttaagaaactgcgcgacatttttgtggaacaccgacaaaaattgggtggccatttcgcactgattgacccatttgagaagcaaaaagagcggcgacgactgatcgacgcttattcggcactgaaaggcatcgacgcctttccctcttcgaatgcgcttttgcaacttggcgaatattttccgaagcaacaaccggggacggcacagccccaatttgggatgagtaagtattttaagagccttttgtttaacttattcttggctcatccccccagtcacaatactgaagtccatttctccccttttagctcagttcggtcagccctctgttggtggtggcctttttagtgcctcaaaagcgcccgccttcagtttcgccccctccgctcaacagtcctccaccaatctcttcggcacaccaaaaccaacgccttttggtatgccaaccacaactgccaccgcgccaagtcctttcggtgctgcggcagcagtcattccaacttcggctggcggtgggttttcacgggttggcgttttgtttgcccccccccccctcattcggtgcaaatatttgcgtatatacccacccatgggttttttggcgaaaaacggcgaaaaattttgtaaaatagaccccataattcgggatttcaaaaaaccaaaaatacacccctaaaaatcgacttaaaaaagaaaaatacacccctaaaaatagaatttttgacttcagcccccccccccaaagccaagggtctggctacgcccttgaatggttataatactttaatctttcgaaaaacctgatttaattcactaattcctcctttgagagttttttctaacaaaacaaacttaatattaaaaaatggcctacggaatgaaaaccattaatcatatttgggttgatgataattctcaaatgtctcgtgatttgaatttgattatctttccgcttttcccattctcagcgtccgctgtgccgtcgcttttcggcacttccgtctcttccgccggcggttcgtccgccccttcacagccgacatttggcgggttcagcaacacgctcagttcggcaagcagcgggacgctcttcaaaggctcggcacccgccaaaccgacaaatcttttcggcagtaaatgatccaatggcctattccttctatttgtttttttgttgctgcatttattccatcaattcttttgtttcctgtttttacttttcggaatattattgtatcattttaattttcacttcataaaaaggcacacaattcggatttcgatatgtaatgatttatttcatttcttcgtgtattaatttgccatttgttgtctgatggtgttggtgtatggtcacgtcgtcgacttggcaatgaacatgtaataagtccagtagaccacattgaacagcgtgtaaattgctgaatcggactgatcagtgatcacatatccctcgcatatttaatcccaaaatgaccgggaaaggcgattctcgagaaatagtccaatttctcgcaagtgacaaatgcgtccgttttgcgccttccgccccttttgctcagatttttcatacgaagcgtcgtccgtccctcatttctcatcttttttttaaagttcgaattaattaatatttcaatctcccaattttattgcccactttaaatccaatggccgcgagttcgacgaggctggcgaaaatgaaagtcatcccgcaaagaatccaccaatcgattgccttaacataattaacgcgcggcaaattgcgaattattgcgcctggggggaggaaaatggaaaaggggagaaagagcaaacaaaaccaaattggaagatcatcgccaggagggcattctgtgggcgaataataatttgtgtcagaatgagttgagaatgccctcttccccctttttaccactccgatcattgtccgtgccggaattgccttgggccccaaataaaaagggatccaactgacaatgagcaaggggaattaatccgttaaataattaggcaattaattaattagcaattagttgcataatttgcttgttttgaatagcggtgaatttccacctgacctgatgaacatgaacagaaaggtcggataaaatcctgccgagggaaatttcccaattattaatttgccattttctgtgattgtctcccccccccccaattttcaccttgcaacaaataccacccatagcgccgttggaagtgaaattggacggtcaattcgtcccaaaagccggccgaataattggcttgccgaatggaaa

SEQ ID NO: 2938 - DNA, 1813 bp, Heterodera glycines
  misc_feature (47)..(47): n is a, c, g, or t
  misc_feature (130)..(130): n is a, c, g, or t
  misc_feature (146)..(146): n is a, c, g, or t
  misc_feature (162)..(162): n is a, c, g, or t
tagagaatgtgatctgtgaggagaagagcagaaagggtagggtttgncaatgactcaatggcaatttcgcaaagtttatgggcgggacaataaacgaaacctatgcaatctcgggaaacgagtgataatntaggatgaattaagcncaatgctccctcttcncatcgggatggcttagcaaattatttaccatttttgggttaaaaaataaataattttgtactgaccgatcacatccgtgtcattggcacaataatcaggaaaagtggcataggatggaacaattgtcgaataggtggatggagttcggttgaatgccgttgttggcattgtcaacgcccgttcggtggttgtcgtctgtagtcgcttcttcagcctttttgtgatcggtcgtcggaaggattcttcggcaaccgatggaaatgcttttgaggaggacaaagcggcacggagggggacaaattgagcagaaatagcgggaaaaaggaagaagaaagagcatagaaacaatggcagggacaaaggaatgacaacagcaaaaggaaacggagcaacgaattcggcacggaaagcggaaaaaatgacagcagcggaaggacaacaaattgggcaaggacgagacggaagggacgaggactgatttggacggcactgacggaggcgattggcatggccaaggctgtggccatgatggccaaaatggaccatagtctgtgagttggatgggatatttggtatattggtatagttaaatttcgggtgacggatactccgcaaatttatcgaaattcacgaattgtccgttcgatgagaaggcttaagaattgttgtggatgagtgggagaggggagaacaaaaagtgttttgccaatggaggaaagggcgggagggcagaagagaccgtggcaatgagcagaggacggacggcgccgactcccaaaccctttgctttccttccgccccacgcgtcgcaatttgaggcttccccccccccccctcccctccttcagctcctcaagctttgtcattctttcctttgcttttcctctttgtcccaatgcttttcctcctttttcccctttccttcgcttcttctctttttctttaccttttcccaatgcttttgcttttgccgtcttcgaatttgtcaccaaaagcgaagcgaatttggccatcggcattcacatttccttttgttggcgaatggttttgcgggggcgaagagattgaaaatgataatgagtgaagaaaaatgggccaatggggaaaatatgcagtaaaaagcgaaaagattggaagaaaatgagagagcgagagaaaagagagagagaagaaataattttcatattttaattaaaataattagccattttaattaatccaatcgtccctcgcttaatgaattacgctaatttgttaacattgtttcgtttgcacatctgttaaatcttccgattgacgcatcgttccctcgctgctcacttctcaaaaaaaagtttcgttcgttggattttaaaaatcaaattattttaaatgtttacatttaccaattgttcttcaatttatgacaattcgttttgattttggcactttctctctttttgtgccctttttccttccaattcttttctttgaactgctccaacagcacggccaaccctttgttaatgggaacgcattattggcggcacggattgggaaaatggccattaaaaatgggccaaaagtagtgggtaagcataaaaaagtggggggggggaggggaggagagagtggaagagagagtggaggagatgggaggagagagtggaag

SEQ ID NO: 2939 - DNA, 1385 bp, Heterodera glycines
gggaggagagagtttaagagagagtggaggagaggggaagagagggcgccgagccaaatttggaattcattcatccactcatttaacctttgatcaggcgctttgactgggctgcccatcggaggaatacaacaacaacaaaaacaacggtggaggtgatcaaaaaacaataggccaaattaaaagagaattaaaaaggtgctcaacagcagcagcagcagccgaattttggcggaatgggcgcaatgaatggggcgagcggagcggcgcaaagttgacttgacacccacattttttggcatttcaaacaatttaaaaatgagctaaccaaggaatgtacgggtacaatgggatgggaggaggagcagcacaatacaacggatacggcggagggatgggcggagggatgccgcaacaatgggggacaatgggaggggcacagcagcagcaaatgccaaacggacgaggtggtaagctagcagcagccttattaagagggtaattagtgtaatgactatgcttggtattccctaggtcgctttacggagggtattaaaaacgtggcaaacagtgcgatgaatgccatcggaggaggaggaggggcagcgaacggacagcaggggggaggaacttggggaaaattggccaaaacggcaatgaacgcggctggaatgggaggggggaggacgagcaacggacaatggaacggaaacggacaacagaacgggggaaggggaggaggaaatggaagaggaaatggaggaggaagaagagaaaatggaggaagtggagggagaggaagaggaaatggaggaggaaatggggaaggaagagcaggaaatggaggaggaggaaatggaggaggaagaagagaaaatggaggaagtggagggagaggaagaggaaatggaggaggaaatggggaaggaagagcaggaaatggaggaggaggaaatgggggaggaagaggaagaaatggaggtggcagcatggatgaacaatacgacgattatggttctgattatggtgatgaaggaacggaggataattattatgatgatgctgatgaagatggaagagaagggagacaaggaagtaatagtgggagaggaaggagtaggggaaatggaagagaaaatggaaataataacggaaaaagaaagcagagagaaagagaagaaacagtttatgatgatgatgataatgaggaggatgaggaggaagagggggattataataatgatgatgatgaagatgatgaggaaggaggggagcagaggaagaatggccgacggagcagtggcacacgagcaaagagaaggaagaatgaccaaaggagcagtaaaggagaaaaagagagtgagtgggggggaggatgaagagaa

SEQ ID NO: 2940 - DNA, 2380 bp, Heterodera glycines
taaagagagagggagagagagagagaaaagaagagagatcaagagagggagggagagagtgaaagaaaaaaagagaaaagaagagagagggagagaaaagggtagagagagagaaaaaagaagagagggaagagaaaatagagagatacagagagggagagaggagggagggggagagagagagagagagaagagagagggagagagagagagggagggagagaaagaaaaagaggaaagagagagagagagagaaaagagagagataaagaaagagggagagagagagagagaaagggagggagagagaaagaaagagtaaagagagagagggagagaaaagagtagagagagatagagaaaagagaagagagagggagagaacagagagagataaagaggaaagaaagagagaaagagaaaatagagagagagggagagaaaagaggagaggaagagagagaaaagagagagggagagaaaagagagagagaaagacaaaagttgaaagaaagagagaaagagaagagagagggagagagaaaataggagagagagagagaagaagagaaaagagagtgtgagacaagttgttaaaaatgtgagagaaagtatgataaattttggctagcgcgaagtgcgcgagcgaagcgagcgcgcctgcgctagtatattttatttaggcattttgttttaatagttttagtaatattcccagtttaatttataaaaaatttttaaaaaaatggatttttttttttacttttatattatggtgttcaggaggtgggaggtgagattttttaatttattttaaatgtcagtcacttaaattccaacaggaaaagaaaccaaacataatgccaatggtaacaaacattcatcaatttaaaaatagaatatattttctttaggcattttatttgtaaatgccggggaaggttggttaaaaataaaggtgtttttcgttattctgaaatttagaccctttcgaaaatttaaaagaattttcgggtgcaaaagacacgtggaaaatggagggttttgaggagggaataaccgacaaattgaacgatgaacagcaaaaaaagaagaatgaaaatggtcagtccaaaggtgaatataattaatgttttcccccattcttctgtttttgacagaatttaaatttttaaaattttaatttagcaaatgccaaagtcaatcaaaaatatgacatgaaaaaaattgtaaatggcttacaatgattgaaagaaataggaggtaaaagacgcaaaaaattaaaaagtatttatttttaaaatttaatttagaggatcagaggggtgagcttagacgagcagagcagcagaagctgatgatcaaaaggacggatttgctttatttttttctgttgatcctttcttggcattgtaagtctcgttgttttatacatgccatttacaaagtgaaattgagcaaccgtagggtcggtcaagagatttttaaaagccgaaaaatttccaaaaaatcatatagagataccgtatttcctgtatttgaaggcccgggccttctatttttcaacccctccaaaaaggggcctttaattagagggggggccttctaccaaggggggggggccttcaaatacaggaaatacggtattcaagaatattattattaaaaatatatttttcaaaaatttgtaagtttcaatcaagaccaagaaataggagattgcagtgattagaattattaatttttttttcttctcaaatatttttgtacctattcgatcttaggtataaatagctgattagtataaaggcttttttgacattctgtctttgattttcaaaacatgcattgcggatcccgcgggttcccacacaaaaaatcaaatttgcgggtcccgctcgggattgaaactcaaaaactctaattctgacaactaagaaaagaacaagaaaatgagcattttcaaatttcgtgaaaaataaaaacctaaaaatggtacttacttaggagtatttctgtaattaatcatttatgtagttttttgaaagaaatttatttcatttaagtattagaattacagtcggagtcgttattttggttttttagactattattaaattcttgattttttatccaacgcctcatttaatgaatgtactgtacatccgataattctaatattaaaaaggcactggcgcgaggactatcaggctccattagaatatccaccattaattaattttccataatcatctttacttctttaataatataaattaagtcaatgatatcggctttttcactgttacatacccctcaatttccaatgaatggtattccctctggttcgtttccgtccgcttcttcctctgcttttttc

SEQ ID NO: 2941 - DNA, 1190 bp, Heterodera glycines
attaaaatataaaaaaggaaaatccgcggaccaaaaaataattgtcaaccgaaaagtcagtcttaaaaatttcatacatttaaaactcgtccaatttgtgccacaagacatttgctggcacatccaatgaacaattggccgacattgtcaaaaagagaccgaatttcttaagcataaatgcaaattaatctccaaaaggcttttcgtcatctgctggtccgatccaaccaaccgctgagttcgaaccgctcacagctcggcttggcaaatccgagcaaaaatccgtccgctccgcagcgtgccagccgcgtgtccatgcatttgtacgcgttgcacccgccacagctgtcgttgaacagacgaatggccgacaagccgcaaattttcccctcctccggcgaagagtggtggtaattgtggcttaaatgtcaaaatgttgctcaattgtcaggcggggcggtaaaaggccctttcggcgaagcttaaattttatttcaatttccaattgttggataccttctcggattagccagtccacttcggatgactgtttcacagtctcgccttaagcattgccattcgcccatcgaatcgtagaaaaaggagccgaacggaaggcgaccgccacccggcagggcacagccaatcagtcgaatatcccagcgaaactcagagtcatactgtaaaaagtaattgccaaaattaatcgaagtgataagaaagccaagaaagggtttaccgtgcattgcataatgtaggcaccattttccaccttaataaattcacacatattttaaaatattgccggattcagtcagacccattcgtcgccgttttcgtggataatgccattgagtgtacagcttttgacggcaccaatgccaataaggaaaagacaaattaaaatgaacaaaaatttattattcattttttgccaatctgtgaccaaaataaaactcgaaaatgaaattggaaaggagaaacagaaagtaagaagcaaatgcaggtaattatagtcaattttccagtactataaattatttatttggtcggtttattcgtaaatggcctcagcaactgtcgcccatttgtccattcattttttcctttgcttttcctcgtcttttcaaatccattttttccttttctcccaaatatttttcattaattattctcattttctaattgga

SEQ ID NO: 2942 - DNA, 3008 bp, Heterodera glycines
ataatgtaatggattaaattgaatttaattaattatttattttaccgtctttgaaaatgatttgaattaaccgccgatggaccaaatttgaaaatgagagaatgctcagtttagaagagaagcgcattttttactaattacaatattttatttggtaagctaacaaataaatgtttgtttttagtgaccataaaatgctaaaaatatttttggtttggaattgattgattaatttattgcgttttcgtacggaagcgatcaattttggtctcactgtgagagcggacttttgttgaagttaaaataaatcaaaattattccccgatcaatcgaaggataaataaataaataaaaaataatgggaaaaccctttaatcaaaagtaaaaaataactaattattcttaaattggagaacatacacattctctaactaatcagcagttcgtttttgagcctgtcctttttgataataatttcctctttttgtattttaagtaaaggctaacgccgcttttaatatttttcgcagataaaaatgataaaactttcttttaatccaaaaggtctgaagaccaatgaacaaagaaagattatgaaatatttggattttacccatttattctaattttagtcaatcatttttaattttttattaattattcatttaaaaatgatacaaaataaaaataaataaatgaaaatttgttcaggaaattggcttgtccatcggttcgttgagtttcttcccttttcgctccattttctccgattgggccgacttttcgcaactgtgcacatccatcgaatgaccacaaaactgaccacacatttggctcattgatcagtcggtcaccgttcagagatttgaatttggcgcttttattggcgtttatcgcatcggcggaaacagcccaaggacagcggcctcggcatcgtcagcagaaacatttggggcgatgccacgagcaaattgaagcggaggcattttccgggctgtgaatattttggattcgaatttgaaaggatttgcaaattttggcggattgtttggtgctcattttgccaaaatctccaatttatatttgttgtcagtgtttttctcttagtgatctgttgaaaatttggcgaggtcggcccgtcgattagtaactgaaggaatggttgggtggcgaattgggggaagagtctcgccaaatccattcaattcattcaactctctctcacccattctccacaatcgattagtaataaataattaggaaaaacaaagaataatgaatgatattttaattcattttaataatttatagaaaatattgaaacggttttttttataattgtgggctttttcaaaagtaattatgattatctcaccaccataagctacatacgtttgagaacaaatcatttaaaaattttctcatattattaaatttaaacacattatttaatttataaatttaaaatatttaaagattggactgtttcaaaagctcttcagaagtttcccaaggtctcagtcttcatttttttttaaataatgtcaatcctgcggagaataggattgaattcaggagtttttaccgtaaaaatataaatatatgccagcatcagcagtgataggatcttaatccgactctcaaattctgattcccactttctgacatttcagtgtcgggatcatgtcatttcctaaatttcttacaaccctcgggtctgacaaatgagtgtcgattaccgagtcttttgaggaaaaaaaaactgggaatttggtatatgaaatagccgagaataatatattttaaaataaatttcatacattttctaaagtatgatttttggattggtttcccagaaaatttatgtaatataaatcgatcatgtcgaaatgaaaaataaaggataatcgaaaggatctcagataaaagcgaaaatgcacaatttgccattgacttcaaataaatttggattggagtgattcttttcttttgacttggcgcacaatcacttctttgtttcccatttttattccttttcagatggcttcaaattcaattgcggcttcgattggtgtgaagttgaagcgactgaattcgatggcatttgaattgatttgggcatatttttctgctgagtattctgagacgggtaaacgggtatcattatcatttgctgattttctggcaactccaatgcgaactgattcgagttggatggcatttgttgttgtggcaaattgggcaaatttagccgcggaaaacgaattggtgccgggggttgcgccggcaattccttcccccttagcttgttgcttggtttgaattggtcttctgatgtcaattccgggatcatttctcgaaaaatttccttggaaatattgtatacaaaggtttcttttataacaatcttttttccaattggtctgttctcgcctttcggctctccttctctgtttcgttttgttccatcagaaatggccaaaaatgccaaaaaagggacaaaaacagtggcggatttcattagatttaaatttcaagaatgtttaggtaaatttttataatactatagctatctaaatggaatgcttttattttaagggaatgggttagtaattagtgaggatgatgatgatgataatgatgatgatggtaatgtggctatgttagcctctttaaattaatagtggtgccagctaatttatgaatattgattactttttaagcaaaactcaacaaatgagagagagaataaaaatttgaaaatatttaaagaatgtgtcttcgttcgaatttttaacggttgaagcgttaaagtgtgagacgcaatgtgacagttccgtaattacgcaattcttcatgaaaaataaacaaaattgtttactaaaagatttaatttcattatatccaatttccttgcgatactttctctaattttcttacatttcttatttgaataaatctcttctgtcaactgttgctttccttaattctctctctcatttgttgag

SEQ ID NO: 2943 - DNA, 2026 bp, Heterodera glycines
  misc_feature (1962)..(1962): n is a, c, g, or t
  misc_feature (2017)..(2017): n is a, c, g, or t
attaaatattcaaattttttacccaatttccttcaaaattaataaatttaggtagccggttttttcttctaaaatgatttcaaaaatatttaggtaactatttctcgatttttagcttaaaattaatgacatattttgcaacttttggtgcatataattaccagccctaatcaaaacattgaaccaatttcagcagttagttcgtaacacacaaaatttttaagttcaatatgctttaataaaataataaaaataacaaaaaaaaattaaaaaagatcggccaactcagtcccccttctcctcctcggccaattcagtcccctctctcttccatctttttctctcctctttcttccgttggtaattttctaagtttccaaatgccacacttttgtgaagttgctccagtggaaaaagatccgtcgaattggctaattccgttgagaatttcgaccctttttccaattctaaatcggctttttccattgctacgctttcggctgagtccgcgccaaagtcacagcgaaataaaccctttctaaagcgaacaatgccaaataaaattaacagcgaaaaaccttccgacggcaaaaatttgtctgcctttttcgtcgatggcaaaatcgaagaattggccatctccgacgaaagtgcgcgacaaatcgacggagggcccccgggggtcgaaattgaaaagggaaatttccgaggcaccgtcgaacaaagcgaagatttcgtttttctgttaataaaagtataaagctaaaaaataaatggaaattaaaaagaaaaaacagacagactttggggagaggaaaaagtttacggatgggcgaatcgttcagtttcggactgacacacaaacaatggcccattttgaagtgccaaactcgcaaaatgccgtcgccacctcaaaaaataaaagggaatctacgcgtttttgttctgactaaacaaattaacaacggaatgtaaaaataacgaaaattttctcttttcggtacctccgctgaccgcaatttcgtcattcaaacagcacaacgacttgacaaaggaagtgtggccaaggcaaaagcattcgatgatttgtgtgttcggatagcgcgaaacgcgcactttctcgtctcgatcggcggatagaaggaaattgggccttcccggcgaaaggcaatggtcgagaagcattgagaaatgggagagcaattcgatggcaccgccagggcaaaaattggcatctgccaaatcaaaaatagcaatggaaaagtgagtgaattggccatcattttcaaaacacaaaacaaaccattgacgcggaattgcagcagagaaccggaccgagtgccgaccaaaagagtgtcaccgcaagcggaaaaatgtatctgcaaaggacgaaattttggcacattttgtaatggcaatttgttactgcggtcggtgtcttgggaatggtttggcatttcgtttcttcccaagtgccaccaattgcatttcccagcgattgcaactcaaagagaaggacgtgttttgtggtcgttgccaccgcgaggagtttgtggtcggctgaaacatctgaagagagaatctgacgaaaaaatcaaaaattatttgggacaaaaggccaaagggaggaaaaattaccgacggattgcattcgttgtccttccccaacttctgctgattattcaccgcatttggaaaagtcaaatcgacttgaaaagccaattcgacagattgggaaccgttcttggcgcatttaagcacaaaaatgtgtgaatttgtgcagacaacggcacaaaattgttcaccttcaatggcatggattgaaacgaccatcgataaaataaaaataaccaatctgacaataaaaaacacacttatcaattttctagaataactgccattcatttttagaatataaatcaaatttaaatttttttgtaataaaaattaatataagttggnttgtaaatttttttgtataaatttatctctgaattttcaaatgtacagtattcangcaccgagg

SEQ ID NO: 2944 - DNA, 3987 bp, Heterodera glycines
aaatcaaaaattattttgggacaaaaggccaaagggagcttctttaccgacggattgcattcgttgtccttccccaacttctgctgattattcaccgcatttggaaaagtcaaatcgaacaaatcgacttgaaaagccaattcgacagattgggaaccgttcttggcgcatttaagcacaaaaatgtgtgaatttgtgcagacaacggcacaaaattggtcaccttcaatggcatggattgaaacgaccatcgataaaataaaaataaccaatctgacaataaaaaacacacttatcaattttctagaataactgccattcatttttagaatataaatcaaatttaatttttttgtaataaaaaattaatatagtttgtttgtaatttttttgtataaatttatctctgaattttcaaatgtacagtatatcagcaccgaggatgcaatcaaaagagtgtctgaactatacgtttttataagcatatttagttgttagtaaatacatcctgggctatttactgtgtgtcaaagaaatcatcggatgggaagtggggttatggaatttgcaagtgacaatatgttagaaatcctttgaaacaggaatggatgaatatcagaaaatcagccaatgttcgctctcttaatagccatgagcttggggatacgaagtcggattgggcggatacacagcctgggcctgaggttgtgccggataagtcggtgccggagggtaaacagcttgggcttgtggctgggcagggtaattatttgatgccggaggataataaggctgcatgggataagcttggcctgctgaaagagtgcaaaaattaaaaaagaattataaatgttgtccccacccgaagggttgtggacattgtcaccggcacatcgtatttgtaggggatggttggtctggtcgtagttttggttggtgttatttcccggcatacaactgaaggattaaaacacaaatcacaattaatatgcgcatctatcgtaacgagtcaatggaagttcgtacaatatttttaagggttttttagattttaaaattcattgattttttgagaaaaatgctgttttgttgaaaaatttaaaaaaattcattgtacgaaactccattttacgaacttcctattgtacgaataatcatagtaacacaacgatatcaaagtgctgtaaacaatttccttttttgacagatttaatttcggctcaaacccttttaagcaaagctaacaaacattctgttgatgaccatttaaaagacctgtcgaagacggagcgacaagaagtgtaagttaacagagcacagcagcagcagaagagaagagcgacaacgacaatgctaaaattctgaataaaaacaaggcgtgtcgcaccgttcggagactttcgaaggcagcgaaaatggtcgactcaccccaacaacactttgccaacggtgcccatccctccgcccgacttcgcctcactgttcggcggagaataattcggattcgggcaacagtccgtcccacagcaaatttcgacgttctctttgcaagtccaaacgacctgacaaatgaaggatggaagaaaaattaggaaattttgcccattttctcacctccttcggacgcgacccattgggaaaagttgcctgaaataggaaaagcaaaggaaatcaaatggaaattgaaaggggatgaataaaatggacaatgtcattttccccaagtctattaaacattttttaaatgacattttaatttgctaactcttaactcttcataataacttaaaaatgattgaaaagtttttttttctttaaattgtttaaatttttggggtgaatgctcccgtgaatacatttgcgagtgtttgttccggcgatgtgccatttgtcgtttgatttgttgtcgcagcaggggattggttgaccagcttatcccacggcactttgcactaaattcaaaaaattaaaatacattagccaaagccgaaaagttggtaatactgccgatgccccccccccttttgaaaaatttattttctattctaaaaagacgtgaaaatttttttccaaaaaggagggggaccatcggtagtattaccgaaaagtttatctgtaatgtaaaaaccgttccattcttctggcaacggaacagttcagtcgccaccgtttacctgaatctctccgtgctgtttctttgcgtatttttcgtccaaatagtaattgcgtccgtcgtgttggaagggccggtcgaaggaatgaataatcgcttttcctttgaataggattctgattagtaccgactaattaatgccatcctacgactgacccgcttcaaaggcaaccaaaccgccaacggtgcccaccgcagcacccgccagcgcagtcgtgaaagtcccgggacggctcgacgaaccgagtcccgttccggagccaaagctaaaacaaacagtgacatattaagagtgcagaccaatcaaaacaaaaaaaatagggacaatatgacatgaaaatttcgattttaaccgcaaaatgaaaaagtaaacgcctgacttttctaaaaatacatgtaaagtttgttgttcagacaaaaatacttaaatatccagtaatttgccacttaccggcccgggccactgccagcagacattgatgggccgtggaaaccgcctcctgcaggcggcggatggaaccctcccccggtcggtccatggaatccgcctgctcctcctccgacaaaatgaggctgtcctcctccaacgggagctccaccaccgccgaaatgcccacctgaatggcactttacctttccaacaattaattatttgtaaaatatacccgctggcgctggattagcgcgagcagctccaccacctcggaatccaccgccaccgccaaactttttggcatttaaacagtgcaattggatggcacagaacaaaaacgaaaaaatgaatttctttcgaataaatttcatctttgagattgttacggtatctaaactaattaggtaatttattattatggaattactaagtaattagataggatcatttttattaaaatacaatctaggtattctcatcatcattggttgtgtgtgcttctgctgcgagctgatcgcaccacagcccatttcattcgatgaaacgtccccccccccgtcgcatttccctccctttctctcgtccttctctttcatcaatcttttctctcttttcccacctcaccaaacgaagcgtgcgcgacttccaaaaaatttttttctcattcatccctttaaaaccatacaatcgataaagcatatgcttattttgttcgaggtgtgtttgttcacctgtctgctgttcttttgctgactaaggcttttcctctctttgtcgctgtttaaaaaaaatgcaagaaatgagattttatacacctatatatatgaataagtttattataaatagaaaaaaaagtttttatcattaaggttgcacgtgatcgggattttctgaattcacaaattcaaataatttcatatttttcaagttaatttaaaaaggtttaaaatatagaagaatagtccggcagtttgtccaatttgggcaaaaattcatatacttgcttttgtgggtcttttggaaaaaatttttgagtaatttttaatagagagcgggtacggaccgtatccgtatacggatttttacagatccgtagtccgtaatccgtatttttttaggccgatacggatttttacggagtacggattttccggatttttagtccgtaagtccgtaatccgtatgtgtgcctagtccgtagtccggatcctgatccgtacaattttttgatacggattacggattttttaaactgaacttttgttgaatattttttttgaattttcattatatttcgctaagttttgataataaatttgaatttgataactctttttctcaattcttaacttattttcaacaattaatgaattttttgttt

SEQ ID NO: 2945 - DNA, 1617 bp, Heterodera glycines
ctctggtaattttggtcaattatttgaaaatgtttatcatttcattaaaattttccaataaagtttgtcagaaaataaaactctttggctaagcctttgaatttttaaaaatttcatttttttgaaaaatttccaatgggcccacaatgtaaaggcattgatggggtatttaaactagacaaatttaaatgttggacatatttgatgaatttttaaatagttaggattgggtccttaaggttttcaacgcataaaagtattaaaaatgctttacaataaataaaatgcattaaaaattcattgggaaaaggaaataaaaacggttcaatatatttaagaatttatgtgccaccatcatttttctgatagccaagcctcaataaaattgtaggaattcatcgacgaatttgtaattttaaggccaaaatatttttttataaatccgtcgacgaaattttaccaacgaacgacattttgtcaaaatgactcgaggattattcaacaaaattgaaacccaaaaaaattctcgagctcaagagtcgagagtctcgaaaaagcgatgaccgcaagaaaaaaaaacggggggaaaattcaatgggtgggccaagaaagggtaggagggggatgttatattttggatagaaacaaaatctttttgaaaactaggtaggtctttgaaagatgaaaattcgttaaaacaaatacactcttgttcatctcttatttgttagtttatgatcactagggcttgtaattatatgcagatgcatattttttcctggactgtgggagatctgaaacgtacgaaaaacatattttagcttgttttgaagcttctaggccgtacttccatatgcatattttgcatatttctgcatatttcgcgatttatgtgcatatttgcatattttggcatttcgtgcatattttatgtgcatatttgagcattttttcaataaatcctctattaaaacggccccctctattaaagcggccatttgggctctaatgaccgaaaacttttcaaaaatatcagatttttgggtatattttctgataaaaaagtaacttttaaaaaattgaaactttatgccaaaaatagtcagaaaatagaaaattctccattttttgctcaattttcttcaaaaataaataaatattacttttttagttctaaaataatcattcatactatttttttagctattttcggaatttttatgctttaatttaacaaacttaaagaaatttgaaaatttgccctcaatttggaaaaatttatgtgcatatttttcactttttatgtgcatatttcgcgatttttggtgcatataattacaagccctaattatgattatatgcaatgcaaattttttcctggacaggaagcagcattaaatgcgtgaaaaaattttttagcacgatttgaagcttctagagcgaagtttaaaatataagagggaaaatcgcaataagttaaggcaatcctgaagaatgggggtttctattttaaaaaaaattttaattgagcccaaaattggtatttgggcttttcgagggcgctgacaacgaatctgaactcggatttgcccaattccgaacatcgagccagaattc

SEQ ID NO: 2946 - DNA, 1236 bp, Heterodera glycines
  misc_feature (180)..(180): n is a, c, g, or t
gtgattatgataggggctgtaaattatatgcacatgcatatttttttctgggactgtgggaggcctgaaacgcacgaaaaacatgttttagctttggtttgaagcttctaggccgtacttccatatgcatattttgcatatttgtgcatatttcgcgatttatgtgcatatttcggcatntcatgcatattttatgtgcatatttgggcattttttcaataaatcctctattaaaacggccccctctattaaagcggccatttgggctctaatgaccgaaaacttttcaaaaatatcagctttttgggtatattttctgataaaaaagtaacttttaaaaaattgaaactttatgccaaaaatagtcagaaaatagaaaattctccattttttgctcaattttcttcaaaaataaataaatattacttttttagttctaaaataatcattcatactatttttttagctattttcggaatttttatgcttaaatttaacaaacttaaagaaatttgaaaatttgccctcaatttggaaaatttatgtgcatatttttcactttttatgtgcatatttcgcgatttttggtgcatataattacaagccctaattatgattattgcaaattttttcctggacagtaagcagcattaaatgcgtgaaaaaaatttctcggatttgcccaattccgaacatcgagccagaattcgaacaaaaaggttaaaaaaaattttccaaagatacagttttctggggaaaagcttcgaattcatttaataactatttattttgatgcaaaacaatgcttcaagtattaattgaataaaaaatacgcaatttgcgcgaaaattcagattcgtaatcagcaccctcaaaaacccacggaaactgatattgagcccaaaccaaaaatttaaattagaaacccccattcttcaggattgcctaagttaatatatttttgctaatatttttcatttgatcgattttttctgttcattattgccgaaaatttacaatagcaaattgactatgctttacacgataaaagtggttttaaagtgatttgggcactcacagttcgatatgtccccttgtcggttgcaccatggaccaatcgggtcgggtactggaatagcattagatcagggctcccatcatcttttgcgcgctatataccaaaattttgtggacataatatagggaattttgggctacattctataagaaaaatag

SEQ ID NO: 2947 - DNA, 3310 bp, Heterodera glycines
  misc_feature (1322)..(1322): n is a, c, g, or t
  misc_feature (1325)..(1325): n is a, c, g, or t
  misc_feature (1337)..(1337): n is a, c, g, or t
  misc_feature (3304)..(3304): n is a, c, g, or t
aaattaaattgtttttgttttaaggaaagaccagaatttactcggatgctgaacaattggaatatgtgaaaagaagtgaagaaatggcagaaagaaactcaaagataagtgagagaaaaattgcattgggcatttcaaatgccaatttaagacgatggacgaggaaatttggcaccaaatcgatccgttagcattggtaaaaaatattttattcagtgccaattggtcaactttcaactatgctgagaaaaaaaaaatgcttacaattagtactatttccctgttcctttctttgtaatttctctcactttggcgaattatctcttcatttgttagctgatcaaaagcaaaaacatttacttcgcttcaaaatagtcttgaaatattttagttatgaaaaatcaaaaaaaataaaataaaggtgataccttcttgcgaccaatgtgatgttaaactaatgaattttcagtgactaacaaataagtgacgtttaaatgaactattttcggggaccaatagagacgttaaaacgaagagtttttgggctaaaaataaagcgctgttgataattttaatgaaaacgaaaaacaaattctttacgatgaaaattaaattttatgcaaatttttgtcacacaaattttcgccaatcaacaatatttgacagtgcttacatattaggacttctactcggaaatgggtctcctcatccaacagcacttttcttatggctattattctgatggtgatggttttttagcgcttgacaacactttggcaatcactttttgcaataatccgtcgcccttttttggcttttcgtaatccgcttcatccgttgctgggacgcacgcatcgttctcccatttacaacgatatttatcgcttcgaatctttgtacatttgcttttctttttcctcttttcgcatgcttgttggtgccatttcttagtaacatctaaatttaatttaaaatttaatttatttttgagtatgaattttaagatgaaactgccaaacatacgtttaaaataaatttattgaaaaaagaaataaaattaagccaaatcagtattgattaaataatttttaaaatcaaaaattcttgtcaagaaaataaataaataaattttggaaatgaataaatatttgagaaattttttagtttcataaggcttatttttgaaaatcttatcgtcgattctaaagaggtatttttttgaaaatttttagtgtgatttttaggagtgaatttttctggcatttttggggatcgattcttaatggtgtattttttgttttattgcatatttttaatagatntgngcaaaacaccanaataggcttttttcaaaatttttaaaaagttttaggcataaaataaaactagaaataggcacaataatcgaaagtagcttaaaatcaatcaggaaaaaacttgttttttcttgcggtcagacatagtgccgcccaggaaaaaaatgggaaaaaaaccctaaaaactcgattccctaattataccccttctacattaaataaaaaaaatggcaaagcttttcaacggcaaaacccctttttcctttccggcccacacccccttaggaaaagcccttttaaatcttccccgccttcggcctttgtatttttttacaaaaattgaagagaaaaatcaatagaaacaccacccaaaaaaaaaattttttataaaaaaaaaaaaattctttttttttataaaaaaaaaaaatttttttttttttttatataaaaaaaaaaaatttttttttttttttttttttttttttttttttaaaaaaattggggaattcaaattttttttttagcccaattaagggcgggtaatttaaagtttttttaatattaagttttttttttgccgttttttttccatgggtgaattcaattgcccaaaaaacaggtgccaaaaagttggcaaattggacaaaagcattggccgcaaacaaccaaatgattggtcggtaggatgaagaagctggggcgtagaaaggaactgtcaaaattatctgaataaatttaaattaatgaaaaaactaaaatttcaaaataatttccttaaccaatcaatatttggcgaaatgttttttcgtttttaaattaaaaaaaaagtgttcccgagtcccgacggtgccgagcgtaatcaaatgacattcaaaagaagtctcggcgtaaattcagaaaaaatcccaattttttttttgggtgatctcgacctcatcaaatttcgagaccggactcggaaaaaccccggattttttgggtgtctcagtctcatcgaatccgcttcgagaaatcccccccccccattaatttaataacatttttagacaatgacaattatttttgcaaaacagtagggactcataaatagttaaaaattaaaattattttaaaattaaatttttaatttctcactcatcgccaagcgcattttccaggcgttcattggatgctgatgagctgctcctttcgcgctgctcaattctgctggcctttggcctgtcaaaaaataaaaatttttaaatttaagtttagcgccaaattttggcattttgtttttgctttttgtttgtcccccgacttggccaattcgctccgctgggccactcgacgcgaaatttgcgcgccatcatcgtccggctgatcggtgccctccaaaactgccgccgatgattgtgatgatgatgccaaatcttccgtctcctctccaccctcatcctcctcatcataatcgtcttggatttccgcagaaatatcctcggacttaaaatggaaaattttttaactgacacggcatttattcgcagtaaacccaggaaaattggggaattttaaaaaaccaaacacggattaattagataattgttaaattttacggaataaaaaacggttcaggaatcaggagaaaggctttggaaattggactaggataagcattttttattgttaaacattctgctttgacaggacaggcttgatccggttgagttcaataacaaaaatcaagaaaatctggacattaaaatgatttgaatattttattttaaaatttaaaatcttacacctaaattcatttcttaaatttgttaatatattttcaaaatatgtatttgtttctgtacaaattctttttgaaacaagcttttccgacataactctgacttgaaaaaattgaaaattctgaaaaaaactgaagaccgtcgagaaattaaattatttgaaaaattaccacaaaatggcaaaaatttgtcattttttggtacttccgntgtttt

SEQ ID NO: 2948 - DNA, 1100 bp, Heterodera glycines
  misc_feature (28)..(28): n is a, c, g, or t
ctttttcaaaaatttttaaaaagttttnaggcaataaaataaaaactagaaaataggcactaataatcgaaaagtagcttaaaaatcatcaggaaaaaaacttgttttttctgcgttcagaacatagtgcgcccaggaaaaaaataggcaaaaaaacctaaaaatcgtatccctaattattacccttctacaattaaataaaaaatatgcaaatgctttcaaaccgtcaaaactcattttcgtttcagtgccatcatcacttaggtaagtcacttctaattcttccggttctgcgcttgaatttttagcaaaattgaatgagaattcaatgaacagcatcagaaaaatatgttttagaaataaaagtttcattgtttaaaaaaattaaattatttttatgaaaaaaaaagaatttatttatttattcataaaaaataaaaaagtcatcagaagggcgagaaccacttactctgacgactatcagataaatgtcgtagagtaagtgacaaaatatatggatgatcacaggaattaaaaaaagacaaaatatgtgaaaataaataataaataaattgaggtcaaagtcaaatgaggtcgaaataccaaatcacttagaaatttgttacattctaactttcccggtcttacagattaccctagtgaacttttaagttttattttaaattgatttaaagaatttgtttttattagttctttatcgagttgattccacaatttcgttaccctcccagcaaagggaatgaatatgctaaaaatataataaaatataagtaataaaaataatattaaaaaaaattacaatatcaaatatagatatatatttattattagaaatatgcaagaaaataatcgataaataattgattttttattcgattcgattttttaaaaggtaaaactgtgaaaaattacgaacaaattttaaatagcatttctgttatttaaaacaaaaaatcgcttaggtttcccggtcggcgcctatcccttaaaataatcaggcttttcgattttacgagttattttccgagtaagttttccaacacgttgccgctaaaaacggttgaaaggagtgcgttcaa

SEQ ID NO: 2949 - DNA, 5143 bp, Heterodera glycines
  misc_feature (1730)..(1730): n is a, c, g, or t
  misc_feature (1755)..(1755): n is a, c, g, or t
  misc_feature (1757)..(1757): n is a, c, g, or t
ttggttgatttttatgagtaattaatttaaaaaaaccatttgtcaccaaggaaataattaaagaagaaaacgtcaaaccgtatcgaactcacgacagaaaataatgtaaatggcactaccctctacaccacattccaaatgtccaaaattgagcaaatcttcttcatttaataaaaatttggcaaatggttaaaaaaattcaaattccgtctaacttttttgcattttctcccacgaaaatgccattcttaggggtgtatatttacgaaaatgccattcttaggggtgtatatttaaccccgaccccgatcggggttaaggttcggggttgtcggggtatgaagcgtcggggttcggggtcggggttttccacgaaaatggccaaaaatgtcggggcggggtcggggttgcaaccctatttttaacagaaaatctaggtcaagcaatcaggtaaaaaaatcaaggtaaatgtcaggttttgacgcgaaaaatattgttgtagggatagtttttagcgtaccaggtgttttcgacagtgattgatttcgacagtgattggtttcgacagtagttgattcggacagtactttttaattatttttctgcataatttattgaacctatgaaaatgccgggtttgagtgccaagctgtaaatctgcaggctcttgtagcaaaattcgaaaactaatgccgggtttgagtgccaagctgcaaatctgcaggctcttgtagcaaaattcgaaaattgcaaaccagtgaacctgtgcttatcattttacttttcaaaatttaactagactcataccattatgagcaagtttttaaaaaataagctttactgtcgaaatcaatcactgtcgagatcaccactgtcgaaaactaacagcaccgatttctaagcctatttaggtcatttttatggcattttgtgcctatttcacctttttacgaagaatttttttcaaaaaaataaccatttaaaaaattttatttacatattttagtacatatttgtggatttttgtacatatttaatacatattttagcattttttatacatattttatttacatatttcgcgatttttcttacataaaaaagaagccctgcttataacagggtttgtaattatatggaaatccatattttttttcctggactgttggaggcctgaaacgcatgaaaaacatgtttttagcttggtttgaagcctctaggaaggagttctatatccatattttccatatcgcaattttatgattaaaaaaatgagtatttttaattccaaatgaggattttttgaggtattttagtggcaaatgaggattttttacggctgaaatgaggattttcaaaattttgagatcacagctctgacaataaagcaaaattctgaacatttaattagaatttattgtgcctaaaatggggagtaaaataaggtttcattttccctgctttttttttgggggggggggggggtcatttccttctaaaaaaaatttttctatccatttctatgtaggtaagaaattgcacaattttcaaataaattctttctctctctctctcattttttttgtttctttctttttgtgtctgttttccgtctctttccacaaaacatcgttaaaaggaaggacaacaaaaagagaagggacgatgggagagaaaggaaaagcaaaacaaaaaaaaaataaacaaaaaatgatgacgagcaagagtcnaaaaatccaatcccgaggaaaaatngntggcggacaaaacccgctggcatatgcggaggacctccaaaaagggcatttccaattcaaattttgaagaatggcatagcaaaatgatgcaaatgagttgaaagagttataattttggatttactgcatttaaacttaaaattttgggccaaaatttcaaagaaaaacgctccaaaaaatatttgtcattacttccgccacacttttctctgctttctcccattggaagcacttttctacaattaaaataaataataatgaattgttttgtttttctcatcgtccgcgtggtctctttttcggcactttttcctccgcctctttccgccgcttttcctccgccgcccggtcgtacatcaaaaagcgctcgccgtcgtccaattccaacaccatacgctgcatggtgaacgaggacttaaaggcgttcaaatcagaatgaaaatatgggatgatccggcctaattgttttgcttttggccgtcattttacggagcttttttcccctgatttttaaccctctcgaaaaaaatattatagtaattagcggtgtcaatagggtcttgagtgggcgaactttccagtctttggcgacattttaaaagggtaagaaaaaaggcgattgaaaaagcggaaatcgaggaaatgtaacctgatcaatcacatgatttgattacccaaaataaattccgctatgccaatccatcattccccttttaatgacccccgattagcgatcagaaatgagtagccgatcaaaccgattttgggcgatgcaaacgatgaacaattttctcggtcgatcatttcttatttatttaactcaagcagttcacccacatccttacaaataagtgaaaggaattttcttcaagcattttccaaaacacgctaattaagggtcccgaaaaaaaattgaaaacggattaaaagcaataaaatttttaattgggggaagggtggggggctcccgagcaaccatttctcaaatgctcacctcgtccggttctctctcagaaaatacgtccacaaagccagatgaatgggttccacagaccggaatgtgaagctaaacattgaaaatattaaaaagtaaataggaaaaagaaattttaataaatggttggtttttcataatatttttattgaaatttggataattttttcgtccaatacaacatgtcccaggtagtatagtggttagtatccgcgcctgtcacgtgcgagacccgggttcgattcccggcctgggaggcaaatattttttgatttttttaaacaacaacaatttgaattaaattgtcaaattccactgtcaaattttttaaagagatttatttaaaaagtaaacgttgtttttattatattgaagtaataaatgacttcaaaaattcccatgaaatttagatattccagcaatatttcgaatttttagatgggggatgagtttgactaaatccatttaaataaaccgacccggtccggcgacccaggcccgtagccagaaaaaaattcggaggtaggaatgcgaagactttatttttggttctttgggccaaaattccaaaaatctttttctcgcgaaatttttaaattttcgtcgccaagaaaaacttttctggctaaaaaatgacaaatttttgccaggttgaggtcaaattttcaaaaatatggtaaaatagatggggccgctgggaaaactttgaatggcataaatttaaaagaaaaatgctatgaattgaggataaaaaattcgtttcttcccatttcccaatttcccaggtagtatagtggttagtatccgcgcctgtcacgtgcgagacccgggttcgattcccggcctgggaggaaaacattttttacattttttaataacaacattgttaaaatgatttaaatttcacgcacccccgcttccgttttgcgcatgtaattcctcttcttgtccaacatgttcagcttcccaactttcaccggttcacccaacaaacttttggcctcgtcatgtccatcgaaaatgagctaaaaacgaaaaaaaaacagtgtaaaataaatatataatattttggaaaatttaaatgatggcacaaacaaaaagcaaccatatacctaattaaaaaatgcaaaattcccaatttattataactaaatttgcctcttaaaatttttggccaatttgagagctctgatttgttaaaataaattcccttggatgtttcttcaacgatcaatcagcaaacacgaaaacgtttttttcgggaattaactttttccgagtggacgaatccgacttcttttcccaaattcggttaacgcaccatcgcctttttgaagtggggcgatcccatgtacgtcttctgggcgatgtaatgcatgaagagacaaatgcctgcgccattgaaggtgataaggccccaggcaaggccataggtcgaccatttgacagacgaaattttgtgcaacccattgacgaacgcactcatttttaggaagacaaagttaaaaatatagaaaatataataaaaaagtgaacagaaatgtaaatccatttaaaataggcataaaacaaaaataaaaaaagtattgaaagccaattctcttccaaaaaataaataaatagaaaacaaacaaaataaaaaaacaacaaaacataggaaatgagtttgttgttgatactacagatcgtttggttgaaaaataaatttaaaaaggaaaactttttttttggtaaattaataatcgaaagaatgatagtgtagggattccgttagatcatttgtgtgcttccttccgtcctcattaattcaaaattgctgctgctactgctggacgtcagcagatgagacggactgttgcgacgattgctgcgatccgctcacaaaatcctcgggactttccaccaacgaaatggtcacagctgacagaaaggcgggcactgaattgtaacggacctgcaaatttggtttcaattattaaataaaaaaggtaatttaaaaggaaaatggaaaataaaaaaggaattccgcctcaatattcaaaatgataaatccataaaaattcgtaaaatacgttttatttcttgggttttcgggggctttgatcaacacattagtgatatctttaagttcgttttcgtgtaaaaaaaaaaatttttgatagagaaaaagtggaattcgaaaaactgatggctttcgacttttggttcgaatttgagttcagtgtacaaatgtcatattcgtcatacatgaaaaaggtggggggggggtcgtagcgaaggggaaaagaaggaaatttctgaaaaatttggtttttttcttaacaaaatttgctagattcaatttttcttaaaaaataaggcccaaatctcaaaatttggtgatcttttagac

SEQ ID NO: 2950 - DNA, 2973 bp, Heterodera glycines
  misc_feature (52)..(52): n is a, c, g, or t
cttgcatggcctgggcaggtcgcaaaaaaagcggttttttaaaacaaaaaanagtcgtcgcctttgataaaaatcgcaaaaagctgccagttttcggtgaaaatctgttacaaaattcacttaaattttcaaaatttttctccggcggcgcctgatggcaccgccggagccccccccccccaaaaaaaagttttctaaaaaaccgcgccgcaaaaaaagatttttaaaaacaaaaaccccaaaataatggaggggaagtggcacattaaagactataaaagcacaccaaataattcgcaatcaagtctttccaacgttgagcacattcgttgtccaacagatcgaccgtcggcggttgttggccatgtttctgtgaggaattggttttacaaacaaaaatttttgaaatttgttttaagcacttggaaaaggaagacacagttcttggaatgcacactctccgcctcgaaaaagccctcctcgccaatgcgcacgtcgtaaccgctaatcaatgcaaccgtctcacgaaattcgcgcagcagctccgcattaactgaaaaaattaaataaaacttgtttatttaacaaaaagaaattgaaagaaaaattttaaaaaaatatttcctcccaggccgggaatcgaacccgggtctcgcacgtgacaggcgcggatactaaccactatactacctgggacacatatcaagggtcttttatttcccttacaactcatctttttttttataagattcttttcacaatttacatttacaattcgtttgaactaactttttggtggacaaaaaccttaatatattgagaagagatttggccccaattttccgctaaatacccaaccattttccgtctgatccagccgatctttgagcgcacgaatttgaacacgtaaattgtgaacatggccatcgtccgagtcctccgtctcctctccgaattcgtctcccaccggcgtttcatctgccgctaattcatcaccaacggaattgtcctgaaaaaacgagacacattgttaaaatgggaaaaacaaattttcaaatggcgcgtcaaagccaaataaagcataaaaaattttctaaattgcaaacgaaaatattccatgagtctcaacccaatgaaatacgcacacactaaaaaatactaaaacctgttcaagtataaaaccactgaccaatttgcgtcgtttcaacggattcggagcagaagcgccagttgaagcagacgcagcagcagcagccacctcgcggatgaccagctcatcccgcgcttcgtccaacggattggcggtggcgaagcgcaaaatgcgagttgtgtctgacccggtgggctcctcctaaagccggggaaaattcacaaaacacacaaacagttttttgcatattttttctcacatatttttgcaatttgttgcgcagttcgccaagctccgcgtcgtatttgcgcttgaacagttgcgcaattcgtcgcgactcgccgacggttggcgcgtcgcgtggttgctgctgcgagtccaacagtttcagtttggtctccagctctttgttcctggaatttttcacgatgacttagaattgttaagaggaagttggaggaaatgaccgcagaattgaatccggataaaatgttacctctaattttttcgtttaggatttttgcttttctctccatggtggggtgcattcttaaatcggaaatgttgttttcttattttttacagttggaaggttatttctaggaaagaaaaaaatgtttttttaaaatttctttgaaaattataaaagcgaaaaaaattcttatttactcggaaaaactagaaaactaaaaaattgtgaaacgacgggaggggggaggtgacgaactgctgctccccaatggtgtgcccctataagcctcaaccaaaaagcaccgacttttcgcgcaattggccggcactgcgcaccaactcctccaaaccgttgcgtgagatggaaccgccgccaaacaaacacttcagctcctcatggtcacgctgaaaaggaaagggacgcgatgatgaacaacttaggcttttttgacaatgagcgtgaacactcacaatgagttgcgcattttgtctccgcaaaatgtccgtctgcgtttgcaggtcgaccttttgttcctccaacagttccacgtgcttggcacgttcgctgcaatttgaaaaatttaagtttttaaattatgaaaatttatagtttgtttatgttttaggttcttccggtaaattctatttgaaaattctggccctaaatttcctgggagtgattccattttcgacgattgttcttatttttggcattttccatcaatccatgaaccaccacaacacctcagaatgatcagttgttcgtgctgctttgagcattggatttccagccgttcaatgtccctctcgtagtcaatcatgcgcaattcttgcgccgtcatcccctccgtcttggagccgtccatgtcgttgttcgcacccggcttggcgcaaaaactgctgtttaataacatttcgttgttgttagtgtcctccgtctgcgtttggaccgctaaagaaaaaaaaacaaaatttaaacttagaaatttaagaaaaatttagaaaaacttttatgaaaattcaagaaaaattattttttgaaattttcttataaaaatttagtaatcaaatttcggagggaggggggacaacctgtccctgttgtataaagatgagtaataataaagaaatcgagcacagcgataataggtaaattttggcatttcacaaaaaccaaaaaatcctgttaaattgagccccccccccctcgtcccggattaaatttgaatatttcaatttgcaggatctaataaactcactgtgaaatttgggtcgtacaacggtggcactaatgttctctacgtcttcgatggaaccaaaataattgccgatggttgagcctgaagccaact

SEQ ID NO: 2951 - DNA, 1021 bp, Heterodera glycines
  misc_feature (11)..(11): n is a, c, g, or t
aaaacaaattntggtaatgctcaggcgataaaaaagaagatgagcttaaaactaaaaattgtttctgttttggtcacgcactttgctgctgttggcttgcccttctctggtggtggtgtctttcacggtcatcgccccctctgccgctgctttggttgtgcataaaacgaccaaaattgcgctgaaagcgtcgttcttctttctgtgcaaaaacacgcgaaacttcgggatcatcgttgtcaaatgaagccatttccaatagccaaatgtagagttatgccggtaataaagaagaaattctgtgaaacaatgttttttcctaagaaaaatcgaaaggaaactcaaaaataaatttatgaatatttaggtataactaaatataagtagaataggtaagttcccgaattgacgcattggtaaattgcgagatttagggttccgaactctgattttttttaatcacaccgtttcaaaaaacgagatgtgtaccaataaatagagagtgccagagaaaaatgcatctctcattttggcgtactatttttttgtctctgttattagagaaaaactgaatttacttcatcctgtttaactttttttctgcttgttaaatccgcttcaaattttgcatatcgatagagaaaaatattctgcatctaatgataggttaagttaatattaaaataggtcaaactcaaaagttataagataaacaaaattttaaagcctcataacttttctctggtacaccaaatcgcttagcatttgtttagaaaaagcttctcctcatcaagagctttcgaatgataccatgattgtccaagttggttggcaaatacctccaaaaataattcccaaaattcgtaattttttaatattttggacaaaaataaatgaaaatattcatgttgcacaacggactcgaaccaccaccctttgtcccttactatcttacaaaaaccactgagccacacatgcaaatcttttctggtacaggagctcatttctggaaaggtgtgta

SEQ ID NO: 2952 - DNA, 1378 bp, Heterodera glycines
aggatacgcaggaaaattgaaggactatgaaaatacggaagattcgatgaatgccccttagaatgcttcattctcaactaaacagaacaaatttggtatctaaaaaaagattttgaaaaggagaatctttttctaaacgaatgctaagcaatttgacatctcagaaaaaagttgtgatactttcaaattcttatcacgttataactcaagtcctaaactgctgttttcagcaaaaatgctaaaactattaatttctctattgattctaaatgtccaaagtgattttgtatccttataaccaaaattgttagcatttacgaatttgatgttttttgtgtgttagagatgtgaaaatagtacgccaacacgagaggaaaagaaatgcaaaaattttaatcactccataactttttagttaaccctttttttgctcttaaaaacccttacattttgttcctaatttctttctctatcgatgtgcaaaatttggtgtggatttaacaagtaggaaaaaagttaaacaggatgaagtaaatgttgttctttacaccattaaaatgaagagatagtacgccaaagtgagagaaataaagataaaaagtaaatgtgacagaacgccaattttttcccataattatccataaagatttattgtcgcttttttttcttttttaccgtccatggtctaccatggacagtgcaaatattcatggacagtaaaaaaatgatataaatattgcagtaaatctttattgttgctgtgaggtgatcagtttaaaattttatacaaatacatacaaaaaatgatcgggggggggggcaattacaatatggggcattatggcagtttatgggcacaccgacaacaattcaaatgatcgggggtattgacaattacaatatggggcattatgacagttatggaaacgctgacaacgcacacactcgcagatgatcatattctatcctgacgatccctccgtcatcggccggcccggcgacgtcagcagcagctcagccccgttgcatggtggagttcagtgcctgcacatagggtgttgagtgcgttcacgttgatgttcagctttgacgccttgttttgtgcctgactgaaaaaaagaaaaattgatttttattttttgaaatattaaagattaaaacccaccgacagtatcacctaactatatgtatagatattggtcgagcgtctggatgctctgatagctgaacagtgcactaccgcccggtagatgccgatctcacattacagcaggggattcgctgccaggtcgctgctgggcactccgcggaacggtccattgtcgccagtggaagtgttggacgcgcaaggggccctgtcgcatccgcggtgctccaa

SEQ ID NO: 2953 - DNA, 1774 bp, Heterodera glycines
  misc_feature (1367)..(1367): n is a, c, g, or t
tgtgtgccgtgtggtctgatcccatgtggagcagccggtcaccggctccggctccgcatgcggctcgcgaagcggcgtctgtggtggggagggcggcggcggggccacgcactgttccacccttgcacgcttccgttcaggccctggttttttattatcatcagcaatttcttccggccaaacatgctccccccatcggtcttcctccccctggtcagcttcatcgggagccatttgcatgggctcttcctcctcttcctcctcgttcatcactgagctgtcgggtgatcccacgtcaccggcacaacagctccatccaaatgggcgagtgcgtatggattgcggcggcacttcatctgaaaaattgaaattgttgttgctgtgtgtgtgtgtgtgtgtgtgtggtaatctagttgctattctcccttttggttattctgttttcttttgtgactcaccaacacactctgctgcaccccgccgaagcacgcgcccctttgtgtacacgggccggtacacgcgggtggagcgacgcgtgaagatgtccgcctggcggttgcgcacaaaccgctggcatggcacagagatggtgcgctcctcctggccatcgcttccgtcagcagcatcagccgcgggacccctttgttgttgttgttgatggtgctgcctgaaaatcatcaaaaaatgtgtgtgtgtgtgtttgtgtgttcagagtgcctcagtgccccccccctcgacccaacaggggagtggtgtcatattatttacccgacgccaaagtggttgatgaccagctgccgcatgcgctcatactgcagctgctggtccgccgcatagttgagctcaaaggagcgcaccttgcgctccgccctcaggtcgccgcccgtgcacgcgtccacgtgttggaacccatagttctttgggccggcggcgaagaagtcgatgatgcgacggccgggcagctcccgcttcatgtcacccaacgcgttgccctcgcgcacaccttcagcgccacgctgcttcacgtacagcacactgtccgtgtcgcagtacagggatcggccgcccacccgtcggacctcctccaaccagtcgtacaggtacagccgggcatgggacgtcacaaaacatgcgacggccaagttgttgtgctccggcgcccgtgcgaacggctcccgcttgcgcaccacacagcggtccagctggtcgttgaggtgggtgaagctgaccacctcctgctccggacgcatgagcagctcgtggaagtcgcgtgcgctgttggtgtacaccacctcgtcgcgctccggacgctccgccattttgccccatagcgagttcagcaaatccttggccaactgacgcagacnctgggttgtgcccaatgttgtcgggccggagatggatgccctcctgctccgcaaattggcggatgtgctccgcgcgtgccgcttcgggtgtcacagccggccggccagccgctcgcctccgccttcagccgcaggaaggtgttcacgtattcggtgaacagcccgttgccattgtccggtgacgcccagcgctcgtagtgccacacctcatggacgctcagcacacggtagccgatggacagcgcgcgatttagctccacgtgcgtgtaggcagcggtccacgcacgctcatgctccgtgtgatgacagattcgttgctggcgcagctcggcgcaacgcgcgcacaggccgaagatgagacgtccacccgcctgggtgcggtagggcagcagcggctcgcgatcgcc

SEQ ID NO: 2954 - DNA, 2223 bp, Heterodera glycines
ggaggcagcccgcgccagaagaggaagccgcggagcgggttgtctcccgggcggccccatgtcagggcaggaggaggacaaagccctgctggaggtggagaagaagctgaaatgctgttttccaatatgggccaaagcagcagcagcagcaactacaaataccttcaaacgcatgggcgcccgcctgccacagctgctctccggtccacacgtgcggtgtgccgatggggaaggggcgcgccttcatgcagtacgggtacagagacaccttggagagagacaaatattttgataaaattcagatgaaaataatatcattcaaaaaacatacaatgtcaatgtacacaatctcttcgtcgggagcgcatttgtgcaacagccaaaagggctccacacggccgccgaacagagcatgcttgcgcaagtcgagcgggcccggcacatccacgcacctctccttgtacagctttcggaggcggatgttggtgcgcagagtgcgccggaactggcaatcccacaccgacagcacctccatcccgtgcagctcggcgagctcccaggcccgttgctgggtgcgcgcccacagcaactccgcgctgcgtccccccgccaacagcatgtgccgatcggggtagcactcccgacaaccttaattgagctcagaaattaaaacattattgtaagtgtgtgtgtgtgtgtgtgtgtgtgtgtgtgtgtgtgtgtgtgtgtgtgtgtgtgtgtgtgtgtgtgtgtgtgtgtgtgtgtgtgtgtgtgtcccaccgtgcatgtagcagccgttgaactcgatgcacaacggtcgcagtggtggatgacggtaggccacgcagtcgagccggaatccgtcatcgtcggcgccggcacagctgttggtgctgttgttgtcgcggcggcggcggtggtaggagcgcccgctgtcccccacaacagcttcgccgatggaccagcgggcagtgcgaagcgggtccaggtcgggccgtacggcggccagcagcgtgaagaagcgccgagactccaccgatgctcggcgtccgcgcaggaatccgccctccggcgtgtgcaccatcgtgttggggcggaggtggtgctggcggaacacagccatggccaggctggcaattgtggttgcggccagaaagggttccatgccgtccgcacactcccccaccagctcgcggaagcgcaggcaggcggtgcgcaaaattttcacatctaaatgcataaatgggtatagccgtatgtgtttgttgtgccccccccccccccccccgcccctaccattccaacagtagcggagcagctcgcggcggagcaaaaagggctggcgcccgggccggcgcagctcgtgtgcgtaccactccatgaaccgctcgcgttgctcggggcgcatcctgtccgggtcgtaggcagcaggtggtggcagcgtgccggccggcagctcaacatccaggttgcgcgcgtggatgtgatggtaggggaagaacggtttgtccggcaccccgcgcagcccaaacgtgcgcggcagggtggccagcgcacagtggaagtagttcagcgagtccttgcagatcagctcccgctggtgcgtgccgcgcaactccaacatgtacacgcgcaacccatgctgaaccgcctttcgcggccgctcaccccgacgctgcaactcctccagcaacagatggatgtcgtaacggccctaagcggacagagaaaagcagcataacaataaattatgaacgcatttgtaaagacatcaaagcttactccgttatgtgcaagcatcacggtgcgcacaccttttgggccggtgtggagcagaaagtcgacaaattgctccatcgcgccccgcccggtgcctggctccccgtcgcagaagaagcgcagccgacgcgggttcagcccgtccaacggcagttgttgttgtccgacgacaccgagctcatccgctccaatgtcgacgtcgctgtcgtcgaacagctgttcaccgatgcgtgagcaccagcgtcgacggttggcgccccgccacggcacgccgcactgacagcgcggtgctcggcgcaacggctcccgctccagctccaccccgtgcgcgatgcaccgctcacaaatcacttccgcacagaccagcaccggcacgtgcttcagcaacacagcgtggtcgaatgccgctggtgccgcctctccatcaccaatgccacccacgtc

SEQ ID NO: 2955 - DNA, 2146 bp, Heterodera glycines
gcaccaccaccaccaccgccaccgagcagaccaagcgccggtggcagggtccacgcactgacggtgcgccgcaaaacagtccgcattcgggaacacaaagcggcactgtgcacagaacagcccaccctgcggcgtgtctgcatcccggcgacatgggaagtgcagcgcatcatagcgcaaacacagcccacacacggcgcgacagcccaacggatgcgagcgtctgtggacgggccgctcgcactcgacacaatattgttttgcctagagggggcggttcgaattagaaactgcattgacatttgattttgactagagatgcatttctttttttactttgctttaatttgctttacagttcaattattttttaaccaatataataaatgatgagtttttaatttttttgaatttgcttctcatttatttttaaatgcagtttattcattgcgtttctttttgaatttaattattcaacatattatttactttcaatttatcgagttattgtttttcttagaattcatttttaaattaattttatgaagtgttgcagttcctgcttaattttctctttttcgacacttctttgcgccttttttaaatttcgtgcttatttttctttgcgttttatttaattctggtctaaatatatttatgttttatttgctttgcatttcttctttgcgttgagttatttttgaggtttaattaattaatcgtttcgttacagtttattgccttcatttttctctttttgcgtcagttctttgtgctttgtgattttttcctttttttacatttcatgcgtttttctttgcgttactttgcgttttatttatttctgaattaaatttttaatcttttatttatttgcatttcttctttgctttcagttatttttcagatttatttaattaatcgtttcgtagcagttcattgtcttaatttttctcttttgcgtcagttttttttattcttcatgcttttttcttttttaaatttcatgcgtttttccttgcgttactttgtgtttttgtttcgaattaaatgtatttcttttatttctttgtatttcttttttgagcaaagttattccaggtatttgctttattttcacatttttttgttagctctttgagattcgttattttttctttattttaatttttttatttgctttacgttgctttgcgtttcgtttctttgtaaaatattaaaatttttacccggaaaagttgttgagggcgctggatgtacccgtagtgggcattccgttgaagcagcaggcaaatgttgaagtgcgcccgattcggggccttccacagcacacgacaaccgtgctcccgctcgaagatgaccaggcgtgcttgctgcgcaccgagccgcgtgtcgagcgcgtgctggatttgttgcgcatccgccaccccgtagctgggccgatccagcggcagggtggcggattgcagcaactgacgggccgcctgttctccgccatgcccatgttgtgccagccaaaaggtgtgcagatgtgcggtcgcttgttggctgtcggcaccgtacaggtgctggaagcgccggtcagccaaccccagcacgacggcacgtgcaaggcaccacgcgtcatccgggttcaccaccggaaagaatgagcggcaccggacactgccccgcgcctctcgctcatccgctgcacaagcacccgcgcctgtgcggtaaaaattgtttttttttggatagttccaaaagcgggccaaacagctgcccccgtcccccccccccactgtcacccttccctccccttcctttgtaccgctattgcgctccagtggccacacagcgctgatgcggaacaaaacagtgccgccgaacaggtcgacgccgccggctgactgcgcggcgagccgctccaattctgcggccattgcttcggcggtgttctgctccggggcgcggtgcgggatgtggtagggcgaggcgaactgcggcggctggcacgacatggcaatgcgcagcgggcgcgggcgcccggccagcacacggtccagtagatgcgcaatgcattgtggcagcaacgtgtccgggcgccgcgcacccgcccatccatacggtgccacttcaactgcctcacaccgagtgtgcgact

SEQ ID NO: 2956 - DNA, 4305 bp, Heterodera glycines
caaatttggttgaattttatcaaaatttctggcactttttaataaattattttaccaatgttcttccctttgtcggttttggtttgtgcacatttgcatttccaatctccaccaatgttaaaagctctttttgcgcgatcgtaaccaacttcttggcaatttgtctggttacgtgatttctcatttttgcaagtttgccaatgataggcgtacttttccttttctgaatatagcaaattttcctctctttatccaattttatcttttttggggcgctggatttttttcttcggtcggcggaggccagtgctggtgcttctgtaatttttgtgcatataacaaaaggccgtctcctcgtaaaagctttcgcaatcattcgacataaagttcctctacatttcattagtaccttcggtgttatctgctcacccagcaagtatcttttcaagtccacgaacttctggaatccaacgtaggtgagaataccttatactatattatttcgaaggagtttgagcaaaaggcggaaacaggcaaagagcagtaagccaaaagctcgtcacaaatagtctcatcgccccaactcgcttcccttccactatgtcgaaaatttaggctactgtcaaatatatacacttacagaacacagtcacacctacacaaacacacacacacacacacacaccgctcagaatttgaaaatttgcttaacaattatttatgaaatgatgagtaaagattttttaaatatggcaacaaattttcaaagcaatgagaaaaatggcaaaggaaatgagtgaacaaatgtgaaatgtcttttaaaaaatcgctctcagtttccggcaccctcattctgttgtgttgcttcccccgtaatgaagtgccgtcggcagagaggacaaatactgcgttgagtcgcttcctgggcgaagcacttccgatgcaagaaatgttggcaggcgagacgaaccacggtgtccacgtctgagacgagccagttgtaacaaatacaacagctgatgttgttgttgccgtcgttgtccacctccacgctgcctttcactgacgatgggaggtgccgcatttgaaagccggtagatatgagccactctcggtctgccaccgagagtggctcatttccaatcatgatgatgtgcgccgctccaacttcatcttccagcgtcagcaattcgtcttggaaataccgggcatcgccacgttggagttgttgttgcggctcaacgccgagcggctccgtgtcgtcaattgtgatcacatctgccgcttcaacggcactggcactgcgcaactcgttcgggactccacgacgcaacaacgggtgggtgggagatgacgaagatgaagacggcacgtgccgacgaagacgactcagctgctgctgctggtggttctgctgtagttgctgacggcgggctcgctgacgaacacgcgtgttgcgctcatcgcgcgagacttgcgcatcaacgacgttcatgcgttgcacaatgctgtgcaggctgcgctgagcagtgatagagcaggcacgctgcggtggtggtgacgatcgacggctgggcggcacagcagccggagaaacgcagcgagaacgaagacggcggcgacgacacggacgcccaaccggtgtacacgggggtggacgtgttgtggacagccatgcctataagaaggacacaatttgttgttttttttcttaaaaatagtattgttaacacttttttgttacaacggcatgaccgcccacaacacgcccgcataaatgaataaaacaaaaaatgtgacgggaaattcatcacaacacaaaaaagaaactaacaaatcagtgtaacaatatttactcagagagagagaaaagacaaaatgtttattgttgtcataaatgcgagcgtgtgtatgtgcgtgagtgtgtaaaacaaaagagattttccgatcattgcatttcgtttcgtttcgtttctttgtttaatttccgctaaccgtttcgctcgtgccttcctcaacatccgcatctcgcgctccggcattggtcaaattggtcgctgccgccgccgtctcatcgggctcgccctcactttgtccatcatctgccgtcacaacgccggtgcctgtaataacgatttaaggaaattaaattattaattaaatccatctgatcagttcatattttgttgaactgacaattgcttttcactcactgttttgtccgtggatgtgctgattattggcaccgctgctgctgctgttgtgacgcaccacgttgctgagagtgttcatgcccggctgttgctgttccaccgcctcaacaatgattggtgtactgctgctggccaaatttgcgcctgagaatgtgagggaaaaatgaacacagttacaaaaaaacgttcgaaaaaatgcgaaaatgcaactcaccaatgtggccggatgccgagagcacgcggtgacgagactcgttgttgtagaggagagtgaacgggaagaatcccttggcgttcttcccctgctcccgaactttaagacgactgaattcgacgatctggtcgcactgaatgttgttggcaaggcgtggcatgcaatcctcccaacagtggacggccatttcctgttgggtgttgtgttggtcgaagatgaggcgcacgtcgaagccgttcagaccacccatcgtggtgaacggaccacacaacacgacaagcccaacaacacgccttaaaacaaaacggggccaatgtataaacaatattaccaaaagtgatcagaatttgagaacatacccaattagcatgtcgggttgccaatccaaaaggagccaagcggtatttgacatcccgttgtcagcacatggtgggagaatgtcggtaaagtcgggctgtgcagtaaccatgcgctgcatttgcctcgagtggacgcgctcaatcgcttcacgaatgtggggagggagggcctaaaaaatacacagaaaattaaaatttaatcactaaacacaaccatctcgacctccccccccccctctcacttcccccactaccgaaagtccgccaaatccttcagcagcactggcactcccgctacgcagcgtcgtgctcccaaaaatgccaccaccaccgaaagctgcagcagcagcacacccgctgttgacaaaagtgccggccttaaatcaaaaataaaatttctattaaccaaaatctctgttaaccattatctcggtaagcaaaacaaaaaatatgaccaaaacatctccaaaaacttacattggacgaaccagtccaaatcgtggtcgccaccgccgccggcacgccacgcatgcagctcactggctgcaaattctgctgttgatcaccgacgacaccacttccaccgcctgctgacagcttaagcggagcaaaagcaatttatgaatgggcattttcaaatgtccaacattactcaccccaaactgcatgtgtgccatggctaattgtccaccgtcgccgccaacaccaccaccgacgccatcactcggccttgcgaagccaacctggaatttaaaattaaaaaaattattattggaaaatgtgaaaattttccgaggcaaaagccatcggaaatccgccgaaaccatcccccccccaccagtgcatgaattaactcacattgctgtccaaaaaccgcgtcggcacaacacccgaagaagcagcagaagaagaagcagttgcactgttcgctgctgacacttgggcaacaccggcaccagcagcgcttgttgcaccgcgctgtaaaagcaacaaaagaaattattaagctcagattttgatcacatttgtgatcagtgaccccgaaaatcccgccttgaaaactcaaaaaaaaacttgccgatgtgtcgctgacgaactgctgtggcattggcgccaaaagcatgtccaaatcgagcgcggcaccgatgccgcctccgccgttgtttccgtacagcgggtgccgcacacttgaagtggctgtgccactttggttgctgctgccgccattgctcgtgctgtcttcacgtgcccgtttcctcccattgttcctctcctttaaaaagggagggcaattattatttgttaaaattgcggatttttatttaaacttgccggagcgtctccattggcactgcgacggcgcggattggtccctcggcgtcctcctcctcctcctgtcccggtgccatttgcatcgctttgttgttgttgctgctctccgttgaacattttgcgcagttttagctaaaattttaaaaaattaatatcaaataaaaatgggtgcacaatgggggggggg

SEQ ID NO: 2957 - DNA, 1718 bp, Heterodera glycines
  misc_feature (1655)..(1655): n is a, c, g, or t
  misc_feature (1701)..(1701): n is a, c, g, or t
ttttcattgtttctttcggacttgatttggctatttcttttcttcattaaccatttgattacttaaattgtttccatttcattcacttaacttctgtccttccaaagtgccttcctttttttttacttaaattattttcaaaattcgaaaataaaactattttctgactggttatttatagttaattatgatctctattttttgaatattctactaaaaaatttttaacaaattcgaaattcagatttcttacgcatttgaaactccaaatgttttttactttaaaaataattttattgtcttttttctgaacaaatttgaatgataattagtagggatggtatttttagggtttagccttttttcctgagttaaatggaaaaaacccaaaatatggattataatatggaagaaaaaatcctaaaatgaacaaaagatttctcaaaacttgaggttaaattttcgaaattttaaatcattgaatttttatactaaaactgaaaaatcaatttaattcaagaaaaataaaaaatataaaaaattcatcgatgtcataaatttgttaatttgcgaaaaataattttttcattgagaaaaaataatttacattaattttgatcatgtaataatcttttatggtaaacgaaaaattttttatattttttaggagtgaattttcgaatgttcttatgacgatgaagaaaatatggatgaaaaataaagaaatattaacaaaaaaaaacatgaaataagggaaaattgaaaaatgcatcttaaaatcagtaggttaaaattatattactttatttttagttcggaataaatgtgcaaaaaaataataaggaaatccatacaaatcgggccttaataataataacaataaatgttataaataagataacataaatattattcaaagttcgtcctttttgtcaaatttgggcaacactttcggcacttttcgaatcattcggtccgccgaatccaattcttccgctgtcacaatgccatcgttgtcaaagtccaagatccaggccaagcccgggtcccgcactcgacccaatgtgcccgatgtgttctgaccggtgccggagtgattgcgatcagttcgagatgcatttaggcccgtatccgccgacttttttcgggacgaagtcatcgcggccaaatccctgcggaagactcggagaaactcgtccaattgcaccacaccgtcaccattcacatcaaaatacctaaaatgggagaaaacccaaccctttttgaatttttctttagaatttaaaaaattgttagaaaataaaaaatcgtggtctaaaattcgataaaaaaaagaaaagttatgagaattcaaaagttatgccaactaaattcgaagtatgataatatttatgatatgataaataattctaaaaataaatgataaaaaagatgatttggcgcaacaaataaattaataatataaatagatttgtccttgaattcaacggcatcattaggaaaaactttcgaattgaaattcgttttctcaagaatgtccttataattggataaaaaatggcattttggatgatcactttttttggcattttgcctatttttcactcacttcacataataccgaacgacgtgccccgtttcgatgtcttcgttgngccatcgcttgccgaattcgcgtcgcattttgtcaccgaatttggncaattccgccgcggtca

SEQ ID NO: 2958 - DNA, 2337 bp, Heterodera glycines
  misc_feature (42)..(42): n is a, c, g, or t
atgctcgtcattcggaatgtttttccacactgaaaatggttntagttaaataaaaataataaatattaattaattattttaatatatttttgcctttgctcttcgcctttctgctcaaccgatagggaacctcaatttggcgcagttcaccggcacacattcccttcattgctttgtccaagccgggcattaccatgccgacgcctaactgaatgcgaatgccctcttcctttggcatccgtccgtaagtttgatcaaactttttgcccgtctccaggaagcctaaactgatcatggaccaaagcagcgatcggccaatttatcgaaaacaacgaaagacacaaaaaagggattgattaagctatttcaccccattgataatggaaaaaatctttaatttaaattttgaaaaataattataatttttgataattttaaaaattaatagtcggtcacccaactcacctttgtaatggaatgtcacaaagtccatccgccgcgcttttcgtgcgcattcgacgggtacccaagtttttttcaccttcgcttttaaaaagaaacatttttaaataattaccattaattgtttaattatattacacattgcattaatttcagtgtttaattgcccacttttatgtccaatggtcccccattggccgcttcttccaattcgcggatttgtgccgcgctcatcggcttcccctcgccgcgcacttcgatcaccggaatggcatcctccggcctccgtctgttggtcatttcgtctccgtcgcccagcggcagaattgggtcggaattagcaaaggcaaaagcttaaaaatacaaaaaaaaattctcgaaaacgaagtgccgttcgctcgccccgggctaatagccgctgatgagcggcgttcattgcgggtttttctggttttttcaaaatcataaacaaattgctcacctttaaatgtgagataaaaaagagccaaataacggaaaagcattttgtcgactgaattttaatttaaaattcttaatcgatgttcggattattgatttattttgcgatgaaaaaaacaaaatctgaaatttgttcgttttgtttgggcggagttttctgcttttctttgtgtgaagcaaataatgtgagcagaacgaatgtgaggaattggaggcattgagagggcattgaccttggagcggaagtgaaggaaagaatcgatttgggcatcggaatttcctcaattggaagtgatgggaaaagcaaataaaaattggcatttttttaattcatttatttaccgaaagatcaaaattaaacaaattatcagctaaaatttaagaaacggaaatttaagtgataaaattatataaaaaatcgcataatttttgctcatcgaatcatttaaatgggtcgaatttgttattgggttaagtttgaaaattctagagggaatggtgatccgcggtgccgataaactgggggaaatggaatttttaaaggaatttgttgagaaaaataatcaaagtttgcagaacgcgatcgcggtttcaaattgccgcggaggcgaagtcgccggcttttcactcagcttttcaccacaccaatgaatgacttcccctgactgattggagtacgatggatacattaaaacgatgaagaaaaaataacacatatcagaagtatatgaaaaaagtcctcaaggttttccattgatcagtacagtactcttccgatcatcaacaacagtgccaatgggatactgtagcggaacagtgacgtcattgtcccaccgacggcgggggacagtgccgagttgcagccatcgccgtagcagcagcaaaaagtgctggctgtgttgttgatgcaaatggcaccagaactcgtcgcctgctgattgtacgccatctttgggagggggggggaatctttgatcaaatcgaatgttttctttagagtttgtcataagattccgtttttcaaattatttcaaattggcatgactacgactatcagcagatcactttccatttgatattgccatcacttcctttccgatcactttttctcacctgtccctgagtggcttgtacggtgcaatttgtagccaagcatgaacgtgtcacttggccactgttgaagtccaccgttttgacgcatgccaacgaaacgccaacgcattgagtggccgaaccgctcaccggcgcgctgagattggccaagccttggtaacagctgagcccatcggaagaatgaaagcggagaaaaaggcgacacaaagcaaaggaaaagtgaatttgcgaaaacgaagaacgatttgacgacgattgaagaatggcattggattaaaatga

SEQ ID NO: 2959 - DNA, 1554 bp, Heterodera glycines
  misc_feature (1461)..(1461): n is a, c, g, or t
  misc_feature (1482)..(1482): n is a, c, g, or t
  misc_feature (1527)..(1527): n is a, c, g, or t
ttcaacgctttattaaaatgacaaatgaatataaacagcttcctaaatattcaaaaaaagaatgggagaaaaattatgccgatatttgtaagaaaattggagtcagccgagacataattaacaaatggaagaaacaatttggaattcgctgtaaaataacggagaaggaaaaaatggaaaaaatgaaaatttattgggaaataaaaaaagaaaatccaaaaatgaatgacaaagaaattgctaaaattgtgaacacttcaaatgcgaatatttgtaattggaagaaacaatttggagaagaaatgtttgagaattgaaaacggatgattttttaagaaattgctttgagtccctccccgatcaccaccttcaaaaattggaattttttcaacaaatatcggaaataaagaaaaaccgaatttatttgtaaaagaaaattttattcattatatatatatataagtagcgcggccgtgcgcggtggtcgtgctggcgttgggaattggaattcggaatggggagggaaagggaaaagtgccacatattcccgaaggatgggtccacggggtgatcaagcccgggattgccttcccacactcgctggtcacacaataagtggctttattctcgggacgactgagctccgttcgcttgaaaaggcaaacgttaaatacaagtgaaaagtgaaatgtcatcgatcaattatcgctgggagggcagtacaattagtaaaaagggaaattaaatgcaaaaagaaataaatgtgaaaataatgaaatcctagagcttcggcagttaaacgagtaaaaacccgacaatttcgattctctcttacacctccaaccttaccaaagaccgtccccggtctcttaccaggatttcacttcacaattgccaaagcaaaaaaattatttcaaaaaaataataattttgctaattttcatgcccttttcccaattttgaatcaaaattttatgcttcgtgccactcactcccaaccttacattggatcgtccctgatccagttcaagactcaggcatcactggcaaagtgcccagccatcaacctttgtctgcgagaactgatcaggacttttttcagatgccaaacaactgacggcatttgaccaactgatgaaaggagtttggcttcgtccgaatgaaagcattgatcagcttggcgaacgtgtttagcacttggtccgttgtgcttaccctggtctcacggaacagctatacgacgaatattcggccatgcatttcattagggcactccctaactcagaattggcaatgactttggagatgactcgtaaacctggtgcaacattcgatgagttcatcgcacaagcagcacgagccgaggcagttcaaaatgccgcacgaaattcttggcgaaacagccaaaacaacggctgtttccaaaaccaacgaaggcatattgtttgctataattgcggncaagtcggacacacttctcgnaattgctattcacagccgacacatcaggcgcaccagggacatccnagcagcaatttccattcatcaccatca

SEQ ID NO: 2960 - DNA, 1455 bp, Heterodera glycines
ggaaatttgtttgtcggagccgtaaattttgagcacttatcagaaattgagaaattcttttcgaaaacaacgaatgattcggaaaaaggcggctttttggaagaaagctcggcgattggtaaaattttggcggccaaagtttcggtatatggacgtaagttgaatgccatgctggacggcggatcccaaatttctccaatttcggccaaattcttctcacaaatcatggataaagtaagccaaaagaacgtcatcgcccgctctgaaagccgcattatcgatataagcggaacggaagtgaagtgttacggtgttgtttgtcttcccattcggcgtgaagcattagagacgaagatcaatttattcgtcgcgcaatcagcttttggctacgatttgcttttcggcacgaatgccttaaaacaattaggcttcaaaatgatcgacgaggttagcaaccaaatcgtagacttctcacccgcttcaatgctcgagaattctccaatgatcgttttcaaaacatttgttattgatggccaaaacttggacaaaacaccgggaaattttggagggaagagaaaggacgcgtcggagcctaaaaatggcactgggaccaagaaatgtaataaaggacggcgacaagaaaagcagtcagagacagagaagtcatcagttcgaaatgccggtgaaagaaggcccctattgaccaaaacattcgtgccccaactaaaaaccaaggaaattccgatcaaaaattctgaaaattttggagaaagtgcggcaaacaaacagcgattgaattcggttcaaatgaaagtgggcgtgccaaacgaaagcgaagaagagtatttggagaaggaaaaattatggtcaaattcagttagggacaactgaaaatttgggtagggggaaggtgagcccaaaaatgcttcgtcggcaaatgggaggttggatctatgcgatcgccgccctgactcttggtcccaatcgtccttccatcgaggcgagactgacgtcaaatttggccaaagaattttttgtcgcggaagaaagcgccgaaaagaacccgaccgtggaatgttcaaagacggatgctggcacaggcttaactcgcccaccacctatcggatgccgaatgagcataaaaggcaggggacgcctttttcttggagggtcgggatgtgttagtatttgatttttggcgtttaaatttattttaatatattgtcccttcataattttgtcttattgtctgtctattactctctatgtaatcgatattttgccatccctttccagcagaaaatgttccctcgtcttcgcttcaattcattctgttggcagtgcactttttatattattttgttttattttcctcggactcttcttccatttttattgttgctgattttaaataaaagtgaattgtccccgtctggaaatattgttgagggaaag

SEQ ID NO: 2961 - DNA, 4893 bp, Heterodera glycines
  misc_feature (4842)..(4842): n is a, c, g, or t
ttttatgttgctgatttaaataaaagtgaatgtccgcgtcttggaaatattgtgagggacagcagtgaataggctccgaccccaaaccagcataagttttgcacgacaactataaattaaaaaataagaatgccgtcaatttttaacgggtatttggccggatgaattttaaaaattttaattaatttatttaaagtaaatttatcataagccttttattcgctttcatttaagcaaaagtcaaaaattaaaaaaaataaataaatcaaaaactaatatagtttaataataaaaaaaaaatctaaattaaatttaacttcattattttcaattaattcaacaattctctttaattcaaatgaccgaattttatggtacaccaaaattaataattcttaatttgaagccagaagaatttaataattaaactttaattcaaaataattgtaagaaaatatgaaaaaatgtctatttttgagaaaaattcagggaaatgggaaaaggaaaaaaacgggaacggattccctcgtttgcacatgggaatctcattcccggtgggctagaaaagaaagaatcaaagcggactcttaacaaatcaccatttgtacactctgttcatgtatttggaatgtccgtttttttcgaacgccaatttaattatcactttcaattggttgatttggtaagtaattaaaaaattaagccgataaaagacaataaaagttataaattttagctctgctgttcgaaaagtgattaaacagtctcaaattgctctcaaattttcgatattttttgaacctgtgccagataacccgaggctggcattgataaatttatttatgtttgtgacgaaaatatgacaaatttttcctgaaaatttcagtaacaaaccaatcccaactaattaattaatatttgtcaatttcgtttcacaatctgttgcttgccacaatctgtcaatgatttcgtcttcaatgagttcctttctttcttatgagattattgaattattaaatggttttttaccattttttggcaaattaatgcataaaatgagattctatgattatatccaatgaaacaaatgacataataattaatcataataatgatgtcattcggaaatttttctcattttgtgtaaaagaatgatgtcagtaagaaaaataattcatattttatataaatgaaaaaatacactaaaaaataataattataattctaaggctttttctcataattattatttttctttttttagtttaaatggctttcggtttcgttaattccatttggctttttcttctattaattttttgtattgaatcattcgccgatcagacttcttggaatggatcaaatcaaaatcaaaaaataactggaaatttggcactatttgccaacgaagacgaagttgatccgccgttgtcgtctgatcgaacaattaccgacccaattaaagcaattaaaacatcccaaggaacggcaaaccgaacagacgataaggcaaaaaattggccaaaaggaaagattatgcattttttattttagcagttgaattttggaacaagaagcaccccaatgaccgtccctctggttgggaacggtgctaaaaatggccaacattttggcacaaaaaaagcgccatcgcaaagactccgctccattttctcatgggtctcaaagttcaatcaaaatggtcacattatgaagctctaccaaaagttgaagaacacccccgggggatggggccaactcatccgcaaaatgtacgctgaaatgctttcggcaaagaaactcggagctggcaacagcaaaccgttacgcgagaactgtcataaagccctccaactgattggagagggacgagcagttcaacgcgtcgatgttcagaagataaaaccgttccacgacttttggacccttttgaaaaattcggcactttcgctggtgacactttttaagggcactttaaaaacgaaaaatggaagagaaagtgaccgtaaaatgaagagagaaaacattttacgagcattgaaaacattttccacagaggacaactcatttttcttgcgaatggtccgaaaaaatggaaaaacgaacgaaagtaagcaaaataaatactttatttatcagggattttaaaaaatgaactacttggtagagtgattgttaaatgtttttcaaatttaagcacacaaagaccaaaaacgacgacggcaaaaacgattggcccctttgattatttttggcataatcatcggaggactgttggtgatcgcgtttttaagtgaatgggtaaaagctggtttttaaattcgaaaagacataaaattctgcctttttttcgagttgtgctattgcataaagattttaattttggttcaattagcgacaaattttgaagttaattcctaattgctttttttcattgtgttggacaacacagggaaagactaaccgtttgtttttacgttcattcttattttaatttattttctattaatcctttcgttcgaaaaggtcgtaaaccgataaatgcggactttttgataaataaatatttatgaattttttatttattaattatgcatttattttttggatacaaattaagccctaagaaaatggattaacttggatattaatttttatacaagtaaatgagtgaatgaatacacataataaaaagtgagtgaattatttcaaaacattaaccaattcgccagttaaatttatgctttcatcaatttctcccttttgccgacatttccgcgcgcccttttcgtgttccgattcgtgccatggcgcgcgctttagccgcggctttacgcggaaagccgcacattgccggtggcattcgcagcagctgagccgccgggagggcaacagcaggcgaataagtgggcataaggccaggaaaagcggctgccggtgcaaaagcgggcacagcggcggcggctgtcaggccgggaaaagcagcggctggcataatgcctaaacattggaaaaagccaagaattagcattaaaatagctaaaaaagaccagggaatgccgcagatggggcatatgcggggaccgccgctgccggcataaagccagcgggggagcgcagaatgggcggaggcggtggagcagccaaaaagggctcaaaaaggttggcaacgatttttgaaagcaaatctaaaaattcaccaaagactgtgcgacaggtgcacacccaaacggtagaatagccggaggcgatgccattatggcgggcggtgggggcggaggcggcaagggaggcggacccgcaggtgcagaagcgaagtaacggccgggtgggaggcaatcatactgtacaacataaatacggtagggataaacggtaggcaattaaaatgcgcaattaataccatgaattgcgacctgacagcactgaacccgagcaacagaaatgggctgaattggggaaaatatgcacaagtttttaaaacaaaattattctaattgatttgaattggggtacaaaagcacggaaacgtcagggaatctcccgaagaatcgacctttgatttgctgacacaaatttaattcactattttcaatcccaattggagaggggttagtcgagattaatttgcattggcaagaacagttatataccctaattaagcaatttaaattaaaaatctatttaataaattattattattaattcagattttatggcaaaaggctgggaaagtcgcgaaaaagctgctagcaaaatattaataaaaagttgttaaaaacaaagattttttttactctaatttttgtgaataaattttagtaaacaacttttgattttttcttaaatttatatttatttattttgtgaatttctctttttctcctttaaaaaattctttggcaaaaaatttcaggccataggaaaattgggttaagataaagaaaaacaaaaaacacacatacccaaaagcaagaagcattgtccatcccattttatcagttaagcaaaagaatttataacaatgattaatgattaataattaataattctaaaatgataaaagtcaattattgtcacagcatttatcacaaaataatggcaataataatattaatgattgacaacaaagacaacttcttaaaaaatgtgtgtgtacacatttgcatttgcattgtcaacaaagttttggggacttggccaactcggccaattccctccgtccgtccgtcgatcggtgggtggtgacaatttgcaattcgtcagtccgtcggtcgggaaaaaattgtcgacgggcgacaaacagaacagacaactgaaaaatacacaaaagtggggaaacttaaagtaaaataagtttaaatttattttttgaccagagaatagagatgtggtggcaagaaatacaattattaaatttttgaataataaaaaaaagcaattagaacaaagcaataaaattattttctttaataaaattaaaacaaaaagaaaaacagatatcatgacaataataaataaatcatcacaaaaaaaaaatttttttttaatttattttgaaaattgtcgttcatacaataaaatgaaaataaaaataaaacacgttgactttctgatctaattatatagatattgataaaagagaaattaactaatttaattaaaatatttatggattttaatttactataaatatgataaaaatgaaaatagacaagcatttctaatttggaaaaggagtgaatattacgttatggggtattcatttcaataatatgaaataaaaatggataaaatacataatatctaaaaacattttcgagaaatcaaaaatcgaataanatatttgattacccagatataaaaaaattcaatacatccattattaggggg

SEQ ID NO: 2962 - DNA, 1324 bp, Heterodera glycines
  misc_feature (74)..(74): n is a, c, g, or t
ggggggggggggggggaggaaaacctgcttagaacaattaaaaatatattcaaaccatttcgaaattccgatgnatatcaaatttatagatttggccgataaaagaaaaaagttatgacttttttaactttgccagacgcaaatcagtgggaaaattgttaatttttaaaagtaattttggcttcgatgatacacagaattacgttgcattgtaatattttgttaaacttgataaattgcattatttatttttttatttgtctatttcttgaaaaatccaggaacagagagaccataaaacggactttttcatccagcaccttttagattttcttaatttgcccgtccttgactgcaaattgggcatttattttgaaaggaaaaagtcacataaagaaagaatcatctcgatcattaaaatgccgatttttaaacgcattcttaattattattattattttaaagtaaattaaaaataattctacggattttccaaagcatccattttgtgtgtagcagcactgctcccaatttgttcatctgctgctgtttccggtgttcgtccgccaaatgaaatgttttgcaacggcggaaaaatgtctctggggaagtagtcaaagggaatgtcgaaagtccttaaatttctttcattttgaaattaaaaaaaatatccgatggaaaaatgccgtactcccaacgtctcgaatcaaatttaaattttcgaccaattcacctgttcttcgccatttccgcttcttcttgcgtgtcgtttgtagtcaagagcgagatgttcttcagagcggacaaatattccggatgaccacccgctgccgtgaagcgcagcgggaaaaggagaaggattagcagaagaatgcaattagcaatgggaagcataattatggctaaaatctatttaaatcaaaaaacttatcaaaaagaaacaggataaattaattgagagattttttgtgaaaatgcataaaaatggacaaaatttgtagtggttaaaaatgatgaatttgtttaaaaaaagtgtccgtcccttctctaatgatcggatagcagctgaatgattttcattttcccaacacaatttgtcataattaatatgcattttgattattcaccataccatcaatttactcaatctttccaaaagatcgggtttttcactgaaattaatgattaaaaaaggattcatttttaaaattgttataatttgttttatgcttgttggcaaaattttattcaactcgagaccttgagaccaaattgagccgaaaacgaggcaattaggacaattcttaaaaaatctatttcttca

SEQ ID NO: 2963 - DNA, 6587 bp, Heterodera glycines
tgcctcggcctgggcctccaatttttttggcagggcgcctccccggcttggagtgaaccaggggtcaaaccaatacttcatggaaaacatggttggccccactcggcggcctttcccctttttgcacggggaacccctggtcactttgagtgaccgcagttcgaggtgtgtcaatgagagacaccctttcttgcgtagccaagattggcttcgctccggctttcgagggcctgcctctttttttacttccaatggaagacgccggcgtgcttatttgtaaagcacttaagcttggggtggtggtacctcggagagatgccgatgcctctccattcccatctgcactcccgtctgagacgggtgagttatcccgactgacagatcgctctgcctgtcgccgatacacatctttcatcttctttctcaaattcttttgttttgaaggcatctgaaacaacaaatcagaaagtgttgcaaatgtggcacaaagtatgaggaaaataaccatatgatgcacataaaataaaaatatttatttaaaattgcgcaaaaaggttattctgtcatcattcttcgccgtggagtgtagtcgtcctgtgctgaaatccatcagccagggctcacacatctcaataagaatgcagatgcaaaagttggtgcgatacattccccgaagcgacgtcagcgaactacagtggtgcgacaaatgccccgaagggactgtcagcgaaccacattggtgcgacaatgccccgaagggcctgtctgcgaaccacattgatgcgacaatgccccgaagggcctgtcagcgaaccacattagtgcgaccaagccccgaagggccagtcagcgaaccaattttattgccctttgttcgcgccaatccctaaatggccaggggcagggaactccgaacaacagacgcgttgctgatgaacagaggacaatcccaccgtagccaaccttctgtttggaaaaagggaacttcgaacaattagcactgctaattaatcaaaggacaatcctcttttacaaacagttagctgggatacaaggccagaaaatggcgttcccattaggcggcccagccacatgcattgcaaaggcgaaagcaagtctgggctttattccatatcatggtcgcaaagctgaccgatatgggtgccatggtcgcgaagcagaccggcactgtgtcatggtcgcaaagcagaccgacactgatggctatggtcgcaaagcagaccagcctagccatggtcgtcctttaagggactggccattgaaccacaatcctcaaaaggcagtccacatttatttgatgaactcagatttcctacgttacttctcaccagtccactggtcttgacaaagtgcgggaccagcttcgcaccggctgttggccagcaacgataaggaattcatggcgccaccattgagcggcccagccacatgcatctctaggcgagagcaagtctgggcttgctttccatatcatggtcgcaaagcagaccgatatgggtgccatggtcgcgaagcagaccggcactgtgtcatggtcgcaaagcagaccgacacggttggctatggtcgcaacgcagaccagcctcgccatggtcgcaaagcagaccggcgtgtacactaatatcatggtcgctaagcagaccgatatttgccatggtcgcgaagcagaccggcatgtgcacaatcttatcatggtcgcaaagcagaccgataagattttgatacaaataaaaaatgtgaatctcaaaatgaataagaggacagaagcctttacaagtgattgttcaaatatttgaaatgtttacttaaatattaatcaagagtaaaggcttcttaaaaactattgtggagcttatgcgtgccaaagtgtacgaaacttatttcctaagtaacctcagatttgggttactaaaactatttacttagtgtacactttgccataatttaatatatatgtgcatctgaaaattttttcttattttattcaaatcatggtcaaatcgatgaattttaaaaattttaatcggccaaatacagcagtttcctgagagaatttttttaatctcacaaaaaatttgcgggatggaaacagcatcaccacaacaatgttgagatttcaaaaattcacaataattgattttcataggtttgaaaatacaaattttgaaaatttcaatttttaattgccgaatgcaatcaaaaaatttagagcataaaaaatatttgaccggttaatttgtgaaaaaaaacttgcgcagcaatccgcttttgccaccgaaatatttgtccaccagcgaatcgaaaccgagcgaaagcagtgctaatttgaggccaagttgagcaatgccaaaaaagggaaagactcctaaaatccaaaaaaattttaaaaaatgattaacaaaaaacataaaaaaaatttggtacttttaaatgaaaaaagtaaaaatatatttgtctttctggctttatgggggttttcaggtttctgctaattgtaatttttttttcttaaataatttatgattttgctacagaaacttttcaaaattctgtgattttagagaccaattttaaattcataaggttcaattttttggggtgttaccgtttttattgcatttcaaatttcaaaaattacataagcaaaaagccctaagaaaacccgacactctaataaaaaaatcaaaaacaattatgaattttggaaaaaataataattttcagccattttttgaaaccaagaaaggtttggggctcctaaattccattaaaacactattagtttaagtaaccaaaaaatcaatcacttttacaaaacaaagtaaaaacaaaaaacttatcgaaatttgaaaaaattcgcgtttaccattgaaatgtttgtccaccagcaaatcgaaacggggcaaaaaaaatttggaaaatttttatttttagagcaattttgaaatggaggcctccgttttgggcacaaactccttaaaaagcattcaataaccctaaaaaaacttgccgaaatccgttttgccaccgaaatgtttgtccaccagcgaatcgaaacggggcgaaatcaatgccaatttgaggccaagttgagcatggtcaaaacagggcaaaacgtccatcgaaacttcgtggcacacccagctgaaattgtgaaagaataactttagtaaataagtaaatttgcgcttagaaaagtggcttaatttggcaaaagcaaccctgaaacataaatcaaattgtaaaattactcaaaaaatttgatttttctcttaatttcaaacaaaaatgttacaatttattaaattgctcaatctatcaaataattttaagcatataaaatcacaataaggtgcttaattgagtaaaatgagtgcgaaaatctaaatttaaaattgcaaatttcccaaaaaaaatttttctgatttaaaaaaatattttcgtttttatttacgatgctctgaaacataaggaaaatagaaaattcctcaaaaaaatttcacttttttttaagtgccaaccaaaaattgtagagcttaatggtcaacattgcattgcgcaactcggtcaaaatggactaaataatggtgacaaaaatgggagtcaagttaatttctcaaaaatgtgtttaagaatttccaatttttattaaattttttttatgcaaaacaaaagggtcccccccccctatggtttttgacaaaattcaaaatccaaagtctaaaagagtatctttctgaaatttttttcacttttttccaattattaaatagcgtgaaacgcgtaccatcttttaaaaaaataaattctgcgtcaaaatccctgtcctgtatatactcacctcctcaagcagttcctcgaaagggttgtggtccaaccgaagtgtgccgagttgctggagccgtgaaattcgatttgtcaaccgtacaagacgatttgaagcaagatttaggctgacaattgaccctgaagagcatcggagaacatttcctgacaatttgaaatctgtttagcactggagcagtacaaaaaactgccaagaaaatttttaagaaattttttaaaaaccctaaagcaaaaaaatttcacagtgattttttaacattaatgctgaattacaagttttttcaagaatttaaaaaaaacgctaaaattttttccagaaattaaaaaaaaattctcaccggcaaatgctcaaattcgttaggctcaagtccaatgtgtttagctgttccagccttgaaattgcacaaaattggcgccaattgcgttctgtgcaccattcgtccgagcccaatttgttggcagcaaatgaaagttgttgcaaacggcgcatgccaaaccaacggatgtccacggcacgaaaatcaatcccgacaatgtcgaggcgttggagataggtcgatgaggctgtaaaagcacatacctataattaatgaaatctggccataaatttggggaagggtgggagggaaatgcattagtagcaaatttcgttaaaactgtattcaaaaaatgaatgcttatatttagtatgagctgaaataagttctttttctatttttcgccttgcctagtaattttgaaaaattatagcaagaaaaaatgggtgcaccccaaaatttcgccaccaaatttcgccgccataatttcgccggctgaaatttttaaatgctttttcatttcgtaaactaatactgtaccactattcgaactaaaaaggcaaaaaaatttaagctttgcctataattttaaaaattataccggaaaagttaagaattgttaaattttttgatcaaaaatggtcaattttttgaattataaacgttaattgagggttattgctagaaaatttccaaaaatttttaagtcgctatttatacatcgaattgcttaaaatttgctttgactccttcccacgcgccttcaagtgataagcaagattgttaccggtacttttgcagtttggggggggggggggtgggtagcattttaaattaaaaaaaatttatccatttttttaaatttcgtcaaatctgtcggtatctcatttttccatctgcagaaaaattttgttaataaaaggtttgagaattgcaagatttatcccagcactttgaaaagccaagaaaaattattcatttatttaattagaaaatcggtaatctcagcccaaaaaagcgccaacaaactttgcctagttttcccaaagctgcgatcagatcggctcattcggtggtcgactcgaacgacttgagcgctttgtccacggcggacgcgtaggcgtagtatttggtgctgttttggtgcgaagagaaagtccgagcagaaaattggtgctggtcgaagcctcggaattatgtgcttaaatattgaaaattaaattggaaaatagggaaaattggggaggaaaacttaggtcgcccatttcgaagaaagtcggttttgttcctcccccaatttacgcgttcggtccgtcgttcgtccgaccgaggacgacaaatgggcgacagaaagcgacggattggcgagaattgagcattcgttggttggtggcgggacggaggaggaggagggaaagttggggtcaactgaagaagaaagtgcttttcttcaaacattcatgagaaagttgtttaattcggccttgaaaataccgtcttgcatagctttacgcttcttcgttatcgcttgctgttgtgccattttttagcgtctttaattattaaaccgcaaattgttgagtaaagagaaacaaatctgcaatattttatggcaaattataaaaatttaaactcataaaataattaaaaaggagcttgaccaaaattttaatggaaatccaataataaacactcttatgatgtaaaacaatatttacttcgttctgtgtaaattttctttctatttgttaaatcaataccaatttttgcatatcgatagaaaaaaaattgcatcgattaatgctgaattatttttgtctatggtcaaactcaaaagttacataacaaaacataaattatttctttcctctccttttggcgtactatcttcatgtctctaacacataaaaaaatacaaatttcgcaaattctaacaattcttttttataagggtacaaaatcagtacaaagatgattagaacaggtagaaaagtgattagaagaggtgtaacaatgattagaaaggtaaaacagtgattaaaaagggtacactcatggttttaaaattaaataatcaaggaaatagtttattaaaagtaagaataaaaattgaatgcaattaattataaatttaaaaaataaaataaattattccttttattaattaaaatgagaatttgaaatgtacatgaattgtatatatatttaaattgaaattaattttttgacaaattctaattaaaaaacaaatgacttctttaatttaaaaagaaataaataatcaattttaaatgtcaaatttaaatttgttggttcagatgggcgcttcgcgcccgttttttaaattttttttggttcagatgggcgcttttacacccgttttttaaattttttgaactcata

SEQ ID NO: 2964 - DNA, 2479 bp, Heterodera glycines
  misc_feature (108)..(108): n is a, c, g, or t
ttttaggctagctcgaaaaatttgaaaattttcgaaattttaaaattggaaaaatcgggcttttaaagctctacaataagtctgctggccaccctgcgctcaggtcanagcctaatgagttattcaacggggactgaactggacaaatttggtactgaaaagttctagaagcacccagcccagggggttagagatagaggcctggaattttttttaatttttagccaacatttcaacttagggccctcacagcgggaattttttgatccgagttttagaaaaaaagttatgggctaacaaacgcaagaaaaagtgagaaatcggtccccgggactcagtcgtccgcgcagaatttttttctatagttttcccgaattctcctcaaaaagttgtaagacccttccaccactttcagggcgctcccggccttcggccgggagattttgttttttgaaacgaaactccttgtcaatataacatatatagtaactagcgggtgcgtgaaccgtcggctatttagctgggaaaaagcgcttcgcgctttgggagcttcgctacctagactgttacggggaaagaggtacaaccacgggtgggaaggtacaattgtgatcagaagagttacaactacggttttttcagggatttttaggccgcttcgcggcctcgaacgggcgctttgcgcccgtttttaaatttagttgggccttttcggccgcttcgcggcctcagacgtgcgcttcgcgcccgttacaacggtgttagaagaggttcaatagtgatcagaagaggtacaacagtgatcagaagattacaactttgataaaaagggtacaccagtgattagaagaggtacaagtgattagaagaggtacaaaagtgattataagaggtacaaattagaagaggtacaacagagattagaagaggtacaaatttgatgaagaggtacaaaagtgattagaagaggtacaaaagtgatagaagaggtgaaacagtgattagaagaggtgcaacaatgattagaagaggtacaacagagattagaagaggtacaaatttgatgaagaggtacaaaagtgattagaagaggtacaaaagtgatagaagaggtgaaacagtgattagaagaggtgcaacaatgattagaagaggtacaacagagattagaagaggtacaacagagattagaagaggtacaaatttgatgaagaggtgcaacaatgattagaagaggtacaacagagattagaagaggtgaaacagtgattagaagaggtgcaacaatgattagaagaggtacaacagagattggaagaggtacaaagattgtaggaatggtacaataatagtttaaaagggtaaaatcatggtttaaaaattaaataaataagtaaatggttttataaaaaaatataattaaaaattgaatgtgttaataatttttaataattataaaataaattccttctttaatttaaaaataaataagaaattaattttatattaaaacatttattcatcaaaaaataatttaatataaattaaacaaacaatattaaattaattaaaataaataaataattaattttaaaacaaaacatttatttataaaaaaaatttaattcaaataagaaaatttaatttattttaataaaataaaaaatattttcaattaattaaaatatgtaaaaacagcaaaaaatacaaagaaaataatttacaccgtccggactcgaacttcgccccccccccccaaaaaaagatgcctcagaatccccaatcacacagggattctgaggtcttaacgatgtcaaaagtaaaatctgatcacgtattcgtgatcagcggcccaaataacgactaaagacatgtttttggaagatttttgacgaaaaatttttttcactcaaaaaccatgtgcacccccctttggtcccgaatcccaaaatcggttttatttttgtaacaattcgtaagaaagtgataaaaatgtaaaataagatttatattttaaagaaaaaaattgcggatttttgtagtattttaattttcaaaaatttcttttcagaagggggttatgaatttttttctgaaaaatcgaaaattttcagaaattctggaataactttttttctttttaagatagaaatcccaaataaatcccataaaattctcctgatttttctctatttttataatataattgcatgaaaattgatccacacttcgatttgttatgaattttcgaaaattaacccaaaatcccgaaggccaaaaaattgacgaattttcaaaaatttttaaaaattccaaaaaaatctgaaacgaaaaacaaaggtcatattcgtgctcagcacctcaaaataccccagaaaaaaatttttcacccccattttggcccacaaaaaaaaaattgaaaatttctagggggcctagctcgaaaatttttgaaaattgagaaaatgaagtacaccgt

SEQ ID NO: 2965 - DNA, 7049 bp, Heterodera glycines
  misc_feature (136)..(136): n is a, c, g, or t
gggaaaacaacaaaattgggtttttcaagtgtccctttggggtactcaaccaattatggggagcagatttccgacgcagaatttaagtccacactatagggaagttattcgcgagggattcgcccccgcccccccncccgcccttcaaaattttgaaaaaaaaataaaataataggagacgcagaattttgaaaattttttataaaaactgatgacaagctaatgtgataaaacaggttaattcttttcctttcagtatccctgcaaagtttggggcgcttctgatcagtttctgaaaaaaaagttaagcctaaactttttggcctgtttaaaaaggaattaaaaatttttaaaaattttattcatctcccttttcgatagaaaaagcatcagagtgcctaaactaacatgtaaataaaatttggcgcgtttcagagcacttactgaaaaaatattatgaattaattttgcaaaaattggaacgcaaaataggaatatcgaaaaatttcaaatgcaacaaaatgggaaggaaatttaaagataattgcgtttcttctcagctgttaccctgcaaaatctgggatttttctgatcacaactcgtaaaactaggagtgattgaattttcactaaaaagttaagcctcaactttttggcatatttaaaaaggaattaaaactttttaaaatttttattcatctccctttttgatagaaaaagcatcagagagccttatttaacatgtaaataaaatttggcgcgtttcagagcacttgctgaaaaaatattatgaattaattttgcaaaaattggaacgcaaaataggaatatcgaaaaatttcaaatgcaacaaaatggaaaggaaatttaaagataattgcagtttcttctcagctgtttctttgcaaaatctgggatggaattttctttgacaaaattcctggtccaagcgatcccttctccctaccacttccaaaatatgccttttttgaaggtttttgcgttgtcaatttccaattcccgctaatccgtctgtccctctcactcattattgtggggggtgacccatttgccgtgccgctatttaactttttaaataaatttttaaagaatattagaaaaaatttagttctaaaaataaaacatatactcttaagcagggttcccgggcatactgatttccaaggacataatgggaaaatttcactaaacccaaggacgcataaaaattttatcatgcaatgaaaattattaaatttcatccaaacggtttatattttttgccggaatgaaattttaccaaggtttttttcttttggtaatattcctcatttcagcgcattgcacttttttgcggcgcgctttttcgaaaaaaattcagggaaacagggcgatgccgacaggcgtcgccgggaaaaaaaatttggaaattagagaatttgttaacagattttcaccaaaaaatgaagattttgcgattttgaaataaaggcgatggccattttttactttacacatttatttcggcattttttgaaaaattttggaatgggtggaggagaaattgttaataggcttatcaaaaattgatcatttttaacactttttgggtgttttttttgaataaaattttaaatacggtagtgccaggccgctggggaaaaaaattagcatttttgtgcaatttaataccagaatttgcaccaataaagcaataagttaccgtattgcactaattatcgcccggggggtgattattgatcaacctcctcagaaagggggggggattattagatacggggggataaatggagacagggcaataattagagcaaatagggtaataaaaacttggtataaaaggacaaaattaaaatttttgaattatttccttcaatgctcattttcaaggacttcttgattcaaggacgtccttgccattcaaggacggatggttggttacctactctagcgaaaattaaattttatttttctataaatattctttaaaataaatttgtttaaaaaattaatttaacaaatattgataattaaaagtaaaaataaagtaatcaaaggaatgatcatttgctcagctatttgaatatatgcaaatttttgataataaatttggggatcattcacaagacagatagagtggtcgccttgcttgactctttggaattggcgctaaattattattatttagccaaaatgtgtgtggccataagtctcggtgatttgcttttcctgtgtaataattccatgggacagcaaaatttttgcgtaaataatagcgcaaattttgtttaaaaaaacaaaagcgcaagaaaagaaggaaaaaagatggagatgaggaagaaatggaggagaaggaaacgggaaaattaatgaaaatggaataacaagaaaaagaaagtaaaacaagttttttttttaaattataccaccgcagcatttttgatgacaaatttagtcagaagcatcaattcttcgtcctttttgtcaattatttctgtctatcgttttcctttttctctattttgatcacttttcagtttagcatcctaatgtctgtccatcgccattctcttccaaagtttttcaaggtcgtgaaccattcaaaaagttgttcaaaaaagtttccatcagctgttttaaaaattttggaattttatagaaaaaaaatttttataaagtcttaaaagtcaaaatataaaaactaaaaaatattccttattaaacgtacgaacgaatagctgggaagcaaaggtggacatcatacaattggccatgagtagaagggagaggaggaaatttagtacaaattttatgataaatcaatgattttaaccccagttctctgagatgtgctgatttttaaaaattgattcaaaaatcgcaaaatttgcctttatttggacaaaagcttattcctatttattttagaaaattattttttcaccttattttctattttctttttatttgaatattaactctgaaaatgacatattaaaagaagttgaaaaggatctgatttttgtgtcgtttgaatgatgatatcggtcttctaattacaggaaaaactggaatttcaatcatcaaaaatcaaataaatatcagaaggcggcaaaagccgcaaatagaacagttcattataagaatgtcttccaaacatttctatgtatgtctaaatttgtttttaaaaagtaaaatttttgtttttttaagaaagtaatcctgttttttaagttgaaaaatctgaatttaaggacgtaatttttcattttcggtaggaaatacttttagttaattaaggacagaaattccataatccaaaatttgggtggagaacggggcccggacaatccgtcagtggacaccccgccagcaaatttttttttacaactagataatctatagaaattataatcgtacttatccttttttgcacccacccctttcggttttttaaaattttttactatggttattttaggcgctgaaaaaaatctgacatttattttaagctaacatccattttatatgaggcacgtgaaaccacacgttaaaagtgaaaaattcaaaaaaaatatcttttaattaaaatgattattttaccattttttataaaataacaataattattaattcactagaccagggatgggccaaattgaaaaataaaaagcgaaatgcgaaaagcgaaatttgcgaaactgaaaaatgcaaaatgaaaaaaaacccaaaatgcgaaaagcgaaacctaaaggcccatccctgccatagactatctcggggagtcaaaaaatcatgtcccacttccttaatggtaaaatattaatatactttttggtccaaaagagtgcaataattcatactaataagggaaatagtcctatccgattaaaaaaactttcatgttctgatcatttgccattaaaatttgtgaaaaattctaaaaaataatagaaagtcgcaactcgaaattatatttgattcaataaaagttggaatagttcgggataaattagttctacactgggtatttccccattagatttggtgggttctggtcatttcgttaaatattttttaaaaaattaggcttgcatgtttttataaaaaagtgccgtcctatagaagatttttttgaaaaatggcaaatacgctaataaaaatgcacaaatgccaaaaaattcaattaaatccaggactgtgcaaggacatgcagatttaaaaaagcaaaaaaagctgtttctcatgcgtttataaagactaaaaaatcaaaaagcttaaaaaatgaggaaaaaaattaaatatatgtatatactttttaaataaagaaattataaatttctggctttttgaaagtacgcgaaaaacagaatgccaaactgtgtaaatacaagcagtctttggtcactcattggcaaccgtccttttttgggccactctggccaactccttcgtgggggcactgcggctgggcgggctcattcatcccgtcatctccatgggtaaaatgtacaaattattaattttaaaaataattatagcataaaaaagtaaaataaaactttggcaaatttgagtgtattgtaccaaatacggttctcagctgcttgctgctaattaatagttttttcaggcgcccaggccgcgtgtcgtccagtgtgccagtgccaagaaccgtcactgaattgccaagtacgaatttaatagtaaaacatttgattgcttctttctgttagcattagtgtcattattaaattttgagagaaatgcgcattgtggggaagtcagtcctgatacctagcattgttcaaactcgggccaattgcaactcgtacaaaagacaattcgtacaaaaagcaactcgtagaatagtcaaccccgtacaaagtcaaaaggtacagttttattagtccaatcgactttcatgaaatccaaaggtatttatttatgtttccaatcaattgataatacttggggtttttatacaataatattgttcatcttcgaacaaatcgtatctttttgatgacattcgaaagcatataaagtctatcgaaactaaactatataaaatctcagcgtttaggcaatatccaaaaaggatgtgtttgattaaataattgttgattattttcgtttgtaacttttttttaaatgtttgcattctcttatttatcgtattaaataccttgttcagactttgtgctttcgaatgataccaaaaattagggttggttcaaacatgaacaaagttactgtattaaaaccagaggtattattatttgattggactcatattatctttggactcataaaagtcgattcgactcataaagtgcaatatgtagagcccaatgtactgtaataaattttacaaaaataagcctaagcctaggctcaagcaggctagtttaagcatatgtacgagttgtctttgtacaagttgtcatgacatcggcttcaatatcagcgccggactaagccgggtgcctaccccggcgaatggcaccgtctcggggtttcagacctaacttttaaaaacaactatttgtcccatttatgcagccgtcgccgagcccggctaacaataaaaagttttgaaccgagtttttttccaataaaagaccgtaaccgactatccagtatcggtaccgtttctagccggtccggcccctagtttgggagaaagttcgagcattcgaaatgacagattttaattctttttttgcgctgattaaccgagccatgggatttgttcgtttgtagtttaaatccgaaatcactcagcaaataaaaagtttgtattgtcagaaataaaattaattctgtaaaaatttggacaaatgatgaggaaagtgaggacgaaatagcataaatgcacaatagagtagtctgtagaattgtcaattctcattgaacaggatgaaagttcgattctccaccagcacggcactttttaatttttctatttgcgatactcttaaattttgttcattcttaattaagttagcattattattttttatttacccggcaaagccattaaaaatattttttataattatgaattgctttcgtaaggaggacaaagttcatctggacgaatgtgctgtacgggaccatccattgcttgcattcggacggctggcgactgcttgaaattggccattgaactggagtaacactagctaatagacaattgtgaggaagcgactatttttaggattataaaaatttaaatggaaaagccgaacggacaatttttgcctctttaatctgggagtaggacaaaaagacgccaccgaattcgtagttgccgaaacgtcgccggacattttggcgcagcaattttttttttgtaccccgttaaccttccttttaagtagttgcacaggccgagaattttctggaaaaatcggtactgggacttgccggaaccagaaaaggagggaccgagaccacgatttttcaatcgggaactaaatttccaagaaaaaatgcaaaaaaaaaaaattaagttaatttaattatttttgaagtgatcaaaaaaatatataaaaatcgtaactctttaatataaaagcaagaaaaaacagaaaagaaatgccagaattagaaagtttggatgtgtatctttttccaaattgccgagaatttcctcgatatcaaaaatcattttaaaaatttttcattttgtattttgtcatatttttatgtaaattttacagaatctgtccttgaacagcatcatcttgcggtagcgatcaagcttctaaggcaaggattgtgatttggttgccggggtcagcaaaaaacagcggcaaacttttcggaaaatggtaacaaatgaattgaaatttttttaattgtgtatttacatataattcttttttcatttaaagtattataaatttttttattcatttaaaatattagcggaatttaaaacgcttcagttttccatttttatcttctgttgtccttttctttctctactttctcttttattccctttgtccttattatttc

SEQ ID NO: 2966 - DNA, 1649 bp, Heterodera glycines
  misc_feature (27)..(28): n is a, c, g, or t
  misc_feature (1517)..(1517): n is a, c, g, or t
ttttttactatttatccatttaatgtnngagtaaagggggagggcccgaaggtgcccgtaagccctccacgaaaatgatcataggcgccgtcgggaattttaaaaaaatgttgagaattttaaaatattcagcataatggatcaattttcttagaataaatagaaaattctgggggctggcggtatacacagaaagagagaaagaaggtgggtgggtcaaccaaggtttttcgaaaaatccgggagtcgtaaagaggtcggcagtcaaatttgtaaatttaatataaatctgaaatttggtggttttttacgccactttttctgcgcgtttatttcaacaaacttttgaggatggaggcgtacggcaaacagggtggcggaggtgccgaccccgggaaaatttgaaaattttattgtgtatgatttgttaagaaaattcaagaaaaattattatttttttagtaaaattttcgaaaaaactttgccaacgaaagaattgattctcttttccctttcattccattcacatatatgtatatttcgcctaagcaaaaattaataaattaatgtacttgcacattcgcgggcgggcaaaaattgattttccccctctcatacttttaaataaaaagttaattaataattataattaaaattttctagatttaaaaaaatatcaatttattagcaaaatttcgccaatgataactcctgtgagtaggctttttaaaatataatttaaattattttcataatggtttttcttggtattttctcattttttaattttcaggaacaacaccaaaagcggctcgaatttataaaaaggaaaaaaatgaatagcgtcggctgttacggctttgaggtgtgttgtaaattttttgttttttattttaatttgattttgtgggttgtgatcttgtttctgttttaattgttgctttggatcagttcccctcaatgcagaggttttcttctaattttcaaaattttcctttttggatggaaattcaatataaatttattaattaaaattgcaaaaattgattatttgagtttaaaaaatttccctgccggcgcctatcggcaccgccggagctaaaaaaattcctttgatttttaaattgactcaaaaatcccgagaatattagaactgacagaatttttcgaatttataaaaaatggcccagctctgatcggcgccactgacgatgcaacagtgaaaaattcaatttacggagagaaaaacaactttttttttaatttttggaaagtgaataaaaaccaaaaattggttaataaaagactcaaaaaataaacgatttttaagcaaataagaaaaaattttgaaaaaaattctcaggtttttggtctcgggatcgaggctcggtctcgtggtcaagtctcggtcttgggtctcaagaaattttcggtctcgaacagtactacttcataggaccataaattgggattttttgtccctaaaatcccctccctatttattatttattcattanaatttaagggagaaaacgcgaccctggaagaaatcgaccagttcattgagcaaagagctgcatccgccggcccacaacgatctcggcaacgtccttgtgtgcaggaggcgacggagaccccaccaaagcctt

SEQ ID NO: 2967 - DNA, 1725 bp, Heterodera glycines
gatggaatcgttttgaatttataccttgtttttagacttagctgatcatgagctttcgaatgctaccaaatttgtacgaatttgaccgttttaaagggtcaggggctccctttttcactcaatttttcgagttttaaaccggttcaaaaaccggtttttttgcatttccgcaactggagacctacttttttgtgcagagctcgtcgagacgaatcgattggtatatcatttgttccgttttttacggggggttgactatactacacccaaacctttcttagtacaaacaaattaagtgatcttcgatcattcggtaaccctaatttttttctcatttcattgcataatttcaaaaattatctatctataaaaaatgggaagttttttgttgaaatttttcatttgatggtttttaataaggattaagcatcatctaataaattaaaaaactctgatcagcctataaggttttatttgtagaatttttcaagatttttttttcttcccaaaattgtgtttttggcgattgatcatttttgtgattatttttgcacctcaaaaaattaagctggtcgatttgggtacactttctcgatgaaacacagtagtaactgttggaccatatgttagtaaagaaatctcataatgacaagcggtcttttttgcacttatttgttagaaaggtttgtgctttttcatggcctaaaaacttatataagattttattcaaagatttcaaaaaaaaattttaaaaaattgatgatcaagtgtcaagagttttgcccaactgtttttcgatcagtctaaaaatcttgaattaaccaaatttaatttaaggattggaaatgcaacaaatgtcccaaggcttttgaaacggctatagggcttcacaatcataaaagagtacacaggtagattagcattaaatcaaatttaaataattataaatttttaattttaaacaaaaaaataatttatctcgaatagtagcgcaaaactttcaccagtccgccggccatcgactcccaccattgacttaacggggggaacacctgaaccagaaaaggtaagtcatgcgtataaaaagataaaaaaatttttaaattaaaaaaaacactcaaaatgttttctgaggaattttttcgaacacactcttttttgcggtggcttttcagaattagtgctatttgttaataaattttgtccgaaaaatgatcgattttgcaatttttaatcgaatccatcaatttttattaacaatctcataggggaatatttatctttaaatgttcaaatcagtttaaacccacttttactgtgtaatgagtgcacagtcgatttgctataatttttcgccttttttttctcctgactcaaactaatatttaaaaaatattttttttttggtttttgatttttgaaactgatcacttttttctgattagtttgttggtgagggccaaaaaaagttcgagaatatgaacaatctatctccacacaataaaagtgggttaaaagtgatttatatttactgtccgaaatgttcccttgtcagaaataaaccaattaaatggttgatcaataaaactttgcaaataagtccgaaaaataaaaattaaaaacaaagttaagattaatatattatagaataaattaaaatctttcacttttttaattgttttttttctaatttttggataccccttttttatttcaattttttaa

SEQ ID NO: 2968 - DNA, 6354 bp, Heterodera glycines
  misc_feature (4772)..(4773): n is a, c, g, or t
tccatatttttaccagccctagtcatcagtgcagcattttttgtttacaattattaataaaatattttcaccgaaaaccgatataaattctaagtttttaattttaattttatggtttttcgtcttatttttccggctgatctctaccgtaatggcaacaaccttgcaacaaaagtacagttgtgctcggtgagtattcggatgattgaccaaaatgcatagaccagcaatgggccaccaaagggagcagacgccttggacgagtaagtagccaattgttttaagagcacgcacaatcacttaagcggaataattaattttaaatttaaaataaattacaaaaaaaaaatataccaaaaaattagcatttttttttctatatacaatttttgttaaaattaatttttaaattgttatttgcaaagttgtaaaagacatatctatcattttttaggaatactaaatagtaaataaattgaaaaacttctaattcatttaaattaattaattaatttttattttgaaatttattattgttaccataaactcaaataataatttcttttaaattaatatttggaaaattaattttatttatagtttcgtataaatcaaatattctatgcttaattttaataaagaacagggaaaataatgttactgtatttcctttaaaaaaaaattaattctcaacggcaaaaaaatgaatgatcaaaataatgctaaaaatctttatgcctaggggtaaaattttgcggtaaatttcggcaatttcaactcaaatataaacctttccacggcacgcttaacatttcgcccataaatttgaaaaatgcgcggaacattgcgccaaactccagcccacaacagttgcaacagccaccgcagcagtgaaccccacgctttcgtcgccgtcggcgattgttgccatcagcaacaacagcagcagcagatggttgtgctgcagatactgctccaacctgaggaatgtctccggcggtggtatccaatgtttgcaatggaaataaatgtacagccattttttcataaattaataaacattggtaggacaactgtaattttaatacattcaattattccgataattagcgattcattttttattttgggagtttggcactctcaaaattgaatgaaaaactgtggcttttggggcttattctggcagaaaatcctgtttccagaaagttggaggctgaataagtttttgttttagtttggatgtttggctgggattggcttgatttgaaggttcattaactgcaaaacgcaccttgccaagttacatggacggtaaaaaatttaaaaaaaaaacggcaaaaaatggttggcgtaaaaaattgcgaacagctacagagagaatgctttgcactatctcttcgtttcttttccacttttcctctcatcttgcgtactttctcatcatttttaaaaaggcacttcattttatatttaaagattgtggcattttgttacgtcaacgatttttaccttttttttttaccgtacatggtttggatataaaaggagactcggccaatgggactcgaacctatgacattttataatggaagaatgccttaatgaatgatctacgcgtttcccttagtggttctccttggagtttactttatacctcgtaatattcaggaatttctttctcagttggacccttcccattgtttttcaataattttttatttaattttttgattttttgcaaatttttctttaattgttcgtccaattttttcataacagcatcattttgttgttgctgttccattttttcaccatcattttccaattgttcaacaaattgttctatgctttctctcttttcaggtgccaaatcattcccaattttttgctttgtattggcaaaatgttgctcaattaattgcgtgagtttactcatttggtcattgataatttgtttttcataatttttttgatgcatgtttaaaatttgttgtgaataagcatcaattttggacagcacttcacaaatttctttgccttcatcatccatttcctaatttatttgaaaaattattatgacactatttactagggataagcgagagtctcggttctcaattctcgactggagaaatttctcgggcttttcgcttctcggtcttgggtttatagtatcaggaacccaagaaatttttagacttttatggatgaccattgcggcgggtggggtcgccgacgaagtgggatgagaggactttaaatgttagaagatttgattttttgtttaacaaaaacggaacgaaacttttttcatccatatccaaatttagtctgacgaaaacgaaagaaaaaattaaaaaaaaaaacagaaaacgaaacaaaaattcaaaattttgaaaacagaaagggaaaagagaattttcaaacggacaaaaacaaaaaaaaacgaaaatgagactcaaaaagggacgctaattattaaaacagttttggattcatcccaaccgaatttttttttctgcttatggacctgacaccaacagaattaaaatagcggaaaaaagcccggtgccgtttctgtttatttttaaatatttttattcatttgatttttaaattaattaattttctggcaattcaattatttttattagagcaataaaaataatattaataaatctaaataacctctgcttcacaaatctcgtcatacaattggtgcacaaatttggtattgaagttttcaagagtctcaatttgtgcacattgattttgttttgatccgttggcatttacaaaaattactgaatttaaaagtaaaaaaaaacaaaacaaattttttaataaaattaaaaaacttacccaaatagaaattcaataaaataacatgtttaaaggaaggaataaaagcaaaaaatttcattctaaaattgaaaaaatgcattctccaatcaaaataaaaaataaataaaatgaaaaatttcagaggcttaaacttttttcttgttaaacattaatttttccaaataaatctgaaataaaaattcaccaattcagaataatgccatattaaaaagggccattgccctatgtttgatagatgaaatgaagtgaaaaaaaattattattttaatatttaatatgtaaaatataataaatctttataagatatacgtaagcaacaatcaatcaatttacatcaatatatgaatgattttatatattttcatgtaaaatgaaaaaaaaatatgaagattttacgaaatttttaataaagtaaaatttaattttcttttgggtaataaaataatctaactttttgaaattcaatttcttttgcaaaacagtggaactgggccggtcgtcgacccattggtgctgagatcgttatataaaaaccatcaataagggagtttatacatcaaatggaaattttcaacaaaaaacttgctataacttttgtcaaagtcaaccaaattagacatttcttgtatcattctgtttgatttcctcatttctcttttccttttcttttgttccttctcaattgtttcttctcaatttcctttttttgtactggaattttcggctgatctttctttaatctacccctcaaaattttgggcaaccaaccctgtacagctcttccaactccgcacttcgtcttttgcaccgtttcttcgctccactctgggacggaatgaactctggttgatttcctcaagcccctcaggccaagtctgttcataaattgagcagctggtgagcaggtggttggattgggaaccgaagggcgaaaccgttctcggactggcgccagcatcatcgacaaacttcgaggatcgaggacgatcctatggaaggggtgagctgtaagggattggccatcctaaaaaacaatttttattttccctcagcagtcgtaatttccactctttattatcacattttctcatctcatttattccgttcatccccgccccttttccgttcgcttcacacttttccttcccccagcgatcagttagtcagtcgtcagtcagtcgagtcgttaagcctattcgatcagtcgttcgtcatggaatatttcaatcaccattttatccggagagaataaattattctaataacatcgaggctttttggggaatttcaccaccaatcctgggcccgggattccttccccaaatcgtcctcccatttattcttcgaacggtgtgtcgactgggggacccaacacgcctccctcactagagttatctattagctaacctaaatttcaaaaaatttagtcaagtttgaaccaaggtatggccaaagtacacaaacaacagggttttcaaaaaattttgaccataacttttttgaaactcaacaaattttttttgaaattttgcaggcttgtagaaaacatttagggctattgaatgatgataagatttcttaattttgttggttctaagaatgttttggtcagaattttggatgatcaaaattattttgtttaattaaaaattttcgttaataattatttttagtttttggtttctagctttcattctaatataaaccctaagaattctctactagcctgcaaaatttcaaaaaaattttgttgagtttcaaaaatttatggcctaaaatttttgaaaacccggtttcgcttgggtacttttggtcataactttgttgaaactcgacgtaattttttgaaattttgcagacaaacagagaattgatttgggctattgaatgataccaagaatgtnnctaatttggttgactttgacataaggttatagccagttctttgttgaaaatttcaatttggtgttttttaaataacgacatagcaccgacccatttcatggtctaagtacgggacggagttttttacgctcatgtaaatgcgtcagtggaaaatgcgccataaaaatgcgtctgtaataagttattttaaataaacttatgtagcataaagtattgttgtacaaaaggttaaaattttgtacaacctcgttttaagtgtaattcaataaataaattttgaaaattatcaaaacccaaaggcgacaaacatactgtaactggattattgtcaatttgtaaccatatcaattaacattaccgtatcttatttcaaaattttgtttacggaagagtaaattgtaaaaaaaaattttttctttaaatccacaaatttattttgcacaaaaataaagcccttactggaaagaaattcacatgtttttaatatgaaaaattgccaacattcataaatccacacacagtttttgaagacgagacggtgcatatgccggaaacagaaaaaaatcatcaatattcatttatggatatattttttaaaaataatttataaaaaaatatcctattccacaaaatgaaaaaaaaaattgagaaaatgtgaaattattttcactataatcataagaataaaaattgtttttttttaaatttaattatcataatagaaaaatatttttagttattacatctatatttcgaatatgaaatttgaaaaattaattctattacataaggcattgtatttgagtaagtgaattaaaaaaaatatatatatatataaatattaaaaatatataaatatataaataaaataaatatatttttaaataaaagtaaatttaattattttttacattaattaattgtttgcttttaaataaagtgacgagaatcatcagcacaatgtgcaccggcaatgacaaagaacttttaaccagaagcccagagaaaattttcgattttgttgagcgctcaattacattaagccttgatgttgattcattgttaggcataggattaaggtaaaaaaaaatcaataaaaatttttgtttaaaataaattccaaaacaaaaaagaataattcttttattaaaataaaaaaatctttttttttatatatcttctcgaaggatcccaaattaagcaaagtttaaaaaacgacaagtgttttctactaaagcccagaacaatcaaatatcaaattttcagacctcgtaacaaaattggaattcaaaaattttacagtatttaattttttagaagtcttttgcatgagcttgcagcaaattaatgatattatatataattaaattaaatatccttatatgactaaattttataatattttctagcccaatttaaacagaaaccaattaatttattttatttaaaattaaataattttttttcatttacagacgtcatccattagaggcatttaaagaacagaaaagcaaaattgaagtgtatttgagcatgaatcggctgttcttttgggtgggtgaccaacaaaattacataaat

SEQ ID NO: 2969 - DNA, 3757 bp, Heterodera glycines
aatggctaaaatgaaaaccttagaagtcaaattccaaaatgttcaattttttaattttaaagaaagtcaatttgggaggcatatgattagaggaatttttcttgtgaaaaaatgtttgacaataataaaaaattcagttttttaaaatttttaacactatataggctcggtcttctttggcaaaatcaacgtccaaggttggctatagatatgtccagcggtacctgggagaaaaattcggaatttttaagtttttaaagaaaagtttaacattttacccacccatttattaatcaaattcccaaactcattagcatagatttgtcacaattgtttttaattgttttttagataaccgcaacaaaaattgatgaaccttttcgtgatttgttgttttacatgtatttcaaccaaaaattgttgcacattttgaacgaaaatggccaacttcaaagatatttggccaaaatttcggatcattccaacaaaaatggtgataaaatggaacaaaaaatgccaacaatgctgctcgatcggcacgattatatccataaatggcttatctgggtcacagagtatgccgaaggttggttggccaagctgatttcgttggccattcgaattggcacactgaacatggacaacgccagggaaccgtttgcctatattatttgccgtcattttgatcgtgtaaaggggaacagtgattttgatgagaattatacggtagaagacgatggtttgatgatggcagtacataaacgaaatgaaattgatgaaatggcgacaaaaagtgagcaaactcagcaacaatatttggacaaaatcgttgcacaaagtttggcgttgcgaaacattttgatgattttagcggaagaagcgaacaatgactttaccttcgaaagttctctcaaaggtgaaaaaaggagcactttttcgttatgccatcccctccccccccccaataaaaacgtcatgatcccgaaaagggaaagctcaaagaaagccatttttggttttttcgaatcgacaaaatcatatataagacaagcgcctaaaactaagcccagaaaagtgctttccctcgtcggaataatgacaattttactgggggggggggcataagggaaaagtaccaaaaaagtaattttggaattctgcctgaggcaaattgaaggcattattattttttcttttcttaattgtatccaacaaacttgatatcattcgaatccgtgggcagctttattattgagctaccgaggcaaaactgcgctttcttttatttgacagttccaataggggccgtcgtggaaacttgaaaatttgagtggaatatttattcacccaagaattggcatttttcgacaaaaccctaaaaaatctaatttttcaaaaattactgataattaaggggtaataaataaatggtataaaattttaattatttattttttcataattataaatttaaaagaacataaaataataatttaggaacaagtagttcctcaacttcttatttaactacaattatctccaaaacattgcatccgttattgatcaaaaatgtgcatagcaaccatcaacaattggtccaccatttggccacgctcattttgttttttcatcgaatttttgaaatggtcgctgtgccacaaatttggttgctcaacaaattcagcgtgggcaccgagttgaagcagttgaagcgcatttatgaaacaacgattaaggccttgcataacattgaaaatgagtgggacaaagaacagaaagcaattagtgatgatgatcatgaagatgacaccgccatttcggctaataaccgttaattagttgattggcgagaaacaaatggacgaagccgacctcaagcattgccctataaaatgcattggattttttgattgataagaatctgataattaattaggttgtcataatttgtattattttttgcacgaataaaagttctcaactgaaactagcactgtgattttaaggcagatttcaaaaatatgttaatttattttgtgagtataactttaaaatatttgcttttctctccttgatcgataattaatcattagggagaagcaggcttaaatggtacaaaattccaaaatttagatttaatatggatgaaaaaaaccgaactatggaagaaaaatatggacgaaacgctgagacaaggacaaaaagatgggaaatttctaaagatataattttttaaaatttttataaaaaccgagaagacagtttgatactttaagtttgaggcgtaaaattgttaatcgaaaaaaaaaatctttcatttggttcaaactttgttgccaaatggcccaaaattaccaaattcctcaggcggcatatgggcaacactggaggtatctgtcatttaagccataatataattgattcttttctttttttttttgcaaaaaatgtatttccatgaaaaatgtttcacgattttttttcgttttacgcgactcggtctcacttatacattgtccccaatagattttctttcctctcctcctatgacaaatgttttacacctatttgacgccaaataaattttctaaaatattattatttaaatgtttttgagtattttacgttgttcagccaaattaattaaacaatcgtaaaaatatttattaatgaatgatattaacatttttgcacatgagggcctaaccgtggttgtccgattgataacaattgcaaaactcaattattttacttttcctatgatttttatcaattttaattataaatatgttaaaatttattaaaatgatacttaaatacacattctcctaaaagttatgtagtatttcaaataaagaataattaaaatttacttaatattaaataaaatcattggctattactgtgaattttttaaattttgtggtttcaatggcgcctataaattaaaacaaagatagttattaatgtgataaaaacaatgaaactgatagtgataaaaacaagataaaaataaaaataatgataattgatagtgataaaaacaatgaaattgatattgacaaaaacaagataaaaaaaataatgataattaatagtgataaaaacaaagtgatagtgataaaacaatgataatcattaatgtgataaaaataatgaaattgatagtgataaaaacaagataaaagcaatggtaattgatattgataaaaacaaaacttggcattagattgttataataatttacagattacacaaaaatatcatcgaggctcagataagatatggacaaaaaattaggaattaaggttttgtggaatttagttatcatatctttttatatatttaagtaaaaaatttaataaaattatattatgatagaaaacacctagagctattgaatgataccaagaattattaatttggttgaaaatggaccaagttatgaatttatatgtcttacattttttgttttcgtaccactatggcggcttttaggaaacgccctggcggatttaggaaacacccaatgtggcggtttttaggaaacgacctagcacctttaggaaacgcccatggtggcggtttttaggaaacgacccagcacggacggaactgacccctacccgcggttgatcgatcgacgaaaagtgcaaaattagctaaatttttgagtaaatcaactcataacttttccctgacgcaaccaaattgcacaatcttggtatcatacaatagcccttcaaatgcattatta

SEQ ID NO: 2970 - DNA, 1894 bp, Heterodera glycines
ttttaatattctatcgattttttattattcaaaatactcataaaagtcataaaaaattaaacatttttttaaaaaattgtttaacaaaattgtcattccatcagactctcattttcttgcgattattacatatcatcaacagtttttgtctaattcatatacgtcgatttcttaaaattatgttttgtaaactttgaaaactcaatttttacaacagctaaatcgggtgccactgcacttgactcgaattcccgacattcttagccaattatatactccaacaagccacatatacatcagtttgccagagatatatgtctcagaatcacagaagagtccgttcccgaatctccatttttgggcctaacccaatctcgataggggtcattaaatgatatgcaccgaaaatcggctattagattaattaattggtcaccaaattaaacactcccgaaacagaatttatttattactcagagtcattcatttaccggtgcaaaataaaattgactcatttatatttattaccaatcaactttctaacattgcatatacggcattttaataattttctttggcattattatttaaaagaatatcatttcttggtccaattttcagagaaaaaaatattgtaaaataaattcacatgcctttttgatgacttccgttcacttacaaaattcacttgtaatttgtttttcatattattcatccgtcaattgattttcgagagtgcattttctatgaggaaaaaataaaataataaatattgggaaatgaaaatcattggcacaagaatatttaattatataaattttattatatcaaaaaacaattaaaaagttggagcttttttgaaaattcgattttatatgaaatagttcaaagaatttatggccagaaaaattcaaaatttatttcgagaatttttgccaatatcttttttatattttttaaaaatttccagggcggcgcctaccacgacaccgttgtgggctcaatgtttctaaatagacttaaaaaacatctaaaattattattttgtattaaaaacagggacctcgaaagtccaaaactctgttttttaatgggggcataaggagccaaatttttaaaatttcaaaaaatggcgcaaaatgtagccaagactctcgtatattcgcgatggcgctttgggtcagagtacagtacaactcaccgacgccaacatgccgatggccgactcgctgacgctaagctcgccgataaattaagcaagaaaaaatgatgaaaaattaaaatttcttgataatttaactttacttggtattcgctcaacggcactgatcttatctttgcgtatagtgaaagaagatatccattaattgttcgccgcgttaacttttgaatttgtagcgaattatacttagttgttactaaattttgtcgcaatttttttttttcaaaggtgtgtaaaaaaaacctaaaaacgctgatggattctactagtttttttaaaatttgttcgttcgtttgttttttcccattcaaagtaaattgcttagttagtgatcagaagcaaaatgcgcgcatgtgagcgaaatttttcgattatgaccatgtttctggctttattttttatttataatccttttacaggaaaatttggttttatttataaaatttgattttttccacatttttcttgaataattatcgcgagaaactatcggtgcatcgatgtccacagctttcggcacatctgaactctcttctttttttttttaaaacgcggcgaaggaatattgactttgaactaaagtggcactgggaccgggaattttggggcaaacccgggacccggacatggtaaaaaaaattttaaaaaaatcaaattttatttttttttttt

SEQ ID NO: 2971 - DNA, 3070 bp, Heterodera glycines
  misc_feature (13)..(13): n is a, c, g, or t
  misc_feature (3048)..(3048): n is a, c, g, or t
aaaaaaaaagttnatataaatattttaataattttcagttattactttttttaattaaaataataattttttgagtttctgtttttaaaagtctcattggcaaaatcttttttagctcatttttttgactatgaacaatttattattaataataaaatatataaagttggattatcttaaattaatctctaattgaaaaaaatattattgattattttgtaaattaaaagttcactttttacaaaaaacttcgcttataataattatgggtggaacaatatggatatgcctaacaagaaaattaatttcctcaaatattaaaacatcactaaaaaaaaggaaaaaaaaggtaaaaaacaaaataaaagaaaatagaaaattaataaaatccttaaaccaaaaaaatgaaaaaaggttttttttagaaaattagaatgaagaaaaagtttggatctgctaccctttttttaatatttttttttgttttttttttggttttttttaattccttttttatttttcaatattatttctcaaataaaataaaaataataataataatttagtttattaatattacatattgcccatactcatgatttacatataatataggcaaattatttaattcgttttttttctaagataaaattcattaacaaaaaaaatggcgatcaattattatattttctttacgatttgtctattttttacgaaatttgcaatgactattaatggtaataaattttgttgaatatttttttacaaaattatttttcaaaattaggagggccaagttcgacaaataaccaaaagccaagaacgatcaatcgaattgcacatccaagaaacattgaaggacaattagctgctggtgatcatattccgcacacaaatcagccaacaaacaatgccacgaatggccaccaaaatgatcaaaatgccaattcagaaaattcagatttgttggacaacagtgcaacagaacagcattcaagtgttcatgaggggaataacggtataagaaagtttactgttttatttttttaatataattaagcaaataaattattgtatttttaaaattattttctgagtttggaatagttggggatttccgatatcctgatctttaaaaaaaaacccaagcctggatttttttttggacacagctccaggtatcaggggctatttttgacaacctggatttcctggaattttgtcagggaaaatgctggtccaggtccaggcttttttgggaattccaataacgtgatctttcaaaaaaaacaacacaggaaggagcctggtaaatgttagcctgatcctgatacactaatccagggacatcataattttgcggccatgacatttttcatcagatgccagatgcaaaaatgatggttaaccctaatttataactaattatcatcattatttttaatttttcctccattttataacgaaatttcgtcttttttttgtagctggtcgtccaaccgaaaatttgatcatcgaaaatgaacatcgagctcatttctttgatcaaggcaaaagcattgataccacgtcgccgtcgggatattcaaatgcaaatgcaacaaaattggacgaaacaaatgatcatcagcaattggtgagcgaaggtgggaacgacgacgacgacgacgagcgcaaaatgaatgacatggaagaaggttttttgtaaatttaaaaaataaataaataaaacaattttaattagataaaaatataattatggttatttaatattttatgaatcaaaaatcgccaatgttttcgaaaattttttagtgcttaaaaatagggttaagccccgaccctcggggagaaaaatgtcggggaacggggaggaaattccccgaaagaatttgtcggggatggctggagaaattccccgaaacatgtcggggcttaaccctacttaaaaactcccaaagtataacgaaaatattagtccattactaattaaaaatatttctagagttaaaagaaaaattcactgtatttaaaatagtgatttaaagctaaaattcatttgttaattttttaatttcaattttttaatgtatgttaaaaaaattttgttttctgattttaatttcgttttcgttaaaaataaatatttcgtttcgttttgtgatcagattgatcggagatacatacgaacatagtctctcgattagaaaatacgaacaaaatgaataagaaataaaataaaattatttttggagataaattattatttattaaaattcatttattaagaagacagcaataatgatccggtggtctcagaatgttgtccaatttgcttgcagccattcacagaagcatcaaacaaaaaagtgcttaacaaatgtggtgtaagaaaatttgtttatttttttaaaattttatttaatcttttttagcatcaatttgatgtgaattgcatcgatcaatggcaaacaatttgaattaattaaatggattaattaatattaaaataaaaaaaaacaaagcattagtaagattaaaataaattatgtttaaggcttcacagcaaaaattcatgtcctgtttgccgttgtgaggttgatggagatgaacgccctaatggacatgaacagagtaaaaaaacaaatttttattttagcattttaattttaattaattttaaaaattaacaaaatttctcttagctgagcctccacgagtaattacgaccaacacaatgaacacagtgttcagagatttctccggtaacttctgatcaacgaagaattattcagcgtacacgagatttgaattagtcagaatagcaaaagtcataagtagggctggtaattatatgcacatgcatatttttttcctgaactgcgggaggcctgaaacgcatgaaaaacatgtttttagcttgattagaagcttctagagtggatttccatatgcatatttgcatattttgcgatttatgtgcatattttggcatttcgtgcatggagttttttcataaatcctctattaaaacggcccctctactanagcgggcatttggggtctaatg

SEQ ID NO: 2972 - DNA, 1802 bp, Heterodera glycines
  misc_feature (118)..(118): n is a, c, g, or t
gtcataagcatacaaaatacgatttattgtatatgttagcaatttttctgataaagtgtttcttatctgtacaaaaattttttaaaaattaatagccgaaaaattgtacataaaaatntattaattgtataaataaatttattataaaagaaagttttatattgtacatacaattttttgttataattttatttttatgcatcattttgtgatatgttaagggttgtatttgtcaaaaaaaagattttttctcattggaataattcattttattttaaattaaattaaacaaccgagtcaataaatactgaattgtataaagcattgtttttcataaattaaatttttcgtctttttttttaaattaatagttttaaaattattcaacaatttttaagaagtattatccattttcgttcatacaatattttgtgtttttgcttacgtttcgagaccgagactgaaaaatatgaaatcgagcccaaaaaaaaaacccgagacttttctcgagtgagaccgagaggcacgagcatcacaactaagttatatattcataaaaaaatgataatcaaaatttcttgcatattttcaaaaaatgaacatttttttgtgtaaatcttatgcctaattatctttctgttcattatttttcactttttaaataaatttgttaaacataaattaattaacaataataaaaaaatttcatatgtttctttctcttatgcctaattatcttttctgttcattaattttcacttaatatagtttatacaataattatttaaatacatttattaaaacataaattaattagcactaataaaaaaaattacaaatttttatttccgtatttttttagtttccgtttaaacgcgtgacataaagcaggctaatattttaatgtgacaaaggtcaattaaaaataaaattcacttccgatatcatttcacgatatgatcaaatgattgttgttattaatttctacaatatataaataaatctcggaaatgaatgaatcacctttataaattcataaaaattctgcaatttatatttatattagagttaaagtcattagaatgacagtatttccatttttgtgtatttcttaacataatttatttaataaatttgtttttttaaggaaatattccacaaatctttcaaatgtttttaaaatttgtgttttttcctttcttctcaatttcattggcaattgctcaacaaattctgccgatgacaaatgatgaaattgaaatgatcaaaaatataatgggctcaattgaacagaatttgattatggtggaagcgaattgttgcgcaattgatcatgaaaattttgatcaattcaaaaaggcggtcccgaaaatgttcgagaaaatcaaccaaaaaataatgattgaaaacgaaacgccaaaatttgcggattttcaagaatttttcgcggaaatttatgcatttttggacaaagtgcacatcgagatggaaatttttgtcaaaaatttgtccccatattgtgaacaaaatgagcaaaaagcgttgacacgctttgaaatggccatgcaaatggaaaaggaatttttgatggacaatttggtaataattgaagagccaaatgcgaaaatcaaacggtaaattgaagaattaattaaatggaaaattaataatttaagattttttgaaaaatttgactcctcattgtttgcaaaattaaccttaacaattgttgatatgctaacaatggattcattgctaaaggatgagagaaaccggcactttagtaaattgtttggtaactc

SEQ ID NO: 2973 - DNA, 1981 bp, Heterodera glycines
gttttagatcaatttttcaaaaaaataaaataaacccaccccagatcccatacttttttgtatagatttggttcttgactttcttcatcgctttttttatagtttcccttcaaattattatgacaaatatttttatccctgagggataaatgatcattgttcgcctaattagttatcttaattacagaaatgctgtctcagttgcggttgtgttgtgatgtcaccgtggatgctttttgtggcaatcattggcactccaattggcattgtttgcgaaggtgccaatgctgtgcgacgctgcgctaacccaacgccaaaagagatgccgtcaaaaattgcatcgaaaactagcggcacatcaaaaacaacatcaaaaacggcgtcaaaaacaaactcaaaaaatggagagaaaaagaaaaataattaagccaattaaatttttatgaaaaaatatttaggtttttgtaggtaaaagatgaatgaattcattagcaaaattttgtaaaaattttataattaaaatatatggcataaaaaattttcctaaattaataatatatggcataaaaaattttcctaaaaattctaaacgattaattcttttaattttataatttatatgtaaaaaaaattttcctaaattttatggtataaaaaattttcctaaaaagtctaaacgattacttcttttaattttataattaatatatggtataaaaaattttcctaaaaaagttctaaaacactattgtttagccgtttcaattctcgaccagacagcctgatattaataattatattcatttttgattagataatttacaatttcaaaccgttgcatgattcccaaaaaattgcgacaattattaaataattctaattgcactttcagtctcataaaattttcaaaactaatttgctatatattattgcaatttagccgtttcaattctttaccaggcagcctgatattaataattaccctcatttttgattaaattattcgctgccaaacaaatttcacctaccagtgttaattaaaggtatatgaaaattattatactttttactctttcatccttaaaaatatatattttaaagtaagttcacaaaattaaatttacggtatcaagtacagtacggtaattaatacgatttgctatcattcaatagtcctaaacattagtagtgtaagaccacgattccctgtacggttcagtaccggacatttcagtcccagattttctgacacgtttcagtaccagagtcctggcactgaaacggcctttctggtactcaaacggccatttgtccccatggttgacctattgtccctttgtcgaccatttgtccgttttggatcatttatcccaggttgaccttttgtcccttttcgaccatttgtccttaaatttaatctgctaactccgcgcggaactgaacccaggttgtgccgaaaaaagcccaacacactatccattatgccactgatatgtatttgtgctgagcattttatttctgattaaataattcatttcaaaatccaatcacatggtgtcgggatcgaactttttaccccctctccgaaagaaccaaacacactaaccattaggccacagatagaccaaattactttgtgataattgatgtataaacaccattttaaaaatccgttcaccatttcttagaagagctaaaaataatttaataataacaaaattattaaaaatagatataattaaagaaaataatacaatcaaatctgtcggaaagtatataaataaagaaaaaagattcaatcaaatgaaaaaaggaatgtttatcgcaccattcactctaattttgtcgggagccactggcagtggcaaaactcaatggttgatgaagttgctcagaaattacacagagctaatcgatccaccacctgccaaagtactgtactgctattgtgagatgaacgaatcggttattgagctgatga

SEQ ID NO: 2974 - DNA, 5662 bp, Heterodera glycines
  misc_feature (923)..(923): n is a, c, g, or t
aaaaaaaggcctaaatatgtgttaaaaaatgcaaaaatatgtgctaaaaattggaaaaaccaagtgtatttacgcaaaaaaaaaaaacatatttaatatcagtctttatcaattttgcccgatcgccagtcaaaattttggcgatatcaatcaatttgtaaagtcccggattaatttttccatcagttgaataagttccttccgggaactttgaaatccagtgacgatttaacacagcgtttgatttggctgctttaggcatttaaatatataaagaaattttctaaatgcttaagaaacgtaaagtgtcaatttttagggtgcattttcagtttttcttgtatttttcttacgatttttctcaaaaatgccaaaatatgtgctaaaaaatccaaaatagcccaaatatgtgcgataaacgccaaaacatgtgtttttatgtttttataagtcgctataaatcaaaaattgttcggagaaaatgctatttttgggcttctctcgccataactaagccgcaaaaaaatatgttaaaacataaaaatcccagccctaataattacctagtaaaaaaatgaaatggtaaattattttttgaaaaaggttgtcacttacggaattttccatttgccgttgaaatgtttgtccaccagcgcatcgaacgggacgaaaggaatgccaatttgaggccgagttgggaacggccaaaaagtgaaaaatgtccatcaaaacattattgtacacccagctgaaattatgaaaaaatgtcgtgaatgtttatgttcgatgttcattttttggaaaaaaaattgtcactactgcatttggctcacaacttttcccaaaacgactcaattactttatggaagcttacaatgaagcgaccagtcagccgttcagctacttggtcataaacatgcacncaaatgcgccagaaattgaacgattgacaagcaaaatttttcccggagagaatcgtgaagtgtatttgccgatcgaatagtcgtgctgtgcacacctggacaaaaaatactatttaaggagcgaaagtacgcgcaggatcgcaaaatgtacgattttagtccatacattcgtgagaactcggagtttttcacgaaattagctgccacaaaatcggacaaaaagaaaaacgatttgctcaagggtgcttcagcagagcaaattctgggattagtggaaatctgcgcaaatatattaaaatttaatttccgtctaaacagacgacagagacggcgactggctttgtacgctgactactatcgagcaattgcacgttcacgcagtgagcgtacagcacgacatagactacaacagggcagcggaattgctttaggcgctattttggcgcctattctcagcgttctggccgaacagctgctacaaaaggttgttgcgaaatgaagcacactaaaaagatgatgttggttccagagagcgaatatttagcgttaataaatctgttgaaaggaggtgtaggcgacggagcagactcccttcaaaatgaaaaagcgttgctcgacgcacggattcaaaggaaccttaatgatcacaagatggatgctgatgttaaaatgaagcgacactcatggttgtacaaacagaggcatcagattaaagatatgatcgataataaaccacaaaaagtcattgtggaaaacgcgtctggttcaacgccgcctaatattgcaccgtatatgggcatacagaaggcggcaacaccgaataagcatctgctagatgaagttgaagatggcagaaaaacaagtcctcttaaaaaacggcggcgatcaatgaaaacacataaccgtgtcgtcgccacaaacacttccaacggagcgagctattgtgaagaaactgatgcttatacgtctgcgccagagaccgatttgctgctaagcaaaaaaagagagcaaaaatttctgaagcttaaaacagacccggtgcattacgataaattgcagagcataatagaacgaaaccccgccaaatacggagtcgataaagcgtcaggggaaattctaacaaacttcaaaaagccggttgttaagtcaaattacattgattctttgatgtatttgacagggcagagggcagacgcgcctaaaggccacagattttttgtccaaaaaattggcaatgatccagaaattatgacattttttcatgcccaacagggagagggtggtaataagcggcgaaagcgcaaaaggatagtccttgttaaggccaatgctataaaaacaattggactcaaccgcattgggcaaactaaattttttaaaccgctcctatgggcaaagctgtagaacaaaaattattagaacaggtctattatgatcttaggtcgccggcaagctacgccggaattcaaaaagtgttggcggaagcgcagagacgaaatcccagcatcacccttcgtgatgttcatcaatttctgcataaacagcgtacctacacgttgtttaaaccgcgaaaaaaccgcttccgcaggctaaaaactgtgcctagtggactacacacggactggcaatgcgacttgtgcatcatggatgcgctaaaagagcataatgacggatttcgttacatcctagtgtgtattgatgtgttgagccgtaaaatatttactgcagaggctgagtctaaaaaaagtgagcacatgattgcggcatttgagaagattttcaaaaaggccggtgtgctgcccaacaagctttacagcgatgcagggcttgagtttcaggcaaagaaaatgactgactattggaaacaaaaggatatcatcaaacacgtgatgtacagtccacatttgcacgcaggagtcgttgaacgcgcaaaccgtacattgaaggagcggctttacaaatattttagcgaaaagaacacaaagcggtggatcgatgtgttggacagcattgtgcgtaacctgaacagctccgcgaatcgaacaaccggactaaagccagtggacgtcaacttcaaaaatgccgatgctctacggaatcgactatataagcaaggtgaattgagctcaaaaacaccaaattttaaagcgggagacatagtacgaataagcaaagaaaagggtgacttttccaaaggttattttccgaattttacggacgaactgtttaagatttctaaagtgaatccgacagatccaccttcctacaggatccgtgaccaagacggagaagacattaaagggattttttacgagcaagaactggtaaaaactgttgcagaaacaacgcatagagcagaagtgttgaagactcggcgtagaaagggcgtgaaagaacactttgtgaggtggattggctactcagacaaacacaatcgttggattcgagacgaggatcttgtcaagaattagaacaatggatgaattttaccttgtacttccttccaacacaccaggcacagataatacgacatcaaattttacggttaggcttccacacacgttggagttggactcaaattggactgtcgctctagcatctataatctacccatattcatttccttcagtaggaattgatgaagatgacatcattagcattaaacttgttaatccaagctacagatttttggatgacaaaaaatttttgcacattgaactaaagattccaagcatgcaattttcaagtgtggaacatttgcggctgactctaaataacctaattactgaagcgtatcagcaacaaatttcttcgtaccttgacgacgatgccaaaaggacgaaacgacaagaaaatgtcactgatctttttttccatgaaaatccggtggattattgggaaaagattggcgaactccgtgcaaaatatgaacagctagaaaaggaactgacagaagaggagagtgaacttagcgccaacaccacggatgccgagaggagaaaagtgttagaaagcgagcttccacttaaacggcttcgtacacggaggaaaaaggaggaattggaagagctggaacgtgctgctgaacgacgtgatcaagaaagtcctgaagctgagcaaaaaaagattggcgaattcttccaccaccatcccgaagattataatagaaagctgaacgaggcaagactgatattcacacaccatctctcaggattacaagcggtgatgcgcaagtacatcgatgaaaaagacgcaaacaaaattcggcagcttgagtcggaggttgaaaagttgcgtctgaagatcaaacgcctacagcgtaatttaaccatcttcgaaaatgctacgctccagcgtgaccaccaaaaatctttgtcgcaatatgaggagctcagccaccagcagaacagtgcgtatgtcaaagaattttttcaaaaacacccaacaaattactggcaaataattcacaacaattatagaggtcttacagaacattttcagaagattgaagaactgcgagcaaaggcggtaggattaaaggataatgcctctttccagcaacaaattgaacgcgcaaaacaactgattgaatacagaagaaagaggtttgctgcgctagaattcgaggcaaaaaagcttgatgaatcgtcaatacggatggtggtgatcatgatcaagcagatgagggtccccaagcaacaacaactccgggagaagcattaagagataaactgctgcaaaaaccaaagcaatctgatcatgatgctgatgataaaccagatgagggtacacaaacgacaacaaaaacgcatggggatgcattaaaggaagagatattgcaaaaacaaaagcatgctgataatgatgacaataaaacagaggatgttccacaaatacaaacaacaacatcaacaaaaacaacaaaaataacaaaaacgcatggggaggcactaagagaaaaagtgttgcaaaagcatactgatgtctctaaaccaactgcgtccgatgcagagcatgaaactagtgatgtcggtggtggtggtgagaaaatgacgcatggtcaaacgctaattgcccgacttaaacagagcgaggagcagaaaaaagaatgggtagcagtgccccaagatgatgatgatgatgacaggccagcgctaaaacatggagatatgctgtggaaactgttacggtcaacgacaccgcataaccagaagcaaacggcgggcgatgtcatccaccgccaatttgcagatgctgaacatactcgtggacaggtaatgatggaactgttgaaaaacatcttagaagaaaaatctgacgctgctgatgcgcaccgtcaacaacagcaaaattatcctcgtcagaaatctgcacaagttcttcggacaaaaagcagaggtgaagcgttgaaggaactgatcaaaaaaacgcaaaatgagcagctgccacaatcttctgctaaaacgcgaggagaaattttaaagttgatgttggaaaatatgaagttttcccgggaggaggaagtaagctttgaaaaacttgtcgctaagcagaaaaccgagcaaaccgctgccgaatttgtgttcaacgatcttgcacaacggttcgtcatgaaaaccggtgcgggcgtcctgcatgtggatgtaagtaagcatcttgcatatgtgcttggctttgacaacattcgcctatttcatggagaacaggcgcgctatatgccggatctgtctggtggtgtt

SEQ ID NO: 2975 - DNA, 4256 bp, Heterodera glycines
ttcaaatttctttgaaatttccgggctctactaagggctcttgtgaaagcgccgggggcgctttcaacactgagacagcaaggaacacgaagcgcctaacttctatataattatctatataaccttcaaacaatttttacacaactttcaacattcttacaacttttcgcagaaattaaaaaaaaaattttttttgataatttgtgaaaggctaaattttacataattttctgcgcttaattactcactcggccactttgcactaatttatgcttagttgattaatccaaactttttacagttctattttaaaaaaaaattacaaattttctcgtaacaaaaaactcattagctgacggaaaacgagcaaaatcagtgtgaaatcatatttatacatcgagaaattttagaacgatgctaattcgttgggaagtttgtaaaaatatttatgattttttagattcaaggaagaatggtataaaaattaaaaagaaataaattcctagaaaaatttacggatttttttgcaatttaataacttttaggttttcagatttttaacaattaaaatccgcgaattaaaatcaacctattccaaaatcacagacttcaaattaatgaaaatttctttttccatcggtgcaaagttacagttacacgtttaattcccaattggtttgcaattattttgtcactaatttttggatttctttcattggttttgatatattttttcattatatttaatttgtccacatttgaatatttattttttgcttaaataattattaaaaattattatcaaaatttttcttacatttaagatattttggcagcaattcctttttccatttaataaatgttacttgagaaatgcccaattcattcacaaatatcgacattaatcctgtagaattgagtcaaaggtgtgacatttggtgattttttggtcaaaatcagttaattaattgataaaattttcaaaaaaaaaaaatttcagacggcgcctatctgcatagacggacccctattctttttcattgtttggattttatttaaatttaattcttttttccatttatatattttttcgcgatttgtgcctaataattttgcaattttcatctcaattttgttttaattttttctttgtaattttcctttttctctcaacttttctttaattgcttcaaattttctaattgtttctctttttttgttgatcatttggttccgttcctttttctccacccatttgctcaactgctgagctttcattatggtcattttgttccatttttatcatttgttcttctctgtcatttttgtcccattcgttaccaaatatttcgtcaaaatttgattggattttgccggtttcaattttatatgcaaagaaaaataaaataataataataataataataaacattaaattgcacaaattcatttttacaatttttaacgagatttttcttcgaatttttcaatttatcttcttcttttttcccaatttaatcaatgaaaaatcaaaaatgttctgatttttttatctactgatttttgaaggaacctattataaatagagaaaatgttaatgaataaaataaaatgataaaataaattgaaaaataggcaaatatttaaaattaaaattaattagggaaaataattttgcatataaaataaattaagcatataattaaataaaatatatgaaataaaattggcaaatttggagaaagtggatttaatcaaccattacaacggatgccagaaattttctcaagccatttagcgtcgattcgagagtaaatggcgtaggaggcttctgttttaaaaaaatatatttttttattatttaaaaagggatgtatttttagttgtttttgcatatttggctttgagtattttttgccaaaattggatttttaaaaaatttcgtagttttcagttaaaataattaaagaaagaaatttctcgcattttttcttatctttaatttaaaaaagtgattaaaatattgctaaaaaatttccggccattatttcattcaccaggagctgacgatatacattctacataagaagaaacggcaatttggacatagtctgtcccattgctggccaatactgcgctgccactatcgccctaacaaaaatgagcaatttcaattcaattaaaaaacaaaaatggatgagttaaacttttatttatttttcccatttaaatcattaaaattaattattatttaaaggaaattatttgaacaattactgattgagatgcgatcccacgaaagcaaattcggtcacctcgatacaatttacggcattcagacaattggacagcccgaccaatcaaataaggagcagagatagctttttctttcgcaacacattctgtttttataagaattattaatttttatataaaatttataataattttagacttattccaaataataatgcggcgaaataaattaaccaaaaaggtgagttaattttttaaagtgcgtcaaattaagcgaatttctcaacaacaaaaaatattaaattatcaaaaactttgcattgcattttgtgaaaatttcagctaaaaaaaacaatcatcattaagttcatttcgtatgctatgacgttagtcaaaaaaaccagcaaattaaagtattttttgaaataacttttctcaaaagaaactaaatttttaattattgaaattaggattgctccccgtccccgagctccccggtccccgaccccgatccccgacatttctgggccaattccccgctacgacccccgacatgtcgctccccgaggtccccagcccccgactttttgcccccccccccgactccccgacactaattcggggaatcagggaccccgagcattgttaaaatttaaaaagttaattcaacaaagaagaggggaaaggttgaaaatttatgaaattttgaacaattttcttaatattaattattaaaaattccgaaaaacttttcagcgccgcctatcggcaccgccggttcaaaaaatgtcccaaaattgcaaaaattggtatttttaggaaaaatctgttaacaaatttcaaattttcaaaaaaaattttcctcgcggctcctaacaccaccgccctcatcacccctttgttccccaaaagtttttctgaaaaagagcgccgcaaaaaatggtggtcaaattcgatgttgagacgggttcgcaaaaatttcagtttaaccccactcctttctacatatttttaaaccagggcttccatcgaaatttttcaaaatataaacaccaagtccaaaataagattttagtgtcaaaaatatgaacatttagcaacatttttccaatcagttatttttctaatttattcgatcaaattttatatttttagtctcctattatcaattttgataattttggggaggaaaaagcaaaattgtaaatttcagtaattcgggatcaaaagatcaaaaaaattttgcggtagaccttaaaatttcttgaaaaattgtgacattatgccataaaatttcaaaactataagtatatttaagaaatcagaataattttagtcgctaccccccccccccccccaaaatcagaatattcttataaataagaacaaatggaaaccccatgtttaaaggccaacttggactcactcatactggcgctaacgaaatcagatgattaaagtgaaaaaaggaagatttacgagcagttaaaaagaaaaaatggtttttttgggttaaaaaaaatttggccattccccgatcggggtccccgatccccgacaattgagctcctccccgccccgacccccgactttggcattttaattcgccaatacattaaagttcaaagaaaaaattttaatcctctattctcaagctcgagattaccatgtacctaaatttagtcccgttacgagatttgaaaatatataaaccgggcagaaaaaaattaaagaaagaaagtagggttacatgggtccgggtatttgggcaaaaaccgggtccgggtaccagaaaatccgggtccaagtttttcaacccggtccaggtatcgagtttaaccaggttctgaaaaaatctttcaaattaattttttttcatgaaaaaaagcttatatgttaaaaatattataaaatatattcatgaaaaatatttactttatgaataattgctgcccgattattcaaaacttttggggaacgaggggaggggggaggggggg

SEQ ID NO: 2976 - DNA, 5462 bp, Heterodera glycines
  misc_feature (8)..(8): n is a, c, g, or t
  misc_feature (37)..(37): n is a, c, g, or t
ttttttanctagtaatctttccccatccggccagtgnagcagtattgtaaagaattgttcaattggaccacagtggatgcacatcttgggcagtttggccatgagttcggttgaatttagctaaattaacaatatgccaaaggatatttatcaagccaagttcgtcccattccaagcacatattttttttttgcttatttttctttttgtatatatttttttgttttattttttgaaaaaacacattcaaaaccccaattttttttctccacgctgcctatcggcactgccgtgctgaaaatttccttgcattaaggggtgataaagttcgaatggcaaaaccctgtattaaatttattattgtttttgattaatgcctttatcaatgccaaatcgttccatcccgttgtgttcaaattttctttcttgacaaagcctggatggatgaacacatttgatgggtttttgtgcaaatgcaactgaattccattgtacggctttccagtcctaatgcgttcagaactattgaacccttaaaaacaatcaactcatactgtatttcatggaattggatactgtattttattcagaaaaccccgacatttgcttctatgccaaaaatctattcaagtttaagtttttttaagccctgatagcctaaacagaattaaattaagagaacacagtcttttagattattaggagtattattgctgtaattagcactttttgtcaatatttcttccatattttggaatttcttagtccatttaaatccatggccctctgcttataataattgtttcgacttaccacggatttgaaaaataaaaattaaagcctcctcgaattaaattaaaatttgaagaaaacttttttttttaaatttacctaaaataattttggctccatctttaacttcattaacacaatgtgcagcaagcaaaacgaattccgatgaaatgagtgagccagagcaatggccgccaccttttatcttataatacacagtccacggcataaggttgatgtccatttttgtaccgccatacatctggccaatttttgaatgtaaaaatacacaataaatttttggcattgagtgatgaattttaaattaaaaattaaaaaaaataactgaaaaataattaatcaatgcattatgaaaaactctaagagctggagaaaatattttcatttttatgtttaattctataagtcaaaaaaagaagaagatttttcgcgcttctttttgccttagggttttgaaaattcataacaaaatgatttttaccgacaatatgaactttaaggtatttacattataaaacttaaagaaaatgcaattataattcggtaaaatttattgtcatttatgcaaaataaattctggaaatggactatgcctctttagaaaactacgagcatccatgttcttgaaaattggagctttttccagctgatgggagtaaaatcaaaatgccaaaaatatttttctataaaattttgcatttatctaattttttgacatacaaaaaaaaatcttttttcgaattattcaaggcttttttataattttaaatgaatgaaaaaattctttgaaccctaaaatgaatcatttgacgcgtaaaatttaatccctcggattttaaagctaatcaagaaaaattggcaaattggtttcaatcattaaacatccccaacattttttttcttacgagcggattgattcgtcttgcgctgcgacgcttttgggctgcctcaaaatcaaatggcatgcattgttttggtggatcaattagtctccattcgaatttacactcatccggcaccaccgaaattaaatccgacatgacgccgcccaattttgacacaatatccagcggtaacagccaaagtcccgcataatcagccaaaaatgggccaaaattggagtgggcaaaaaattccttgccaaaatcattcaactgttcctgtccatcttaatacgtcattagtttaattggctctactttggtttacacatctaatcagcgaactttccttaattcagttttttgagagtatattaaagaataatcaaagggatcacctaataatctaaagggatcacccttagctcagtcgttttcaagcattccatggtgaggaaaggccgtgggttcgagtcccatcgggcgagttagcttttatgttctactatagacataatttcatttgatatcaagaattacgcattgaccaagtaaaaacaaagttattgcctatgaaactgaggaaaatcactgattaaacgtatacactggaatatatccatttaatgattaccattatcgactgtatttcctgaattagagcccccgggggctctatttttcaactccattcgaaaggctggctttatttcaggggggttctaatttagtaaacacggtatttggaaaataaattcaatgcaagtgattgttattaataattaccattgtttaaaaggacaacattgccacaaaatgagtcaaatttcaattcaatgtttgtgtcgtttggctttgcattgctacaatataagattatttatttcatttaattaaaatattttaaaggatatattttttgttttactgtattttgttaaaaaaattttaaaaaaatgccaaaaacagaaatgtaggcccgaagacggcgggagtaaggacacccgcgggaattgttttccatgaaatttaccattttcaatgaaaattagaccatttacgacatcttcggtgccttttaaacgccgaacagttcaatcccaatgggaaatggttccgatgcttttgataggttaacccctcaaaacgatattttcataataaaatgtgtctcctaaaaatttgaatttttggccaaaattacgttaaaaaatgaaaaaaccgactttttattttctaaagtcggcacttctttgatgtaaatttgcgtactatatatactaataacccaaacagactgacttggtgatcaattcatttccgatggtcagagtttcgttggcaattgaaaagtgaattttcctggcatttggcccacactgatcactgatcgatggctcactgctgacgttgaacaattgatcgaaacgaaacccttttttcagtttccacggaaagcctttgtcggtcattgtgcggttgtagcagagccaaaagcttaattaattaaccaattaaattaagcaattaagcatatgaccaaattaccttgagcatttcttactacggtaaaacacttggattggccacggattggctttagacacttgcaacgtaagagtgcttaatgttttaaaaattaatgttaaagaaatttttctatttattataaatatttataaattatttaattaatcaaaaaattttttggaaaatgaaggatcatttcatcaaattattaaccctgaatattcggaacttgaacaaaaatttttattatgtcaattgagttgtatcattgaccccatagtatttgaaattagaattttgagccacaaaaattttaatttcaaatttttagaattccaaattagaatgtcagattttagaaaaataatatcagattagtgtttaacttacttgtttaggaatttattttatcatccattttttgagaatataattagacaaattgtattgcttactttccatttaatccggcaaaaagttcggaaaaaacaaacaaaaaaatgcagaaaataaaattagccaaaaacatttttaatacaaataataaaaaaaattggaaaatttttacgctttggaatccgtaaaaataatgaaatgattttgctttcacttatttggttgatggaaaacgagaaaaatcgcaatgattcaccataatgcaacgataaatgatagaatgatgataattcattgggaaaatggtaaaatatttatgttaatcatttttaatggttttgtgaaaaagagcataaattatagttttggttagatttattaatgaaaatataaaaatgtgcaagaaaaataaattaaaaattgaacaattattgaataattatttgtttttagataatactattataatcagtgattggactcgtatttgaatggaaaagtacgtacttgaaaatcatgcgggaaaatttgaaatttgcttacctttaagattgattgtacttgaaaatagcaatttaaaaatttaaaatttttttgaaattttgtaccaataattttaatttttttttgtcacttttgattatatgtattctgatcattttgcatttgttcacttgatccactacgattttcttcactttaattttgtccaatccattgccatatatttcgtcaaaatttgtgaaacccaaataataaagaaaataaaattttctttgaaaacaaataattctttaaagcctggaattcacagaaaatagcttcacacagacaaatatggcgcaaacaattgatttttgttgttgattttgtctcaaaataacttttaagaatttttttttttataatatgcaaagatacgcttcttctccaacaagataattgtgaaatcggagaaaatctctgaattttaagcaacttagttagccctgtatttgaattgaatttgaatccatttttcaagaacattaggatcaattattggaaatttattttcttcgttcaatcaattgatatttttaaattttttgaaaaaaaaattaataataaagtgagaatttctctttagaaataaaacctaattatttttattatagaattataccaatactatttaatgattaaattaaaaaaaaaaattaatttgtaaatttaacaaataaatttaaatgtctattttggggttttaatgaggagtttcccaaggaatgattggctggcttatttgccaaaaaatgacaatttgtaacacgaaattgactattcctcatacgaaagtttaaaaatttagcaaaaaaatcagggctttttaagaaatttattgtttcggtaattttttatggcataaaaaccgtaaaatgttttggtttatggtcttaaaatgggaaaatatgacctaaaaaaactcgataaaatggagtttatttaaaaataaagtttaaaagtacaaatagcagagacaaatcacatatcaaataacataaactcctacaaaaaatcacttttcaaaactgaggaaaatttctttttccaagtttttagggtttcatatttaatttccaatttcttagcaattatttcgtcacggatttttggattttcatctttcatcttgaaatattgcttcatcttatgtgatttatcttcatttgaatatcgtgcttaaaatgaaaataatttaaatatcataataaaatttctcttacttttgtaatattttggtggcactaattcttttttccattttcgaaatgtttcataagaaatgcccaattccttcac

SEQ ID NO: 2977 - DNA, 2232 bp, Heterodera glycines
atttttacttttgggaaattgaattcattgcataataaatgaatttattaatatttatccgctttttaatatgaatattcaattttgttatttttctcttcaacaaatcttttctaaattgataaatccattaattattagccgaaaaatcaattttttactaaaatttttagaatttttcttaaaataaatgaaataaaattctttaacgaaaatattaaaaatgtacaaaatggattttgctccattcaaattacttctccttttatgccagaatgccgagaggccccggtggcccggtgagcccgggcgcgccaggcagccctgccacacccttgggacctggcattccaggcagacctggatttcctgaaaaaattggaatctgtagtttaacgaccaattaatttcgaaataattttagtttcatctatggtagcaatcggaaatcgatgcctattcttgagtatataaatatgtacgaattttttcgtattttcataattttcaaaaaacaattacctgtaactccttgctatccagccattcctggcggtcctgcgaggcccttctgtctggaaaattccatgttcgaacttttgtccatttattcctagaatgcctgataaacgatcataccttcttaaattcaaaaaatattaaatttttttcttgaaaattcaaaataccatgcccaatggtacctaaattgcttaaatttttaaaaaatcatctcagcgcctgtcttatgcaaattcattgcattaattttgttcgcttcttaatattaatcttaattttattatttgtattttcttttaacaaaactttgccaacagtaaaattgtacaatcaatttttcactatgatttaaaaatattcttaaaaagtatcagttaatatgtatgtaagaattattatttattgtgaaatgttgttaatatttttattaggatgtgtgtaatagggctgttcgaatctccgatttctgtcatttcgtctcgactaaccgagacttttttacacccttaaagattgagttttttaaataaaataaaggtatttaaattaatatattttgtccattattatatggccttagcattcattatctgtgacttctgcttcgttttttggttttatgaaactcgattcgatcaaattgatgtgaaattacggtttttatttattttttcccatttgatcaatttaacaaattaagaaattaaaatttaacaaattttttaaagaaaattccaccttttcttttcaaatttacatttgctttgtaaaaaactattttcgtcttaagggaaaaataagaattttgaattttcttttgttctgttcagttttgggtcgcacgctttgatttgataattgcttgaagttcctgtaaaaaaataaaatttttcttaaaagttttttggaaattttttttttttgctgcgattttctgtcccggcgaagtttcggcggcgacgttttggggtgtaccgacttttatttccagtaggacacatggaaaaaaagaagtatattttttggtccaatatatttaagacggaatcggcctttaagtactaagtcggaactggcgagaccgaagcggccacacagaactgacccccctaccgttgtatccttcgttgagttgagcgttaccagtaccggtagcagccgggtaattagcggtttgttgtagcattttaccaatttttttccgaaaatctacaaaactagttccgcgggactcgaatcattggaaccaaactcgactcgggaataaaaaaatacggtcaagatacaaatgacaacttttttgggcaagattcgaaatgggacagttcttttgtgcttaaggtatataaaaaataaaaaatatatcttaaaaaaattatcttacttttatggtcatttggcaacaattcgtttttccatcttcggaatgtgtctttagaaatgcccaattccttcacaaattctttctgtttgccttgagcatataaatttttaaattcatcaattcgttcaatgaattcgcgctttttctgctcataaaaattctttttcattgtttggattttgtttaaatttaatccttttttccatttatatatttttgcgcgatttgttcctagtaattttgcaattttcatctcaattttattgttattttttcgttgatattttcctttttccctcaacttttctttaattgcattaaatttt

SEQ ID NO: 2978 - DNA, 2366 bp, Heterodera glycines
  misc_feature (2281)..(2281): n is a, c, g, or t
aaaataaatttatactgttatatataaaaaaagggtggagttacattttttagacattatggatttctttgttcaaaaatatgtttgcttttgaataattattaaaattaagggatgaaaatcgatagaagaaaactcttgcacaaatttaaactcattattgaaattacaattatgcaaaataaattaaaattcagttaaaatgatatggtaatatatgaaaattttgatccaatttaaaataatataggcatattaataaataaaaattaataatattaaaagcttcttattttaagaacacgaaataataaacaaaaatataataaaattgcatcaagaaagtgcaaataagttttctaggctacctaagacccaataagaaacaagaaagatgtgacgttgcacgtgaaaggcgagtgcttaaaaacaaaaatgtaaaaaatagaaatgataaaactaatgtattgtattttattttaaagtaagatatcttcatatgtaaaaaaaaatttaaattaagcgttttaatattcgtttcggttgaaacattccttatttggggaatttaaatatatatatatatatatatatatatattttattttattttcggattgaaaattcaatacaatttaatttgcaaaatcaaaaattaataaacaatataaataccaaacatttaatataaacattttaaaaataatattcagagaaaaaattttcaggaattattaaaaaaatggattaatttttttacttttataattaattaaaattattgatgataaattggtgaatgactgctttttacataaaaaataaagtttattgaataaatttaaaagttattttattatcttaattataatttaaatcttatttaatttattgaatgaaacccataagaatttatctgtaaatatttaattaattgaaatttaaaaaggacctagtgcaattattggacctgagaatcacatactaaaatgtaaaattttaaattcataaaaaatatttttgatcgaaaaaggctgagttgaaaaagaaaaacatgtatatgtagaaaacataaaacagaattttatatgatcataaatatttaatatgaagaataatataaaataaaaataattaacaatttattaaaaaaagtaataattttaaaaaatattaggaaacaccacccgtatatttcaatggatattcgtcaaattttttgtctcgaaaaatttacaaaataataaatggaaaaaccaacaagtaggcaagtgaaagtgattaaatttaaaagaaattaaaaattactataaataacacatgaaaaataactcccaaaacaaattaaacttaattttattttgcaattgaaattaaatgaaaaaaataattaaaaaaataattaaaaatttaataaaaaaataaagatgaaaatctattcaatcattaaaataatattttcagtagtaataaggccagattcggagtatcaaactgttgcagaacagttgcaattttttcaaggctcttaatagaatagctctacaacggcagagggcaagtaaacacttaaaaaatatattgctaaaatttacgcaattctaattgcttctgggaatttgaaatactaaaaatttgaacaaatgcaaaaatgaattgaaaaattattactaatataaacaatgtcttgagttaaggattaattatattgaaaaatcagctaaataaattatataatcttctaaaaacaattatcacaatatttaacacattttcaatataagtgaaagaaattattttaaaaaatttctcttccactataatttcattaaaatggttaataatgataaaaatataaacatatttaataaagattaagctacataatctcaggttaggattaacttaataaaaaaaaaaaaattcaatttgcaacttacaaaaaaaaaaaaaatttgaacagcataataataataataaaattatataaaaaacaattaattatgctcgctcgaaagtggaagagttattagacacatgtgaaaatatgctttatggataaattattaatattgcatagcaaaatgaataatattatttcgaaataatttatagaatattattatttaaagtatttattactcatctttgcatatttcaataccataattaacaaattggtttttgtttttaaaataatatttataaatcatttaaatgtggcattttttgtccaaattaatgaacggcaacaatgatcacaataaactttgctgacaanagtaaataaataaatattaatttaattgcataaagcagtaccaggtacataccaacttacaccaaaacaaagggcagaaaccgct

SEQ ID NO: 2979 - DNA, 2084 bp, Heterodera glycines
  misc_feature (32)..(32): n is a, c, g, or t
  misc_feature (64)..(64): n is a, c, g, or t
  misc_feature (118)..(118): n is a, c, g, or t
aaaattaaataaatattaaaatgtttttattntaaaggatatgaaataaaatttataaaaatcnaataaaatggtactagtattttaaaatgaaactcaatgaaaatatatccgaatntaaaaaatagaattacgaatcatttggattttgtttaaattattccttatttttattctaaaacagcagataaaaaataataatttaagagttattgaaaaaactaagtgaatcaaaatcaattatggtttcaataattataatttaaaaaatataaagtaaagtactaaatatgagtgctaatcattttaatcaattttttaattagaaacaacaggatgataataaataataaaggtaacatgtgatttcgtcagaagtgatttcgtcagtgagtgatttcgtcagaagtgatttcgtcagtgagtgatttcgtcagtgagtgattttgtcagcgaccataataattttttttttaaaaacaatttagtttaattaaggctaatagtttattatccgtattaactggttaattttaatttgataaaattgataaaatcagttcagatctcaataaatttaaaatactttatatataaatataacaagtgaactcaaaagttcggttgatattttcgccggccactcttatcagtaaaatattggtttttgtgactcgtctttgctagtttatctcttgtatgttaattaatttctcgagggtcgccattatcattctgcattaacatcgagactctcgtgtgttcgttcatttctcgagactcgccacccatttattcgttttggattaacctttgaattttcacatgaaattgcttaccacaattttgcttttctcttttttgagttattcaatggcattagttagattttctgtcggcaaaacgaaccgtgggcgtcagctgatcacgcatggaggctacgaataccttttcgaagtgaaagttttcaaaaaaacaaaaaagcagttttctaaggctgactcccgcacggaagatggttggagttactggaaatgtcctcgccgtccaccatactgccctgggagggcaaccgtgcagtcaaatttgtttgttgctgatgacggctcaaattacagattaggtcgtgttactgcacaacacaaccacgaaccggtctttggttcattaactgtgggtcaaattttagtggaaaatagggggaaaaattatataggttagagaagccaatgaacgacttcgtgatgaagcacgatctgattttcctacaacaagtcgaaatgttgtgaggcaggtcagagcggatattccagtcgatgttcgggttggcgttgctccatctgcttcaaacatgcaatggaactacaattacaccaaacgaaagcattttgaacaagtcgatttaataaataaataaaataataataataattaaaggaaggcgatattgggcttgatgcaatgcccccaacgaatttattggttccaaatgcactccaaaatcgtgtcatttacaaccaaaatcttcaggggaaaaaaatgctcattttttgttcacagtttggtctcgatgcactcagaaattacggagaaagcgttgcaattgacggcacttttgaagtacgtaagataaaatcaaaatggaaaaatgtttttcagagttgcccgaggggatttggacaactttacacaatgtcggttatcattgagcactgtgctgtcccttgcgcctacgggcttcttcctaacaaaaattcccccacctaccgcattttttttgattccatctgcgcttctgttgggattgggtggtaccctgccagaattatgactgattttgaagccggggcaatcaatgcagccaaaattgtttatccaaatgcaatcgtcagtggctgcctcttccacttgggaaaggctttttttcgaaaaattcaaagtcttcctcatttgttggaccgctacaacaacaatgaggatgtccgaaaagcactgcgttgcgttcaagctcttgcctttgttccattgaattatgtgtacaattactttgccatcgccatgtcggtgttagagccaatcccaaa

SEQ ID NO: 2980 - DNA, 2395 bp, Heterodera glycines
ttttaatagaataaagtatttattcgctcaatataactttttttctatcaatacaatttttacctaattgggcatatcgatggagaaaaaaatatgaacaaaatgtaagggttttaaaaacaaaaaaagataatctaaaaagttatggagtaattaaaatttcgcatttctttttctctcctttgacgtactattttcatgtctctaacacatgtaaaaagatggaattcgtaaattcgaatagtttttgttataagggtacaaaatcacctcaacatttagaatcaatagaaaaattattagttttcgcattttagttaaaaacagcagtttatagacttaagttataacttgataaaatgaaagtatcacaacttttttctgagatgtcaaactgctgagcattcacttagaaaaagattctccttttcaaaaatttttttcagatatcaaatttgttcggtttggttgggaattaagcgagttatggctgatcaaattaaaaaatacaaaaaaggcatgtaaattaaaaattagcgcgcaaaaattcacgacaattacgctctttggcgttatgaacaattttgtctgacactgggcttgaccaaaacacattctttaaaacaattttgtcaaattttttggtaatactgccttttactggtcccattaaaaaaagagaataaaaaggcttttttttacgattattcgttcttttagggggttatcaggccgctgatcacgaatatgatatccatttcgaccaattcctaaacccgaattcgaacataaaatcgaaaattcaaattttcaaaatttggatttatgtttcaaaaagggtttaaatgcacggaagcaaaccgaaagccataattagcaataaaaaatacatataagcatttttaagacgaaaaattcgaaattctttaatttgtgaactttctattttttgttcgaattcgagtccgggcttaggaattagtcgaaatgaatgacatgttcttgattagcgaccccgataacccccgagtagaacgaataatcgtaaaaaaccgcgtttttattctcttttttttattttcaaaaattataatgtcaaaaaacatagttatttccttgggttttcggggtcactgataacgaaattcggcatccatttgacaattcgaaatcccgaaggtgaatttgaacaaaaagtcgaaagccaaatttcgaattctcatttttctctgaaatggtttaaaagaaattttacttaagtatttattgttgcctttcagtttgtttccgtgtttttaaacaaagtttgaaccaaaaatgcgagttcgaaaatgtaaatcttttggttttttaatgaattcgtgttcggagtccggaatagtcaacatggatgctggattcgtaatcagtgacccccgaaaacgcaaagaaatgaattgagcagcgggggaacaaactccaatattacttctgcgcttatgtcttatggaggtcggaattgaacggatggaaagcgatgagaatttggaaaatttaccaaaacaggattggacgataacaccagaaccaattgtcattcgtggagttgggcacctaaccatgtgagaagagtaatttaagacaattaggattaataggacttgttttttcttcgaaggtttggccttaactcgcatttttcaacggaatttcctagcgctctgacaggaaaattggcaccggaagagtttgacgacacattgcgacgtgtgaattacgttcttcagaggaatgtgagcagaaacttgcgctggttgatctgcggattgcttttttgctgctgcagcttcggcatttcgttatggccggtggtctgtctgaacagaagggtaagtggtgaaaaaaaagtttatttcaatttttgtaaaaaccaaaattcaagactatttccgctctcgagaaaactctggaccatgagaaccaacaattgtacgacaagctcggcttgcattggtagcgcacctttaacttttcaatttgtttgctacaaatggcgatttcaggaagttggccaggctgcccgttgagccgtccaatcgcctgacagaatatgtccttttgcttgaaacgctgccaagaattcccctttccatgccggattagcacgtgaaactgtttagatttgactgcgatggctctttctgtccgttttattccaaatgttcccatttttcactgatccctccaaatcatcccggttccagaccatgtactctcaataaatctctctcctacgtcattgtataattacatcccatttgtccttactgagtgagtgcctataccaaccaaaacatccgttgtaaatgaacccataaaaaggacctatttttcgcctttgtccatattatattca

SEQ ID NO: 2981 - DNA, 1088 bp, Heterodera glycines
  misc_feature (1066)..(1066): n is a, c, g, or t
tttactgatgatgatctcatgtgctgctgctgcctcttccttactggaattgcggccgagtcgcagccaccaaatgactcccaaggaattatgcgaaaatgatggttcggatgaatttgttttttgaattttgaactccaattggaccgtttttagatctctgtacagccattctcgtggatacaattttgggctttcagacgcataaaatgagcttagagttcgttttcttttccatttgtttttgattgattgttcagtcataagccattggcagaagaagaacggaggcaaatcattgaaatgctctccaattttgtggacaatggcaacgcaattgtactgacacagtcacttttgtcgttgagaacggtcacggattttttggcaagcaaatccgaacaagaagtgcaaaacttcaaagaccacgtgagaaaaggactttatggaaaacaaaattttcgttttcggatggctgcttttctcccgcgacatttaatttcggcgaattatttaggtttttttttacctgaagagcagagaaaaggtttcggaattataataatttttagatttcttcctagaaaaaaaaattaaaaatttcacttgaaaaaatttttttcggagcggggggagggttgggacattgtgcatccgtccgcttcttcgtccgctgtttttccgtgtccattgccttcccaatttcgctttgtttagctcctccgttttctgatgatgtatgacgtctcttccggcttcacatttcgcccgtgccacagatacaacgcggagaacagacgcggggctatgctaatagcgaccagaaattggcaaaagggcgacaccatcgaatatcttttcggagtgatcggcgaactgagcaaaacggaggagggggcgattctgcgcaaggacatcaacgacttctcagtgatgtacagcaccaggtaaacgcccgggggcatttggtcggtcgcttttcactcgttgaaaattcggattgtttcccactttttatttaccctttcggaggaatacattgcgtcaagaatgttttcggttttanagagtaccaacgatcttttttg

SEQ ID NO: 2982 - DNA, 1909 bp, Heterodera glycines
actgttattgttgaagcaccaaccactataccacacaatacacatgggtaaacaaaagcaaatttactttatttaatataatttggcaaaatggttaaaaaaattcaaattttgtttaaattttttgcctttcctccacaaaaatgtcattcttagcggtgtatatttaaccccgaccccgagtcggggttaagggtcggggttgtcggggctggaatcgtcggggtcgtggttaacctcgaaaatggcaaaaatgtcggggttcggggtcggggcggggtcgggggcccaaccctaattataactcttgaacttgttgaccgaatccagtaatcttgatatcattcgaaagctcttcacaggctctattaacctacgaataattgcagagtttgtcgaagcataaaaaaagatagagataaaaaacttcgaaaattttgcggtttcatgtgacaaccttttagtgagctgcttaatcacttagaaatagcttagaaataccatctaaacatttaaagttggccagaagaagttgacccctgccgcgttttagagtgtggggtgatcggaagaggcggcgggtcatttcagtacggtatttaattattttaatttattattagctttgatgttcagtatggaatttaataattattttaacaaaagtaagtcaacagtattctaaagaagtgtaacaatccgttcttgtgccgcatcttgtattccgaataaaaagatccgttaaatcacagttttttgttcacggattaacataattatatttttaagtgcaaaatatttaaatttatctttgactctataatattattttctattgtcatagtataacaaacatatcattgctattatttgtttacttacaacaaaacaaatattaattttttttcataagttctggcggtaagcacaattcattctcgtcctatttaaggtcgttgattatgttgaaaatctcattgtttttttcttgttttggaaatttttttaaattttattattctagtattttgattaaaatgttattgcttttttattttaaatgttcaaatttcgtattctctcgacgtaagcaaaaatttgaaataatccggttaaaaaattctttttattatttttatcattaatttgattttattaaaaaaaatgttcgtttattatcattactaaatgtcgatatttaattgataataataaatttgattttgatattcaaaatggaaacataaaaatatttttaggtactcttccgttggcgattagttaactttaacgtatttcgtgtcattatattcttttgattgcatatttttctttattttccccattctgtattcattttcaataaattttcatttattcgtttacattataaatttatttgttgtttttatcttttaaatttgtttatgagttttattaattatgcaattccccgggtcgtttcgccagttgtttataagtcgttaagtttgttaaaatttatttttatttaattttattctttttgaaaatattttttattttattgattatttttattactttttatttaaaatgttcaattttggcattttttggtgtaattaaaaaattgaaatagtccacttcaaaattattttttatggtttttatcattatttttatttatcgataagaaatttttaacttatcatataaggtttaattatgctttttttttgcatattataaaatagcaaatcaatttttaatgaattttattttctttagaaatatattacatttcattataataatggagaaatgtagcatcgtttatacgggcgagtttcaattaagaaatcataaatttatatcaaaaaataataaactagtatactgccatttgtaaataatttatgtctttctt

SEQ ID NO: 2983 - DNA, 1610 bp, Heterodera glycines
caattttgcgcccccccccccctcgaattgagtagagcttccgcaagaaaaacctgattttttgtggatcaagaagccaacaatcacgtaaacaatgatggtaaatgcattacagacaaacgttattgaagaaatattctggcctccattaccctaaatgaaaaccaataggaaaattgtagactatttgttaatgatttaaaatggccatacaattaacagatcgccaattgtgccggtgaccatcaaaagtggctttttggatgttgattcaaagacaagtaaaagattgtgtgatgaaatgcacacgcaaacaaaaatgattgtgccaagatacggaattttcttcactgttcgtggactaaaaaattttcgttaattatttgtctcggtatccgaaaaccccaaagaaactttttcattttttttttgatttccatttttaaaaatcgattgaccgaattatggtaaattaggcccattttagtcgaattttatataaacgccaaaaagggtgttgccggtctcagcaaaaattttgaaaaatttacaatgccaggatgaggacgcacaacagtcggtccaacccagtgaatgccatgattagcgaaattccgctgacagcaaacagtgaaatcgagcaaattttgatggccaatgaaaggggaatgaaattgtggccagaaagtgccacgtaaaggaacagcaaatggccatgctggtggagcagttcaaaaaaggagcaaagtgcgagcagaacattggcagtgccatggagagacctgaaaaatgatgggcaacaacacatttttaagggggtgcaataaaaaaataatttcaatttacttgaaaaaatgcattaaaatttttggccccggggtggggtcagttcgtcgcgaaccgattcagtaccgccaagtttgaaattttataattaattatcggaatagatttttagacatttatttaagttttttggaaattgtgcaagctcatatagcagcagacgtctcgtccctcactttgtacgaaatgttgtccaaatgaccccaaaattggcaaccattccgaatatggcaaccaaattgattgcaattgccccgattatgagtggccaacatggatacacattacggtacaacaaatacaactgtagtaattttttgtagaaatttaaattaaaattccgaaaaaaattaccgtattatttgcgttcattaaattggtcaagtcattctcttccatttcaatgcttttggtaaggtttagctgatttttaaaaatatatttgtgttattgtgtcccaataaatatttgttttaatgctgaatgctaaataacataagtctcactaatttaatattctgaaaatgataattaaatttgaaacggcttttcatttactaagcgttagtaaatttattattcaatttacgttattgactcaacatgaattgacagtacactaccctttttaatgttttacgttaaatgttttattaaatttaaaataaaaaataaattaaatttaaaaaatcgagattttcttaatgcagtgacaaatttaattaactgtttttgtaattcaaaataaaaattctatttaaaat

SEQ ID NO: 2984 - DNA, 979 bp, Heterodera glycines
ttgggaactctgtttatacttcatacaattaaattttgctttttttcttcttttcgtttttgttcaataatatttacatttattcgattattaaattttgaggatttattaaattttgacaaaatttattaactgatttagtcaaattatcttaagcaatcttcacaaaaattctattggaatattttttataaatattagataaaatttttttgatattattcaacttaatataattttaatttcaaaaaatcaatgaataaatggaaatcttggttttaataacaggaaaagcatatgccaaaaaataattaaaataggaaaatgttaatttactaaacaattggcaactcaaaaatcacatctccgaaactgaatcaaatttctttctccatgttcttaatgttgcaattccaattcccaatttttttgcaatttttacgtcgctaatcttcgcatttctttctttaattttgaaatattcttttatttttcttaatttgtcctcgttggaatatggtgcttaaatgaaaatttataaaaataaaaatataaaaaatctgttacttttaacatattgaggcaccaattcttttttccattttcttaatgttgttgtattaatgcccaatttcttcacaaattcattctgttttcgttggccatataagcacttaaattcatcaaactgttcaatgaattcacgttttttctcatcataaaaatgcattttatttaaatttaattgttttttccatttgtatattttttcgcgatttgcgcctaataattttccaattttcctctcaattttgacaattttttttgttcatattttcctttttgcttcagtttatatttaattgcgtcaaatttccgaattatttctcttttctgttgatcatttggttctcctctcgtgttttgatcacttttgataacattctgattggaatattcacccatttgatcaactgat

SEQ ID NO: 2985 - DNA, 7792 bp, Heterodera glycines
tattttttatataaaacccagacaatcctaagaaaaatactttcgcttattcaccaaaatcgcattatcagagcacatttcatcaaccaaattggatgtcaaaaaggggatacaatggaagggataaagcggaagacgggttttgctaaatccgagatgactttttggctggttttgtgctcatcgtttattgtttggcccgtgtgacccgctgatgaagaaacagtaaagtggccgtatttaatgggagtttcactaaagcattttgcaacgccaaaaatttggcttaattgttttagccagtttattacatcttttgtgttatttaattctaagaataataaattccggaaacaatttctcgaaaattcttagaattccattttctttgacaggaaaaaaagtttagtccccaaaattttcataataaaatttcatcactcttttaatgtttgcgcaaaaaaagctaatttaatttgcctgccaatgaatgtcaatttgtctcatgtttcttaaaaaaattaaaaattcaattaactcgagaacaagtagctctaagcaacatttaacaaaataaaattaaataatcaagagaagaaatttcttgttctttaattttaataaaatttaaaacttagagtgttcatcaatttattacatttaaaaaagaaactcagaaacaatgttttatataagaaaatgtgaacaaaaataaaatttttttgttaatacataaataataattttccctgaaaatttatgcagtttcttcactcaaataagtggctttaagtgtttgttgagtctgggccctatgattaatatttacataaattttttccatgaaattttcttataaaaaattatggtttttaaaaaatttgtgttgctttgccagttcccgatgcccattttttggcgatttgcgccgaataattttccaattttcctctcaattttggtgtgccatttttccattgatattgccctttttggttcaactttttttaattgcttcaaatttttgaattgtttttcttttctgttgatcatttggttctccatttgtgtttgattacttttgatattattctgatcattttgcatttgagcaattgattcgataccattttcttacttggcatattgtcccattttttgccgaatatttcatcaaaatttggttggattttgccggattccatcttattaattaagaaaaataaaaaaatattaaaagccacaaattcatgtatagtattcagaatactaatagaatgaatttatttattggctttttaatattaatattcattttattatttattttatctttaataaatctttttccaacattaaaatgtcacgtaattctgagcaatgcaatcaatttttcactcagatcttaacaaatttttttttttttttttgcaaacaaagttaatatgacaaatatttatatttttgaataaaagatttttactaaaatatttttttctgaattttttaaaagtaattggatcgcatttgttttttaacaaaattcttttggaatttcagaaaattttcaaaaatttcttatggcggcagctttggcaccctgccggaacactaatttattttgatattaatattgaattaaaaatccataaaattgctaatttttagtcgaatttctttttttaattaattttaaacttttcggaattgcccatttttatataaacctattaataaattatacaagattttgaataaaaaattaaaatattttaattttaatgctttttgatgcttggcatttttttaaatatatcatttcttctatttagtgatgtcattttgaaaaatttttccgtgcgatctccgggtgaaaaatgcgttaaattttttacattttggtgggaaaacaacagcaaaatgaagcagaaataacgacggacggacattcttttgacaaaataaaatgaaaatggtaatgataattaaaatgaatgaatattccgttgactgatgcgtttttggggagagtaaaacggtgagtgatcactccaactgatcagcagcagagagttagtggtgttccgtggcccatttcgctcactgccattttctcaaagtgactcatcaattttcggcaccatcgattgattacattattctctacaactatttaagcaatcaggcgaatgattttgcaggaaattctactttttttttgcaagtacaacgcccaaaataggtccggtgatcagaacgaaacaccaaaaacccaaaaactcactcaaagcatttcagagctttttgagcagcacaaattattatttttttttgtcttcatggttatgaagaaatttgtgtctaatgaataaacggaatttttaatgaattcaatttaaacgttttattgatagtataaatgatggaacaaaaagtaataaaaataatttaaaatttaaacaataaatgcaagcttttgggtgaattaaattataaaaataagtaatgcttgggattgttaagagagtattaaatcaattcttattaatttccgcctaattacacgcattcttttgccaccttccgcacatttggaggcgaatatgaccaattgcagagagactgtgaaaaaagagaaaataaaaatataaaacaaattcattttaacaaaaattgcacctgaataaatgcagaaacgaaaatgatcaaattcaaaacggagacgcagaaaagtgaccacctgacaaatgagcaaagttacagaggcaatttgataatgagaatcattaggaaattaaattattttattagaaaaagtgaaaatgaaatttttaatttaccaaatgaggaagaaaatcttctcattgaaccaggtgatgcgcagatggcattggacgaacacgttcggagcaaggacagagtgacaaatgatcagacgggggaaaatgggcagatccttaaaagggcaaaagttcagtgattaagagagtatttttcggtgtcttcaacaaaaaacggatttaattaactttctaattaaaatttaaaccaaagtgccgaaagtgtccgaaacaaggcaaaaaattgcatatagagtaaaactactgaaaacttgacaaagtttcgcgctttatctttgaaatttataagaaattttgcttagataaaattatgcgctttgaaaatacataaatttgctgaaatatttgaaataattgctaaacaaaacgattatgtttttaaatcggatttgtccttaaaaataaattaaatattcttaaattagtcattcccttcaatttccaccttaatttcatcaccattgagcaatgcttttcccacttcaatgccccaccagcggtgccctcggccggtcaatgcgttaaccacgacaaattgtgccacggcatttgtcaacaaacaagctaaattttataaacttagatttaaatattttaaattcgaagatttattttttttgcactttcttaaaatcactcaccgttttgaagcaatttgtgccgcgtccattttggcatatagaaaaatgccgcttggataagaatcattaccggcaaaaactgaacaaattactcacagttttgaagcaatttgtcccgcgtccattttggcagatagaaaagtgccgcttggataagaagcattaccggcaaaaactgaacatattaacaaattgaggtaaaactaataaagcaaaattggtaaaacatattattatttattttattcttttaatcatttttacctcgtagaaaaaaattgctgaattgttttggtgattcgattgtgttgttccgtcctcattgagcacttcgcacacattgaacccaaaatcgtcggttttgctttttgatgaatgctaaaattagaataaattaagagcgatgagaatgcccaaaatgcaaaatttgaagcggtgggaaaagccaaaaaaaaaagaaaaaataataaataaaagcggaaacgaatggtaaacgaagctcacatcccattttggaaaaagattaacttactaaacatttcatcggttcatatccgccgacgccaaaactaaaattaatttgagcaattaaaacatttatttttttattttttttttcattgcaaataaataaaatatttttgttaattaatcacataaatgcggtggtcagaactgcgaagaagacgaacattgaaggaaaaaggtgaaaatttagctgatcaattcccatattaaagaaataaaattgagattaactttaatgtcgaaattaatttaaaaataaaatataatggaaaaaatgaatgataagtagagtgccggatttataatttgccggtttggaaataatttaaatccctcattaccccggcgggaggggtccccaattctcggcctattactgtccctgatcagaccctggacttcaatacccaaaataccgattcgcaccatctttgccaccgaaggagtgccggggagggatcccaatttaaaattaaaatttcgttttttttggctaaaaatatttttcagaaaaataatcccggcatttatttgtaataaactgaacggaatagaaaatgcggtcacaaaaacagacaattggacacaaatttaaaggatttgttcagattattaatctgcaggcaccgaaaagcaaatgccagcggacaaagcgaacgaattgcctatctttctctgtgataattccgctagcatttgttttttgcaaatccgttgcttcttccctttggctctcagtgattgagcgtccaccaccaaatcaaagcaatggataaaacccaaaagccccccccccactcattattttttcaattcattcatttattcattcattttttgctgtcagtgtggcctgccattcattgaatttacagcagtcgaagcatttgcattttgctgcgattcgacggaccaaacgatggaaagggaagggacaaagacaaaacggaaaaccgacggggggggggggggggaatgaaaatgtgaggcattcattcatcggatcaattaaaagcaggagattaaagtgaatttacatttaatggcatcatcatttacgtcggattgggccgaagaaatctttgatctttgatgcttaattggccgttatttgaagcaattttaatttcaacgcataagcataaataagcgatcagacccacgccgagtttagggccatgattccgtatgattttgtagtgaatttggaccagaaacttttgattcccaaacggaagaactttactgaattaaaactcagacagaaaaagaattttttgttttttcaaaatttccaattcgatttgctcaaatgttttgttgtccctcaaaaactctccatcaatgtgcttttgctcactgtctttgaagcggccgcacaacgtggacctcattaaaccatgacaacacttcggcacaattttccacttctgccccagtcattgattttgacatcaaagcgtaattgatcaccacattagaagcgactgacaaatgagcatgtttaagtgcattatcccagcaatgatcactgattaaccaagccaaagggcttcactgatcagcggatcagcagtgcccacctcgatgacggatgatttttcaaaatttaaatcatctgggagaaattttaaaaaaatagaaaaggaaaaaattcatcaaaccaaaaaaaaaggaaaaattatttgaaaaataaaagctaaagttttatttttgttattgcttaactcaattgatcgaggtcgagactttttcgaacttattttcttaaatttttagactttataaattgtattttgtcaaccctttcaaagtgtgccaaagtacactttgaatttatcgtcggctttacttacgctttgaaattctcggcgcgcctccgattgcacttgcgtaagcggttgctccgtttcatcgtttgctttcctccctaaccaccgtctccgttgagtaattgccgtcgattaacgagttgtctaccacgtactttggcgattgaatggaataccattttaaatgtttttattttaatttccattttcaattttatttttgtgctttctatttgagagttttgcctctccaaattcacattaattattatttggtaattaattgtgctctattgtgatgccaaaaggaagcggagtatggagaaagtagtataaaggacatgtgagaagcaggggtggagcgcgaccgcgatccgcgactgcgattcgcggcaatttgaatccgcgatgcgcggaatttgtgactccgcggcaattttgggtaaaatttttaattatttaaaagtaagtttttgtttatgaaaaagcaagagattcatggaaaattgataattttccccaaaaaattcatttaaattccaatttttccccagtcgaagccgaccaaaatctttatttttctttagaaaaattggttctaaataactaaataggtcatttccccctacccaacccctaccattcagtcccgtcccaaattttgtatgcatcgggattttaattaattttatataagaaaattttaaaaaagtttttaaaaaatgctttaaaaaattggaaaattctgataaatgcgcgaccgagattagcggcaatttttttgctcggtccgcgaccgcggcaaattgaatctgcgatcctcgcgaccgcgggatttttctgtccgcgctccatttgtgggttcgagtgccaccgggcgagttatttttttttgttctacagtgagcaaaatggcatcgcaatgatctaattaattattatttaattaataccatttgtcattctcaactccccccccccccctatctttgctcatttatttctaattagtattattattatcattatttttcatccatcaattattagtccaccaacgttgtcaaggtttcctgcttccaattgtcaaatgcggccacgtaaaagcgttgtgcttggtcctcattttcaaatgatttttctttctcaatttcttcgatcactttgcgcagagtgttcttttttttgtcaccgtcgccttctttttccaagtatttgatcagtctgtcaaataaacactttttcaattaaatttaattaattttaaacatttttaaatttaatttcatttattttcatttcaaattcactttttcgcttttttctgtgcttctttatagcttttgttcacattttccaattcttttttggccttttccaattgtttctccctttgccttttccgattttcagcgtccaccaattttattttattacccttaatttttttttatttaatcaaattccttttcctcccaatttccatcccacaatacctctagtgaaagtggatttcgttcacccgttcttctgtccattcgctttccccgtctaccgtaattcgtccgccggtgtatggtgctccgactgtacggtagtccctcctcttcgctgcttatggaattttccaatgattgtgccaacaaaaagtcgttctgctgtccttctccctctgtctgccagttatctgcttctgattgttttgtagtattcaacatattaacaaatttgaaaaaggggacaaagaaaaaaaccgtaggaaaactgagaaattcaaaatcgcaggcttttcaaaatttcaaagatccaagtgccaactaaaaaaagtcttcgcgccctaaatttggcgggactgagtggacggggctgagccgcccgtttgtttttttcatccttcctgcacttctgctgatggctgaaataattttta

SEQ ID NO: 2986 - DNA, 4156 bp, Heterodera glycines
  misc_feature (4068)..(4069): n is a, c, g, or t
  misc_feature (4072)..(4072): n is a, c, g, or t
  misc_feature (4081)..(4081): n is a, c, g, or t
  misc_feature (4089)..(4090): n is a, c, g, or t
  misc_feature (4093)..(4093): n is a, c, g, or t
  misc_feature (4096)..(4096): n is a, c, g, or t
  misc_feature (4099)..(4101): n is a, c, g, or t
  misc_feature (4105)..(4106): n is a, c, g, or t
atgaaaatgaaaaaaaaattcgaatttcatttcttttattattggaataaaagcttcgaaaaatgttaaactcaaacaattcaattcaattttgaattctcttctattccccaaaattttgacccgacccctctcaaaatgagggcacgcggcgaaagttttatgtgggggtatgtgttaggtcatttcattcatcgccggcggggcattgcgaataaatcgtctttaaatcccccgccccttccccattccatcttttgagagtgaaaattgggagcgatggtcatcgtcgtcgtcctcgtcgttgtcgttctcccaaaatcgtgtcaaattgccgccccgtcccccaaggcgttgcgaatcattacgccccctcggcgggcggggggggggggggcgcatggcgtgcggcatcactttgccgattgtacatgaaattgggggggggggggagcgaaagcgaacaatgaaaatgtggggtggggaagggggatgaacttttcgccacccatccgatgctccaatcgccagcggctggctggatgaacgctgttctaaaatcacagtttctgacagccgcttgcactctctcctttcacgccggagagaaaattgagattagctcaatgagagagagagtgagagtgagagagagagagacagagagagagagagaaaaagtttaataaataagaaacaaaactgagtaagaaagtacatacagacaaaagcagagcgaagagagtgtcactgatacattggaaaagaaggataaatgttcaaagaaaaaacctaaaattttctagaaaaatcggtgagaaatctctagcagctttatcatatatcattaacttatcattgccactgtttttttccatcttgtcagccaccactttctcttattaattcctttccccccgccggcggtcggcagaagggggggggggggggggggacttaaacttacttaatagaggagaaaggtggatgaagaggtcaagcataagttgcaactttaaatggcggcacatccagcgacgaactctctctctccctctctctctattcgtgcggaggttgcgcggcgaacaatgcgccgcgctgcgcaattccaatcggatgttggctggcgggcggatgatcatcctttctcgcttcctgctacggttgctgacaacctccgctgcccttctctttccttccctttcacgccggaggggaattgtgtgtgcgaaatgtgtaccaaaagagaattttgggtgagagcggacggattaataggaggaagaaaagcagcaggtcaagcgtgcttgttgcgcggggttcgtcatgtggaagagttagggaagcgtcaagcggggcggaattgaaaagcgcggagggcagcgacgggtggcaggcacacattcgacagatgaacgcacagctcgcatccccctcctcctcatccatgccccgggggcatgaatttggattgtatgggattttaaatggagaggattgaactcttccatcctttcttcttccccttcctcttcctcgccccaccagtgagggggggaggggggcgttatgcgagcggtgcgcaattgcaccccagcaatcggctggctgatcaccctcacccagccctgaccccgtccgtccgccgcgccttcaatggggatgcccgacgagtgcccgccgtgtgcgcatgtcccgcttcctctgctgctgctgacagccgcggctggctgtcccccgcccatcggcgggcagcagcaaaagcaaaattcggtcggtcgtgcgccggagggcatccccacgcacagcgcaagaaaagtgaagattcactcactcactcattcgcattcattccattcgctggctgctgctctctcccgcgccctcacatccatcgcgaagtttcaccgatcgccaaaatttttggattttggtgcatcagcggttcaggcacaacggcgccggaggggtcacatcgctttaaatcactatttttgtgccgcttttgctgtgccacagtgacagctgcccactcaaaagttcggcacccgcccgccctctcccacaatcaatccgtgctcaacctgcgcaacaacgtcgaaagtgaatttagtaacttttatgtagtacaatttttaactttgcatttaaaacataatgccaaaaacttttaaatattatttgacagccgacggcgtacagtggtgccaaaaacaaaagcaattagcctaagtgacacctgaaattgtgccaaacggacatcacatattcacgacagcaaaaacaaaacggaggtaaaaaattatggaatctcaaataaaattttaaatcattttttgcacaatgaaaatgtattatctatcgtacattatttatttaaaattttacgaaatttgcttaatcaattcaaattccaaaatgaggttcattccgaatcaaatttgggcattcgtcactcttaattcattccattgatttttaaggaaacaaaaaatttttctctaaaatttcttttgtttcggctaacaatttttaataagtggtgagcaaattattaaatatgcgagattagtaggaaattgtctttattaaaaaaatttcgctaattaatacattgataaaatttttaaaaatttgttatttattccaagtaaattgaaaaaatcaaataaaaattttatttctacggggtaacgcaatatgtttctttcatcatttttttctccttaatttttttaatgattttgataatttttttttgccattttttctctttaatttttattaatgaatttgatacgttttttccattttcacttgaattttttaccatttttttgatttttctaatttttttgcacatttttctctaatttttattaatgaatttggtaatttttttttgccattttttctctttaatttttttttttttactaaattttgataattttttttgccattttttctaaaaaaatttccccgtcccctcccttttttctgttcactgattggctgctgttaatttccctcttttttatgtgtgtatgtgtttaacacaacaaatgcgcgaattttttgatgggaggtcgggtgaatgaaatgaaatgagatgaaatgggatgggatgaccttgatgcccaatatttcttctgttgctgttcattattactttcaacagcagatgcaatttttggatcactttcatcagcgaacgcacaaaatttgatcattttaaaaaatgttggcaacgcaaaaattaaataattatttaatataattttctaaaatatttttattgatatattttttgaaattttttttattaactttttttattaaaaaatttacaacacaaaataaatgaattataaacaactatttttgttttattaaagtaatttttatttataatttagcattaggtacaattactatatcttttttccaaacactttatgttattaaattaatttattttaccttttagtaatttgaaaataatgatagttatgaatttttaatttatttttttgttcaattctaaacgaaattatttatataaattatcatttttaaacaacattaataataaattcatttaaattatttcttttagcgccttttttttaaattcataaaaaataaaataatttcaaagcattttatcattttttgtgcccacaaattgtacaattttcatccatcaccactaggggaggaataaaaactaaaaattcatttttatttattttttattttgtggagggccaaatttatttgaccttggggctgccctccccgctgtccctccgcgccccgggccatgcacaaaatgtgaattttgttgctgctcattaatctaaaacggccgcgcaaagtttggcgacggcggtggcgccaaacattttttttttgtataagcataaaaatgttgcgacgacaaaataatttttatttgagtttgtcatattataaaatttttctttataaatcggaaatcaaaaagaataattgtatttttttctataatttagtttataaaagtgtaaattaatttcagcnnatnttataagtntaattccnnatnttnttnnntttnntttttccctttatgggtacttttttttataataaaaattatgattaaata

SEQ ID NO: 2987 - DNA, 950 bp, Heterodera glycines
tttatatatatatatatatatatatatatatatatatatatatatatatatatatatatattcttattaaagtttaaataatcatttattgctgtttagataactttaagctcactttcatgtattttaatctggttcgacccaaaaactcgaaattcgataaattaaatttttgaatttttgttcgagttcaggtcaagggctcggaattggcaaaaatggacgctgtattcgtgatcagcgccccaaaaaccccttaaaacttactttcattaatttataaaacacatttgtaggcatctgaaaatgcattttaaaagtaaatcacctaaactagacaagtaccgatcaatctgctaatgggtcgtacgaatcactttcaatgcttttttgatttccaccaaaatgaaaatgcatgaatcgcaattgcttgaattgaaaatttgcttgatatttcagtttcggaagatcatttaatacaaagttggagagaattagtgaagtggaggagcagctaaagacaatctaacgaaaaataaaattttgtcttaaaccccctcccacccatgtcaaaggcttactatttttatttctcttattaatattcccacacgtatttagtataattgagaattttaaaaaattgatatcaccaaaatcggcggcgtctatcggcacctctgactttttgaaatttacaagccgcaactttttgaaacacaaccaaattttttgaaattttaaaggtaaattgaggacattagggctaccaaatgatacaaagaatgtataattttcaaaagagatttctaaaaattttcaaaattctcaatatgtataaaaaatgaaaaatttgccgaaaattttgactttttttttggagatccccaaaaaaaatttcctcagaaaaaaaatctcaaaatatgtaaaaaaaaatgaaaataactaag

SEQ ID NO: 2988 - DNA, 3822 bp, Heterodera glycines
  misc_feature (48)..(48): n is a, c, g, or t
  misc_feature (55)..(55): n is a, c, g, or t
  misc_feature (57)..(57): n is a, c, g, or t
  misc_feature (61)..(61): n is a, c, g, or t
  misc_feature (87)..(87): n is a, c, g, or t
  misc_feature (93)..(93): n is a, c, g, or t
  misc_feature (95)..(95): n is a, c, g, or t
  misc_feature (97)..(97): n is a, c, g, or t
  misc_feature (101)..(102): n is a, c, g, or t
  misc_feature (104)..(104): n is a, c, g, or t
  misc_feature (107)..(107): n is a, c, g, or t
  misc_feature (110)..(112): n is a, c, g, or t
  misc_feature (116)..(117): n is a, c, g, or t
  misc_feature (123)..(125): n is a, c, g, or t
  misc_feature (127)..(129): n is a, c, g, or t
  misc_feature (132)..(132): n is a, c, g, or t
  misc_feature (134)..(137): n is a, c, g, or t
  misc_feature (140)..(143): n is a, c, g, or t
  misc_feature (151)..(151): n is a, c, g, or t
  misc_feature (160)..(160): n is a, c, g, or t
  misc_feature (192)..(192): n is a, c, g, or t
  misc_feature (195)..(195): n is a, c, g, or t
  misc_feature (206)..(206): n is a, c, g, or t
  misc_feature (210)..(210): n is a, c, g, or t
  misc_feature (228)..(228): n is a, c, g, or t
  misc_feature (234)..(238): n is a, c, g, or t
  misc_feature (240)..(242): n is a, c, g, or t
  misc_feature (244)..(246): n is a, c, g, or t
  misc_feature (251)..(251): n is a, c, g, or t
  misc_feature (257)..(257): n is a, c, g, or t
  misc_feature (261)..(261): n is a, c, g, or t
  misc_feature (273)..(273): n is a, c, g, or t
  misc_feature (275)..(275): n is a, c, g, or t
  misc_feature (3746)..(3746): n is a, c, g, or t
taaatcacctaaactagacaagtaccgatcaatctcttaccagggcgnacgaatnantttnaatggttttttgatttcttaaaaaangaaaangnangaanngnaanggnnngaanngaaaannngnnnganannnnagnnnnggaagaanatttaatanaaagttggagagaattagtgaagtggaggagnagntaaagaaaatntaangaaaaataaaattttgtnttaaannnnntnnnannnatgtnaaaggnttantatttttatttntnttattaatattcccacacgtatttagtataattgagaattttaaaaaattgatatcaccaaaatcggcggcgtctatcggcacctctgactttttgaaatttacaagccgcaactttttgaaacacaaccaaattttttgaaattttaaaggtaaattgaggacattagggctaccaaatgatacaaagaatgtataattttcaaaagaaatttctaaaaattttcaaaattctcaatatgtataaaaaatgaaaaatttgccgaaaattttgactttttttttggaggatttccaaaaatttccgtaaaaaatcctcaaaatatgtaaaaaaaaatgaaaataactaagttcaattttagctaaaaaattagtaagtgagattcatttgtaaacaagatccctccaacaagaagtgttaaaaggccttacggacatttgcggacaatttcgggaaaaaataaaaaaaatttcgtaaagaaattttaaaaaatttctgaaaatatgaatgggactgaaaactaaataaaactttgtttttgggcttttaggcccaacatcttatttttacatttcttagaaattaatttcactactgctattttaagtgattaaagtaaaattggtccccaacatcggggaggtgtgaatgtcgcctgttacactcaaaacaaatcttgcaggggaatttgctactcgccccctgaattttcttttccttttgttcgggatggagaagaacccaagacacataagtcttgttctacttttcatcagcagggaaagcatttgaggccccaaaaattttcaaaaaggaaatcggaaatctgatgcccaaaaatctcgggaatcggattttagtacagctgatgttcagcatttagaataataggctgttcatttcgaaattataagcaaattttgttcacgattaagcatgtctcagaattttttctaaagatgaaaatagcactctcaccgaatttgagtgtaacaggcgacattcacacctccccgatgttggggaccaattttactttaatcacttaaaatagcagtagtgaaattaatttctaagaaatgtaaaaataagatgttgggcctaaaagcccaaaaacaaagttttatttagttttcagtcccattcatattttcagaaatttttaaaaatttctttacgaaatttttttattttttcccgaaattgtccgcaaatgtccgtaaggccttttaacacttcttgttggagggatcttgtttacaaatgaatctcacttactaattttttagctaaaattgaacttagttattttcatttttttttttacatattttgaggattttttacggaaatttttggaaatttttcaggacttttttgcattttacgtgcttttttgtgttttttcgtgactttattgcctttttgtgactttttggcgattttttatgacttttagtcgactttttgaagaattttagtgacttaaatttccagcatattcatgactataaaaatgtttttttttcactttgtctctcaaaaacgatcaacagcagatgtgacagcacagagagagcgaatcaatggccaaaagcggcggatggatttattcggaagacattaattgatcactaattgtggcacgtctgctgaacattgtgccgaccgtcgtgttgtgatgatcaaaatgaccagccaccgtatataatagataaataccgtattttccatccatttttttttactgtgccctccccccttttctctttttttactattacatttttacaacatttaaaaacttgggaaataactgcggtggttgattttttgtacaaagcagaaagtggcatatattagagaatatccgttatgggcgtcaagctcaaaggttacaaggaaccaaatgttgttttatacttatagacagcaacaaaataaaggatttgactgacaaagacattttctaaccttttacaaatgaaagttgggtaaaaattatccgtccaattgattatttgattgattgatttgtgggtggggggataaggtaaaacgcccggcaaatggtcataattttgcaaaatattctcgttggtggtcctcctctcctctgttgcgttccattccaattcactgtgccattccctttttctgctcgccgtttcttcggtcggtgctatgatgttagtccagggatgggatcgcccaatgtcggtttccaaggacgggtatgccgatttgcaaggacatagtggggaaaattcatgaaatccaaggacatttaaaatttttattttatgcattgaaaaatggttaaaatttattcaaatggcttgtatttttcaccggaattgtttttttccaacaaattctcaactatgagcaaaaaattgacataatgccataatttaatatccaaatatgttataaattcaaaaatttaccaaatttcctttgattattttttccacttttccaaatgctcattttcaaggacgtccttgccattcaaggacgaatcccatccctggttaaaaggccttacggacatttgcggacaatttcgggaaaaaataaaaaaaatttcgtaaagaaattttaaaaaatttctgaaaatatggaatgggactgaaaactaaataaaactttgtttttgggcttttaggcccaacatcttatttttacatttcttagaaattaatttcactactgctattttaagtgattaaagtaaaattggtccccaacatcggggaggtgtgaatgtcgcctgttacactcaaattcggtgagagtgctattttcatctttagaaaaaattctgagacatgcttaatcgtgaacaaaatttgcttataatttcgaaatgaacagcctattattctaaatgctgaacatcagctgtactaaaatccgattcccgacatttttgggcatcagatttccgatttccttttttgaaaattttggggcctcaaatgctttcccttctgatgaaaagtagagcaagacttatgtgtcttgggttcttctccatcccgaacaaaaggaaaagaaaattcagggggcgagtagcaaattcccctacaagatttgtctgtatgtctagagaaatttaaaaaatgtcggtggaaaaatttcacatccccgatcttggggaccaattttacttttttaatcacttaaaataccagtagtgaaattaatttataagaaatgtaaaaataaaatattaggcctaaaaggccaaaaacaaagttttatttagttttcagtcccattccatattttcagaaattttttaaaatttctttacgaatttttttttattttttcccgaaattgtccgcaaatgtccgtccgcaaatgtccgtccgcaaatgtccgtccgcaaatgtccgtccgcaaatgtccgtccgcaaatgtccgtccgcaaatgtcccactgcgtttttagcaactattnttgggggttttttagaaactaaaaactaattattttggcagtttttagcaactataaatccgagccctaatgatca

SEQ ID NO: 2989 - DNA, 2307 bp, Heterodera glycines
tttgtccatcccttttttctctcattttaaagtcatttatttaaattttattttttttcatctaatttattatgtacacaaattcagaaaatgcagaacatttgactttaactcgaaaaaagttttttaaatttttgttataacaaattaagaatcaaattttcatttataaattcgaatgtcatcattaaccacttgttcatcaacagcagaggacgaattttcctctgatgtgtttggacaaggtggaaacggtaggcaaatatttaatttttgggctactgtatacatccaattaaatttaaacattcagcagaagtgaatgatggtgggaccaccagtgtttctgctgacgttaacagcagaaaaacagcaatcggtggtgagaaatttcttttttttgcgtaaattttgaattctgaagtacaattaaatgcactttgaggaagactaattaattgcttcataaatcatagctatttattgataaaaaaggggaaatttttgatttaaaaatttcgaattattttttaattttcagacggaggaatgaagagaaaaatgacggagttgttcattttgactgtagtgaacattacggtaacagtggcactgatcagtttcattgccccggttatataaattatttaattaaatttgcggttattttcaattttcagattgagaatgggcgggtaaatgctgagttggaaagtttgaagaaatttgttggaaaaatggaacagcaacatgggaataatggttggaattatattattaataatttttgtattcaatattattccccaacaaaatcttatggagagttaaattatttatgaaaaaaagtacagggcagatcagaaaattattaatgctaaactgagactctcggactataaatttgagaattaataaataataatataaattaattcattttcatttgaaaaaatgtttagatggtcaacagactgaattttgtgccaaaatggacaccgaaaaagacatggtcaaagccattgaaacaaaactcaacgaattggtggaacagcaaaagaaagaagcaatctttattggcgttttgaaagaccgatttggaaatggtaaaaatgaaaattaaaaataatattaaataaataaattaatttttttgaagaaagggaaatgccaacaaacgaaggtaagaaaaaaaacaaaaaaaactttttaatttttttaaattatttgacatttggaaaatatttggttaaggcaaaaattaaaatctgaaaaacagacaatcatggtcatgtgtttaacaaccaacacaaataaacaaataaacatgaacggttgtaaaaattgataaacctaatattgaattaatttttatgattgaatctttgatcaaataattgtgctaatccgtcgtaacattctttcattcattcagtccattgttttgatcggtattaaaattcttaaaatggattaaatattaattggcatcaattttaaatattaataattgctttatattttaagcaggcgaggaaaagctcgcacaatttcaaaatgatcagaaggaacttttggaaaaatcagtgaaatggaaaaacagaaaaaagaaaaagccaaaagaataaattatcacttattaaaagttatttttgtaaaggatatttattatatgagctaagaatattttatttaattaaaaattttcatttaaaaattgtttagatggccaacagacggaattttatgccaaaataaacaccgacaaagacatggtaatccaatattatttagttgaagtaccggtaaattaagtgggtggttgttgtattaacaataaaaaaaattatttttattctaaataaattattttttggtctgtaagcttcgagaagcgtttgaacatatttgccttgtccgtttctgactgtttaaaaagtagaaattgcgacaaaaaattataaaaaattaattaactatttttggccatctatcgtaccattcattaccataccaatttgttaattgtctttttttgattcatttgagtctttgccattttcagaggtcaaaatggccgaggtttcagcaactgatcgacctggtcttctgcattctgttggctcttatcaaaccgatcttatgcgtttttctttatcctctactgctggccttcattctgcaatacgtcggcttagacaagttataaatttttatgtgtgacattttttatttttaactactcagcacggacgacggcgacgatgcgcattggatcctcaaccattatactgaacttatatatga

SEQ ID NO: 2990 - DNA, 1725 bp, Heterodera glycines
ctctgtttgtggtccattaacccaacaaaagtgcagtaaagcagatgattttatattttcaaattgtcgtaagaagcaaaagattattttaataaataaaaatgcaacaaaaattggaaataattccaaaaagtgcgaaatatataaattatttgcatgtctaagataaagaaaattaaaaattagacattatatttcaaggccatcggaaaaagtattatgtatatttaggtgattttgcttttttagttttcatttatttttgttttctatgccattgaatctgctgctcgctttatttttaaattttaatcatttagtaaataatttcttttccacttttgaaaattgttttttattttgctttttgtcgtttggcgcctccgcctttgcaagaattttcgtttttaatactattaaatatttttattcgattatttaatcattaaatattttttggaaaattgaccaaaataacatttattattatttactggtaaatcgaattattttttgtctggtgattggaatgcataattatttatgtgaatcactttattattctctgaaaaatcaaacccaacatattcatattcatccattcatttagcacaattctcaaatattttttgattaatgatggaaatttaaaaaaagacaattaaattaaaaaatcctttcctaattgagtgtgtttttttaatatattaatttaatgcttttcttactcttactgttgtacatctttccactccatttcttggtattttttccaattaattactaattacgcattaattaattttatgtgccttttgtttttgcccgttgccatgccactctcgcctattacgaacattttgacccgagacggacagatttttgcatgcctgagcctgggaatgatgattattgtgtcgagtcgagctgcttatttggtaaaatgcgataagttaccatatcagtcagatgatcagcctctcatctcgaatttaattctttgtttatattttattacttttttcatcattaattaatcaaataaataaatttaaaaaataattaattaattaattaatttgaacagaaattgcgggaaaaagttggacaaaagtgtcaaagggttgcacttacgacagcataaatcagtgcgttgagcttgaacagaaatgcttgtcaaacggtggcaaacccttgggcgactgttcaatttgcaattccacctggtactgtaacgaaaaaatttcgaaaggtgctaattgaattaattaataaatgatgcattttattttgttaagagattgttgtgtgtttgaatggaacagtgaatgaaggcgaggaaaaggacgaagcatttgccgaaatttggtgaagaaattttgcgggaaggtgtgggtgacgactaattacataatgagcacctaaattacactaattagggacataaaagaggggccgttaatgatttagtccaattagacatagacaaattaaggtgtgaagatgcgagttgtttctcagtgcgttgcgttgggacggacaattcgacgcttttccacaccaaaggctgtcttaacatggacaaattgtgggccgttaaactgccatttcaagaatttgagctagataaatgccaagcgatgaatgggacgacggagcgcaattcttgcgatgggaacagatgcaacgggcgtaatgaaaagcaaagcgtaagccatgctttta

SEQ ID NO: 2991 - DNA, 7879 bp, Heterodera glycines
agatgatgcgggactgcctgctgacgaaccgcttgcgggtgtgcctgtacctgcgggactcgctttgcggttccggtcctggataaccgccagcaaccgattaggctgttgcatttgatcaccagcggttgctgtaccatctgtgccgcggacgccgctgcttccgccaccgtacacgcgacagtacgcgtccgaggcagcttgcgcgcgtgaaaatgagcacagagcagcggctgatgctgacgcagccgccgccacgcggccactgctacattccggcactgagctggatggactgtgatggcgggggcggtgatggtggtggtgccggatcagcgattggaactcgtccgcttcctcctcttccgcgtgttggtggtcgtccgctcgagccaaaagcgccgccgacgattgtccgccactgtctgcgtgctcttcctcctttaacccggtgtggcatatgtcgttgggacacgagcgcaccgaatggccggaaatggttgagacgcgtcgctgttccggcacgtatagtaacgcttgggaagagccttgatgcggtagtagatgcatgcgaccggtaccgcaagacattgtagttggtgtgcgcacaaagcgtggaccaattgttgcggttgaactgcacggcgacgacggactgggcggtgatgagcggcatccaccgccgcgtaccggtgaaccacttccgctgcagctttccaacgacgaagcggcaatcacgcttggcgtcgacggcataaacacaatggcggatgaagcggtggacagtttggcatggcactcaacgctgtcatcgtccttcatcaaaatgccgtcaagatttccaagctgatcatcatgctgttgttgttggataacaacatcaggattgttgtttcggtggtaatagtactgttgatcagcacccttttgatcagtatcggttgtgctgatcagacatggcacgttgctgatcagtcgttgttgatcaatgcaatgttgatgttttgtaccattcatccgttccgttcgtgtgggttcagtgtgatcggacggcgtaaattccggcggtcgggagacggcttcttcttgttgcggcgattgatcggtgctacgattttggacagactgatcagacattggttctgcttttgttgattgtttattgctgtttttgttctggtgaagatgatgatgatgttgctgttgtcgaccgatcaacaacaattttactgtagcggaggacatccaaataccatatcaacacgttggtacagcacacggcacaatgtacagtataatattatgtttaaatgaagaaaattgtgctaaaaatttatatatattatatatataaagcttagaattattttaattgaataggtatgcattcaagaacagcaatgacggaaagtataaaggacagtttaataatttggatactcaaatacaaaaatggaaatcaaaaagttgttttaagggtagtcaaaatggatagaatgccaaagaaaaataaaatttcaaaaaaaccctaaattacctcattaaaaagagggttttcaaatgaatgacagaaaaggtggtcaatgtcttttcaaggacgtcctaaatttggaggacaccaaaaaataccaaaacaacctaagctaataataatgtgtggagaggggggaaaaagtgaagttttttggcacaaaaaatattccgctgggatccaattagcagatatttttattgtgccttaatttgcgcgccaaaaaaatcacttattgatagagaccggcgggaacgggagtcccgtgggagtttacgggagtcccgctcccgactcccgtacttttttgtcgggcgggatttttacgggagcgtgatttttacgggattcccgctcccgctcccggaaatttgacccaaaaaacgggagtaaaaatgcactggtaagaattgagttttttggtaaaataataattttttgttcggatgagcctatttgaattattatggcgatctgtccattcaaattccacgccatttttgttgttgtcacttgtccataaatagacgatcatttcctccctcctggtcttttccctcattcattttattttgttatattcctccgaccaaattgtcttcgctctttatttattgttcgtcaataaacatttatttattgattgtcttccttaaaccctcggaccgaacaattggcgcagtcacaaaaatttggactttgctcacatcttcgggattaaaagcaaaagccgagacggcacaacaaattcaccgaaaagccgggattggctgtgaattttgattttaaagctgagttggcaaaattcttcaacaaagcagtcaaagaaactgctcagtcgtcaaaagcctggtcggcaaattcttcaatttaagcagtcaaagaaactgctcttctaaagccgggacggctcgacatttcttctaaagccgagtcggcacgccaaattcgtcaaaagccgggttggctaaatattaaattgacacctattggtgcaatactacaacgtttattgatttcgggtcgaaacaataatcgtctacaatgacgcaacccgccgcggttcagccaaatctgcagcaattaatcgacgtaattgctcagcaacagacgcaaatcaaccagctgataaatgttcaaagaaacaatcagccaaatccagcaatcatccaaacaataccgtcaatgccggacgtcgcaattttcgaacaatgcgacgaaaagcatcgcatcaccgaatggctggagcgtttcacttttgccattgactcgtgcgcaccgaacgcggccgatgacataaaagtcaaggcactgatgaacaaactgtcggaaactgcgttcagcgagtacagcaaatttgttctcccggccaaggtgacggatttcgactttgatgaaacaatttcgaaattggagaagctgtttgccaaaccacaatcaatatttgtggaccgatttgcatgtctgatggccaccaaagacgatggcgaagaatttcaacaatttgttaacaggcacaaacgacttttgaaagattttcagtttgacaaattgaatgaggaacaattcaaagggctaatgctcctaactgcgctgaagtcttcaaaggacgcagttcttcggcaacgtattctcgccaaacttacaaaggatggcgacgccgtcaaatatgatgaactgattgaggattgcatcaattttttgtctacaatccatgaggcaaaattgatcgaagcaacttccgtgtcatcaaggacagtgaatgcagtgaagccaaaccaaagaagggagagaccaaagccacaatccaagcaaggccaaccaaacgcaactccaactcagcttcaatgttggagatgtgggaaaacgaaccacacccacagagaatgctcgcacaaatcggctaagtgtcccaaatgtcactacaccggccatttggagaaccaatgcgaaaaagtgcaagagtggcgccgcaaaaacttcaaagtgaagaaagttggaacgcttagcattggaatggcactcaaatcaatcaacagtgcttctcttataaagataaaagtcctgctgaacggaaggatcgtgaagtttattctcgactccggggcagagatcaatgtcatcgatgaggaaacttatcgactgatcggacagccaaaaatttgggaatgtgccgaaagaggcagaatgttcgatgggacagaaaaatcttttatcggaaagggagaaggacatttcgaattccaaggcgtaaaagttaaagaaaatttttatgttgccgaaaaaggatcgatgaatctgttgagcatccaaacaatggatgcatttggattgttggatggcatcaaagccaaaatcaactctccgataaatctttgcagcgcaggggaagaattgagaggcaaaacacatgccccaatcaaatccaacaaagttgccggcacaccaaataaggacgccgagaaagaaatcagtcagctaaagcaggagtacaccaatgtttttaaaactgaattgggactctgcacaaaggtcaaagcgcacttagaattgaacgccaacgcacggccaatatacagaaaggcccgtccggtcccgtacaacgccaaagaagcagttgacggagaattggatcgttgggagaaaatgggagtcatcggcaaagttgagcacacagaatgggcagcaccgattttggtcgtcaaaaaggccgatggtagcgctcgactgtgcatcgactattcaaccggactcaacaatgcgctaaaagaccaccagcacccgttaccattaccggaagacatttttgccaccttaaatggaggccagtacttttcgcaaattgatctccgggatgcgtatcttcaagtggagctggacgaagcatcgaaaaagctgtgtgccattgccacccatagaggaaattatgaagtcaaaagacttccctttggcatcaaaacagctcctggcattttccagtcgataatggaccaaatgttggcagattttgacttcgcgacagcctacctagacgacatcatcatcgtcagcaagggccaaaaagaacattctgaacatttgaaaaagatgttctcgcgatttcaagaatggggatttcgcgtcaaacgtgaaaaatgttcgattttccaagatgaaattaaatatctcggacaaataatcgacaaaaacggacgcagacctgaccccagcaaaatcaccgcgatcaatgagatgccagaaccgatggatgtctcttcacttcggtcatatttgggaatggtaaaccattaccaacaattcatcaaaaacatgcgcttcgtcagaaagccgcttgatgatttgctgaaaaaggacgccgaatggaattggagcgataaatgcaaaaatgcatttgacaaaatcaaaaaaattttgtcatcaaaattactgctcacgcactatgaccctcaaaaagagatcgtagtagcagcagacgcatctgatcagggaattggagcagtgatctcgcacaaattcccggacggaacgatgaaagccattgcgcatgcatcatccgccttaactcctgccgagaagaactactcgcaaattgaaaaggaagcactagcaataatttttgcagtgcagaaatttcacaaaatgatctatggacgtaaatttacgctcctaactgatcataagcctcttctcgccatcttcggcaacaaaaaaggagtgcggcaatgcagtgccaatcggctgctccgatggtcactcattctcttggcatacgactttaacattgagtatgtcaataccaacgacttcggccaagctgatgcactttcacggctaattgccaaaggaaaagatgcggaagaccgcgtcatcaaaatacttcggtcgattcggaggtagaatcgattttcattggaactgtcgagaagcttcccatcaaattcgatgacattgtccagtcgtcaaaaagtgatcagaacatcaaaaaggtcatgaaattcattagaaatggctggccacaaaatattggcaacgaaaatgtggaaatcagaattttccaccaaaggaaggaacaactcagcatcacaaagattgtttgatgtatgctgaaagagttgtgattccaacgcaacaccgagccaaaattctgcaactgctccacaaaggacatcctggaatgaaaaggatgaagcagttggctcgtgaatatgcatactggccgaaaatggaccaggaaattgaacaatttgttgaaaattgtcaaccatgccaaaatgaggcaaaggcgccaaccaaaacgaatttgcaatcttggccaaagacaaatggaccgtggcagagagtgcacattgattacgccggaccatttttcggaaaagagtacctgatcattgtcgacgcatattcgaaatacccggaggttttcgaaatgccaacaaaatcgacaagtgccactatcgaaaaacttcgatacctcttcagtcggcacggacttcccgaaactctggtctcggacaacggaacacagttcaccagccatgaatttgcaaaattcacaaatgtcaatggcatcaaacacctgttctcggcaccatacaatccgatgtccaacggccaagcagaacgatttgtggacacattcaaaagaactttccgaaaattaaaaggggagggggctctgagtaaaagcatagtcgagactttcctcgtcagctaccggacaacccccaatgattcgctcgaagacagcaaatccccagcggaaatgtttcttggaaggaaaccacgaacaacgttggatttgttgaaaacaactcccactctgccaaaagagcgaaatgaagagatggaaaaaaggttcaaccgacgttatggcaccaaaattcgagagtttgccgtcggcgacaaagtcttcgccaaacaccgaatttcacaaaattggaaattcggtgaagtgtccaaaaagagaggagtcatttatgacgtggacttccgtgacgggtcgtcaggaagattccatgccaaccaactccgtcctcgacacactcccgacgaagccgaccaattgcaaatctttctcgacacatttgacatcggaaaacccgccgatcgccaaattgccaatgatttggaagctcgagctgagcacaaccaaactgtccaagagcagggactcgagaatgatctaaatcagtccgacaacgacgaatcagtggccgaagaagatgattagcaaattcaaccacgccgatacccgcaacggaacagacgtgccccaatacggtactcgccatgagccgctcaaagggggaggtgttcggatgagcctatttgaattattatggcgatctgtccattcaaattccacgccatttttgttgttgtcacttgcccataaatagacgatcatttcctccctcctggtctttcccctcattcattttattttgttattttcctccgaccaaattgtcttcgctttttatttattcattgtcttccttaaaccctcggaccgaacacaaatattaatctcttcagaaattgtgaaaataaatcattaatggtctcactcatcttaaaaaagacatatttcctcaattttctggtcacatcccctgcaatcttagacgtaaagttgtgttaaaatcacaatccactaaaacttcaaactcttttatcaacagaacggccactaaactcaacaaagatataacagatgctccatctgttgacagtttcaaaaaacgtataagtaaatggatttggttaaacaaaaatttagtctgtaaaagagctgcttggagttgatattaattaatttactaaaatctaatgtgtaagtggtcaccccttcgttggatattttatttcttttgaataaataaataaatacaaaaccaaatattaatctcttcagaaattgtgaaaataaattccatttttttactaatgttcagcctcgcgtaggaatcgaacccacgtctcgccctcagtccgtgggcagctctgccactaaactaccgctctttatttaatgggtcgcaccaatctcagtttgaccgcacagtcagcttcatacttacaatttgtacaaaaatttattagaaatattggggctactttttgttcattttttgtgcataatttatcggaaagcacacagcgtgtgctctgttgaccgccaccgcaacaaaatgtagacgcatacacagcaaaccgtatctttgacaatatgcaaagcaaagcaacaaaatttgtcttggtatcggcaacgaagacacatataaaatacactttgaaaagaaaaaattcttgcaaaaatgaagataagtgcagggcaaagctaaa

SEQ ID NO: 2992 - DNA, 1491 bp, Heterodera glycines
agtttttgaaaaaagtgccgcaaaaatcaacttcgatttttttttctcaaaatttcccatatgcttatttctaacaaaaaattgctcaaattgatcatggaaaatcaaaaatataacatttgagcattttaaacatgttttgaataaatttgtaaaaatgaggctttttgacccaaaatgaggcttttttacctgccaaatgaggcttttgaaaattttaatctggctaccctgatgatatcctcatgggcatcttgcacatgagggtactcttcttaatacaggaagcctatcaattctttgtctcccaaaggaaggtccccaggtgtccgtgggatttccgaatgaaactttgtgggtgaatagagcacctatgggttcttaagaaaaatggtttcaatttctgccaaataagtacgggtgccgagttatgacgtgccaaactttttttatcccaataaattgaataatcaattgctccactttgtgctgttcggtggcgcaaaggttgtgcgctcgctttcactttttgccccacaagttcgaatccctcttacgtaaatttatttttttaattttgccattgaataccctttttgaaatgcaattattttcatttatactataacagtttatttttttaaatacattttttgaacgaaaatgcataaaattatttttaaaaaactatattttctaaatttatatgattccccgttaaaaattctgtaaatcccttaaatgtcatccaattgcttcaaaaaattgtcaaaatataaagattttcgtggagaaaagcaggttactttgatcacgactagcaatctgagttttgtcatctggtcaaattttgtttgaagtgccaaaagataaagataccttccaaaaaataaattgtgatactgttttacttcattgcggttattgtgagattttcttatgttttgctcattttttcacgattaccacatgtgtgaaaatgcataaattttaattttaatattctgtactaaaaaaatgaaaataattgcatttcaaaaagggtattcaatggcaaaattaaaaaaataaatttacgtaagagggattcgaacttgtggggcaaaaagtgaaagcgagcgcacaacctttgcgccaccgaacagcacaaagtggagcaattgattattcaatttattgggataaaaaaagtttggcacgtcataactcggcacccgtacttatttggcagaaattgaaaccatttttcttaagaacccataggtgctctattcacccacaaagtttcattcggaaatcccacggacacctggggaccttcctttgtcagtatagctcatgtgaacggtaacgctgatatgagcccggattcgtgtgatcagcaaccccaaaaaccccttaaaacttattttcatgaatttataaaataaatttataggcatccgaaaatgtatgtggaatctgtcgtgtaaactacacaagtaccaaaaa

SEQ ID NO: 2993 - DNA, 3054 bp, Heterodera glycines
tggtttttacacactcaaattcaaaggtgcccaaattattgcaagtagtgcgcccaaatgcgtgtcactgaattttcattactcataaaaaaggattaatttttagctaatttatttgcccgcacttaaacataaaataattaataagcgctttttttattattgttattgaaaatgacgtccgaaactgtgtcaagtgacgcgtcggcagcgggaggggcggacaaagagaacacaaaaacggacacaaccaccgacccgagttccagcgaaaattcggcgtccatcgaggcggaccacaacaacagcaaattgcgctacgccgacgagaccaccatcatcccgcacgacctcgtggagcggcattttctgcaaaacacttggtatgtgttgtgttgtaaggcgtgcacaacaggtttgagacatcatggtgggaccagggagagccaaaaaaaaaggaaaaaaaatccggaatttttgaatctcgaatgctcaaaaaacttgaaaatggagccatgttcggtaatagcagggctaccccccattttcgaaaaatttaatttgaatttttgactttttgttcgaattcgggacctgggtcggaattgttcgaaatggatacaggattcgtggtcaatgacctcgaaaaaatttttggaaaatagatgggtcgtgagaccaccctgctttactccagggagacccaagagaaaaaagaaaaacacggaattttgaactcgaaaaatggaaagatttcaccatggtactggatttatagaaggaattgaagagacacatgggtgtcagtcagcattttttcccatttctcatggacccgcaaaacctcaaaaatttaagccgaaaaatcaaaaattcattcaccgacaatatcacatttctatttttgtctatttttcaaaaattcttacggcattgtataactaaataaaaatgaacggctgattttttaacgactttttgtaaaaaaaaaaattcaaaattttaaactggcattaaatttgtggaaaaatgggttcacaatgtcgtatccaatttattaatttttcattttttgacagggctctctggtacttgaagggcgatcgcaacaagaattggaccgattgtctgaagaaagtgtccacctttgacaccgtcgaagatttctgggcgtaggttttaaaaaatttttgggggtattttttggacaatttgaaaaacaactaaaaaaatgttttttccccgttattttttcgtgaattttacattaaatagcaatggttaacatgggaatacgtggttgggctgttggtccgaaactaaattgaaagattgacatgaaacagtcaattttgggaaaatttcggaaaaaatttttccactgtccttcttatgggtgtaccccaaaatttcgccgccgaagttttcctttaaaaatttttcaaacttaaaaagtaaaatcttttaaacaccccaaaaaatttttttcgaaaattttgacggcgaattttggggtgcaccctttcatttatgatatttgtaaaatcatttgggccttcttcaaggttgtacaaccacatccagccggcgtccgggctgagctggaacagcgactattacctgttcaaggaaggcatcaaaccgatgtgggaggacaaaggcaatttggagggtggtcgttggcttgtgcaggtgaatacgcgaaacacaacccagtctcggcttagtctcgaagttggctttttgtgttgttggagggagaattggccggagttgcgaccaccacccaccaagcaagtttttcaaattttttgttgaattactaagatttttcaaaaaaaaaccgctgaaaatttctttttttaaattttgaaggaggtgggaatcttgagactttttctgagatttttttttcatacactgattcacctccgctgtttattccccgccccatatcgtttcctccttccgaaagggaggggggacgaaaaaatttcggaaggggtgggaagagggagccccgacatttgcggcccagacatttgcggtccgacttttgcggccccgacatttgcgcctatgtccaaaatcggactcaaaattgaattttttcaacccctgatagcctaataagcattaaaattaagaaaacacggttttatggttcattatgatcaataattttttgtttgaaaatttcagtattttttcaacttttttttgaagatcaaatgatcccgcttctgtcacgtcgatatactcggataatgtttaagactacgaagatccgaaagattgtgctctattatataaatttcatttggcatgagttatttgggccggtgatcacgaatacgtgatcagatttcaattatgacatcgctaagccctcagaatccccgtgtgattggggattctgaggcatcatttgaggggggagggggggggggaagttcgaatccgggcggtgtactttatttatctatttatttttgtgttatttttcagtgcgtttaatttatatttaaagatttgttgtaaattaataataaaagaatttatgtaaaaaataataattatgttttaataaagaatttcatattatttttaaattgaatttataaaaattaatttcatattaatttaaatattcaattcttgtacatttcaaaattctctttttaattaataaaaggaataattaattttattttttaaaatttataataaattgctttcaatttttgtacctcttttatcacttttgtacctcttctaatcactgttgtacctcttctaatcattgttggacctcttctaatcactcttctaatcgctgttgtacctcttctaatcactgttgtaccacttctaatcactgttgtacctcttctaatcactgttgtacctcttctaatcactgttgtacctcttctaatcactgctgcacctcttctaatcactgttggacctcttctaatcactgtttacctcttctattccctgttgtacctcttttgatcactgttgcaacctcttctactccttttgtac

SEQ ID NO: 2994 - DNA, 5098 bp, Heterodera glycines
ttattggtttcgttatgaatttcgggtccaattgaaaaaattccattaggattcagaagaaagaatttgttcaaagttggctgatgagaaaaattttaatggatcaagaaggttatttgttaattgaacgaaattgcagtaaagagtaatggactctgttctggctgtcccttcttcctgccattccaccaaagtgagtcggaatggtccaccacttcgatgatgtcgctcaatttgaaggtcaactcgtcctcatgttgcgcagtataatcgaatgctgccacagcaattaccgtctcatcggatgcattcaacagctcaatctggaattccgggtgattacagcgaaagtattggattgcgctgttttccacacctgatcataattgccggggaacaatccaagggtggggggggggggaaccggaaaaaaattcggggttgagaacccgaagaaaaaaatttttttttctggcccttaaaatttgtgttgagtgcacaactgtaagccccccccccccccacccgtcttgtgtttccgctccgaaaaattaaaaaaaaaaattttcaatgccacactaacaataagtttttctaattttttggtaaaataaaaatgtaacaaatcggattttatgtgccaattttttgagggattgtaactctgtgccgttgtttttgttttttgtacaccttcactttctagtgtttgtccacaaattgtattgtttttcccctccgtctgcacaggtggacaaacagaagcgccagaccaagttggacatgtactggcaggagatgatgatgtgcatcattggggaacagtttgagaaatggagtgaccacatttgcggtgcggtggtcaacattcgtcaaaagggtgacaaagtgaggaaaaaaggggcttttgaaaaaatgcaattttcaattccttccacctatctagtctaaatatcaacaaaaaaaaaaaaattattaaaaatttgaaggaacagagaattttgttcttgtttctgcagcgattttttaggattaaccgacgcattgacggatatttgtttcgaaaattccaagccgaaatccatgtagaaccgaattctaacaacaaaaaaaagtgtaatttttgaatctcgtactttcatggtcaataaattactccttttcgaagattgagtatgggaacaaattaatcctcgcccatctagcaatacccgggtaaattgggaacccggtctcatggtcctggtttttcaaaactgtgctctacaaagctagcacatttaaaaaaaatagaaaaaaataaaaaattttattgttttttttctaggtttcgttgtggacgcgcgacgcgaaggatgacagcgccaacatgcaaattgggcacattctgaaggccaaactgaacattccggacaccgaaaatttgcgctacgaagtgcacgcggagtactcggcacgcacgggcagtgcggtgaagtcgaagtgagcaagcagcgaagcgagcggacgggagggggggggtgcacggactcaccccaaaatttcgccgcaaaatttaaataaaaaaaatttaaaagaaatctttaatgaaaaaatcatagaaatttttacaagaaaatgacaaaaaaatttcttataaaaacccttaagaagattttttcttgaaagatttctaaatttgaaaatttttaaaaacaatttcggcagcttaattttgtcctgttctgagagcgcatggatttccaatgcccaagggattgatggacaacggtcccatagtttagtttaggcaaatcttgggaatttttcaggaaaaaaaatattcgaaaaagtttctggtaacttaactaagaatttccaaaaaatcactgaaaatctttcgaaaattcttttttcttggaattttcttattaaaacatttctagttgggggggggggctgtttccatccaaaaaagcgtccatttttgaacgaaacaaagggaattagtgtggcgatgtcaaacaaaaaaaaatttttttttggcgggttgaggggggggggtcaacttggctcagaccaataaactcagtcatcagcagttgatttttgcaggctcaccattcctccaaaggggactgagaaggctgaatgaatacaatggagaattgatgagcagaggcgatgaatgatgtgaattgatcaccagtgatcagaattttatttatgaaaaatgcccaaataaatattgaacaaaaaaagtgtaatattaccgaaaaaaaaacattttttcgttcgctttttgctattggttaggattatatgcacacaaatttttcaaaaatcaggacaaaaatttctaaaaattcttcaaattcggtagatttaaggtaaaatcggtttgggatatactttagtcaacgccccgtaaaaaaaacggcatgatataccaatcgattcgtcttgacgagctatacacgaaaaaataggtcttcagttgcggaaatgccaaaaaaccggtttttgagccggtttaaaactcgaaaatttgagtgaaaaggggggggggctcctgtccctttaaaatggtcaaattctgacaaatttggtatcattcgaaagctcttgatcagctaagtctaaaaaaccaggtataaattcgaactgatgtcatctaagcactgggacaactgagttccagtgaaaatggacacttcagtaccaaaaaaaattaaaaaaaagttcttatataatgcacgaaaatcgtttagccttgaatatcgagtattgcgctaaaaaaccgccgcacactcgactacggcggccagtaggtggggcgagactacgggctacggaagaagtccgcgcgaccgatgtgaccttagatattactaaataaaacattcgaaaaaaaataaatttatgctaaatgaaaaggaaaatcagaaaaacataaaacagatgatgatgattagggcttggaaaaacatggatataaaatcgcgaaaaatggccataaaatatagatcataaatcgagaaatatggacaacaatcgcgaatatggacatagactccatcctagaagcttcaaaccaagctaaaaccatgtttttcgtgtgtttcaggtcttccacagtccagaaaaaaaaatggatttccatataattccgagccctaatggtgatttgaccaaccaaaaaacaaaatatgatttatcccatttctatgcacagatagaaatgaatcagaaaaatgtaaaaaattatactgtaaatgcaaatgccgttggctaattgcaggaaattggagatttggcatttcgttttagttggccaagaaatttaaaatagtcaaagaaacccaaagagagaaactaaggagacttttgtataatgttgagacaactctttttgaccacttttcttctctaatcactctctccttcccaccttcattcttctgctggctcccggacaatttgacagtaaaatacacaaaaacataagaaaaatgccgtcgccgaagggcacacaacaattgtgccatacttttcgctactaatcgcacatcattcatatctttgaatttttagcgttattcccaaaaactcatcaatacatttgcctattttcctttttttttctttatatagcacaattggtcaccttcggcgacggaattttcttatcctttttgtgtttattttactgtcggattgtcccgtcacgattcattcttctcaaagatgtacgttcttctggcgccaattttttgtacaatctcgtcaactattaaaaaaatattaattaattaattaataggggccggattttatgtttttcggttaccccacatttgcgcctatacccaaaatctggttcaaacgaaaactttcaatcccagatggcctaaacagctttaaataagcaacagaaagtgattgtatctgataattcgctgtcagcaaagtttttaaaaataataattttttcaaataacaaaattgttgtttctaataaagcaaaagattgggttttcttaatttcaatgatgtttaggcgatcagggattgaaaaaaattttagtttgaatccgtttcgaacataggcgcaaatgtctgctgggacacgattttttcaaatatcaaaattaaaaattaaaaatgaaattttcatccatgggattttgcggggtcccattccgaaatcccgcatacctatttacaataaatttcttaaatttaaaaatagttttcatagcaaatttcatccatttgtgaacggtgcctataaagctacttaactcatttgactcaaaacagaaattgattacttcgagcaaaaattctaatcccgcggcggtatccgcaaatttgaaatttccgatttctaattttagcacataaacacccaaaacatttttaattaaatatttgatattttcaaatttactttgctccttttccattttcaattctttttcattttccttgtacacataataaggtaagttccaatttggtaaatatatgccgacactttgttgtgtaatttccattttgtattcgaagaaatagaatttggtataacttaaaaattgaaatttgcctttatttgtcaaaaatcgggatgtgtgagaagtgatttttagcgagaatcgagaaacaagaccgagacatgacccagagaaacgagaccgagacatgacccagagaaacgagaccgagacatgacccagagaaacgagaccgagacctgagcccgagaaacgagaccgagacatgacccagagaaacgagaccgagacctgagcccgagaaacgagaccgagacatgacccagagaaacgagaccgagacctgagcccgagaaacgagaccgagacctgagcccgagaaacgaaaccgagacctgagcccgagaaacgagaccgagacatgacccagagaaacgagaccgagacctgagcccgagaaacgagaccgagacatgacccagagaaacgagaccgagacatgacccagagaaacgagaccgagacctgagcccgagaaacgagaccgagacatgacccagagaaacgagaccgagacgtgagcccgagaaacgagaccgaga

SEQ ID NO: 2995 - DNA, 4076 bp, Heterodera glycines
  misc_feature (3882)..(3882): n is a, c, g, or t
  misc_feature (3997)..(3997): n is a, c, g, or t
attttcgctaggttagctggttaatttttttaaaatggctcaaaattaaaatactttttaaagagaaaacttaacaatctccgggccgccctcattttgtcagtgaaccccacccctcctcctccccccgaatatgagttttgtgaaagcaaagggataaggttatgtgttttctatttgtcaatctgatgaatatttgttacttttttgtcataattagcccatgacatttggaattcaaatcaaatttcaatgcctaaaaatactatcatatctaataatttactttaattatttattttacagactgagaaaaagcgcattttggcgctttctgccttcattttgttgttcatcggtctgctgttcattgcggccatgatttggaagcagtgatgatcgaccacacaacccacacacgacaaatttccattggcacgacacaaaaaaaacaacaacaaagcgaataatttaattaacataacatcgttgccattgtgtttaatttgtaatcgttggctaattgctttaatgttctttaatccatcttttttattataatttggttggggaataaacgatgcataattcacatttaattggagttcatgcctcggaaagttaatttgaaaaaatggttaaaactaaaatactttttaaagagaaaactgtgaacaatttccgggccgtcctcattttgtcggcgaaccccaccccccccccccacttttccaataatttttgtgcggtcattacaattcatttatggtaaacgaggacacaaaaataagggaaagaacagagggataaaaatatttgtaactgttactttttataagtacttaaagtttggaattcaaatcgaatttattcgcccgtcgattgatcctcccccattatccgaatctgttctattttacgctaccgtacaattttcaaaaacatttttgcaataaatttatagtacataattagctaattatttcacacaacaactcaattagcaacaagtttttggccatttgaaggtaaaaaataataattaagaattgcttattaaatattaattttctaataaattgtacaaataatataaaatatgttttaaaatgaaaattttcagaaaaatccaacaaaaacaaaacgaaatttttcaattgaaatggcgggggtaaagcaagagcagcagcagaaaaagcaatatgagctccgcaaaaacatgacaatgttggatagagcggttgtggcagttgaaaatgcgcgagacgcagcagcggaaaatggtgggcaaaaaaaatgtgtacatttggaaaaaacggtagaaaattattttttagcttttttaaaatatcaaaaaaaaatgagagagataacctcgacaaaaatggccggttttttagtgatttaacgaatttttctaaaataaaataatataaatttaaaaaaatgaccaatatttttactgcaaaatttttcgaattttcaattctcaacttaaaaaaaaaattggttgaaaaaatcattttaaattggaattttttattcttaaaaaatcttatgagcttttggtttttgtacagctttgttgtacaggactttactaagaaattaaatccttgaaattaatggaaaaaagtagagaatattaattgttttttatataaattttcaaaaaaggaccctctattttgtcacatttaaaattttaattacaataaattgaaaaaaaaattaattggttttttcaaattatgttcgttgattcgccgttccttcatatttatatcattaattccattttcttccccctgtcccctccacttccctttcctctcctcctctctctcttcccgtctccccttttctgtccatctctctctttgctatttaccgcacaattatcttctctcttcccgtcgccccttttctctcctcttctctctctctctcttcccgtctcccccttttatattctctctctctctgctgttatttaccgcacaattaacgtatttttgctagtaattttttgaatatttgtgtttaatctcttacatgctaatcaattgcctgtggcaggcattgaaaaatgttgtattgacccctccccctcccccaccgcatttcctccatcatttgtaacattttattttcatggaaaagaataaaaaataaacagtgcctctacttttgaatttaataaatttctttaatgagcaaatgcccttaattgacccccaatgctaatttggtttaattaattgcataatatgctcccctaatgtattattccctatttgtgtgggatggttaattaaattctattaaatattttgtgttcctagagaaattgtgtttaataactaatactaattatcttaccaattaaacaaacgatgaacaccacgccaaaaaaaccgttctcctcgtccaatggcctaagtataaatagcatgaaaatttaaacaattcaaagcttttccaaactaattattttcagaccaacaacaggcttctcctgaatatttcaacgagattgctcaacggttcgaaaattcggaggaccgcagcgtaaaatcattttgcatgcccaaatctatttggtattatctacaatttttcaggcacgtgcctgggtccaaagaatgctggacgaggtgcaagaaaacaacgagcaggcccgcgtgagaaaattatttttaaaatgatttaatcataaataaattaatttattatgagagggttcaaaattgccaatttcacattttggcataaaaaaggaaattgtcaaattatggtcatcattttcatggccttaaaatttggaatttggcaggtgtttcgatacagctgatcgaatacactcataataataataattattattattatttaattcaccaggtttaattatttatttataacgcagatggaggacaaagaacgcatttcggcgttggaaaagcaaatgcttatggtttcggtcggccttctcatttgcgctggcgccgtgcttttcaagcacttgaagaattgagggctcaaacgaagaattccattggcacgaaaagaaaaatcaacaacaaatgaaataattttaattaacttaacaatcgttgccattggatatttaatttgtaattcgttggctaattgctttaatgttttttaatccatctttttattataatttggttgggaaataaacgatgcataattcacatttaattggagttcaagcctcaaaaattttttgttttcgagcagcactaatgaatttcatttgttatggctagacagtgcggattttctacatttttttatttttcttatcagagatgctaatcaatagcctttcttcatatgttttgaaatcattgtcaaatcttttaaattttcgctaggttagctggttaatttttttaaaatggctcaaaattaaaatactttttaaagagaaaacttaacaatctccgggccgccctcattttgtcagtgaaccccacccctcctcctccccccgaatatgagttttgtgaaagcaaagggataaggttatgtgttttctatttgtcaatctgatgaatatttgttacttttttgtcataattagcccatgacatttggaattcaaatcaaatttcaatgcctaaaaatactatcatatctaataatttactttaattatttattttacagactgagaaaaagcgcattttggcgctttctgccttcattttgttgttcatcggtctgctgttcattgcggccatgatttggaagcagtgatgatcgaccacacaaccacacacgacaaattccattgccacgacacaaaaaaaacaacaacaaagcgaataattttaattaacataacatcgntgccattgtggtttaatttgtaatcgttgggctaatggctttaatgttctttaatccatcttttttattataatttgggttggggaaataacgatgcataattacatttaattgnagttcatgcctcggaaaggtaatttgaaaaaagggttaaaactaaaaaactttttaaaaaaaaaactgggaacaatttc

SEQ ID NO: 2996 - DNA, 1232 bp, Heterodera glycines
catttcctccgtcttttgtacattttcattttttaaattgggaagaaaataaaaaataaataattcttcctctaattttaatatttatttaaaattctatgtctttgaagaagttttgctaataactaataacctatttattattaatatcaaacgctcacttttctgtgcctcaaatggatgtattaatttgcatgaaatttttttaacaattcatctaaaccaaaaaatttacagaccgacagcaggtgtcgccggcttattacaacgaattctgtggccgatttgagaattccgatgatcgtcgagtaatatttttgccaatcgcttttttctattgtcttataaataaatattttcagacccaagcatggatccgtcaacttttgttcgaagtcaaagagaccaaccgaaaagaagtgaggaaattattattgaaatttaaatttcaactttcatttgggttttgttgcaaaaatgtacacaaaaatactaaacccctttgaaaatttgtttaaaaattattcatatttttcccaattgcctttgtttataattggaaataatttctcagctttttttttcaggacaacaaagcgaccaccagcgaaggcactgttttcattttgggcgtttgtttcggcatttccgtcggcttcatcattgacagaatgttcctgcactgagtgatgagagaaggcacgaagaaaagaaccaatggcacgaaaaacgaaaattaaaaaggctaatttaacaacaacaaaaattcgttgccattgaatgcctaatttcgtaatcgttttctaattgtttttaacgcttttaatccatcttattatggtctgagttggggagtaaacgatgcataattaactcattgggatcttatgtcttgggaaatttttagtgccccaagcaggactaatcaattaatcccaatatttgtttcatttttaatggtcagacggtgcctaaagtttattaatttatgcttaaaactttaaaaattatatgaaaatttcttcagagcacatttttaaaattattcttcatgaaaacaggaaatttgaaatttaattttttttttgcaaatttgacgaaaaagtgattggatcaattatctgacaagacaatattaaatattttagaaaaataaataaatttaaattttatggggtgtgacaatttaatttcattcgaaaacgaaattagtagactttttttgaaaaata

SEQ ID NO: 2997 - DNA, 1473 bp, Heterodera glycines
cgctttttcaaaataaaaatgtaataaattttcaatgataaaacggggggtgggaagaaaatcgccgccggggcgatgggatgggatgcccatcaccagcatcatcatcattttcgcctccccccatcatatcgatgtctcgaccgacagaaaaaagggggtgccgccgtcgtcgtcgtcaaattatgcgaggtcgagagcgatgggagaagacaaaatcagtggagaatgaatgtcttaagcaaaaaaggcgctaaaaggcgcgacaaaaaatttttgatgacaaaagacggcatttttcggagataaaaacgcgtaaaattgctcccacaatgaaagtgaaataaatgggctggcaccaaaattaaaaaaaaacactcgcgtaagcagctggcaccacactcaccagccattcattcattgtgccaacctcaaaagatggcacaccaaggcaaataagcgtggccatttggagggatgggatagacagcgggagtgtgaaattaagtattgaaaaaatggagagtgaatagagaaaaaaacaaaatgacatttaaatcagttaaaattaattaattgaatgaaatataaaaaaaaataaaatattatttaaaaaaatagaagtgaaatggaaatataaatgagtattaaatttaaaaaaacgccaaattatggaaaaaaaggtattggaaaaattgaattagttttagaagaatgaagcttaaaaatatttggccattgaacttgattcataacattattcatttttaatttaaaatatgaaaagttaatgaaaaaatttcctatattaaaatatatatttttttttaactttaaaaatggcaccctgaaaattatggaattcttttgttgaaataatttaaaaaatttgaaataaaactttaaggtttggaattttatttggttttaattaatatattttttaataaaatttaatatttaagttttacttactgtttatttcattggaccagattggcggacagatcgacgacataatgcagaacaaaatgccaaacaaaaatgcgctgtaccgtagcatttttttttgtcgttatgtgatgaaagacgtcggtaatgaggttaattgtatgggagttttgaggatggacaaaatgggtaattaggacattttcagctgatacgagaaggatttagatctaaatttttaatgaaattttaatatgaaattaattatgcgtaatttttgtttgattgaatcaattaatataaaaaaattgtggaccattaatacacaaaattgcaaaaaaatgctaggaatttataagataattattccaatgagccgtgaatcaatttcaaatttgatcattattttttattaccccaaaaagtatgtaaataattaattgaaaccaaattttattgaaaaaattaatttttacaaatttttatgagtggctgtgtttagccaaatcaccaccaaatcga

SEQ ID NO: 2998 - DNA, 3594 bp, Heterodera glycines
tcatcattttcgcctccccccatcatatcgatgtcccgtccgacagaaaaaagggggtgccgccgtcgtcgtcgtcaacttatgcgaggtcgagagcgatgggagaagacaaaatcagtggagaatgaatgtcttaagcaaaaaaggcgctaaaaggcgcgacaaaaaatttttgatgacaaaagacggcatttttcggagataaaattgggttataatttaaagttaattcagaaaagaattaagctgataatgagattttattttggtaaaaaaagggtggtataattttgatttaagacggcgacattttttgaataataattgttttttttttggagaatttaaatgataaattatgcagaaattggcattttgagggaattttttttatataaaatgcaaagaagatagtatatttttttgaatatgacaatctattttaaatcataatttaaccgaaaattgaattaaatttatttattttattaaattataagtaaaaaaaaatcaaagttaattaggcatttaattgaaaaatgcgacatatttcaggtgaatgataagaaatcatatggtgtaaaacagtttaaaaaataggaaattcatttatatttaaatttttgtttgtctccagaccaattagggaaccatggaaatgctaagcgaaaatctaatcctgaaatggcataaaattaatgccgcacacacacatcgttttgtttacggagttgcagcacccggatttggaataaaattaatgactctcgcggtttacatttaattgcttctaaatcaatgcaattttcttgggtcgagagagaggctaatggcaggaaaatattgtaagcattgaaattcttaaatttgttgagtaatagaaggaatttaacccaaaatttaagctttcaataacactgaaaaagatgtagaatctcgagattgaatcgatattctgatccatctgggaatttatgaaaactgattgatctcgagtcgaaattttcaaatcaatctcgtggattattgtcacaatttcagggttctgatcactcacagagcagctattactgctgtcccatattttctgatcaatcgattgaactgtgtggatttgtttgatcagcacaagcatcaacagcaagagtgggcggggatgggaagcgggatgattgtgacgcgtacactaatgggtgtcgcggagggtgccgacgaactctcaaccgcaccaccaccaccatcatcatcatcacatcatctccatcagcagcatttcagtgtgctgctactttatttgtgtgtgtgtgtgtgtactcattaaccactgttattatcgataaaaaccggttgctagctgtgagtaaatgaattagcacatcgaccgtccgcccgcctgaccgccacacatcccctgcggggggagtggcgggagatggcggtaaaaatgggagaccgcggaacagtgtgcggacggttggtgtgtgggatggtgtgaaatattattaaacggttgcgcgggactcaattcattcaatttatgtaataattaaatttaaatgaaaattgattggagcggggcggaaagaatatgggaatggtcaaaagtcagcagaaaatgaacaatggacaagaatgttgagaaaaagtgatgattaaatgaggagagttgataaattagtgaaaaaatgcaattaataatttaatatatggcgcgaaacgagaaatttataaataaataaattaaattatttgaataattacaaaaatttttaagattttaattccaatgaactaaggctatgaccataatataaataaatttacattttaatagttaaaaaaaaagcaacagaattaaataaaataaagaaaaaaaaatttaagataaaatttgcaattaaatgctttaatggcttgctatgggcaaatcgatgggcaaaaacgaacattgatgatgattgtgtgggggaatgggtgttgtacgtgggtgtaaaatggcgaaaaaaaacaatttgtgtaaaagtgggaagaaaaatgctaacaataaggaaggaacgaagctgacacgacactcttctgtgaacatgagtcatgtcatcacagaagaagaagaagaagcaatgaacaaaaaaagaaaaaaaaagaaaatgcgaatgcgtaaatgtttaattttatgttcgaaaatgagaaaaaaattttaattaaaaaatttgtagaaatcataaacgatttatgcattaataatcgatgtatgaaagtttggacgcaacagaaaatttgcgtaaaattgaattttcgtaatcggctgatcacggatccgacatacatttcgaccacttcctaaatcctaaccccgattctgacacaacgtcgaaaatatcactaatccggcatttggaataattccaaattcgtaaccagactcggatacaaacatgtaaagcacacctcgatacccttagggaataaattttgacactggattttgatgaaaaattattttagccattttcacagaaatgcttttaattaaacaaaatgtaacatttatttaacccaattttgacccagattttctcatagtgtgtttgcatttgaagcaactcggagcttgattggggtagggagtgagctgctctcccgcttctgcttgctgattttgatgacgggaagaagcggtggaaaagcaatgaaattgaggttggatattttgcagcccccgcctcccccgcgggcaaaaatgggcaggaatttgagaagacgaagatggaaatggacacacacacggcgtgggaaatgaatgagaatgaaattgcaaaaccccaaatgaaggacatttaagagcaatggttgcttgttggtggtggtggcggtgctggtggggaggaagtagcggaaaaggcaattaacaaacggtgggtaaattggggtggttgaaaaacaaaattttctcgaaattttgcactgaaaaattttggaaaaaatgtgagaaacgaaatttattgataattgtgttgatgataactgaattttttcaagataaaaagaaagatacaattaataaaggctaaaaattgaggtgcaaagttttaaccgaaaattttgcaccaaaaattaaaaaaattggaaataccaaaagcaagaaattcgaccaaaacataggtggttaaaacaagttgctgaatgataattgacgaatatttttttttccggttttgttggttaaaaaaaaggataaaaatgttaaaaaaacgcattttaaaatgaaaaatttctcaaaaatagaattcaaataaatagaaaaactttcactgatttaattctcctgtaaaatatttatatattcttacaaaaagaaaatggaagaaagagaataaatctgtttatcaaaatggcaaattgtatacaaaatttctaacaaacatccgccccattcgccgactgtcccctccggcgacgcggaagaaaagtgctcctccttcctccgagcaaaagggggcgggcgggggggtggggggcattttgtggaaggaatgcacaacgcccgccggcgtgggcggggcgggcaaatgacacacatctgctgctatgcct

SEQ ID NO: 2999 - DNA, 1301 bp, Heterodera glycines
ttaatttttattttggttgtggcaagtaagtggtcagccggaatcttcatctagtctcgcagtgacagactcaaaatctttcatctaaattaatttacaattcatcttcacttaatttttcttcggtcgtaccaatttacgaattagcaattttatattcgaaaattttgcagttgataattgttgctataaccaacataaataaatatcagaaacgttacgattgtgatattaaattttgcaattgccttaatgaatatcctaattgctttcaaacaaaagtctgttctccaactcatatcttaaatattttattttttagaatatattatgctggtcagttcatatttttggagaacgttttaaagaaggataaaaataattattttattttaccgtcactagatatgcatatgtattttaaattttttattgttatgtaaacttctaatatatatatttatatacataatcatatgagttggcggttttaagaaacgccctggcggttttaagaaacgcccaaagtggcggttttaagaaacgccctggcggttttaagaaacgccctggcggttttaagaaacgcccaatgtggcggtttttaagaaacgtcccagcaccttgtggaggatgaggggggggatcagagggataggcccagaaatgccggtgatttgaggttggggggcgacttgaaacaaaatggaaacttgaatttttatacaagaaagggataataccgcagattataatttaatcagaattgctttttaattgtttagcattggtttataaaaattaaaattaattaaatgaaattgaataggaaagtttgatggaaacactaaaccaagagttattaagagcttttcaaaaaagtcgaaaatttaattcaagaattaattagactaagtaagtatctaagaaatggttgattttctgcattatcttttcaagatttttcagccgacattaatgcatactttctgaactgacaaatccaaggcttactcaaatccaatttccaccctaaatgaaggggggggggggggtgagggacaaactgcacaaaatgcttattaagcccattcatgaagtgaaaggtggagtgtgaagcaaacgagagaacggggcagagggggcggggggggaggaagaagcgcacattgtgttaatgggatgggtgagggcggggcgtgggcgcgcgcttcatcgactttcatatcccctccggagaggctttacctgccggtgctgctgctttgttggtgatgggggggggagatggaatgggaagg

SEQ ID NO: 3000 - DNA, 1054 bp, Heterodera glycines
tcattagtatgagaaaagtgtggtgcgatttgagagggtgggataaggtgggttttcgaacatattgggctgagggggcttcgatattatgaaatatggccaaccccatggacatagcaacaatattacagactttatgaaatctcttaaaatcttgattcctgaaccgaaattttttaccaacaattatggatccgcgccatctcttacttgacgctcgcgctcccgccggagatccttggaaatcccgattttttttttgactttctccgattgaattttttttttttggacttctccgatttccaacaaagcggtccccgcccccccccccccgcgatttgtcggagacgcacccaatttaaaatttttcaaaaaattgtttgtttgtgataagaagggcaacacaaaaaggaatgaatcatcttcaaaaaaaagataaaagggtaacaggaaaaatccttggctttttctaattgttcaatgaaacggaaatggccaacataaaagaacagaaaaaaatgaaatgattaattgctgacaaaaaatgattaattgctgacaaaaaatgattaattgctgacaaaaaatgattaattgctgacaaaaaatgattaattgctgaacaacaaaagaaccatcaagcaaagatcaataagaaaaaaaatggtggccaagaccaatacggatatattctttgaaaaaaatttatctaaattcaaattcgcaacaaaagttggtctcttcatataggaatgatgccaaattctcgacatgccccgaatattgttcccgttaattatggaagggtgatttaaaacaaaaatgtattaaaattaattacacagagacattacataaagggtcataatttcagtaaaatgcaacaattttgcataaacaataatgctttttgtttcttaacctttgccatcatccctatttaaataaatgatttgtcgggagacggggcaggggaggtagtggtgggggggggggggacaagtcatcactttaagaggggcaaatgtccggtggggaatgagagcccccg

SEQ ID NO: 3001 - DNA, 1101 bp, Heterodera glycines
actagaataaaatatactagagttgtccacccaccttaactttgtactacatattattaaattattagcacacttaaactggtacaaattgaaaattttgaacaatgcaattattatttttatggatttcctttttcttcaatgatgagaagcgtccatttataaagcagtgaatcccccgccaaaacagaggagaaaaggacggggcgggggtaccaatgggacggggacgacggcgaatgggacacattttgcagcagatttgggaccccggtttctgctgcttttggtgcagatggcgccgccaccgccattgccgggggcgatggaagtgtgtgtgccgaaaatgcggctaagcatgtgcccgccgccggaggggaagaaaatgctttttggggtgggcgctttgcggatgggcgaggggcattggaggggtgtggcgattggtagcgctctgttgcccccgcgggggttcaaaagagaacggtgacggggccggggagggcgggggggggggcggagggggggggggtggactggatggcgaagaagacatggttgagcacgatggaggcaccaattttgaggaggaagaaggcaaacaggaagatgaagaggaattggatgggcgcccggcccaaaagcggccccgttatgtggcacctgttgaggaggaggaggaagaagccgggaatggcaccagtgccggcaactgtacggcggaggtcgacgagctgaaggcggtgatcgaaggaatgaaaactgagcttgaagcggccaatgaagaggttggagagttgaaagccgagatgggcaagctgagcgcagaaaacggaacattgaaggcggacatccgttcaatcaaagcaaagatcggaagtatggcaataatcatccgtgggaacagagaggagcgcaatgagatgcacgaggaaatgcaagagatgaaggcggacatggccgagttgagagcggaaaatgcaaatttgaaggccgacttcggcacaatcaaagcgggcattggcggaatgagacaaatgtgcggcgagatgaaagaggagcagggcaagatccaaagaggaaatgcaagagatgcaggtg

SEQ ID NO: 3002 - DNA, 3208 bp, Heterodera glycines
  misc_feature (3194)..(3194): n is a, c, g, or t
gggagagaaggcaaatttgtggaggagagagcgcttttgtcggtgtctaaagaggggcccccaagggggggagtggatggagaaggacggcataactgctggaaaattcatggcggtggtgacaaaacaaaacaaaacaatgcacatacatatgatgagtgaaagtgctgctgtgctgtgtatgtgtattgaagtgaacaaataaagatgaactttatagtaaaaagtgggaaattaaaattgtaaaaatgaaaatttaaataaataattttaaaaaataaattaattttgggctagggttgatggcttatttatggagaaataaaaaaaaacgtgaaaaatttaatacatacaattggcataatcccatacatagaatttaataagaaaaaattaattgatgtccgttatttttagttaaaaatttcaatttccttttttacctagttttattttaattttttaattttatttttgttacctaagaaaaatgggacaaaaaaatcacaaatgcaaaataaatataaatttatagataaaatattaaatttagctatttttatgcagccacaggtccaaaacaaatccatcagcagcaaattaaaacaatggacacgcacattacccaggggcataataataaacaacacaatgccaataaaatgaaattggcaggttaaaagtttgcctgctgtctgtccaccattgtccattgtccatggatcacatcacaccacaacaagattaatggtcacaatcagcacaccccataaccaccactgactgcactcgcaaatggtcattacgcggggttaattgtccgtccgtgcgcccgccggtccatcaacaattcacccgcccatgcccacacactcaactctcaatccgtaaaacaatgaccgtgaaattggcttggcgcattgtgctggtgggcaaaattttcgattagacaataaaaagaaaaaaaataataaaataaaatgtggaatttttttaagtaaaaagagtaaatgcgttttatgcatattgaaaaatataaccttgatatccttatttaaatatgtgtttattaaaataaattaattctttaaaaatatttttaaaaaatttagacaaaataatttaaaaatatttgttaaaggcaaattaaacaattttattagcttcttaaaaataaagcaaattaatttaaaataacctaataagaataaatgagcaacattgaataacttaactagacaaatgacttaaacaaataccaattaaaaatcgcgtaagcctactcaactcaaccaaattaatcgtcttaattaaattaaattattccataaataaatttagccactaattataagccaattaggtggatggttggcaagcccatgcccaaaagcccaagccgtggtgccctcccctgctcaaaacaaaaaataatcgtcgacgctaaactccgccaatgtcgttggctaaaacaaatatttgtatattatttttggggctgatgataatggtgatgatgatgaagtagcctatttggtggcttttccaatacaaaactgtgctgcttttgccgatgggagggatatcggaacggatggctgtggagataaatgatgatgaacgatggcgcggggcggatgggatatgagggatatgatgaccttgatcccgtcacgaaaaactttatctcatcactcatcaacgttcccagaggggggccgggggggagggggagacagaagaggcaaaattaattggggataaaacaaatattaagaaaacggttggtgtttattattttaattatgcgcataattatgcttaggtatgccgattttgcctggggcaaaggcaggcagtcagatttggtggggtgataagctatgttggtgggcataattagaatcatttaaaataattatgtaaaaattaattgctttatcgtttattggcgcaaaaagccaaaatttaatttaaaattatctaagaaaattaaaaaaacaatacaaaaaaccaacctcatacgagtcaggaagttttccaaaaataacgaaaaaatgaaaatgttacaaaaaatttggttattttttaatggtgggaaaggatgaaaatgcttagattttggtggacgataaacatttttgagcaaaaatgaaattgtttttaagtataagattaatatttttttgaaaaaaatgtagttattgtatttaattcattttcagcgcttgggatccttaaaaatttagtttttttttaaatttcggtatcctccttgggttctttttaaaaatcagggctatttatatattaaaaagcttttttataaaaatatattttaaaaataataattttaaattcactgacaatgaataccaaaatttaaatttaaattcgttttttcctttttttgtcaaatgtaacatgcaataaattttcttgtgaacacactctgttgcgcaatttggtcaacatgaacaaacattgcgcaatctttttcgttcaaaatgttcaaaaaacgtaaaaagcgcattcatctaatctcatatattttcgcgcactaaaaaaaattaataaaaattaaatttttgtaaaattaaaaacgaaaattaataattcaaataataaaattgtgcggcaattggtcggtggcaaattggtcgtatagaaaatgttagcaaattatttacgcgttatgcattatgcattcatctgctccattagatgcatctcttctgctgatcgtagcaaatcgctccgatcgttttatttattgtaaaaagctgccgatggattttggtttgaacaattgtaatataatggaaaagacacaaaatccggacaataaaacagggaattctttattaacaaaatattttcttaattgaaaatacgaataatttatagatttatacgtttatttagatcttataaagagaagaaaaatattttatttatgaatattttggctttaaattaaataaaaaaatcaattggtgattttgtgaataaataaattaataattctccttaaaaacataattgatttgcttaattcattcacataaattcgtcaattaattcaaattcaatttattattaaaatattaaaaataaaaatgcatttttgcattttgatattttttattattttctttgcttttaaaattaaatccgccgaaaatcctgaccanaattttgatgaaat

SEQ ID NO: 3003 - DNA, 2133 bp, Heterodera glycines
  misc_feature (2071)..(2071): n is a, c, g, or t
ctccctttccagatagtcaataaggaattaaatttaaatatttaatttattaaaattaaatttatttttttgggatttcccaatactcaaattatatttcacactttattagtgaattttatcgaacaaatatatttataatgaacgatttgaacgattgagcgataaaaaatggtgattttgcaatggtttaaatacggcaattttacataggcgggctgacagaaatttaaatgtaaacaatgctgactaataaaaaggtttaaaatcacaaaggttatgaatttggcgtaaaattattttaaacagatgaatcataaaattttaaattttcgtcgctaaggatgaaattagcgacaaaagaatttcaatgaatttatccagtctttcacccggttaatttcgctgcatttaaaccaagtgattccgatattagagaagaaaataaaatggacacgaatttgttgagcctaaaaaccgtattatgacggtttttgacaaaaatttctgaaaatttacttttgaatatttaggtatcataaatcctctttgcgattcctttcgattaatttgaaaaatattctctaaactggatacacaaatttcattctacaggtttaggttagcctggtaaaaactggagaaattcagaaatgtaacttgaaatgccggaggattgagtcccagtgattgaaatgctggagggttgagttccggtgattgaaatgcaggagaatgagtcccagtgactggaatgttggtgggttgagtcccagtgattgaaatgctggtggattgagtcccgttgattggaatgttggtgggttgagtcccagtgattgaaatgcaggagaattgagtctcggtggttgcgataccgaagaatcaggtgaggttaggttccagcgattggaatgatggtgagttgagtcccgctgattggaatgccggagaattgagtcccagtgactggaatgtcggagagctgagtcccggtgattggaatgcaggtgtgttgagtcccggtgattgaaatgctggagggttgagtcccagtgattgaaatgcaggagaattgagtctcggtggttgcgataccgaagaatcaggtgaggttaggtcccagcgattggaatgatggtgagttgagtcccggtgattggaatgctggtggattgagtcccgttgattggaatgttggtgggttgagtcccagtgattgaaatgcaggagaattaagtgttggttgcgataccgaagaatcaggtgaggttaggtcccagcgattggaatgatggtgagttgagtcccgttgattgaaatgctggagaatagagtcccagtgattgaaatgctggagggttgagtcacgttgattggaatgttggtggattgagtcccagtgattgaaatgctggagggttaagtgttggcgattgaaatgttggtgggttgagtcccagtgattggaatgttggtggattgagtcccgttaattggaatgttggtggattgagtcccagtgattgaaatactggagggttaagtgttggcgattgaaatgttggtgggttgagtcccagtgattggaatgttggtggattgagtcccgttgattggaatgttggtggattgagtcccagtgatagaaatgctggagggttaagtgttggcgattgaaatgttggtgggttgagtcccagtgattggaatgttggtggattgagtcccgttgattggaatgttggtggattgagtcacgttgattggaatgttggtggattgagtcacgttgattgaaatactggagggttaagtgttggcgattgaaatgttggtgggttgagtcccagtgattggaatgttggtggattgagtcccgttgattggaatgttggtggattgagtcccagtgatagaaatgctggagggttaagtgttggcgattgaaatgctggtgggttgagtcccagtgattggaatgttggtggattgagtcccgttgattggaatgttggtggattgagtcccagtgatagaaatgctggagggttaagtgttggcgattganatggttggtgggttgagtcccagtgattgaatgctggtgagttgagtcccggtgattggatg

SEQ ID NO: 3004 - DNA, 4258 bp, Heterodera glycines
  misc_feature (207)..(207): n is a, c, g, or t
gtcatctcatagtagggaatgattagcttttcgagtttttctttaaagtgatttgtatacatatttagccatttatgaagggcgttactttatattaacaaattaaagaaattatgggaaattataccgtcaatcgaaaaatttatgtccatatttttgcattttatgtccatacttccgatttccgtaccccgctaggtccaaaanagtatgcatgaaattgcgaaaagtcgaaattttgaactttttattaataaattttttccaggcttgaaaatctttttattttttgtaaggctaatagagcatgttaagagctttcgaataccaagattgttgggtttagatgccaaagaacaaagctatagtggaaaaacatgctggcgcccaaactgagcgcccaaacgcgcgcgccaaaagtgcgtgggtcccccttaattgggtgcccaaattccccctcccctcccccgagaatacaaatgatttatacgtttacgtggaatatttttcagttcatgttcactgtttggctttcacgtaaaagttgttgcattttccaatataaatttggtttatttggcgcttattttaagtgcaaaatattggttttttgatttgtttggatgttcacgtaggaatagaaattgtttgattctaagtttcgcgcacatttcaaaagtttcgcctgccgattcaaccgaagtcgaattcttttttaattttgaattaaataaattacaaaaattttaaaattgttaaacaaaaacacttaaaaaaatttcagtcgcattttttgttcaaatcgaattgctaattgtgataattttgttcaatattatattaatgcgattaattaacttgctcaatgtaatatttccaaattcgcttcactcatttatcatttattcttgtcatttcttctcgctccaccattttttagttcgaattaattgacgtatttttccgcttttttaaatctactacttgtaactcgttattggctagggtaattaggatacgaacacgagcatgattattagcggtgttaattaatagtttattccttactaaaattattaaatatttatactttattttgttttctttaattaatcaattttatagcatttccaattcagcagacatttaatgtttcaaaaaatttgcatttttctcttccacccaatgctgaataatcgttgaaagtttaaaatttccttcttttaccatccaagttcttttaatatttttaaattaatccatcctataaatatacctaaggcggtcatttaaaaaaattttaaaaaaaagataaaacaatgaaaaaattggaccgcagaaagcaaaacccaaatttaatgttaaaatttaacaaatttaatgagtttttcaaaatcaaaaggtagataaaaacccaacacgaacatgaaacccgcaattattactgcccttttaattgcgtttattctgcaccaaattaccgccgtaattgaaaatgaatgtggacaatgcaaacattgtctggataaaaatggtaagcatttggaataggtttttgtaatattatggaatgccaaagattgttttctcaacatgatcactgcttgggctcagaatggcgaaatcgaatggccacgggtgttgggagagaacccaaatttgtggggaaaggaacaaaaagtgttggccgatgcgaaggcaaccgaagacaaacagttccaagacccgaaatttgaacaaaattttaagtgggtttcaccaaatgtatctttatttcctaatctgcatagcattttgttgtgcacccattaatttgccttaatttagggcaatgaatgccattggtatggctcatcgcggtgcctaccattacttcagaggagagccgggaagtgccggtgccttggagcaagtgcggcattttctaaacacaagcataagggcgggattcaatgtgcacaaagactttgctgtggtcaatgttgaaatatgtgagtttttaaaaaagtttcagtatattttaatattttaaaatattaattgccaacttggttattctcggacagtgaactcaaaataaatgaggaagggaagcgggtttacctaattagcatataattccaagaaattgtgatcgaaagttgctaattcaaattagaatctcattaatagtacactgttaattattttgttatttaattctgttgttcagataagaatgaaggtgcagacaaggaccaattcacgggaaagctgctcaattttgtcaagttactaaagagcaaagtgccgaaccttttcatccacaccagtgtcgatcattggtcggcactgatcaacaacgatcatgacgagttcttcgctcaatttccgctttcggtgatcgattatgacagtcaacagagtccggcattgccgcgcccgtggaaagtatggcagcggtggttgcacacaatgactgtgccggtgaatggcatttcgggcaatgtttggctgagtcgagtgaattgcagcgtcaaaatgatgccaaacattttctgatgagcgaaaaacaaagtgatcattggaatcatcctgttgaaaaatttatgaaattttaagtaccaaaaacatttcaaaacaaaggcaataaaataataattttatttttgttaaaattaaagacaatgctaatttttgtatagaatgtataaataaatcaaatgcttgaagtgaattcgtgaaagtttggtggtgcaagcgaaagtgaatttggtcaaaatgatccaaaaatatttaaattattttttaatgccagaattgtttggagaattgcatgagctaattggatttattggataaaatttaacatgagctctagaattttctttgcttttgcacccacaattctttacttaatcactgatttgatttatagaaaatgttacgatagcatttttgccttaaaaataacaaaaataaatgtatataaaaataatgaatgtgagtcacaatttttaaaaaaagtgggagcccagccgcttcatcgaccaaaggaacgacaaatgtccgtatcaacggaacggacaaagtgttcccgctccatccgatggtcagtcaaaatggccgaccattcgacgcgtatttttaaccgcccgcgtccctcctcaattagaactaattgctcctccaggcgaatttttttattgtttttgttgttgttgttgctgctgctgttgtcctttgtccgtccctccacaaactgtcgcacttcgctctccgcgacgaatcgcaccgaacgattcactggactcacacaatcataagaaacaaaaaaattaatatataagaaagaaaatattcagtcaattttcccatgggttgaaaaaggaaacagagaaacaaagaaatgtatgtattctttcgtttttgtttttttcttttcctctttctatttcgcttttactgcgctcttttctttttcttaacattttataatttggtaaaaatttgtgcttacactaattggacaagtcaaatatatttttcgtacatttttctccttttctttaaattttgtgttctttaattgccccatttttagattcatcgtaaaatttttaatgtattcagtcatgtgactaaatggtgccactttatgtgttaatggcaatgccattcttttaatttttctccattaaaattttttattacaatttttttactgctttcgtccgttaccggaaaatgcgtcataagtcaggatttcttgaaaaaacaaacacggtagtattattacctgaaatcataaacgtgggttggtaatttacagaatgtttattttatggatttgggtaatttcaatttttttttgcctttaaaaaacaatcgcaaattcagtatgatgtttttatacaattttgtcctttggtaattcaatataataatgctacacaactttattttagaaaaacttattactgactcattttccgggagccctttcatcagacataaatatatgtatatagcgttattttctgttgtaattcaccaaatccccacatggattctcccggcgaagggtcagggatctctctgaatccgaatattccgtttttaattagcaattaatattttactattttttgatttgtttttcctaattcttttttgcttattttgatatgagtaattgacaactttttttcgccaaaaaagcccacaaaaattaaaagaaacaatgccataataataataatcccttttattcattgta

SEQ ID NO: 3005 - DNA, 1496 bp, Heterodera glycines
  misc_feature (63)..(63): n is a, c, g, or t
  misc_feature (119)..(119): n is a, c, g, or t
  misc_feature (1399)..(1399): n is a, c, g, or t
  misc_feature (1477)..(1477): n is a, c, g, or t
cgctcgtttatgtcactggaagacaaagtcagctttttcatttattttggctaataattatantattttcaatttaattttccccacttttcatttctttgccccccccccccctttanaaggacacttcgtcagtcgtgcaatcgtttgatcgcggccaatgccttcttttccggtctttttggcctttcgttgtcaattggttgggcttttgtccttcttggccaaccttttatgtttgaaggtgccaaaaaattaaaaaaaacaatttcgattttcaaacattttcaggcccctgcgttgtcgtccaagtcattcctttgttctgtcgtaattttggcttgagtttgcttttttggattggttttgaccgattggtcattgcgctgtccgccaaatcatttttgtaacatttttattgtatattatattattattatataattattattaatttattaatcactcttttcaattttattttagacatcgtcaccagtcgttctactcttttctgatcattttcggctcgtcacttcacgcgggtttcattgtcatcacggtcattttaatggccattgaatacccgcaacagtgagcaattaattaaaaatcccatatttgatgctaattaaattggcgattagcgtcactctgtgcttaacccacgacgacaattatgttggcccaatgtcgttgcctttgcttctcgtcaatgcggcactcagtgcactgatatttctgctctacattttcttggcggttgtggtcacatacaaaaaggacaattcaggcaataattaatttgccaactaataaattaattggctataatttacctatttaaattttaattgccaatttaacttcccccgttcgtttagtgagttcccaaatcacacggcgccttctccgctctatgatggccattatggttgtggtggtggccggcttcaccatgaacaattttgtaaatgtgttgttcaatttgatggtcataaaaactacagaaattagcaaagtgaatttttgaaaatggcatttttcaatatttggcatttttaattctccattttaggcctatacgtcgatggcattgtcttgccttttggcattggcttacgcgagcaatgcgccgttgttgatcattttcaggtgaacatcaaagcaaagaagcaatgttttcataaatgaataaaaatatttgccggttaagtggcgaatatcgaaaggcgtatttgcgcacttttggcccatttttggagcgatttcctttgatcggcagcgcatttgtacaactgcagccgcttactgtgaacaacaacagcaatagaacgataatgaccaacaaacagcagcgaattcaccgaaacttggccaaagtgacaccaataggtgngccattagtgaaaggggaaaattgagacaatttgggacaactaattgtcgctaattaagtcaattaatgcgccagtcnaagagaaagagagagagag

SEQ ID NO: 3006 - DNA, 4250 bp, Heterodera glycines
  misc_feature (31)..(31): n is a, c, g, or t
  misc_feature (42)..(42): n is a, c, g, or t
aaaaaaatgaaaaatttattgctaaaatgtntaaattaaaanaattaaagttcaaaccgaaaatgcgtgcaaaatgttaggaccaaataattattgttgttttgttatggagttcccttcatgtttatttatcactgtttgtattgtcctaatgcatcaacacaatttgtgctgtcacggcacaagaaatgccgagtcgaacacgccggtgccatgagaaacgcctccctcattaacctctgccaactttgtgcgcataaagtgccctctttggacattgtgcaacacttttccctcacttctgtcgcccaacaaaaagccaaaaatgcccaattccgtggtcatttcaccgaactggggcttcttatgacctcggatcataaaattctaaaaaataataattttttaaaatgaattattgtaaattcagtttttatttattttttcctcgcctttacgcgcattgcgctgagtttttgcatcaaaatgtgtgcctcccgttcttcgtcggtaaattgctgcagtttctccctgagtttttcgtcgaagaagttgtggccacccccctccaggttcggctttatcacatagttttcgggatgaacaatggcatcctatcaaataaaaaaataatcatttattgctaaaatatttatttttatttattcaaattaaattattatttcatttgttttatacgtttatggctttttgcgtgtcttcgtctttgtcagtcaaactccacaggcccgcgaaagtgcttcttaccaacggcacaatttccaattggtcctccaaataatgctccaccatgccgggcttcgccaaaatctttggaaatatttattttttaaataatcttaaaattgttttgtctgccacctgttgcactttcttttgtgtggctaaatcaagagcaattgttggagacatctaaaaagagtaaattatcagaggagaatgtatactgattttttggcatttcttccaaattccatgcccatttaattaatatatatgaaattaattaatttcatttgctttgttatttaattgttaattaaaaataaaataaaaataatataaatatttatttttcaaatgcatacaattgttgttgaacgttcgaacaacaaaagagtttcccaatcatgttcactgtatttcggaggctcattcaatttgtaaacaactcccactgtcagtccctccaattgcaaagaatggtcgtcggcgttaagagtcaatcgaaaagaaaaattaaatattttaattaaaaaccattaattagcattttactttccatctttgtacattttagcgcattcgggcaaagacaagcgtacaatttgcagtgcttctccttcttcttctgccaaattcgtaatgtcgtactcaatgtgacgctggccataacggtttttgcttgttcggctcgcaacgaacaaaatgatggcatttgggtcggcgaaagctttcctaaataaaaaacgaaaaattaaattaattaaagaaaatttctcccaccacgctttgtacaacacttctgccgcaccaaggcccgcctcattgtccggcacttggtcctttgtcgcgtcaatgcccgccctccacaatgtccgccgatgcatttctgtgattcgactcgaaacggaaagcccaccaatttggccggcattcatttcaatctgaaaaataaaaataatttttatttatttttaaactaatttttagttagcccatcatttacctgttttagctcgtacttctgttcatttgtttctttgtctgttatcacatggcacatataatccttaagaaaaatataattcgatacccaaaaaaaaattaattaaataaaatatttttgccaaaactcccaccgatcgtgccaaaaccactgttttcgtttgtttgatgccttcgtcatggacctgtttcagaatgttaagcattcgtctcacattttcgtttgttttcgcgacaggttcgaatgtttccgacaaaaagtcaaaatcatttgaaatgcgaaagtaaagcaaattgaaagcctaaacaaataaggaaaacaattatttaaaataaagtaattagctaaataaaaaacaaataaataaatgattttgctttaatgaccttttgcactttttctgctaatcggaacaaatttcgcggaaatggagtcgggaagagtgaaaatggcgtaatttcggcaacatcactcctaaaatttcatttatttttttccgtaacaaatccaacaaaaagtgattttgttgattatgtaatattttattaataattaaagacccgatttaaaaatagacaaatggtaaaaaagcacaaaaattgaagaataatactgaggaatttttaaatagaacaaaataaaaaattagaaatagatttttggtgttttaggccataacggctagacaaataatcagcaaaatgctgcaaaacggtcccaattaaaatgaccttccgttgtgcacatttggcaaaacagtaagtgaaataatttgggcaaaatcttttgcgtcattagttattgcttggatgtcaagttcttcattgtcttaaaattaaatgatggtttttttatttagagctcgaccaggacttgagtccaggcctgggtttttctgcgcctgggttttcctggatttgctcagaaaatcaaggtcctgatcaaatatgaaacccagatccaggtctagagttggcataaaaatctatattttctggacaacatttagaatttataaaaacaccaatgatttagttcaaattataaaaatgaaatggattaaaatatattattatcgtaattagaaaaagggagatattccaacactattaacataatttaaatctttgattgacttttttattacaaatttcaaaaaagcaaagccaaagcctatgtttttcctagaccttggttaaaatccaggtacatgtctccaggccttgtcgagctctaattatatttgactaattaccctccttttggtcattgggtgccatcgcgacgacacaattcaaaaacaccacaccaaaaatgataagcgacttggtgtcaaacatttattatttatcgtgaaaataaatgtaaaggaaataattttagttaaaaatatattaaataataaaaaaaatgaatatttttccctatttattcgccaatgaggagaactgaaaacaaaattcacatgaaaattttaatttgattgacgaaaattctgtggaattggccaggtgacaggaaggaaatcgaaatcgatataccaaaatgagcaaaacaaaaagaggaaatgtaggaaataatgtctgattttaataataaatatttaatgaaaggttgtcgattagcactgattaaggcaaattacaataaatatttcatcatgatggtgcaacaatttttacaaaaataaacatggtataattttttgactatatgagcaaaggcaaaaatgaaaaactccgaaccccaactctgaccgatttggtccaccccgacccggacttcgactccggcctagctgagcccgaaaaactccgacttttctcacctcgaagggtcggtgccataccctagaaaaaagcaaggagaacgctaaagttgcagaagtgtcatggatgtaacgcagaaatagcgatcaaattttggagtggtggcaagaattatgccggatgcaattttcttaaaacttacaatttgtaggtttttttcgtcaaaggtcacagaaaaaaatgcagttgatgaacaaatcttttcccgagtaatgaatgaactcaaagcctaaattaaaatcaaaaaattcaatgaaaaaagttttcctttctgtccaaggtgatcaatgcctggaactcctacgaggacttcaacactttcgacaatttgccagtgattggcgagcatttgatggacgagtcgttcttccaattgtgcggcttcggcggctatgggccccaagtggcaatcgctgctggccgaatgttcatggaacgcatcttcgactttgcctattcgacggtcaatttgcggaagttttacatgcgtcggataatgcatggcgaacggttgcacgagcagttcagatgtgtatgaagcgaattgttgttggaacggaaatttaggggggaaattttggaattgtttgtcattcatttttttgttttatataaatgaattttttttgccgataatttgttttattttccttatttaattgactttgtgt

SEQ ID NO: 3007 - DNA, 1110 bp, Heterodera glycines
atacgaatattgaaaagaaggcgtaaatggctctgaagcgtccataggccgcagaccacaacgtaaaatgggacaacattcataaaaaaaggttggcctcaaaagggcccattcccaagctaatttcggaatttgctgataaaatcaaatagcctaaattatatacgcattataaaaaggaaatgacagaagactcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcatccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcgtccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcgtccataggccgcagaccacaacgtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttcctgaaaaaattttcaaaaaagtgttccg

SEQ ID NO: 3008 - DNA, 2051 bp, Heterodera glycines
  misc_feature (35)..(35): n is a, c, g, or t
ctaatttcggaatttgctgataaaatcaaatagcntaaattatatacgcattataaaaaggaaatgacagaagcctcgaatgttagttatattgcgtgtcacaaaatctctttcggaaaaaattttcaaaaaagtgttccgaaaaaaagagatagtcgtttttacatacgattattgaaaagaaggcgtaaatggctctgaatcgtttttacatacgattattgaaaagaaggcgtaaatggctctgaagcgtccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctctttcggaaaaaattttcaaaaaagggttccgaaaaaaagagatagtcgtttttacatacgattattgaaaagaaggcgtaaatggctctgaagcgtccataggccgcagaccacaaagtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctctttcctaaaaaaattttcaaaaaagtgttccgaaaaaaagagatagtcgtttttacatacgattattgaaaagaaggcgtaaatggctctgaatcgtttttacatacgattattgaaaagaaggcgtaaatggctctgaagcgtccataggccggagaccacaacgtaaaatgggacaacattcataaaaaaaggttggcctcaaaagggccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgattattgaaaagaaggcgtaaatggctctgaagcgtccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgattattgaaaagaaggcgtaaatggctctgaagcgtccataggccgcagaccacaaagtaaaatgggacaacattcataaaaaaaggttggcctcaaaagggcccattcccaagctaatttcggaatttgctgataaaatcaaatagcctaaattatatacgcattataaaaaggaaatgacagaagactcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcatccataggccgcagaccacaacgtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaagagatagtcgtttttacatacgattatgaaaagaaggcgtaaatggctctgaagcatccataggccgcagaccacaacgtaaaatgggacaacattcataaaaaaagg

SEQ ID NO: 3009 - DNA, 1760 bp, Heterodera glycines
aaaaattttcaaaaaagtgttccgaaaaaaagagatagtcgtttttacatacgattattgaaaagaaggcgtaaatggctctgaatcgtttttacatacgattattgaaaagaaggcgtaaatggctctgaagcgtccataggccggagaccacaacgtaaaatgggacaacattcataaaaaaaggttggcctcacaagggccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgattattgaaaagaaggcgtaaatggctctgaagcgtccataggccggagaccacaacgtaaaatgggacaacattcataaaaaaaaggttggcctcaaaagggccattcccaagctaatttcggaatttgctgataaaatcaaatagcctaaattatatacgcattataaaaaggaaatgacagaagcctcgaatgttagttgtattgcgtgtcacaaaatctctttcggaaaaaattttcaaaaaagtgttccgaaaaaaagagatagtcgtttttacatacgattattgaaaagaaggcgtaaatggctctgaagcgtccataggccggagaccacaactatatacgcattataaaaaggaaatgacagaagcctcgaatgttagttatattgcgtgtcacaaaatctctttcggaaaaaattttcaaaaaagtgttccgaaaaaaagagatagtcgtttttacatacgattattgaaaagaaggcgtaaatggctctgaagcgtccataggccggagaccacaactatatacgcattataaaaaggaaatgacagaagcctcgaatgttagttatattgcgtgtcacaaaatctcttcctgaaaaaattttcaaaaaagtgttccgaaaaaaagagatagtcgtttttacatacgaatattgaaaagaaggcgtaaatggctctgaagcgtccataggccgcagaccacaaagtaaaatgggacaacattcataaaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctctttcctaaaaaaattttcaaaaaagtgttccgaaaaaaagagatagtcgtttttacatacgattattgaaaagaaggcgtaaatggctctgaagcgtccataggccgcagaccacaacgtaaaatgggacaacattcataaaaaaaggttggcctcaaaagggccattcccaagctaatttcggaatttgctgataaaatcaaatagcctaaattatatacgcattataaaaaggaaatgacagaagcctcgaatgttagttatattgcgtgtcacaaaatctcttcctgaaaaaattttcaaaaaagtgttccgaaaaaaagagatagtcgtttttacatacgaatattgaaaagaaggcgtaaatggctctgaagcgttacataggccgcagaccacaaagtaaaatgggacaacattcataaaaaaaggttggcctcaaaagggcccattcccaagctaatttcggaatttgctgataaaatcaaatagcct

SEQ ID NO: 3010 - DNA, 2803 bp, Heterodera glycines
  misc_feature (50)..(50): n is a, c, g, or t
taaaaattactttttttggtatttttaggcaacatcccctaacttatttntttctttataaattttcaaaatatgtaactaaatgaaaatatgtacaaaaatatttgccgaaattttggatttttttttgaggatttccaaaaatttccgtaaaaaatactcaaaatatgtaaaaaaaatgaaaatatatatgaaaaaaatcccgaaatatgtaaatatgtataaaaaccccgaaatatgtaaaaatatgtaaataaaagtcccggtttttgttcgcaaacacaaaaaagatgtatttttcttgctatttagagcatggaaaagccagggaaaaaatatgtatttacataaaattgacagccctagtaatgacaaaatttatccaaaaaagtaaaaaaataggccaaatcagtattgagctaaataatttttaaaatcacaaattcttgtcaaggaaaaaataaattttggggattgatttttgagaaaatttttcatttcttaggcgtgcattttacagaaatttttgggtcgattcttaggggtttattttttgaaaaaattttaggtcggattcctaggggataacaacaaatttttattcacaagcaaaaatgttgaaaatagttttttttttaattttatagttttttttgttgctaaaaataaaaaaacttttaggccacggagagctcaggaaaaaaatagtgaaaaaacgttaattattagcactagtaattattagtaactatttgctaatataatggttagcatttgcaaatttcgtattttttaatatgttagagacatgaaattattgtgccgtcatttctcaacaattgcccatctctttgctttgtctttttcaattttggcgatctcttcattgaatttccggccgatgacaatgccacggcatcggatggacaagcggtggccaaatggctgttcactccacacccaaacaatgtgccaaaggtgctggttgcagatgcatgacgtgaatttggcgtcgaagttggacgccttcaaagcggtgcttactaatttatttatttggcgtttttacggtctttggagtcgctgaaaaaaacccttattttttcactattttggtgttttgtcactttttcccactatttcgacattgtttggaaaattctcaacacctctaagaatcgacaaaaaattcacccctaagaatcaacctaaaattaaaaaagacacccttaagaattggaaaattttcaaaatgtaatttttgactgcgtggcgcaagtgtccggttttgctaggcggcccaatgccgcggcgcaaaagtcacaccacatctctcatcaaagtagccatcattatgggttctcgtatcgccccaacccaaaaagtggcattaatttattatttaataagtttttccacattttaggcattttccaatgcttcttctcccgtcaattttatcgctgtcatttggtttccgtcgtcttttgctgcttctgttgtgccctttgatctgatcaacgaattgactcgggaacaattggcattgaaaggaactgagtttagcagatgttttctgctggtccgttgtccaattgcgcgagacgcgagcaaatggtcaaaatgggaaaaggaagcgattaattggcgaattggtgatcagtggaacagaattgacattcaaattaatgatcaggatggaatcgaagatggatcagcgaatgctttttcaaaaatccaaaataaatttgaaaaaagaatgcttttattccaaataatgttttaattttgaattactcaatctcaagttgattgaagcgtattttgctgggcagcgattggtcgggcaatggaaatcccacaaaattggcaccaataaacacaaacaattttgccaccgctgcgtcactgtccttggaaactatgactgaaccccaaattgtcaattcgcgtttgccatcgaaatgcttgtccaccagagaattgaaacgtggcgaaatcagtgccaatttgagtccaagttgagcgtggtcaaaaagggggaaaatatccatccaaacgtcaaagcagacccagctgaaactgtgaaaatggtttagctaaataaatgaagaatttgtgacttttaaaattgtttaccgtcggttcattttcaggcaattagcacaatttgccttatttcaaatgtggtcacacaaagggcagaataattatgttggaaatatttttgcacaatgagagaccaatcgaaaaacaaacatttttatagccatgaaattgaatttttttaaaataaagataacgctggtcaagaataagatttcggggttaaaaatcagaaattgcaaaaaattatgccattttgaattgatgaacgaacgtactcaagaaaaactgacagtggaggaaggtttaggcttttcgaagttggtttgcacattttttactgcaaaaaaaaatccaaattgatcgtaccaacaaaaaagtatatttaatgatcacgtcaatttcaaattccataattgaaataaatcaatcacttttcagcaattcaatcacttctgctgctgatcactttagccaaaagttgcgtcgagaagcctaaaaacagaaagcaatttattttggatttttgaaaaagcattcgctgatccatcttcgattccatcctgatcattaatttgaatgtcaattctgttccactgatcaccaattcgcaattaatcgcttcttttcccatttgaccatttgctcgcgtctcgcgcaattggacaacggaccagcagaaacatctgctaaactc

SEQ ID NO: 3011 - DNA, 5391 bp, Heterodera glycines
accaaatgacagcgataaaattgacgggagaagaagcatgggaaaatgccctaaaatctgggaaaacttattaaataataaattaatgccacttttggggttggggcgatacgagaacccctaatgatggctactttgatgagagatgtggtgtgacttttgcgccgcggcattgggccgcctagcaaaacccgacacttgcgccacgcagttcgaaaaatttaaacgtagaaatgcgtttttgagctcctttcttcaaatcaattgagcaaaaaaaatagttaaaacctaaaattcccagccctactaatacaataattaacgtttttttcactatttttttcctgagctctccgtggcctaaaacgtacgaaaacctatttttattttaagcttaaaagatttttcaagttttttcggttgttggtaagctatatttcgaattattgatactattttctagtttttttatttttagcatcaaaaaaactataaaatttttgcttgtgaataaaaatttgttgttatcccctaggaatccgacctaaaattttttcaaaaagtaaacccctaagaatcgacccaaaaatttctgtaaaatgcacgcctaagaaatgaaaaattttctcaaaaatcaatccccaaaatttattttttccttgacaagaatttgtgatttaaaaattatttagctcaatactgatttggcctattttttttacttttttgaataaattttgtcattactagggctgtcaattttatgtaaatacatatttttttcctggcttttccatgctctaaatagcaagaaaaatacatcttttttgtgtttgcgaacaaaaaccgggacttttatttacatatttttacatatttcggggtttttatacatatttacatatttcgggatttttttcatatatattttcattttttttacatattttgagtattttttacggaaatttttggaaatcctcaaaaaaaaaatccaaaatttcggcaaatatttgtacatattttcatttttttacatattttgaaaatttataaagaaaaaataagtttgaaaatgttgcctaaaaataccaaaaaaagtaatttttatgtcattttgtggccatttcatattttacggggattttctttcccaaaaaataccattaaaaaaattttatttacatatttggagttttttgtacatattttgggatttttcttacatatttatgtacatatttggaccactttttgtacatatttttggcagccctagccattacacccctaaatatgaaagtttttagcaactatttacccatttttagcaactattttatggggtttttagaaactaaaaactaattattttggcagtttttatcaactataaatataagccctaataaagacactttgttttctttttaaatctttggcattttgttttttacgccaacaattttctccgtttttttaccatccatgacttaacttcaaaaaattatccttaaacaattttaatggtttttttcatgttctaaaacagggattgcacagaattccgacttacagacattttggggtcggaattccgatttccaaaatttgaaaaatgtcggaattttttaactttttttttggattttgccttcaaaaggattattgtaaaattataaatttattaatttagtataggtatactttttactttattcacagctattgtatttcaatttcaattctttttattccaattttccgcactttcgcaaatgccaaaatcgaagcgcgacagagttggtcagcaatttattattcttcagccaaatttgtccataattttcttcaatttgttttttccttcagtttctctcacaaaagtgaagaagaagagccgcgagggcaaagaaaacattttgaaagaggcgggaaaaaaatttgtttttttttgaaaattccaacaaaaatttaggtcagagaatgcgtggagcagtacaaacatttgtttgtcttctcgacggagaatttgcgctctgcaaggctggcggaggtaaaaattaaaaaaaaaagcattttttccataaatttttgggacggacggtcataaataccacgtttcgttgagtttaaaaaaagttatggccaaaaatttcggaaaatcagtttttttaaatgttttttgtcataacttttaaaattttgctgacagatagagaacactagagctatcgaatggtagataatacattggttcaatttggactaaggaaagtgggtacttgtgggttttcggcctacaccacaaaatcgctgcgaaccctccccccctcttttacaccggccctccccttcgctgcgaaccctcccctcccccctcttttacaccggccccccttcgctgcgaaccctccccccccccaaaaaaatgtatgttggtaatactgacttttactggtcccataaaaaaggaataaaaaggggttttttttttacaatttttcgttctactcgagggttatcggagctcacgcatatgacatcagagttatcatatgacataatctaatctgtgattttttgtcaagtctttgatttacctttttaaaattttgtggtgtaggcccaaacccacaaataccggaaagtgttatattaaaaaaaccccggactgtcgtccaattgtcccccttttcataaatgccacagtttttgaaaatcagtaaagtttcgaatgccgttttttgcggtggaattcgttggttttatgctaccccatgaaaaacagcttacaattagtaatttcataagggaatataaaatgataatccacgaatttttcgcattcattaaagcccttgaaattttcattttctttggaaaatccgaaataaaaaaaacatttttttaaattttttttttcacaaaggtccgccaacatttcaagcagaattcgcggattttcttcgccaaaaacaatttgatggccgtggcgttgggcaaatcggcacaggacgaacaggttggagagggaaaccaacctaaaaactgtgacttttacaagccatggcaaaacgctcaatttcaacccaaccccgacacactgacaaaaaaaaaattcctaaattttttggtttgaacaactcataatttgggagtcaattttatgcagccataaaaggcttttattggcagattttttttttttttggtttatctgacgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttgacacatgccagaaaaaattaattagcattttgtttaaaattcgtgcctctcccgccctccctctaaactaatggtcgtgcatctgtttaatgccaaaatttttcaaaataaattacgcaaaaaattcccactttctcttaaggacattttcatattgggcaataaattgaaagttttaacaaaaagagtgatttttgaatgataaaaaaaataatagcaattttcagaaatttcctccccccccccttcggaagtaaatttaaatttaaaaaaaaataacgcactccccaatttaggcaaaggaattgcacaaagtgagcgcacttttgcggggccaaagtggactgatgttcaccaatgcgaaggcaaacgaagtgcaaaggtcggcgggggataattccaattttttcgtaaatttatttctttccttttttggcgggtgctcatttggtggaaaatttttttaaaggttctacgaattcgaagcacctcccttttttccattttgtttgcatttgccgtcccaatttttaaaacagaaaattttttcacttttttttttactttgcgacgctttttttaattcattttttttaatttcaaaggcacttacacagaagagacagtaaatttatagtcagtcgtatgtcctcataattctatgattattcatcttgtagcaaaatttaaaaaatttctgagtaaaaaattttcaaattttttagttttccaatttcgttccggcgaatggaatgcttttgggcccaaaaagcggcaaaaattaaaaaaatcaaaaaaattaaattttctaaggtttttcgcagagcacaccgaggctgagtttgcccaggcgggtgccatctccccaacggacatttcgctgccggccgggccaatgccggcggaatttcacttgcacggcgccatggaatcgcagctgcgcaagttgggcatgcccacacggctggaaaatggtgggcattttgggagaaacgaaaaatggaggcgaaatttaattgcaatggcccaaggttttgaaggtgttcaattgcaatttttactctattgagctttaagcacctaaaaaaagcagccagggagaagggatggagatccccccccccccgaaatttaaaaattttctaggagtaatagcatttttttttaaattaatcaattttttcttaacaaaatcattaaaaattcagaaatttttcttccgtttatttttcgaatttttcagcaagggcaaaaaaaataggaattttgtagcggttttgcgccaaaaaaatgacagatttttgacactttagagtcaaattttcaaaaaaacttgataaattggggtcaggcggtgccgatgaaaatttttggaatttttaatcgagaaacgggcctgatgtgggacttgatcttatttaataaaattagcagtttttccatcccctctctcggagcaattttttggaaaatattgaaaaaaaaattagtgattagttatagattttttcaaaaatagttgaaaacttaaaaactttcttgagatttacttataagaaattttttttaaaattattattgggggtggagagaaacgtagtgcatccgagtctaattgagtcagccccaatcgtaaaagggcatttcaaacgacaaaaaaagggtccggaaaatgccacctaattcggcaaaaggggcgggccgtaaagcctcgtaaaatcctgaaaattaatttaatcaagtaggcaaatttaatagtcgtagaattggcagaaataaaaaatgaattagcatttaacaccttttttcaaaatttggggatggggacgccgataaaccaacggaaaaatggcgaagatttggaggccgcggcaacggattttcaatggaattggcgacgaaagatgaacatgatcaatcagaaaaaccttctcaaaacattttttgtaatttatacaccgctggacacattacaaatcgta

SEQ ID NO: 3012 - DNA, 4866 bp, Heterodera glycines
ttgaacagccaaaatttcagcttggaaccaaaaagaatgtcacaataattgacgtgttggacagtctttgcccaatttgggcattcttttttgattatgattacggcaaaaaatatggaaacaacttggaagctttattcaaagtttcagtgaagccaatgtttatagacaacgaaccgatttggcacaaaattatgaatgtttttcaaaaaattaaaaaatacaacatgaaaaagtcgtccgacgattcagaagtggcggagtcgtcgagcaacgaagcgatttggaaacaacaaattgcgcaatatgttaaaattgctgacagcgatgaaaattatgaatataaagaactacttaatgaagccttaattgaaaaaggtaaagaacgcgaaggaaacagagccaaaattgagttggcccgaaaagcatttgacaatttgctgaaatcgatgacggaaacggcgaaaatgcaatcgggtgaaggatttggcaaaaacaaaccagttttgcgttggctattcctttgaaaactgagttattctctagcgtttgaagcagaattcaccattgacgaaatccagaaaataattagtataatataaaactttttttcataatttatttttcccttttccttggtgtaagcccgggtcccggccatgggtctgaaaatcaggtcgggcccgggtcagcaattaaaatataaaactatacctgtatcttctctgttttgcttttcattggatatccttttgtttttgttgctgtagttcatcctttctttctcttttttggtataaatttttaattatgaatttacaaaaagttcgctgaaatttagtgatattactaggtcgttgcataaaaaagggcgcttttttagaaaaaaaattttataaataaaatatcaaaaataacaatcataacaactgtaaatacaatatcactcaacaaaatagtttccctggaccctaacaacctttctccaacgagaaggaagtttcctaatgccgcgacggaaaaaatctgtgccgatctttgaggtcaggtactgccccaccgcctcctcgacctcggcgtcttcagtgaagcgcctaccccgtaaaaagtttttgagagaaagaaaaaggtggtaatccgagggggctaggtcagggctataaggcgggtggggcaacacattccaattcaatgtctgggaaatgtactgggttgtcaaatgagaacggtgtggcggagcattgtcatggtgaaagagtaggggaccgtcaaattggccctgctggcgccggatgcggtaagcgatatccaccgcccgcagttggtttatgtatctattactgtccaaaatagtgccaggtgccagcagttcccagtacagtgggccatgtactgaccaaaagatacacaacatgcgctttttttggtgcaggttgggtcgggggaccaaaattgggtcttcctccttctttctccaaacaattttctgtgctgtgccatcgtaacagatgtagctttcgtcgcatgtcaccagccggttcagcacataacctctccggtgtcttgcgatgttcgaaagacacaggtttagccgccgctgtttctgctgatcagtcagacggtgtgccacccatttgctcctcatcggccgacgaccagatttccgaagccagcgccatgttgttgttttatggcaatgtcccaccgacaattctgcgcaggaactttccgggtgtcgtcgcaaccgttgtgccaaaacgtttttgtccactgtcgacggccttccagacccaagtttgcgtttggtgctgtttctccccgcccggaattgttggaaccatttttgcgcttgacgaggagagatcacatccgcgccgagaaattcattcacttttcgcgccgcaggcgccgctttttcgccttttttaaattgctggtgtaatagcttatgtgcgtgctccttattagcgttcatttttttagctataaaaaatttgcaaattgagatatgaacaaaatcaatatactattttgtagacaacaattagcttaacaaaacggtatataaaacattttattatgttaacaacaaaattttttataagccattataaaaaagcgcccttttttatgcaacgacctagtatttgttttggtccgcaccatttgcgccatctaattcaagaaattttttaagggcaaaataaaaaattggcgttgtgttacagtcccagtgatttaaaacatcagtcaaaggccattgttatattacaatacagtaacaaaaaggaaggggaagagcatgtgatatgcatactctcctcctcctccccccatcccccggcggtttttaacccatccctcggatttttcttccttcgttcgctttcttttcccttcttttgatttggcctcattttctccttttgttatttgaggaaaatcaatggcaacggacgaattgtcacgctttttcgcttctctcttacgcactcagaatgtcggtttgccattctgattttgtcagaaatgttaatcgggcgtgttaacccaaaacatgcgggttttttggaattatatttttctatttttacgggcattcccttactatgttttttgactatcaccaggaaggccattttttacaaattcgttcaaaatttttgctcaacagctgatcgatgatcactgtctgtatgcgttcctcaacagacagtccccccacagaattgtctcccccttctgatgctgtccccggttttggttgttatcatttatcaatcactcattcattcattcgactcgcacccattggaacaattcactcaaaaaaattaaaggaagaaattattcaaaatgatatgaatggtttaacattcgtaggattttttatcagtgtataattgcacttgttaaattcgtttgatttccttatatttaatcgccattgattatttatgattttagctttttttcttcatgttttcggatgtttccgttcaaaaggttaaattattgtcccattgaagaggaggaaggagagaattcgcagtcaattcatggccggattgatggcacatgccaagttgggacggactgttgcgacacgcgagagtgtgcaggagttcatgcaacccaaagcggactcggcgtgtctttcaaatgcgagaaggacccggaaatgtcgtcgatgagagaggaccgggcccggtgggaccacgtgggggacgtggaccaggcaagcagccaatgctaattgattattggctcattatcgtcgttttgttgtccagttcttctcctacatttacgagtattaccaacaaaagggcctccggtgcatcgcccttcgttactttttctctcttttccgtttcgctttcgtcgtctttttctccacctttttgttacaatgtgtcgattacggggtcattttcaacacgagaaatgccacttttgatggcattccgttgccggagaagaaacaaattcaggttttgcggtccatcatcggctcttttcggcttacgcttctttcttaggatgtgttcatttctcagtgccaccgtcacttcaatccgctagtcaaaattgcgcttttgctggcccttctcttttgggtcggtcaattcgctcgcatttgctgtcgtctcgtccacctttgtgagaccaggaatttcttcgccactcaacttcaaatcaatgacagcgacttgcaaaacctttcttggaacgacgtcgtgcataatttgtgtcgagctcaggaacgaattcatttaatgcaagtgattttgagacattttgagtaataagcgacagagaaatacgaacagaaaaaaaggttttgtttaagaaaaataacatttaataatatcacttcgagtggtctcattatcgcaaatatcccatttatccgcacattcgatcatttttaccaattttatgtgttcagtgttaatcgcgactccatctcttcgctcgacatttaccagcgcattctccgccatcgcaattatttcgttgccttagtgcacaaagtgagtcgccctttttcactgtccaattgtccgccactttttccttaccctttccccccccccttttcagtcgcttttaccgcctcaaattcggctgcccttcgttggctctgtgcattacctttcgtccggccttcgctttaacatcgaatggcttctcttctggggtccgtggtccccgtggaagtcgtcgtacgcattaaaagacgaatttaaggaaagggacaatttggaaaggattggtaggggaaaggcggcgacgaaattgcaattgctcacccgccaaattcagctcgaaatatgcaaatgaatctgctggtgatgagtgtcgtcaacttggtctttcttccgtttgtcgtcgtttaccaagtgttgttcagctttttctcttactccgaacattttcaacgggatcgccacattttgggcatgcgcaaatactccaattacggacggtataatttacttttcccaggggcgtatctagaaagatttttcgggggggggggacccgacctgaagacttttttttttttgctattaaccaataactttttttccactgctgggtaacaactgcactttttcactaaaaatgaccaaattttggccgttttaaggcaaaaaacttgtaaaaatagtggaaaatgtaggtccggcggtgccgataggcgccgccgggaaaaatttttggaaatttgagtgctacttgttacgaaatttgcctattaaactttttaattttcgtttgggggggaattcgaaaaaaatttccattatttgctggaaaatttttaaaaattttcattttcggggggggggggggggg

SEQ ID NO: 3013 - DNA, 3705 bp, Heterodera glycines
ttcccccccccccccccctagatacgcccttgacttttccatatttaactgattgcattcgagtttttagcgagaaattgcgccatttcaatgaaatggacagcgaattggacgcccgcctaaatcgcagttacgaattcgccgttcgttacaccgaccaattcgtttcgacacagtccaaaatcattgccaaaaacattgcttttgttgccgctgccgttttcgtcgtcctttgctctctcacggcttacgacgaagacactttgaaggtgtaaatgggttgtaattatgatttctcatttgttactcatcccatctcattcagattgagcatgtcaccactctgatcaccatctccggcgccatcgttttggcctgtcgcgtgttcattcccaacgaacatttggttttttgccagcaccaactgatgcgccaaattgtggccaacattcattacgcgccgaagtcgtggctccaaaaggcccattccatggaaatttacacggaattcacgcaaatattccgactaaaggccgaacttctggtggaggaattgctcagtccgctgtttactcctttcattctctatttttagtgagtttttcgcctcacttatcacaatttactcctcttctttaaagcattcgtcctcggatgatggaaatcgtcgaattcttccacaaatgtacagtccgagtcgatggtatttaattctttacttaaaacccaccaaatttttatttctttttgagggctcggcgacgtttgttcattcgctcaaatggacatttgccgcgatggcgaaattcggctgatgtcacttaacaatgagtcggtggttgtccacgacagttcaaataacggtaagacaaaaacaaaatcatagacaaaatgtatacacttttccgtgacatgaaaagttccaataaaagtacacacaatttaccattcgcagcagcaaagcaaaagcgaagcggcaattcgtacggcaaagtggagctgtcgctgctgaacttcgccgttcaacaccccgactggacaccgcccaaagaatgtgccgaattcattgacaatgtgaaggcattggtcagtcctttctttcatttggcttttctccccattggtaatgccattgttttgtttgaaggtttcgcatgagatttacatcgccagtcggtcgtacgaaaatggcggcgacggtgccaatgccaacacttcgtccgttttggacgcgcaaaccctcgcgttgctccaggcgtcgacccacgcgtccctccaccaaatggaacagtctctgcagcaatgcgctgtcccgtcctccgccattttgtcttccgattgcctccgtccttctccctctcagaacatggcgatgtccacggcccaaggcgaccatgacgaggtggatgagctttatcaaaacggtcaattgttattgtcgctcctcttaagagaagggacgcgtcgtcgcctccccctccgccgctcgcggcttcgatccgtccaaatgcgatggcggcgtcgtcctcgcgcattggccattctctgctgggcgagggcgcgctccgtccgtcgcccttctcccaattggccacttcctccttcattcagccgtcccctttggcggccattgttcagccgcgcaccatccaaggtgatcaacacattcattcactcttcgttttatgtgttggccatttcagagagtaatttccgtgccttggaaatgtcaatgcatgcccttctcatcaaccaaatgctcttcgccaattcgttcgcttctccggcccttcgttcctcccggcatcacccctttggctacggttccatcccttttggcagtgtttcccgtcgcggacccgtggacagtatcgtggacagcaacatttttggagtgcccgccggggccagtcaaatccaactgatggacgaattggaaaatgaatttgacccattgtcaaataatcgtagggtgtgaaatgtaataaattgggtttctccaatcaaccgtcagaccattttttcattcttctcctcttgcgttgaatgaatttcacatactcaaaaacagctttatttgcattactatacttgttttttggactatgattttcaaatttaaaagcctcaaatcccttccgcaaggttttgaattgtattgtttatattaaaaataaaaatactcatttgacgggaacggcctcatttctgatatttcttgtagattcaaaccaactcatcattcgttttcattcagttatctatcaaatgttgaagctcatgtacaaataaatcattcattttgtttgacagcttaaagaaattcgaataaattttgtcaaaaaataatataacagatttaatcaaaagaaacaattgaaattgccgaagtgttatgagatctttgaaattgtctctcgcaagtcatttaacaattcagcattgtccccgttcttaatttttaaaattattttgtttgctgagtcccaactttttaccgcttcgttccgtccaatgaattctttgatttccgcaattgcaattgcccgggttgcctcgttcctttctttgaccaccgctccctcttttaatgcgcgggcgtaattcgccatcagtttgacaatttcctcatttataagcgtcttttgccgggtgtcgtcgccattcccttgcgactcaaccgaaaaagcattggcaaagccaaaaggaagaaatgggccctgaattgaaaataggcgtaatgattaacattgaaagtgtgcaaacaaaagcaccgctttctcctccgaaagaatcatttgtcggacgacgtcccttttgggggaccaaagcgtttgggccatcaaaagtccgtcgagtcgggaggagttcaaataagtgccgatcagaagcaaaagggcgaaattgtcgtcaccggcggagaaattttcatagcgttggagaaggtcctcaaagcttaaaatggtaattggcaaaatgacaaaataaaaactgaaacaaaaataatacaatggcataaattggtcaaggaaggcaattggctgacggagacggagggccaatggccccctttttcgggcatcgataagaaaatcattgaccaaaatggaaacgcaattgcgaatttgatcatcgtagagaaaaacttcggggcctgagaaaaaataaataaattgagaaaggaaaaaattgaggaaaagaaaccaatcaaataaatctcggctaaacgacagaaaaattcgttgacgcaaacggaagaacggaaaaaggcgggacggagaagaaaaagagaaacagtccaaagcaaagcgagacgaacaatctccacgtcatcggatgttgcaatggcacaactaaaagcgaatgggagtgaaaagggggggggggagggccaattcttaaaaattggcttattgttaacatttcattaataaattgctatgagttcagaggaggcacccatcggcaccaattttgaaagaaagagggcaagaaaaacacccattggcaaaagccaaaaatagattaaattcaaacaaaagttcactcactttcgctgctgaacgacgtccaaaacccttctgatcgggctcaaagtccacgcgccgtccgaaaaagggtcgacgaaacgccgcgcgaattgccaaccgacgcgccgactctcaacactttgactgaaacaaagagacgcaaaatgaaaggaaa

SEQ ID NO: 3014 - DNA, 685 bp, Heterodera glycines
ttctcctctctctgtgccatttgatcaatatgccgtgcaaaaagacttttgcccttctgtttttgttcagtcgtttttggttctaaaaaagaaaatagaaatgacaaaccaattacttaattacttaaccatcgtttgggtcggaaggtgcggccaatttcgcatgttctgtcaagtcaatcaccgccgggaaacctttctccgaattttcctcgtcaaaagaggtcgactcaaacggaacacatctctcggggagttcaaaaaagcccatgaaacgttcctgaacaaagcgaattcgttaaaacgtgcccaccccatgccgataattacggaacggcacaaacattcccttcccatggagtacagtcaatcataagtattcatcctacctgaacagcacccaaacgcatcggttggtccgaatcctcctccgtcttttgctcgtcctctcccctcccgacaacgtccaattcaaagcgcactttttccttcgtttggtgttcattttttggttttccgattctaaacaattgtgttgccatagcaaagtgaatgagtttaaccttaaaaagggtaaatgttacggtcacaaaatcaaattattaattatatcatagatatttgaaaagtaaatatttaacaggtagcaaaaaagacaacatcaaatgggaagaatttattttta

SEQ ID NO: 3015 - DNA, 4062 bp, Heterodera glycines
  misc_feature (37)..(37): n is a, c, g, or t
gaattccgagagaattgatggccattcatttagcagngatattgaaggcggaggcaaaatgtggcgcctattggccgtgccgatgccattggcgaattaaggcaataaataacatttttaaatttattttgagtgttattaatgcaaattttaatttttttttagcctgaagcggggaaaaaggtgcgaattcaattcaaaagtttgagcaatttgtttgaatgcacatacaactgctcatcggcgtatgtcgaggtcaaataccgagacgacaaaagggcccaaggcaaaaagacaaataattaattactgattaattgcaaaaggatcgtttataaggtgccaaactttgctgtccccgtgcactcactgatctgaacggaaatcaatacaaaaattggattgcggcggaaaagccggacacggacatagtcatttccgcgcacctttcaccaaattggaccgtaccgtctaccgtattcgagctgacgtatgaatcaggcaaggaaattgtaaaatatattttatttgttttttaattcttttttaaatatttattattttaatttgactttattttaaaatgctttgcatatctaatggataattgttcaaaaaatattaaggcaacgtcagaatctttttttcgagcaaatgcgtaaaaatcgaaaatttgtttgccgagaaaaggaaccccggcaccggcactttgtattgttatgacgggatcaataagaaacgttatgcctgctcctgtaacggtgataagaaatgcctcactgaagaaaaatatgaacacgacagctttatttgcccaataataaaggtgatgaggtaataataattaaataaaaactcaatattaaaggtatttaattaattaatcagacaccggcatagaaaaattttaactatttcattaacaaattattatccattcaacattcgcaagtttatgaagttttaggctaaaatataattaaaaatataaacgaacgatgtactgaaataaggacaagagagaagataattgataaaaagcccatctattctatataagttcaaggtcaatggaattcaaatcaaaggaagccgacaaacaatgtacactgacccaaaacattatcattacaattcgactcaaattcatgttaattgctttgtgagttgggtcttaattaatacatcatttctaaaaccctgtctaataattgactaattttacagaaggcccaaggaggtaccgtaagcttttggggctacagtaacccggagaccagagaaatcattcgggtggacgaagtccactgtttgactgataaagctgctggagtgccaaaacagttcaaaagtttgcaagccgaagaacagccgccgatgaaattgagtccaacgcgtccatttttggccaataatgcttcatcacttatgcatgtgttcgtgccatttggtgaccatccatgagagaaaaggggagatcagtgatcagtgggcgatctttattctgcacctgatcagttggccaattccaatcagcaaatttttattttatttttatttttttgaatttttaggggtgtcattcttttgaatccatttctattcagtactatatgcattttgagatttgaattgcgaggatttgtgtgaaattccgagagaattgatggccaattattcagcagtgttattgaaggcggaggcaaaatgtggcgggaattggccgtgccgatgccattggcgaattaaggcaataaaaaacatttttgatattttaaaattattttgagtgttattaatgcaaattttaattgctttcagcctgaagcgggaaaaaaggcgcgattcaaaagtttgagcaatttgttttaatgcacacacaactgttcatcggcgtatgtcgaggtcaaataccgagccgacaaaagagcccaaggcaaacagacaaataattaactaattaattttgagtaattagcgaaatgatggctcattagggtgccaaactagcccccgttttggcacttgtcctcatggcctttgcatgagtctgaacaaatggaaagtcacttaattatatttaattgatttgcctttgcaataaattcggttaattatggccgcacctttgaaagagattcgttcgcgttggccaatcgtttgttggtaaaagcgaggcaaagtgatcagctttttcaaaaatatttcaaatatttggtttaaatcgacaaaaactggactgaccaggattttgattgtcttaaaaagtgatcaatcactattcatctgatcacttgtggtgggtcgttcatgtagacttcttttgctcaacaatttgcacacgtggctcttcttcatcttcttcttcatcccgctcctcctctcctcctcctccacctcctcttcttcccgctcctcctcatccgttgcgctaatgtgtgtgccgtaattagccgtgccattgttgtcttcgtccaccaacgccatgttacgctgggacggcatttccccagcaaaatgttttggatggagaattggacacgcttttttggtcggcacgggatggagccgcttattgcaaattattactagtaaattcgaaaaaattttgactcactaaatttgtccaaaacttatttcaaactccataaattctgaattttcacagaataatagaaaaatgtttgagctatcttttcgtaaatcctccaaaaaaaaggtcaaatgtctcacatgttttaagacaatgatgatatcggtattcggcttggtcgtcttgaaaatttctcaacccatcgatcaacgccacaattgtcgagcggctgggtcgccttgagcagcttatacagaaacggtcaatgacaacacaaaaaataatcgatccggggactcaatgtccttctccacctcctcacccagtgttctctgtggtcaaccgccgcctcacatcggaatggtcaaccaactggtcaacaatgccgtgttggactcggaggagattatcgcaaaatcgaagagagcagtgttggagaaagttccagaacaaatcggttccgttgaacttgtgcgaaaggtcgctaccgaatatggaatgatggacgaggtgatttttgaagagatccatcgacatccaaaattacaattgccttcgggcgaaaaccgaattgtcaaggttccatttgtagacaaaaaaaccgaaagattttccttaaaaactttcggaaaaccctcacaaaattcaatcaattcccaaaaaatgtctcgttcaggcgggatatcacccggcctgaactcaatttgctttatgagcttcgccgtaaggcctatgccatgaaccaaagtgaaaatatgtttaaatatgtcgtcgttgacctctccattattactttgaaaactccgcaccctcttcgcccaaaagaactcaataatgttacccgagcaaaccaaactataaaaatggaaaatccttagacaaaaatccatgggtttcctgcctattaataaatagggatgggattcttagttttttaactatttttttctgcggctttaactcggcgagaaatgcacgaaaacacattatttttcgaaaatttttcatttttagtgccactattcatcactatgaatcagagatgggccaaattgaaaaataaaaagcgaaatttgcgaaactgaaaaatgcgaaatgaaaaaaaagcgaaatgcgaaaagccaaaatatgtgaaaatgcgaaaagcgaaattttttctacaactttttaatagttaaaatcataaaacaaaaatcattttttaaaattttattccaaatttaaaaattgtaaggaagaagctggctgggcggttaaaacgcggaaagcgggggttgataagatccataaaagaaagggcggatgtgcctcggtagcttaatggtagagctgcccacggaaagggtgcatgagtgggttcgattcccacccgaggtttaacattttgcccatttacttattgggaacaccggatgggtgccccaccgcgccagcagcaattaactaattggaccgatggaccggtcccg

SEQ ID NO: 3016 - DNA, 1720 bp, Heterodera glycines
ttcatcttcttcttcatcccgctcctcctctcctcctcctctacctcctcttcttcccgctcctcctcatccgttgcgctaatgtgtgtgccgtaattagccgtgccattgttgtcttcgtccaccaacgccatgttacgctgggacggcatttccccagcaaaatgttttggatggagaattggacacgcttttttggtcggcacgggatggagccgcttattgcaaattattactagtaaattcaaaaaaaattttgactcactaaatttgtccaaaacttatttcaaactccataaaattttctgaattttcacagaataatagaaaaatgtttgagctatcttttcgtaaatcctccaaaaaaaaaggtcaaatgtctcacatgttttaagacaatgatgatatcggtattcggcttggtcgtcttgaaaatttctcaacccatcgatcaacgccacaattgtcgagcggctgggtcgccttgagcagcttatacagaaacggtcaatgacaacacaaaaaataatcgatccggggactcaatgtccttctccacctcctcacccagtgttctctgtggtcaaccgccgcctcacatcggaatggtcaaccaactggtcaacaatgccgtgttggactcggaggagattatcgcaaaatcgaagagagcagtgttggagaaagttccagaacaaatcggttccgttgaacttgtgcgaaaggtcgctaccgaatatggaatgatggacgaggtgatttttgaagagatccatcgacatccaaaattacaattgccttcgggcaaaaaccgaattgtcaaggttccatttgtagacaaaaaaaccgaaagattttccttaaaaactttcggaaaaccctcacaaaattcaatcaattcccaaaaaatgtctcgttcaggcgggatatcacccggcctgaactcaatttgctttatgagcttcgccgtaaggcctatgccatgaaccaaagtgaaaatatgtttaaatatgtcgtcgttgacctctccattattactttgaaaactccgcaccctcttcgcccaaaagaactcaataatgttacccgagcaaaccaaactataaaaatggaaaatccttagacaaaaatccatgggtttcctgcctattaataaatagggatgggattcttagtccataaaagaaagggcggatgtgcctcggtagcttaatggtagagctgcccacggaaagggtgcatgagtgggttcgattcccacccgaggtttaacattttgcccatttcttattaaatcaataaaacgcttttttgaggcgctcttttccaaaaaaactttttggtaagagggggcatgcggctccggcaggcgctgccgggaaaatttttgaaaatttgattaaaatttgttgacagattttcaccaaaaaatcatcaaattttgtgatttttgtatcatttttctaatttttgccactattttggtatttttgaaaaacttcccaaaattgcaataaaaacgaaaaatacaccccctaagaatcaacctaaaaaattttcaaaaatacacccctaagaatcgacctaaaaattttcaaaaatacatcccaaagaattggataattttcagccaaaaattgagcaaaaaaatctttattcactgattgcagttacaaatgagatacattcctttttttgggcccattcttaggggggtatt

SEQ ID NO: 3017 - DNA, 1468 bp, Heterodera glycines
attaatacagggtttctttatgttcttgtttctaagaaatgttctgatttgggggtaatgccttattttcatctaaaagaagaaaatttctgaaaaatttggctaagttctaacaaaattcatataaatttttaaaattttccccggtggcgcctatcggcaccgccggcccccaaaattcctatattttttcttaaaaattatcccaagctcgcgaattttgctcattttttgtacaaaatttgttaaaattgcattcaaattttcaaaaaattttgaactctctcctcgcacattcatcaagttttttttttgaaaaatgtgccgcaagaaaaaaaatttaaaaaatctgagttccaattttgagtaaatcacgataatttaatatagttaaaaaacgaaaatttatcgaaatttttttggtgaatatctgttagaaataaatttaaaattcgcccctatcggcacgcccccccccaaaaaaaatttttgttcttaaaaaaaattacccaaaaatccctaaattttggttactttttagtcgaaatctgtgcaatttatgttaaaagaaatagtatcgaggcgatcaacaaataaaggaatgtggagccaaagaaatcattcttaaaaaatatttttttgtgagatttttggacctaattcaaagcaaacccccgcccccgtccccgcgggggcggaattatcgtgcccccgcccccgcccccgtgactctgacccccgtatcccccgcccccgtgaaaagccacccccgccccacggggctcgaaccctagaaaaaagtggcgcagtgccatttgaagaaattttagctcaaattgtgacatatatgcccccaatataattctggcacgaagtttttgcaattatgtgcttcctttgttttttttttaaatttaaatctaggcctcaaaaccgaaaagtaccggaaaataagacagagaaattagagaaagaaaacagagaaagaaagagagcaaagcgagacagagaaattgacgagagagaacagaagaatagaaaaaatatgaggtaaggctgagaaaatgagaaaaatagagataaaaatgaaataaaaatagaaatattaaaaaaaacagaaagagagagagcattggaaagagaattgaaggaaaaacgaaaagtgattgaaaagaaaaaaacggataggcaaagaaaataaatagaaaaattcatatttcttctctaaattttgtttttctcaatcaaaaaaattatatcagaatcgaaaaatttaaacgtagaaatgcgttttttgagctcctttcttcaaatcaattgagcaaaaaaatagttaaaacctaaaattcccagccctacttatcagacactatctctgggacaaaattccaaagcgaaattattaaattactttttaaaaaaccaatccaaattataaatatatatcgtccaccgaatttacagttca

SEQ ID NO: 3018 - DNA, 2254 bp, Heterodera glycines
gatttataactttataaaattaaaaacattggaatttaaggaaaaatttataaatttttaactaactttttaaaaaatcggagttttaaggttaaaatcggcgaagtattgtcagaaagtttcagcatattttcgggagtgccccagggaagtgtcttagttaaatcagcaacaataaaaatgggggaaagtccgaggaaaataactgacgacaacaatataaaaagtgcactgccaacagaatgaattgaagggaagacgggggaacattttctgctgggaagggatggcaaaatatagattaggcgagagactacaatgacagacaatgagacaaaaattaagaagggacaacataattactaaataaaatgccaataatcaaacattaacacacaaattcaaggtttatattttctgtttattttttgttttattgcaccagcggtaacgccggaaaaaagtttagaaaatttcaagaaaatccaataaaaatttaaaatgtttttccttttgtgtcggttcacaaatgctctgaattcctcgtctttcagtttggatgctctcaggcaatcatatctgtcaattaaaaagaaataacaaaattggggaaaatgatgcgaatgagacaaatgatgagggaaggtcaaaaagcggggtatttatggacggagggagagacagagataagggagacgaggaaaacatacaaaataaataaagttagggcggacattcgggtaccggactaacagtagagttcaaaaagagctttcaaattaactattaaatttatggagaaggcaaatttaaagttttatatgattttttgaaatttaattactggcccctaagggtcatatgagaggagggtctggggttcaaattcgcttggctgcggattattttttatgacagccaatgaccgttcgtgctttatttgcgcacatttatttggtaatgacacacaatgtcaattgttaactttttgggttcatttgccaataaataaattactcaatggaagcacataactagggaaccgatttctagtgaaaaaactttttttgctcaattgttttgaagaaaggagctcaaaaaacgcatttctgcgttaaaatttttcatttggacgtcatttttcgtaattagaaatcactattttagcgtttcgtcacttaaaatagtgaaaattcacttttttggcattttgtcactattttttcactttttcgacattttttggaaaatccttaacaaaaatgcaataaaaacaaaaaaatacacccctaagaaccgaccaaattttttttgtgtgtcattaccagggatgtgatctgttcttatttataagaaatgttctgatttggagggttcaaatcttacaaaataaaaatgttcttatttgtaagaaatgttctgatttcgggctattgttcttattttgttcttatttcttaaatatattcaaaattttgaaattttatggcagaatgtcactattttatcaagaaaatataaggtttgcgcaaaatttggttattttttgacaaaaaactgttagcaaatcgcattaaaaattacaaaatttttccgggcggcgcctatgggccccacccggaccctctccccccttgttccccaaaagtagttattttttcttctaattttcaaaattattcccttttcggtgagaattcaatcacaattttaacaattaaaatgagaaaatattgttatttttggactaaatttgttcacaaagtgcactaaaaatttcaaaaattttccccggcggcgcctatcggcaccgccggcacccaaaaccttatttttataaaaagttggctcaaaatcgcaaaaaattggccttttttggtgaaaatctgttaacaaatcagaattaaattacaaaaaatttttccggccgcgcctatcggcaccgccggaccccctcccctcacacttcccaaaagttttttggaaaaatgcgccgcaaaaaattgttaaaaatctgatttttttatcccgaatgcactaaaattttatgatttgctaatttcctccccaaaattgttaaaaccgttaatgggagacaaaaatatactatttgatacatttttgatcgaataaattgtaaaaataactgatttgaagcaattttgcaaaatgtccttatttttaaccaaaaatcttattttttggccttgatgttcttattttgaaaaattttcgatctgaaccctgacttaaa

SEQ ID NO: 3019 - DNA, 679 bp, Heterodera glycines
  misc_feature (584)..(585): n is a, c, g, or t
  misc_feature (638)..(638): n is a, c, g, or t
  misc_feature (650)..(650): n is a, c, g, or t
  misc_feature (670)..(670): n is a, c, g, or t
aacgacaatgtcttcaatggaatgctaccgctgtcacgagacgggtcacattggtcgcgactgtcctaacagtggcgggggtggacgtggtggaggttagtaaacgaaggcaaacggtagttgaagacaacgtgcgttccccttaggaggcgatagcgtctgctacaactgcaacgagccgggtcacttctcgcgcgaatgtccgcagggacgcggagggggcggcggcggatcgcgcggtggttttgcattttcatggcagaggatcaattcaaaattaatcgcaattcgtgtcgtaggtggtggaggcgacatcgtctgctacaactgcaacgagtcggggcatttctcgcgtgactgtacgcagccgcgtggcggtggtggcggagggtcgcgcgggggttcgttttttatttcaacatcggaatcatttttaaaccgcatagaaatattaaggaggcggggacagtgtctgcttcaactgcaacaaaccgggacatttctctcgcgagtgtccgaacggtcgcagcggtggtggtggaggcggcggctcgcgtggtattagctcattttccattccctgnngtacttttactgttcatttcctttaggtggcggtggcggcagtgtttgttacnaactgcacaagnctggtcacttctcgcgcgangtgcccgga

SEQ ID NO: 3020 - DNA, 934 bp, Heterodera glycines
accctattccctctctcccaaattcatgcagacgtccttttcatcctcactcaccttctcacccatctcgaccataaaattcgcccaaccaacaaattggccctgtgctattgaacataaacgcacaaagacacgtatttccagctgagcaatgggctgacgctttgttgtgatttcaatgcgttatttgtaattcctaaccacctaaatattccatttgaaaattcatcggcagcgattcattcattcaaaagcacatgaaaactaaacgccagcgatgacgaatgatgacacatcttagacttcgtcaagccaaaactgtcctcgtttggctattcctttcccgatacactcacaaaaaccgcaaatttgcccgttcgttagtccaccaatcgactccctttctttccttactctaaagtccacccattaaataataataaaaataatcattcgcgcctacacataaaaatgcctagcaccagcactcgaaccgacgtcgattttgtagagatagtccatctgttggctcagactttccaactttccattttcaacaattttcttcatacttttttcaccaaaacaagaaggttttgaacagaacaatgataataaatacaatcgtttttaagacgatcaattaaatggacggcaacggaagtcaaaattcggcagaaaacatttggccattggcacatgtcgacaatgccgaattggatgatggcacatcgtcaaaggcgaattcgactgaattttgtgaggaaacaacggaagagggaggcgaggaaaaaggggaggacaattcttcggatgggccaaacgaagaaccccagtcagaagatggatctggcaatgaggacgaaggtttcacttttgccaaaagcattctcgacattggttttgacataaatacaagaaagaaattaggaat

SEQ ID NO: 3021 - DNA, 3739 bp, Heterodera glycines
atggaagaatgtgaatagaggaagccaagggatgttagaagatattccattcttcagcttcgtcccaccctccgttctcgcccctccgcttggcttttctcgtcgtccagtcatttctcgcgtcgtcgtcgaggcgtcctattccgtgggcgtttcccgtcatcgttcgtcttcctcaccgcccccaccattttctgaacaccaattgaagctgcaaggccgaggaataaaagcccaaaaggtcttgccctgtcctttcgattcatttttcgtcttacaattagttaatgaccctgtgccccccccccccggtttgctaatcacttctttccgtcttaagcattcatttggcatcccttcactgatcgatgccatccgagtaaaaccaattccgccgccgcctccatcaacgaattcgaacacgaacccatttatatcaaaagacagaaaaagagcgacagccagagacgaagttgaccagcagcgaggtacttgtgattttatactgtagtgttatttatttttcaacagaccaccgaagggtgctgaccacctccaacatgggcagtagcagtgccatcgcctattccgacccgtgggcgcgcaacgcctcgccgccgcgtcggcacggacaacgcgggcggacgacgcatcggacgcactctccgcactcttctgcgtcatcagcagacgaagtcggggattttttgatttaactaacaataagtgttaattaccctctcattctttatcagtttcggtctcgtcatcgtaacacaaatgctttttccgctggtgagtccgtttcccgtcgccatcgctcgcgctcgtcctccccccggaacaaacggagaactacgacggtggtggagaaaaagggacaatgggaaaacaccacaaaaaggaggagggaacaacggacaccaccagcgagtaggagagactgaaagggacactcactcgctcattcatcctttttacctttccaggctcctttgatgaccaattcgccgttgactcaaacagtcgccaccgccctcgaagtccccccaacagttcgccgtctcgtcgcaagtcgccctcagctgatcgccgttaccatcaccacaggcacaatcgtcgctcctctccgtcctcttatcacagtttgggtgcccttttgacgacgagttcttcaacggcggaatggtcgcgacagcacaagggaccgcgaacaccaccggaacccccacaaaacagaaagcgctggggcaagagcagcagaagtgcgtcaccgttgacgccttcgggaaggtcgtccgtaagcagagcaacctcatctgatagggacgaagaaacgaaaggcggcagaagacgaacaaaaaagcggtgagttttgacagggccaattatttttttcgatgataaactttcaaccccttttttaaactctagggaatatatttctggttccgtcgacaatggcaccgcggatgctgctgctgttcagcatcggtttagtgatggcatttccgtctcgtcaatgccccgtgctctgatcaatcgtcaaccgccggtgatcagtgcttcgacgaaaaaaacgggccgcaaacgcatgtcagcttcgtcgagtgcctttgttcccgaagacgaggaagacgcaccggccgcctatcgcttgccatcgaatgcgatgggtgacgcacggggacagaagcggaaaaggtggggaaatgaatgatcgagtcgcactgtgtagggctttgtgtttcttctttctgtccatatgccgtgcttctcccacctgtccaggtccgtctcttcatccagcagttcttcctccgtctcctcctccgattcttcttcttcctccggctcttccagctcgtcatccgcttcatcacatactccactgaaaaacgcaaaaccaaatgcatcagaacatccatcaaaaaggacgccgaatgagagggagaaaagcaacgacatgagcggaagtggtggcacgaccattagctgctcaactgtggaccaattggcgctcaaagtgacaaaggcggagcaacaggaagtaaatgcgcaaaatgtggcgcaaatggatgacgaaagtggacacaaagtggcacaaaaggcagaaatgcatttgaataacaaaaattttagcaattgagcaaaaatattgcgacaggagaaagaaaaaacgtcaaaactgaaaaagctccctgcaattcttcccgtttggccgatggggacaaaaagacgagcaaaacgaaagatgaaagaaaaggttggggcggaaaatgaaagcaaaatgaatgccacaaaaaacacacatttatcgatgcagatgaaccaatggatgaaaagagtggtgccgcgccgtcctccgtcgatcatagcaaaaagcgtagggaacagttgctgagacagctccaatcggtggaagaagccattgcccggaaaaggtgggcagcgaggaccaattagaattttctgtgatttttgtcgtttaaggcagcgcggggaggggacgagttgaagtgaattggtcccatggaaaatcgactaattattcgaatttgttaaaactgatatttatttgggttttctatttgaagggattttgtgatattagtttcgtctcattgacttcaattttgatgtcgtacgtagtgtttgttggtggtctgtcattcatggcaagccaattttggctcgccaaatgtctttaatatttggcaatttctatgttttgttcccaacttataacaataatatgtttaattaagtatacatttttgcttgaataaatcatgattttgacactgatattctggcaaagattgttgtaaaaataatttattttcgaagaaagaacattaattgatcggctcacaatcaaaaatagcacacaatactctttggatggtcgcttttgtgaaggcgaattccgaacgtttcttccatctccgaagacccatcgccatttgcaccaaaattaaccaaagaacctcgattttagaatttggtcagttaaagcgaaaaaagtcctcacctcccgcacttaaacttcggtgttcgatcgttccaatgtcggaaaagtgcctaaaattcgctggtgatttaaaggtcataatgaaaagctgccactttttgtgtcgcttggcataatgccggcgatggccttcagcagcgtaaaatgagggcagactcggcactgtgccacgccttccgtccattttcagttggggataaaactcctccaaaatgtgggcagaacgtgcgaaaaaatcgtagagacaggcgaaaagggagattttgccgttaaattaatattgcctttccgttacccaccaaaataattgtccatttgtgcgtcgattggtccctcgcgccgttcgtttggcctcgtcagcgaaaacattctttcgcgctgtctttgctcatcccaaaattcgaccatcgaagagacaatttgtcaaaaatgataaacatttttattaaatgtttttttttctcacttcgcgtgccgaatttggcggtgccgtacgaatgccgagcgctccgaccgaacgtcgaccatcgcaaattggtcggcccggcgttggaaataacggcggaaaacgcattcgaattgatcagacaatgctaaaggctccaacggaggcgaaaaggtggctaacgaacaaagaaaacgaatattaattaccgaggtaataagcctaattggctgtcatttgggggggggggggagcgtact

SEQ ID NO: 3022 - DNA, 3292 bp, Heterodera glycines
cttccgattttttctattttccgaccacagtagaaaaaatccaacgcgcccgaaaatgactaatgcttggttgtctaatcaaatggaagtgccttttttgccggttttttcgcacatttgggcacccatcgacgtgacttcgacccttttgcagtcattatcataattgtttattattgaaatatattttcaattaaattaaataaggcagctaataaaaggggaactttttaatgatttacaaataaatggtatgaaatggcagcagcacactttttgcgagtgcattttttttgtgtccgcccaatggcatttttcccaggccgccctctcaaatgataagtaaaataatccaaaagtgggaaatgaccaaaaaccatcagcccaatcccaaagactatcagcaggcacaaaacagcaggtggcaaagattaaatttgaaaagaatggacggagaaaagcgaatggagaagatttaaataaagccaaagaatggaagtgaaacgccgaggttccttcgctttctccggatttgaaaaatgagaaacaaatgtagaaataaaataaatattaaaaataaatacaaaaatataaaccaaaaaagggcattcaaatgttacttccccatttaacccgacaaaacatcacaaatgctcttcactctcttctttcgtcctttctgtcgtcatctttttgtcgtcgcatgaagaaaagcatcgatggaatgcgtctgcatgtactgctctgtcttctcgtcgtcctcatcgcccgccaccgtccacaactcctccatcgcccactgtcccgcggctgcaatggcttcgtctgcgtccattctcggccgtttcgctttgggctgttcccgccttcgctttccggcactgtcatcggcgccatcgcccaaactgaacagttccaacagttcgtcggttgccatgccggccaatgatcggttgtcagcgccaacaagggcctgttaaattgagtaaattaatctaagaaatccatcatagtcagctctcacatttgccgtgtcgcttttgaaccgttgcagtcgcatcactttctcctcgacagtgcctcgagtgatcagtcggtatacattcactgttcgtttttggcccaatcggtgcgcccgatcgatggcctgcaagtcgcgaaaggggttccagtcatggtcgacgaagatgaccacgtccgcaccggtcaagttcagtccgactccgccgatctgaaggggacaaaatgttgtggaaaacataaccaaccagacttaacgtatttgaataaatatttttcgtcctcacatgagtggtgagcaacagcaggtcaatggacgggtcggtgttgaatcggtcgacgacactttgtctgtcctttgccggaacggtcgagtcgaggcgaagccaagaaatctccgctccgaaagcgccgcggtccaaaaagtgaatgatcaactaaaagtggagaaaagggacatgtttaactgattgccatgcaaaaaatgcaacacgcctcgagagttgcacgccattggcagaagaccaacgcacgatgggcaccgccggaaacggacggaaagagaagcggaggggcaacgggcggaggaacggcaaaggaagtcgaaggcgcttctgaaaaagtgggccattgaaagaaaccaccgccccccccttccccgatcaatcacttttttgatcatttgcattgtcctcggtatcgcctcccattgccactgtccgatcgccaatttggcattggataagcaaatcacggaaggccaccatttttcccgactgatcaacactcttggaacagaattaaattgcgaattattatttatcggttagtctctgctcactaattttttcatttcttccataattcgttggcgtttttccatttctgccgcctcggagtttccggcacaaatttgatcaatcaaattggcattgatcagtgagggatggtccacaattttgcgcagcatgtgcaatgcttgaagaggcgaaaaccaacgattgcgatcggaagctgctgaatgtgaagaatctgttttctaattgactgtatattttgggtttacccttccaaatgagggaaggaaatccccaaattaacgattaattgatcaaatgcttttcgttggcaaattcacccacaatttggctgttgtccaacggcacaattgtccaccaccaactgataaagtgccttttgcaagtcgctcaactcgcactgttggtcttgcacaatcttttcaggcagttccgtcagaacatcagtctgaaaaagcgagcgtacaatggcaattcaccggatgtttggccattttctgatcactttaagtcggcgcatcacaaagggaaggcattggcgatggagcagttgaagtgctttttccccatcctgcaaataaacgcaattccttcccccattgaccagttcgtcactttgcactgctgctccgtggcgcgtgcatttcgacatgccaaaatgtgccgcataaatttcgcttggaaaacggcacgggtggacagataaccgggcatcaaaaagctagaaaccaaattaaaaagatggccagcgaaattgtttaatgactggaaaagtgcccataaatcagccggcgaattttgcacgggagtgcccgatagaatgaggcgatgcgcggcacggacagagcagcaaaagtcgaacagttgcgagttggggttgcggatgcaatggccttcgtccaacaccaaataattccaacggtgcccttcggaagtgaccgtggaaagcctgagaaaaatgaaaaatatgggaaaagtttcaattattcttaaaatgctctactctttgtgttgtacctgttcgacttcaattcctcgtacgaaaccaccaaaacaaaggccgacttttgaagttcagcggctgcgacggctttgaattgggagagtttgtaaattttcatattggcacatggaaagtgggagtgccattctgcattaataatttgcaagcaaatggggaattattccgtgagaatggaaccgattcaccgttacaccaatggtcaattagtgtccgtggaccccccccctctgtcccacaaaatttttggaaaaagcgcgccacaaaaaaagcgtttttaaagcagaaaaaagtcgtcgtaaatgaggaaaatgatcagcggaaataaaaaaatattggaaaaaatccattccggtgaaaaatacaagccatttgaataaatattaaccattttgcattgcatataataaaattttaaatgtccttgaatttc

SEQ ID NO: 3023 - DNA, 2228 bp, Heterodera glycines
gggggggggggggtcgcaaattttttaaattttcttaacaaattcattaaaaagtccaaaaattttccaggaaagtagctcgaaatcgcaaaaattggccattttttttgcaaatctgttaacaaagcacacccaaaacccgaattttttttggaaaaagcgcgccgaaaaaacggttttgaaaagcaaaaaaagaaaaaggccatcgggcggccgaccccccccttcgcaaaaattgtttccgacccaccccctttttaatgtatgatgtggcaccttccaattggtagtgcctaagttgggtgttcagccatggaatttggtcaacgccaattcggggcaaatttgccggggcacacaaaacatcgaccaaagaaaaggcaccggcgtaggcattggccaactgtgaattgccatcggaaggatcggcgagttcagccaagaaatgggagtaacgctgaaaaagagagaaaccatttaaaatcgaaatgaatatttagggggaggagggagggaaacaaacattttccaatggcaaaagcgtaatcagctgacggagggcaaaagcggcagaattgcgaaccgaaaaaatgagatggaaatgaaaacggaaaaaaaagaaaccaaaacctcgacaatttggtcgcttattgcacaaagtgcgatcggagtcagcagagaaacgacaccgaaagcaaaaaacgaatttaaatttacgaattaaaaaaaatgcctaaaagttttggcgcgccaatggctgccaaacggaccaaaagctcaatgacaccgcaacgagcaaaattggaattggagagggggcctaaaagagagaaaaatagcaaaaccaaaaagaagaaacctgagataaagtcggaaaaacgctggtaacaaagtttgaggattggacagagttcggcggatgcaaattcagacaaaaagcgagaaacctttgggaaaggaccaaatttcaatggctggcgattcttgtggataatattttaacaattaatatatgatttttaaaaacgattattgcaaaaagaaaaaagggcactcggaagcgaacagcgggattcgcggaggacaaaaggacgaagcaattctgaatgtgcggggcaatcctttcgcgaatgattcgacgtcggagaacggacgaacgcaaagcggggaaaatgacacgaagggcatccatttggagcaaaataacctgggaagggacaattaaaacccaaaaaatgtttttattagattttgtgtttctagaaaacagcccaatccttggggcggcgtcgttccgaaaatggcacctccgtctctttgtttcccatttgcccatccgttggcatttcgcgcaatgctttcagggagcaaaacggcccatggactaattcggcacagttctgctcgatgccatctccaaacacggcagtgatgtgacgcagaatgagctcacaattgcgcgctttgatcgcgtccgagctaagggaagaagtgccttgggccgactgttgttgttgtttctgttcttcggactccaaatgatccaaactgaggacgcgattctgttggtcagaagcagccctgaaaagagaagagaaatttgccatagcgactcaaaggatgaaaacaaaaacaaaaaaacaaataacttaacattgactcattttgggcactgcccacagttcggcacattgggccaagccgaggcaaagttggcgcatcactttggcatgcggacacggctcacgtcgagcggtggaacggaggagggcaacaaaggcgggcgccagcagagaagcggcgagagacctggaaatttcctgaaaatttaaatgaataaggtaaaagaaatggaaaaatagtaaaaaaagaatatgcccgatttcattgcacatttcccaccgattccaatgcgtccatcaacggtttgaccagtggggtgagttgagccggcaacggaactgtgccattgctggcgaaatggaaaagggcggaggcaaacagtgcagtgacacgactaaaaagaattttcgaatgaaaaaaaggaggaattatgtgccttcccctccctcactttgtgtacgttcgaatggccaattttgtgcgtgcgatttgttcgacaattattttgtgccgtgcggaaatgcctggcggtcgtctgctcggcttaagcgctgctcacagttgagaaaggtagcactaaattgaatctattcggataaaaaatg

SEQ ID NO: 3024 - DNA, 3752 bp, Heterodera glycines
ttctttaaaaatgaaatttcatgaatgaaaatttttaacactttttcttgttctccatgttaaataaatcgccaaaaaaagaaaaaattttcaagaaattttctttcattaaatgattttatttttatctgctccaaaaattcttggtggcaaagttacttaaaattcaaaaaattaattgacaatattcacaaaaaatagcgaactgtggacggcacgcgtgccatcattgacctgttttgggacgagccaaaggaatggaacggtgaccagctggggtatacggtaaactgcactattgtagctactgtgccagccggccaacagcaaggcaccagtgatgtgcaatcaggtaagatatttaatttaatttaatttaatttaatttaataatttaataagtaaatttttaaattaaattaaattaattttattttaattttaatttaattatatttaatttaacaaagttttaaaataatttgtttttttaattaaattccaataatgatttttaaataatatttgcgcttttcccagtcaatgcaacgcttcgtcgcggcacaaatcgtgcttacaccttctcagtccgatccggcaaaatttcatgcctgatttttgcgatgaatgatcaacgccttgttggccctccatcatcgccagcggccgaaattgatggaagcggttggttaggagaattaatattttaattaagagttaatatattttaactaaaagatatttaagtaattttaatatccaatattttgctaatcaaaaataaatatttcaattaagagatatttatttatccaatattttgctaattgacaataaatatttcaattacgagatatataattagcaaaaaacttccttgctaatggagccaataacaacacaaaactgagaaatgtgcaaattttaataaactttttgtataatttctattaaaaaaaaaaatattatggtccgttggcattccaatgctaaatatgttgccaaatatgttttatataacattttgccagagttcaagccgttgatccgtttgttcgccatcgattccactgacaatcttgtggccatccaaaattggaccattgagtcggtggtaaagccgtctggcggcagcaaagcacgctttttggccaagaacagaaagcgacgacaaattgcgcatacggtaacaaaaaaaaaattttaaaaaatgcttggcattttgtattgaataccaattttaaaaaaatacacaaaatgacaattttttttttacactagattcaatatcaagctatgacctatgtgggaggtgaactgtatgcaattcggaaggagcctgaaatgtctcagttggccttggttaagctggacatcaatcaagtggataccgtaatcttcaaggtccacatgagtgtagtacatgatttttttgaatattcttttaaaatatatttttatttatttatttaataatttattttgactaactaaggcttcattattgggcgaattttctcaaattgatgcaatggcagctgattgggtagcaaatcggcttctgttagtgagcaaacgtgaactgatgacagtaaattttatacacataaatgaaggctaattaattttgtaaatttattaaatttgaattccgataaatttcaataatattttcactatgctgtgttgtagatacaccttgatcagctgcaagattcgcccagcactgtgctgttgaagaagctgttccaactgtcactgggcgctcaggatgccaaacagctcgtttttgacccattcacgaagttggaaaaccttatatttgaagacatttttgaaattttaaagtcttaaaattttgcctaactctgatcagcaaagactatataataagtagggcagcaacttttagtgaaaaaactctttttttgctcaattgttttgaagaaaggagctcaaaaaacgcatttctgcgttaaaattttttcatttggacgtcacttttcgtcactagaaatcactatttttggggttttgtcactaaaatagttaaaaatcactatttttggcgttttgtcactatttcgacattttttggaaaattccttaacaaaaatgcaataaaaccaaaaaatacacccctaagaatcgacctaaaaaaatttcaaaaaaatacacccctaagaatcaaactaaaaatttttcaaaatatactcctatgaaatgaaaaaaattttctcaaaaatttactttcttggcaaaaattttaattttaaaaattttttaggaactatttttgggtttttggtctaaaaatcccagtcctactcatttgcactgcaatcagtgaataaaaattattttggcttattttttggctgaaaattatgtcactattcgtcactattttggactttttgtcactatttcttcactattttgggatttttactcactattttagttaactatttcgggatttttcgtcactaaaagttgctgcgctaataataagatagaaaaaaaccatttaagtgatcagctcgattaaataatagaccctgatcctatcattttctctttcctagtgatcagaattagttcaatgctaattaatcaatccctgataaatccaagagtaatcaatcagttacaattaattcttgatcattttcccattagcacagcctatttgttgaccaagaatggttcactgttttcgcttgatctgaacaaaggcatcgagagcaacttagaactgacaaccggttgcctcaggcaaaaggtaattattttaatgaatgatttgatgaaggcacaacacacaacactcactaattagcctaattacataaatttgttcgcttaattaagacgatcacttcaattgtgggcgaattcatatggaacaaagcaacatctccacaactgtacgcactgacatggaatgggctgatcgagctgaagctgaactcggacaacaattgccctgacatcaacgtcaattggtcactttttgggggtgaggcattttaaaataattaaagattttataatttgttaactctaaaccaactaattatcaaatagcttaaaaaaagtataatttaaaaatctaaaccaattaaatgacaaattcccgatcagttttattcgaaaaattttttttgataaaataaacagtcaaataataatttttgagagtaaaaataacatagaaaagcaaaagcaacaaacatacaaaattgtaaactgaactgacacgggaaaatatccctgccatggatttggcctgttgataaagataatctgatcttgggagattattcggccataattttcgactaccgataatattgataaaaatatttaattaatattcggcatttaccgctcaacccaaacagaaagtggcctgaaagcaatttcgttgttcactgttgcggacaaagtgttggtgtttgccaccccaactgatctgctggtgtacgatcggcaagcggctgcggtgtcccaattccccagtccaagcccaccaattcgtcaactgttggccgtctcacagtcatcccaaccattccctgatcgctactgtttccagctgccacccacaaatcagatcaacttcaatgtgaaaaatgaaggtataaatgtgccatttatcaggaaaatgcgtcagtcagtgctactataatccaagaataatgtagtccacaaaaaacaaaaaagcgtggtttggtgcctccggcggg

SEQ ID NO: 3025 - DNA, 1456 bp, Heterodera glycines
actatttttaattaaaaaatgtcgagtgtggaagggtcttgatgggtggggggaccaaaaatttctaactttatgtagtcaaattaattttttaatatttttatgaaaatttgactaattttgatcaggccgaactggcgcggtggttgaagtgcatgagctgcagcagaaggatgcggcccagcaacagcagcagcccaacgaatgtgtgaatgtgtcacaaccgatcacacaatatgatgtgcactttcgaaaacatggcacggacaaacaccaacaggtgggcatttatttatttcaaatttcgtgaaaactgtacaggaagtttgacagaatgccaaagaatttcctttaaagtttttcaacataattgaaaaagactaaattaaatttaaaattaaagaatcattttaacaacggacattcgtgaaaatgaaaaatattagatttacaaataatccaaatttgtagaggaaggttggcagaatgccaacaaattttcctttaatattttaaatataattaagaaaaatttaaaaaataataaattttattttattactctaaaaattgtctgcacttttaaaggagaagatcaagaatgcccattcgagcagcaatcgtattgtggtggacaacggtgtgctggaaaagtacacagagtaagtttcaaaaaaaataaattaaaaatttcaaaaaataccgtacttttattgattagctacgatgttacggtaagctggctgaaccattactgtccagcgcaaggccaatcggaggccaaaccgttgcacaccggttttggctatccgtccgcgcccaaggacccaaaagcgttggcactgacgccggacacggtgctgctcagctggaccttgcctgatctgttgagtgcgccggctgctgaaattcgttaccgagtaaaatttattatttttttctgaataaattaaaatatattttaaaatattatttaataaaatgattttaattatattttatcattaattaaaaatagaaaattaaaatatacttttcttttaataattctaaaatattttaaattatatttaaatttaaaaagtttcattttaaaattttttaatatatattttaagcacttatggtaaaatataaacgaaattttattataattttaaaagaaattttaaatgattttgttaagcacttaaataaataattgttttaattttttattatgtatgtaatttaaaaaaaggatttattttttgcaatttaaaatagggttcgagccccgtggggcgggggtggcttttcacgggggcgggggatgcgggggtcagagtcacgggggcgggggcacgataattccgcccccgcggggacgggggcgggggtttgatttgaattaactccaaaaattttacaaaaaattaattttttatcaatgatgtgatggctccacattccttta

SEQ ID NO: 3026 - DNA, 2432 bp, Heterodera glycines
  misc_feature (2191)..(2191): n is a, c, g, or t
gaaaactgatggatctgttaatagatttgtccaaaaaatgataggtttttgcaatttatagagaatttttttaataagatttacgaatttttgggccctgcgattccgataggcagcgccaggcgaattttaaaattaaaaaaaatcaattaaaaaagaaaatgtcatcctgaatcgaactcacgacagaaaataatgtcaaggttgattcactaaccactacgccacacacgctacacactaatgaccaataataaaattaactttaattcataaaaaattttgtcaaaatggttaaaaaaaatcaaaattgtctaagttttttgggctcgaaccataatttaaaatttgaaatgtcatagaaatctattaaatgaaattaggaccgaaagtttaaaaatccatttccccccccccccaattaagattagccaacagagtcctacagttgccaacccagtcccggttgctgttcgaccagcggaaggcaccggcgggcatttttcaaccgcattagccgaagtggtgccatgcgaggcaaacccatgccttgccaaagtgccaaaccttcgtccgtccaccgactaccacttttgggtgtgttcaattttgttagggctgagatttcataaaaaaatttcctattttttttttcaaaaatccgaaaaaatgctgaaattttgtgtgccctactaaaatgcctactccggaaaggtcgttgcgctgcacatcaatcgactcaatgctgacgatcctgaagcaacatcaggggagagccaggcacacacgcgagacattcctggcactttacgccttgaaaatgtgaccagtaagtctttaatataacccaagaatcagacccgagaccgggatactgtaccagttttagacccgggttaattggtgaagaaattggaaaaaatctttgggactgggactccgtttctagactgggtgttattagtgaaaaaatcggaaaaccccggcgaaaatccgggaatgtgagaacttttcccgatcaaaaaacctggggctttgcccctgatcccgatcagttttttattaaggaaaaatttccaggtgattcaatgttcctccgctggaatacattgatggccggtgtggatgtctcatcatcccaattagtccaaatttccatccaatatcgtcaggttcttatgaaatttatgaatttaccacttttttaatttaaatgatttttaaattattaatatttattttaaattatttttttcagagcggtgtggacgcctcgtggacggatgtgcgcaattcgaccttttcgctcacggatttgccccaacgttttgtgtatgttgatcaacttcatccggccactgcctatgactatcgatatgccgctgaatacaccacaatatttggtataaattttttttaaattaaaaaatggataatttatttaatttaatttaatttttaaaaattaaaataccaaccgttttatttttatggaaaaaatctagagctcgacattttgatggaatttttcaaaaatttctctgggaaggtggccatggtctccgctgtacccgcattaattaattagttaattaattattggttacacagatggcattggcactatgccaaccgctggaagtggtgccgtagatggtgcacagcagcaacagcagccgacagtcccttccggcgacgccaaagagtctcagcaacaacagcaatgggacggcaagaagtcaatgcttgccgaaacgttctatcagcagagtcaacaagcacgtacaaaagcgggcacaccgtccgcaccgttggaagtcaaactgaacaatgagcaatgctacagtaacggtgagtacggtggtgggttccgaagggagtaaacaaatttgtattattgtgtctgtgtctgatcataagttaaatattcagctataatttgggacaaattgtgtccttttttttaatttagttcaattttttaagaattattaattaatttttgtgattaaatattttaaaataaatttatttaatttttgtgcattatatttccaatggttaaaattgtaagagcttaccaatgcataatgaaatgtcatttacaatctgccattaattatcctaattaagtgggtcttttgtttaccgttttatttttctctctattctggtcgatcattatttttanagaaaatttttgtaaaaaaaattcatttttaatacctgacaaaaaacagatgttaccacaaaacaaccaccacagcaacagcaacaacaaactgattggacaacaatgacaacacccacaacaacaacaatgaaatgtgaagctgggtggacagcgcgacggcccgagcccaagcgagacggaggcgaaccaacacaaaaacacgcggaggaacaccggcaaaacggaaaacgaagcgcca

SEQ ID NO: 3027 - DNA, 4901 bp, Heterodera glycines
aaatgtgaagctggttggacagtgcgatggtccgagcccaattttgacggtggtgaaccaatacaaaattatgcggtggaataccggtaaaacgtaaaacgaagcgccaaatttttaaatttttgaaaaatttaaagtgccgacactcagacggagtgggaaattgcggaacgcggcttgccacctgaccgcctgttttggcgcgttgcatgggctgaaacgcattcacggcgtggcaaaacgccaagtgatgaagagcttgtccaggggtaggttcaagtccaattgcatttttttacgattttcaaaaaaatctggaaatttgaaaaagaactctttagaattttttacatagcgtaaaaatgagaattttttttcgtaaaaaacgaagatatttttgcatattttcatgtagtcaaaaaattctttttttttttaatttttagacagttccgtgtgcgtgccgccaacgcggaaggcttcggcgactttggctacacaccgttgagcgacaaaagcgcttcaggcaatggccccggcggcatcagcttttggttgcttatactgatgatactgttctcgctgatgttgttctcatgctgtatcgcgtgcggatactgtaagaataaacaaaatactgtaattaaaattcggcaacatttacctaagcgcgttatgcctgattttctgcatttttaattttaattaacaaatttataagaaattttataaattttcgtaaaaattcacctattttattaaaaaaaaaataataatttttctcggtcaattagtcactaatgatctgtcccgccatctaatcatataattttttcaaaatatacaaaataaactaatgattaattaattagctaatttttggattaaaatttaattaaaacaccaattaaattttgatgcattaattactaatttttatacaatttctttcaccattttagtgcgttggaaggtggccgaacgcagacgtatacgtgaaaaattgcataaaccaatctgtttggaaagcattggacaacaaatccaattcccacaatcatcacacaaattctcacaggaagtgctaaacgaattaaaaagtaaaaaataaaaggaattttttaaaatttaaaaaaaaattcgcattattagcactgcctcggcttaaaccggaaagtgtgaaggcaaccaaagagttgggcatgggcagttttggcagagtttgcgaggtgatggcattatttttcatgaatatttaaagaaaattgaatatttactttaaataaatttttaaaatttgtattatttatttattttaaaactaaaaaaaaaaattataattcaaaaattaaaaaatatttaaatgcattaatttttattatacagaaataatttgtttgtttaaatatttattaattaataaagataatttaagttcaaagaaaaaaatattgtaaatttcctcaaaattttgatttttcaattaattaattgtaattattatttattaaaatattaaaacaattaaattaaatacataatattttataaccttttaatttagggtcttatgctcacaaataatatcccaccaacatccgtacgggtggcaatcaaatatttgaaggacaattgtgaggaaaatagagtcaaatttctcaaggaggccattttgatgaagtgagggggggggaggccgtgaaatttttgaattttaaattttcaagaaattttgaccatcccaacattgtcaagctgcttggtgtgtccatggagggtgaacagtttctggtgttggagctgatggacggcggagacatgcgcaatttcttacaaaaatcgtaaatttgtacaaaaaaaattaattaataaattatttttaaatgaatttatttaggttatgaaaattgaaacttaaataaaaatggtttaaaacagtaataaacttcgcgtttcttaaatcataaatttggaaaatttaaatcaaaaatatttttttgtgaaaaaatttttcattgttttcatgcaccttggtggaatttaagtatcgcatcagcacgtttttatattgtaatagttaaatttttataagttaaaaaaaagagaataatttctacaaaataaaattgtttttttaaaaaaaataccgttcccctaatcctcctaccaaaggcgtccccaccgtactcggccgtcgcgcgtgtcactgcgcgaactgatcgcaatgattgttgacgtgggccgaggctgtgtgtacctggagaagtacaagcatgtgcatcgcgatttggccgcccgcaactgcttgatctcctcagccacctcactgcaacgggtcaccaaaattgcggactttggccatgcacgggaattgttcgtcgacgactattaccgcttcaggggaggggttcgtaaaaaaataaaaaatatgtctcgatttcaaagtccattttcccgtgatcccgatcggacttttttgaaaaagtgctgtgatcgtggtccagaaaaaattgggttttgaatcccgggtctggattcatatcctgttaaaaccgagatttgaatcccagtaacccaaccccgatccattgccaatcccgctctcgactttttcaaattccgggctctagtactcataatatatttattttcaggatttgcttccgctccgctggctatccccggaagtgatcaaccagggcttgttcacatccaaaagtgacatgtgggcatttggcgtcttactatgggaaattgtaatttttaattttttcgaatttttaaactaatatatttttttaatttttaggtgacacttggtgaacaaccatattcgcatatgtcaaatgcacaggtcttcagagataaacctcatttcattatcttttaatccttttcattaaaatccgttttcggatcttccataatccgatcattaatttcttgatttcaaatcactttccatgaaattttcacatgatcgaaattgatccaaaaatgtcttaggtgttggccaggctaagcagcggcatggcattggaccgaccgccggattgtccaaatgaactgtacgatgtgatgaagcaggcatggacagtctgtaccgaaaagaggccacagtttgcggacatacagccccggcttgagacaatgcggggcctaccagcatttcaagtgggtttaattagctgataaatcacggctatatggatcaagcaaaaacaaacttcgtttagctaattgatcgatcaagaaattttcaaaaaaaaaattcaaaaaatttttataaaatgaatttaaggaaaaaagaatgaaaaataaattcagagattttttcaaaaatattatgaattactaaattttctctaaaatttttcaataatcgatggaaaaaatattaatgattttctgatttgatcatcaactaaatccattttaaatgttcagtctcgagacccattcccgccatcatcattatgcggcgacaatagcttttttgacgcttcacaaaattcgagcacctcaaaaggagaacagtcgtctaccacgacaacaacaaacggtgatggtgaagagtcgtacacaacagcatgccaatttgacaaaagtggaggtgattcaaaatgtcaaaattaaaaaaaatatatattttggaaaaatctattaaattaataatattttaaataatttcatcaattaattcttattcattttttattgtttgattttttgtgcttgatcattttttgatttgattctgtattaaaccgagctgattagatgataattttttaagttatgaattaaattgaaaaaataaataaaataaaatattttctcaaaaagattagttagttctccttttcctaaaagaattacatttttttaattttggcgttttacagaaagtttctccgttcgacggaatgccaaacgatcgcgccgcaaaatgccaagtcggtccagcgttgaagcaagtactggcgccgctggcacggctggtggtggtggtccatccgcttcatattcatttgggacaacaagcaccggtgtggattcatcagagtatgaattgccgaggtcaggggctcagcttatgttgacgttgccaggatcacggtgaaaatgaaaatcatagattaataaaaaaaaattaaaattcttgagccaggaaataataaaattgccgatttcgttacaaagaattttctaaattagccaaattatttttaaaaatatatttctagattattaatttttttatattgattttaattgcattataagtatggaaaaaaaattctataaaatatttcattttgtatattttttttattaattaatttaccaaagtattttgaaatattttattcttaaaatttttttagcatttagattattttaaattgtttattttattatcaaatttaaatgtgcaattcaattaaatttaggccaacaaatcaccgacgatccgcaaccacaggatttcatcaaaatgacgcatttgtggccgattcatccgtggatgaaagcgccaacggtagcaccggcggggaccaacaacgcttcacccggtccatctctttggctggcacttcacgtgccgccgctgatgagccactgacgacgccattccgacaatttggggcctcatcttctcggatcagtcgagtctaagagtctaagctcaaatacaaataattaaaattccggaacatttttcgaaaattgcgagatttatccgcggttccgattcgcccttatccatatttttagtgcgtcatatgtctccactgccaaaaattttaaatgattttaggatgcaattttatggtttcaaggcatattatacactgttcattttgtgtctatcatttaatttacatccaattgttata

SEQ ID NO: 3028 - DNA, 6750 bp, Heterodera glycines
  misc_feature (22)..(23): n is a, c, g, or t
agttgagaagaattttaacccnntccttacatatcgctcgatcaaatattaactcgaaacgatttttgttgatatcaaaaataaatcggcaaacgagcctaactttacggtacgcttgaacccacgcttccattcccatttctttcgttgcatcaagaattgtacggtcctcctctaccatatttttaatttcttcgttcaattttgctctgatcatttcttcgagtatgtccaaatcgggaccacttaaatttgaaaaatattcatccaatttatgttggtatgattcattgtcatcagctgacattctcaacggaattttgctcgtctccgcgcgcttctcacgcgctaaaagaccttgagtcacaccaaaaaggtcacaaccattgtttcaatgtccgtcaataaggcttctagaagtttttcttcatctcgaatacttcgtttctctctcgtttttcgttttatgtattcttctctagccccacgacgagcagagtttgtagcatgcgaaaaataattctgtgcggttcttaccttttttgctaacggttcacttccttcgcccaagagcctatacagacttttacccaagtcaattggatttgtgacattcgatggcggtacttcaatacgcaccgtatttcctgtttgccattcaacttctacaaattgctgttcaacagtaccaatcgaaggccaagtatgaggatatacaataacagcgagtccaacttcccattcggagttgaattgtagttttcgtggtaaacgaacccggaatgaatttgtcttgttaccttcaacatttgtatttgaaggaagaacaatgtaaaaagaattggatggcattttttttaaaagataaagcgcaataaagtttttatatatttttctcggagatagaactcaatggaacccagctattgaatttaatactgtatcctttccattttaccagaacgtattcaataccattttgttttttcttcttcaaaattgttcaatatcatatagtgattctttgtttttgagaattttgcataaatcattggaataaaaccatccctttataatttcgttgctatcgtcacttaatctgtaaacaacgggcgagcgttctgtatgtacttctgctaccgtaaatatttcatcggcaaatcgtggtaaataacccttttggaatacatgtttgtatttttctattctcacacggtcgcccactttgaatttaggactcttttttggaaattttttcgcttcattatataacttttgtctcagttcctctgcattttcaaaatttacgtcagcaggtcgcattccaatggaggagtttatagactgattaatgcccttaacaatgtcctgaactatctcaatccatttgtaagtgtctctttcggtgaagtaacgatataaacgttcttttatactacgattggcacgctcagccataccagcgtggaatcgaggggaagtcagcatgcaaaaatgtttaacatcttttgtatcaaaatatttttttactgaatgagctgtaaattctttcccttgatcagtcaaaattttccatggaatgtacttgcttctcataaagatattatcaaatgctttaattatgtttatacttgtttttgactttacaggctcaacaaatatttgtctacttagagtgttaatgcaaactaacaaatatttgaatccacgattatgttttgcaagtctatcaagaatggccaaatctgcctgccattcggtatgtaatccaggagctaatgttggtaagtgtctgtagcgacgcttggcttgccgatgtaacgtataagttcgttgtgtgtacaagaaattttgaacatctgctctcgtgatttttctttgccgttttttcgcctctctcaacaatggttcaaggctcgtgaatgcgactggtgaatttatgtctttatacaaaaactcgagtaatcgctgtttcttcaaatccataacaaaggcttaaattttatcatagcctttttataaactcccgtgccaatttgaccttcagaaaagagacgtttactcaaaagcggattttgtttggctctagcaacaaactctttgagtgctgttggttctttggcatttgcacgcttgtctttgtttaacaaatgcgcaacaatatcttctatattactcgttctaagaacatggccatttgttttgataatctgtccatcctcattgattcccaaggcctcagagtttttataaatgtaatttataatatccccttggtcaaatgtttctgcatcttcaaaaacttcattttcttcatcttttcttgttttaccaagtttgatattacgacgtctacgagcaaccggtcttcttaccagattaaaaggttttggcatagcctctgtcatttcctgtaggttttgcaatttaacatcaacagggcgttcctcctcatctttatttaattttttgaggcgtttaaattcttgttcatatttaaatgccctctcatcatcgttaatttcatcatcatttttaatttgcttaattcgtgatctaactaatccaagaggacttccatcttgaggtgacgtcagactctgataaatctcctaaggaacgagcaaataccgctttgtgtattgcatttttaaaattatttattgttttttgtggcgttatttataatttgcaattaaatttgaaaccaagggcaaaacaattgaagagagcaatccagctatggctggaattcccgcaccgtgttgcaataatattcgttttgcggaacgagaacaacgtgttctggctagatgacgcaaaatctgagcatgtgttttcaatttttttaaatgttcaggctttagaggaacccgtccttttaaaatattaagacaaatctctacgatacataaaagctgttcatctgatgctctctgtataagttgtttggaattttttgcattacaaatactctctaaaaaatttgtattctttgtaattaaattggaaacattcatttttgaacgtaaacaattatcttttcatcatatatatgtgttctcaaccgtaaaatttcaagactttctggatgcatgtcaactaggagataaccaaaattttttgaacatgcgttacggtatgactccataaaatgagctgtccttgaaggaaaaagatgtgtggctaaagtacgaatttgaagctcaccggttgggttccgcattaacaccaaataatgtgaatttccacgcgcgacacgcaactctttattaaagaggtgttgagtaactagaattatgctaactccccaattatgtgaaccgcgagtaaagagtgtgtctaaatattgctgtctcataccaaccaataaatcgtccaacaccagcaacaatttttcctttttggcatttcctttaatgtagtcttcagcaggaactccattgtgaacagtgactgttatattgtcaattctcccattgcgttgtaaatttaaaatattcggattcagctccccgtaacaatacaatacacgctcaattggtactgaaataattttgtccaagttacgtaataatctcattatccattccgactttccacttcccgtacttcctgacacaatcattgtgaatggatgacgaaactgtacatccgtatgatcaaaagtttcctccatttttaattacatttagatttaaaactctatatataacttttaattctgttaatttaaaaaaaaatggatttaattctcgccactgattggatgaataacgcttacccggaaatggaacaggacaaggctaacatgtcaccaaaggaagaccctagttggattagtctcattgatgaagaggaaaagcgggagcctatagctattgtgcaaatcgatgaggaagaggagaaacaaagaaaaagtttgtcttttagtgttattttttttaattaaaatttagatcctcccggaaattgcgactgtcgagagaagcgtcgttgctttattccgcttgttgaccacttgtgcaagaaatttgagtgttccgcccacgagttacacgtactcttcaaagacttggggaagcgtcgcgccatcgttgaacacctacgctcttctcaattgtgcacctcccacctgcgtccatcgatacggaatttcccagttcgctgcaacgatctctccattttggatgctcactcagtccctgcataccgtggttacctcggaatcacggtgtttattctttttatttttttatttctcaaaatattttaggttcgaatgcactattacatcaaacacggtattcgattgcgtcattcaaatttgccttgtgttgttgaatttggcggtggagatcataagactttcttcccattagaagctttgaatattgttatttagatgttttctgtatcaaattgtactgttgtttttaaaataaatgctcaaccactaacaattgaacaatttttgactattgcacaacatggagccaatactgagtacaacccacgccgtttccacgccatcatcatgcgaatccgttcatcaaacaaaaaaacagtggctgctctaatttttcagtcggcacgtgtcgtcctaaccggcgtaccccacccagacagagcaagagtgtttgcgaaacgagttttgcgaagaatacaacatacacaaaacaccatcttcgatatccatgagatgcgtgtggtcaacattgtgggtgtgaaaacctttccacaacgaatctatgtggagcgcctcgtaacaagactgggtggtgtttacgatccaagtattttcccagcacttcgatgcaaattggaaaatgatgcaacgtgtctcatctatatctcgggaaaaatcattataactggtgtcaattcaattgataatttacacaatttatttcaatatctctcaagtgtgattcccaaattttttcgttgagattataattttttattcattgattataaattttcaaaaccatccagaataacccggtcgagttgggtcagggtcaatcaatgttctctttcttcgttcagctgtaggttgtattggtggatgtgatacatcctccacatatccaaatggtcgtgtttgcattcccggtcgaacacggcccttggcgtagaaaggtctgtagtctttgtgggcctcgcaggtgtatacgtcagaacggacatttcggtcaatttgcggaaaagttactcggatgcaacgatgggctccacctcctccgtacacgtagagatcatcgttgtcgatgacgtcatcactaaaatttaaaattattagttgtgaaaattaaaaaaaaaaaaactgacataggtccgtcaatgttatatgtagccagtgtcagatccttcattgcttcaaaattcagtaattgttgagtggcgtacgataatctgaagcttcgtatttttaggttggcccgctcatcagttccgtctcgtgctgtgtgccgaattccataattttttggaccaccagctacaaattccacaattcgacgatcaacatgctcacgcttcatttgtccaagtgcctcgccttccggaacacaccgcccacccatcttgttcacgtagtagattgagtcagtgtctaaaattatctaacatttttttttctattgtattcgcaaaccacaataaagaagctcagccccttccagtgcaatcactttttccatgtatgaatagagatgaagtctcgcgtacgatgtgacgtatattgcgactggaagacagtttgtgaggggtgcctttgcaaactcgggacgcttcctgacaacaactcggtccatatgctcggagacgtggacaaagtccagtttgtctaatgttggatcgtccaagagttgatggaattccgctggagtgcgcgtgtactttatctgcgtgaaacccacgcgctgtgccatttttcccctaaacattttttttttgttcaaatagaagtttaaaaacgtataccacagagaatttgccaatgttttggcaatgaggcggagccctgggttgggtgtcattttcgttgagtctagttggatgccttccgtgcgcatgaaattatccacgaattctttacgttgttcatctgtctcacacccttccggccacccagtcgcttggactttgagaccaacgaatgtattgacatatttgctgaacaagtcgtcgtcccactcgtcatagttccaaaccttttttttatatatatttttttttcgttatttttaatgtacctcaaagagatcaaccacaatatagccgagttgaagtgccttgttcaattccatgtgcgtgtatgcgcacacccaagaacgcttttcgtcaccatgttgacatggacgttgctggcgtctgtccgcacaccaagcacagagtggaaaggtgaaacgtccatctttggtgcgatagcccagcaacgggacacgaattaggcgcggtgcgagcactcgtacaagtaaaagtccccggaacatgttatttgacgaacatgtccagggaagtggggccgtgggtggatgaagcaatacctcacgcgtgagaacacgtggattctccactgggaaaggattcaccttctaaattcaaatttaaattgaaatttattgagaaaaagcaccatgacgtagggatataggctaactatatcaatgcacaatatctcttcatcgtctgagcacacatgatgaagtttgaagggctccgtacgaccaccacggagtgcat

SEQ ID NO: 3029 - DNA, 1733 bp, Heterodera glycines
gtggtccttctaattaagcctcggcaaaacttttaaaaaattttagtttagctttcaaaaaagttacggccagaagaaattcaaaaaaccaaatttttccaacttttttcggccatcaaattggttcaaaattaacaaaattttttggaattttgcaggctagtagatcatctgaagagctttcgaatgataccaacaatgttggatttggacgagaaagaaaaaagtatagtggaaaaacatgtgctggcgcccaaccgtgcgcgcccaactgaggtagaccgggcgtttgttgtgcattagttaaattgtttttgattttccatgatcaaatcgttatgtagtttaaccctccgaatacaaacaaacaaatttaatttgcaggaggacaacctgttcgagcagttcatcctgtccactcaaattagctactgttactatgccgactcgcatcgcattctgggcaacacctttggcatggctcgtgctgcaaggtgaataaaatttcggagggtggaacccaaaaatattctcttttttttttcttttttcttttttgctctgttaaattttattctccgtatgaaaaaaggcaggaatttgtagtcttctttttcacgaaaaatgaataatttttgtctttttggtgtcagaattttcaaaaaaaaggggtagtaagagcggggttcgggcgttgccgcgcctggaaaatttttttttggaaaccaagcatgtttatgttaacaagggaacattccgagctgtgagtgggaaaatgcatataagctatataccattggatagagcggggtcgacttgtattgtgaatttttaattttagcggtgcattccgcctgcttcaaaagttacagggcctcgaaactcgaaaattcgtgcttctgtgctcattttcaacttttttcactttatatcgatttttctccactttacaatgacagtacacatttattttaaacaaagaaataattttaatgcatttttcatatttaaaaatgtatttttaaaatctttaatttgttaaaaatttaattaaatttatttatttttatgttggattcgaacccggacccccaaaattgtacttacctcgactcgttctgccatcagcattctattctgctcgcgtaaacttgcgatttcactctcaagttggcgagcgtgcgaaaaacccttaatcattttatattttatataaaaaaaatattaatttttcgtttaagctcatttatcattggcaataacaggtgataactgtataaacaagacatgataaatggctttaaaatacccagtaagtggaaagaatgaatggatgggataacccagcctcatccaagacaatagctattctcatcgattttactattataccaatgaggaacttatacagtttacagggtactttttacatacattttcagatgcctataaatgtgtttcaaaaattaatgaaaataagtgttaagggttctcgaggtcgatgatcacgaatccggactcagatcagcgctaccgttcatcacatgagctgtacatggacaaagaattgataggcttcctgtaccaataataccctcattggcaagatgcccatgaggataccatccatacaattttcgaattttatgcttcctgtaccaaggttaccctcgtgggtaagatgccaatgaggatatcatcctatatattttaaattttattattgttcgagt

SEQ ID NO: 3030 - DNA, 4652 bp, Heterodera glycines
gaactgtcgaaacggtggagggcggtggcctcgtcgtgctgctcatccaatcggtcacctcactgaaacagttgttcaccatgagcatggtacattaaaaagccaaaaaatcatacgaattttagttaaaaaaaaattgtcttggaatgtttcttttttctgagaattttaaaatttctatgattgaggggcatagaaagtgcccgactagaaattttttagaaaatccgggcacccataactctactaaaatcagaaaaattggagctaaatttttggactaaaaaatcatgttgctctgtttttcatgtcccttaaagtaaaatttggtgcacacttctgaacattatatgacgatttgtgggtgccaaaaaaatttttttttaatgccaacaaaatagcgccacaagggatttgtctgtccattatttatttattttgattgccatgcctttgcgcaggacgtgcacaaacgctaccggacggaggcgcacgcggacgttgtcgggcggttcaacgaacgcttcatcctttcgttggccagctgtgccaactgtgtggtgatggacgactgtctgaacgtgttgcccatttcctcctccgtcctcaacatggccaatttgccgcccgtcgtcgcccagcaaaaagtctgtcttattttatcttaccttgaaaatatgccgggttttgagaggagtcagtgccggttttttttttgccaggttttgagagtccgtgacaggttttttgccggctttttcaacacatgtgtcggatttttgggctttgagtcttacgtttcaaatatacccatttgcacttatagaattcaatggcggatttctgtccatcgattcctctagaattatccatagtaaaaaatattaaatcgcttcttttcatacataaaaaaggggggtgggtcggaaaattttttgcgaaggggggtcgggccgcccgatgacctttttttgtttttcaaaaaccgtttttttcggcgcaagtttttccaaaaaattttcgggaacaggggggccggcggtgccgttaggcgccgccggagaaaatttttaagttttgggtgtgctttgttaacagattttcaccaaaaattgccaattttttaagaaaaatttggattttggggtccggcggtgccgctaggtgccgccggagaaattttttttccgatttttaatgaatttgttaagaaaattttcaaaatttgcgagctgcgaaccctctcctcccacctcttttacacggaccccccccccctaaaaaatgtgcttctttttgcatcccttactaaattaggtaagtaagttcataacggcaatcaaacccaaaaaattcacagagtgccgcgggcggcgatgtgtcgtcggagttggcacggctccaacagtcgctggccgacacaaaacccatcggcccgttgctgcaccggtgccgcacactgtgccaggccaaggcgctgctccgcctactcgacctggtcaccgacaaaatgtccaactcaatgtgcgcaatcaccgcggcgcgtgggcgcggcaaatcagcggccatgggcctggcggttgcgggcgcggtcggctgcaatttgacgaatatttttgtgacgagtccaacaccggagaatgtgcgcacactgttcgaatttgtgttgcgcggctttgacgccatcggataccaagtgagttctttatttgttttttggcccagttttgggcgggggatggatgagataggcatccaaattgtttgaaaaaccttttaatttttatttgtaattagtgacaatttggtaggggtttcagtcttgcggcacgagggacatagaccacaggattttggagggattgtccggatttttttgtggccgatacgaatttttggatggtttttacgtacaagtcccaacccccattaaaacctgtacgggacaccctcgtttcagcgccgctcgtttcggcgccagcccagtttttggactataacttttttctttgtcaaccaaatctaacattattggtatcattcgaaagctctaagtgttctctattagcctgctaagtttcaaaaaatttcgttaatgctcaaaaaaattatgactagaagaattcaaaaaaccaggccacatgtgtacttttggccataactttgttcaaaattgatcaaattttttggaattatgcaaaataatagagcatcggaagggctctcgaatgataccaacaatgttagatttggtggaaaaagaaaaaagttatagtccaaaaactgggctggcgccgaaacgagcggcgccgaaacgatgtggacccgattttcatagcctcaaaaatttttttgagtttatgactttaattttgcaaattatttacataacgccaaaatgtcatggctaacaatgcgcgttaattcaaaaaaaaacatgaaaatgtctttcagcttcgggtctattatttttgcttcatctcaaaaattagtaatatttaaaagcttttgaaagaagagcaaatttttctcggagttttcagtgtcatatcatgtcgaaaaggttatggcgaatctttgaaaaatttccattgcttcaaagacatttggattgttttctctcaacgtacaatggacaaaataaaaacaaacatacatatttataaatgtattatttatctgcataaaacaaaaatgattcctaagagccgattcgatcgctttttctttgcccttccctctttttctcccatttctctcttttctaatggtgcgccggctcggcccaatgtccgccccaactcgtgtgcccgtacttcatcttggaatacacctcctccagcccgatgattaccaccgcaatgcaaaggccctctttgatgcccggcttgagcagctaaattggggagagaatggagaagcaaattttaagtggcgcaccggcatcaacggacgggaaaaaagaaaaaactatggcaaaaactctaaaaatgcttgaaattgaaaatttaatgggattctggatggtactaacagaatatgtgtgctttgtggttgtcaaattcccttcccctccccaaaaaaaattttttttcgaaattttgcacgagggcgccaggcccaattaggcacattgaattaaagcatgaaacaaagaattaagaaattcatacaccgtaattgcaaaaatatcttattaattagcctttaaatgatgttaattggcccttaaatgaccacttttccctcctctcccgtcgtgttataccttccacgcatagccaactttggtgtattgttttgtcacattcgagcacgggttgtccgggttgtacatccagtagatgttactgaacaaaaactacatttttttgttatttcaatttttgtcccataattccgaccaaagaatgctcaataatgtccatttaccgaatccacgggtccttgagacccatgcgctccaatcgtttggcatatgccaccaaatgaggactccgctgccaatcgttgtatatcgaccagtgcctaaaacaacaacaatttcgtggaatgccattgataaagcgaaaacaataccgatgaaacacaccattttcgattttttgaacccgttgcgcaaaattcgtttgctttttgaccaaatttgtgcccatcaaaaagaattggctcaatgccccgtgcccctccccgtagaaggggtaaaatttctaaacagacaagaaacccgaatctgaaaattgtttttcttttgaatacccgccaagccacggaaatcctaaatcattgggaatcaccaaaaatgaacaatttttcggaacactaccaatacgaaggccaatgtcttagaatcagttaaatgggtgacttacggcactttgaacggctccccgtgaccatgtctgggcaagtcctcctcatacattgtggacaattaatttgttgttgtttccgttgggtgttgctttctgtgattatcctttttttgcacaatgacaaattgtctaaaaatgttttaatggcgcaaaacatggaagtcgaaagaaagcattttttcgatagaaaataaaatgaaaataacaaaaagtgttaagcaaatcatgtttgtggaggtctttttattcagtttatcacaccaatcatcctttggagacaattttaataggaaaattcaattaaattatttgttttttccgaaaataatttatagttttgacatttggcagaatcgacacagtttgacacggcagttcggtgttttgtccccgcgcactttttcatcaatggcatccgccgacaccgcctgaattaaaaaaggcaattaaaaggccaattttccaaggaatgcaatttaaaaaactcaaattttttagtgttgggctgtgaaaattggaagccacgaaatatgttttttttagtcggatgacgctcaaaaacccaaatgtttctttcaatttttgtttttggcgttgggattcgtaagtaaaataatttttgtttatttatttttccatttttattatatgattggaaaaacagtcaccagctcgcgctatttgttcaacggaatgtatcaatttgtcggacaatttgcactgtttttggagttggcgcaatgcgtcaagtcggtgtaatcgccgcaatgaaagcgt

SEQ ID NO: 3031 - DNA, 2653 bp, Heterodera glycines
ggtttcactaagaaattgctcacatttgaaatttttcccccttcgttacaacccctcccccacgagacccccgccccctcctttacagccgcccccttaagaacgaggtaggagggggggatgggcacatcccttgttcacatatgattatgacccaaattttgcaatattccgaatgaaaaattcgaattatgatacacattttttaggagcccactttaaattaattcatccatcattatttggtcacctcgccgaagattgcgcgttgagtgcgtagccaatatttctaaaaatttatcgaaattcagtgaaacaaaaatcaaaaattttatttttttcacctggtgataatcctcagcctgatgaaactggtccaatttcttcaggtaagtctgcactcgtcctccgtattttgcgttcgctttttccattgccttctccgccgtttggtgctgcgattcgtccacctgcaaaaaagaaaaacgttgaatttttttttaattcaaaaaatgaaaaaaaaaaattttcattggaaattataataaaaaaacttaatggtaaaaaaacctccaagaaagttaaaattttcgtaaaaaacttttttcgtggggggggggtctgacgagttgccgccgcatttatttaccatacccaaaggatggccgaagcgtactgttttttatgccgttgagttgggtcgtggtggtcgaaaaaccaatccaaaattagctcataagagcaacaggaggggtcgaactggagttcggtgacctctaaaaacactaataactgatttgagtcgaaaatttataaataattaaataaaaattcacaatcagtaatattaaacggagggaccggtgtggtcgccgatgttggcataagttggcgccggggaagtgccacccgcgtagccgacccgcgtatgcagaacaccggccatgctggcaaaagacgactccacgccctaaaagcagcaacgaaattggtgccaaaaagatgggcaatttaatcacccagaagcattgcatgcctgaaaaggggtcaatgtttgattttgttgttgctatatcagccccaccccccaatttttgagaaagtacaaatttagaaatttttcaaaatcgtagcattttttataaaacaaaaaatggaaattttttcctagcgatttcaatatttttatggtgaattagtttttctaaaaattcgctgaaatttttttacatttttgaccatttaaatatatttttttggtggcacccattcatcactcaccaacataagctcgttgtagcatcggagaggtcacaattcgtgtaaacagctgaatatttaaatggcattaataaaaaaaaagtgtggaaaataagataaacggaataaatccgagtgattcaaataaacaattagcaaaagagagcgaatttatagtaaaattataaatttaaaattaatgttaacaataacaataaaaaagtgtgttccgttggtgccccatttttattagactgattgtgagaagagctgaagcatttcgcgctcaattggatgcaatttctcatcagtggccggcacaatgagcacatgcaatggcaaaccttcaacaacaaaaaaaaatcgttttattccctaaaacaaatctttaaatcaaaaaaagaaaattttgtctttattttggaagtgaggcaatgaattgggtatggtaaaaaaccaaagggtacgagataaatagcaatggcacataaaattgaaaattgtatgtaaatagaaaatgaaatgtcacaatcagccaaaaaacttacccaaatcggcggatgccatttgaccgaggggacagtgcaaaatctaaaataaaatttaaattcatagaaaacgacacaaaaaacaaaaaattgtgcaaatgctttgtgttcacccgctggtcggcccatccaacgcgtgccatgccaaccaccattgtgcgctcgtcgatgtcgacggcgttgtgccgctgggaacagcaatgttcgtcggcatcgttttcccttttttgttgttggtctttgctattgcacttgctccgttcagccgcagcactgagaatttgctgtgccgccattggacacgtcaaaaaatgagggggttcaaagatgcggttgcccctaaatattttccttttttcaaaaattttggtgacggatcgaacaaacaatttttcgcgacattttggcatgggaatttgtatcaaatattaaaaaaacgcttgaatctttcataaaaatgtgaatttcttggacaaaaatgcatgcgagtcacggcattgtgtggcttttgcgggtttccgtccaaaacaccgaacccaaaacaaatccgttgatgggactcattgaccggatttaaatttaaaaattgcatttttccccattgtcaaaaaacataaaatattatgttggagtacttgatcaaattttctgccgtttgttccttcactttgatatctgacaaaaaatatttacaattaattattgacgaatttttggtaacaaataaacaacgaaccgagcaggcaaagtgtgtgcattccattccgacgattcagcaaaatcctaaaaaaatattccaaaattgtaaaatggttgatttgcataatattgtaataatgtaacac

SEQ ID NO: 3032 - DNA, 2283 bp, Heterodera glycines
tgcgtctatgtacagcttcccaaaatgtttgactttttgtagagactcgatctgctcctgttgcatgctttccatctcctttttatggaattgttgctgctgctgaagcaacattaattgccggtactgatgttgctgctggtggtttttgacaaaaaaggctcgagaggctgttcgttggtgggctaagataattgtgataagaaaagaataaaggtgaccaaattgattgaccttgacgctattccttacctgcggaccaatgcgcaactccaatctggtgtcttttctttggtatagctttgaaccgacggttattctgtcgcattttttaaaaaataatttaataactaaataaacagcaaattaaataaattgaggaccaaaatgttgagtaaatgaggaaagtgggttatggatccatctgcgcagagaactgctaccaaatcgccattgcgtgacttaagtctttcaccacttcccgccttcttcactcagttggagcaaagatttatgtttgaatatttaaaaataatttaatgggcaatattccttggatggatcaaattttggcatcaatccttccttcgttttcttgtcatcgtttcatttgtgatgcagttaattcttgcacactcttcgcacatctcgaacccaaccgccactcttccattatccagccggcgtaccttctctttgttgtgaaatagtttgtcccagtcatctaaaaacatcaataaattgaagctaaaaatagtaatttttaacctgaacagagtcttatcgccaacatgaattgacccctcgtaattttccaaagaaaacggtcatcaactcgtggtttattagcttctttcaacccatcctcgggagtttcgtgttgtacaaattgttctgaggtttgatgatgttttgcaagactgatttgattgctcgtgaaaaattcggcttaaatacctttgcaaagtgggcgtggcctaattgtccgggagtataaaagaccctgcaatttgtcagctatgtctcattcgttctgctacaatggtcctcgtcatcgaattttgtgcccaaattctcggctgttccccgaaatcactccgcgataagctcaatcatcctgaggaccgagtgaaggcactgaaggagctggtcggaaaaaaggttcggacgacataccaggaccggaatggaatgcagaaaacattttttgtcgacggaatatcggaccatggagcggctttgaccccagcatacggcagactcagacaaccgtacaacattaacattgctgcccatttctacgctcgccaccgtatcaagctgcatttcccatacgtgccgtgtgttgtggagaaatactccgggtgtggcgaagacagatactacccaatggagctactcgaaattgtggatgaagactacaccaacaaagagcgatggcttggcaaattgtttaccgaaattgaggacgacttcattcctgtcaaacgccgtggtcgagttgacgaaaacgaagaaattgacgctggtcgttttgaatgcagtcaaccgtcttacgtttattggtaaacacatgtatgttaccttaattatgcacttttctacctaaaaacgacaaattcgtttttaagtttatacaaattgcaacttccgctccttaataatttacaaattgtgtcttctttctcttaattctgcacttttctacctaaaaatgacattcccaaatgcttaataatttacaaattgtaacttccattgcttaattctgcatgcatgttaatgtccttaattatgcacttttctacctaaaaatgacaagttcgtgcacataataaaaattgtatcttccactctttaataatttacaaattgtaacttctttctcttaattctgcatttttctacctaaaaatgacgttcccaaatgcttaataatttacaaattgtgtcttccattgcttaattctgcatgtatttttattaaaaacgcaaataaaatgacaaaattacacaatttttggtataaaacatgaaaaacaaaggtggtacatgcgtgtgtacgtgtgtatggggtgtgtgtgtgtgagagggatacaatgaatgataaacgataaatttacaaagtgtgtccaaaattgagaacatcataattagggcccactatccctttgcctacatatgggcgataacatttttggagggggcctgaagtgacgtgtccgccacccctaatgtccggtctcaaaaagattgggaacatgacatttatagactcatact

SEQ ID NO: 3033 - DNA, 5537 bp, Heterodera glycines
cttaattatttacaattgtaacttctttctcttaattctgcacttttctacctaaaaatgacgttcccaaatgcttaataattttcaaattttatcttccgttgcttaattctgcatgcatgttaatgtccttaattatgcacttttctacctaaaaatgacaagttcgtgcacataataaaaattgtatcttccactccttaataatttacaaattgtaacttctttctcttaattctgcatttttctacctaaaaatgacattcccaattgcttaataatttacaaattgtgtcttccattgcttaattatgcatgaatttttattaaaaacgcaaataaaatgacaaaattacacaatttgaggtataaaatagagaaaataaagtgggtacatgtgtgggtacgtgtgtgtgtgtgtgtgtgtgtgtgtgtgtgtgagagatacaatgaatggtgaacaaaaacataacaattacaaagtgtgtccaaaattaagaacatcataattagggcccactatccctttgcctacatacggacggtaacatttttggagggggcctgaagtgacgtgtccgccacccctaatgtcaggtctcaagaagtttgggtaaatcacatttattggttcatattctcctgtttgtgcataccgcaacacctcttctttgaatgtgtcgtagcagagggattggttctgcatcacgtcgtagttgagtgtgatgcccctcagcttcagcacaaattcttcctgtccattacgccgaagtttaagcccatactgaaatcataaattgcaattatgaatcattaaaaggataaatttacctgcttcgctccgccactacagtactccacaatctcatggttaggatactcatcggtgaattgtcccaagtgtggccctgtctccagcggattcaagccgattgggtggacaaaaatcagcgagtcggtgtccgtgtacaacagtcggcatccaggtgttctcatcaccttctgcatcgctttcaaaagtagaaggcgggcctttgatgttgtccagagtgagatgactgaaaaatcccaaaaaattatacaaaaattctttaaaagtctcaccagtgttggagcactcgtgctcctccacccactccttcttctggacgtaactgatcaaaatatggtctgcatccaactcgtcgatggaagtgacgtcaactgagcggttgtccaagtattcggccagcaccacaggatcgtcggtgatcagcgtttgcgcgaggccaaagtttcgcaatgagaagcggccccacaagttgttaagacatagtttggccaacgaccgcttgcccttgttgactttcatgttgtctttgtcgattgaaatgccgaatttttcagcacactctctgatgaactgctgctccaactctgtatttcccttgatgctggcgtcaaacccgctcgcttcaattttctgcgacatgaactcggcgatgtagggcctaaacagtttgtcgtcgccatgcttgtacttcaacagtcggaacactttggtcacacggtagccctcttcaagcgcagcatccaattcaatggatgtacatgttgtgacccatccgcgttgttggtcgtcgtgttcacattggtagtcaaaatccacgcctccctttgggtagtcaagagcacactgcatacaaagcgggaagcagagtcgttcgttgactttaaccggcaacactggcacatcgcacttccgtggcgggatcacccacaccttgagcagagacaatttgtatgggttgtcccgtgcagttgtccattccacattttcattcaagatgagcacttttggatgctcaattggataagtggtggagaaactgaaaataaaaaaatttaatgtgggaaaattagtgttgtataacaactcacttgacatacgggtagagggaagtgaagtcaaagtacgagattttttctccctctcccgccttgtggtacagcttcagcggcccagttcttccgcccatgaacgcctcgcgaatgtccaatggcccgtcatccacgtaatcagcaaaactttcgcgcatgtccgggtcacggtgcagcattctttcaatttgacactcccagtacacgtccacacgagaaacttggctttcgatgaattccagccgcttctggtcccgctcccgcacctctccagccgtctttccgttcggcattagcatgttgtcactggggaagcattccttgcagccgtgccatacacatccgttgacttcgattgctcttctttcttcctccacccagccatccacggaatattggccaattttcttctctccgcctgccgaatgcgccgtctgcaccacaacaccatgctcctccgcataccaatgaaagaagcgaagtgccagcaacgactggttttgggcgttgtcgtagccgcgttccgggacgatagccaaatgcttcttcggcagatggttggtgcgaaaatgcttcatacatgcgccggcgatcgtcatgcactccctaagcacatcaatgccgtcgtgatgctcatagaaggccgcacgctccgcaacgattccttcattccgtttcgtcacatccaggaactcatgacgaaaagctaccagcgcagccatcagtatctcaacgtcgtttgtgcagtagcttgtcaatgcttcgtcgaggaaaaatggctcctgacggtgttgttcataccactcgtcgaatttttgtcgtttatctggcatcattccgctgaccaaatagtcgtccggcattgggtggatctgctttccgtagttgtccgggtggttggccatgtgcgggaagaacggcttgtcctccacgtccaagccaaatgatgggaccaaagaagcgagggacattggcataaggttgaaggagtcgcggaacacaatgttggggttgcgctttttctgccttcgaatccgcatttcgtacattttattccccttaaaattgaaaattattcaaatttgaaaaatagtcaattattactttgcgcaacatgtccgggttatatccgcgtttgaacaattcgcggaacaccagcaccatatcgaaccgaccgccaaagtgagagaaggcataggtgtcgtaggcgagcggtaagtcgtttatcaaccagctgacaagcgcttccaaagggttttccgccaccacttgcttgtcgactgttgtttcggtgaagcggcgctggcagaacgcgaccgtacgattaggaccgcacacttcacaccctcccgatgcctctcgccagctctcattttcaatgcagtcggggcaggcgacacgcgcagcgataaagttgggcaaatgttcacgcttttcgggcttttcagatggcatgtgctgcatagtctccaagtcaaatgccacaattcgataggggtcgcgttccttgggctcgatgggttggatgtagcatccccgctcggtgttgtggtagttgttgcacatcttacagaagcgttcaccacaaacatgcccttttctgccatttctgttgttaaccgctacgtcccaaacagcaccacaatccttgcattttttcgaccgcttgcagtagcctgactgcagatgatgctggtagcagccgttgttggtgaattttttgttgcattctttacactttttgatgaatccatccgttggctgacacggaaacagcggtccaacacgtgagcatagcacacagcgcgctttacatgttttgctgtgctctgacattcttcggtacgggcgctcacactccagacaataaggcctgccgaacaaaccgccctgcttctgcacaccatcgaaatggtcctcattgaagtacaacagcagcggagtgtcgtaagtggtgtcaatgtacttgtagatcggtttatactgtcccaacgatccaaagatgaacacagcaaagcggtgttgtcgctgcgcgttgttccagtagtcaacgacgtgaggcacaaaagtgttcgcgtcgtagccatccaagtccattggtgcattaacctgctgcatgagctcaaccgcatcatgataaagttgtccctgttgtccttttctgtcgttcacatagtcgaaaaacttccagcgaggccaattgcatgttttggcgaccattgttgcctgcagtgcgtagaaaaggcagaagtgattgtcgttattgcggattttgatcaggcattggtcattaattcggtggtgaacggccgttttgacagggcgacgagctcccccgttgactcgacgtttggatggtagtccattacggtccagagtcgtgatggtgacggtaaacggctcaccccataacgatacatttttctgttgtttggactgcgccacttttttgaactggttgagaatggtgtcgagagtgttgtttgtcatttgtcgtatcgggattgggatatctccgccttccagcagaggactgctgatcatacagccgaggtgtgtaggttcgatgtttcgctcacggctttcaacaattgcttcgtcgatgcagtgttggaaaatcccagccaacaatgcctcaggcgtgctcggcaaatccgtaatggtgaactttgacttgactttgacgtaatggaatttggccatgtgctcgatgttgttctccaattttttaacgtagtctttgactacattcgatgttccatcggcttgttgaactgattcatggaaatggaatacgccaagttcattgatcaggaagccttgacggggctttttgggcgcggagagaatatggtcaatggaaaagttagtgaagcgctttcggggatgattgtccatatttttaaatctgtgcagggattgaggaggagtgaacaaaatttcggtatttatatgcgcacgtcagcatggaaaatgttgtgaagaagaaatgatggtgaatgatggaagatgaagaaacattgggcatggataggcacatcataatatgttaaaacatacaacttgctgccaggataaacggagcttttttaattaaatctaccgccctggttaacagcaaaaatattaataattttaataaaatttaattatactgtccccaaaattcccaattaaataatacggcccccataaagcacaagacaagtgagaggaggagagagaaacagcagatgtgcaaaaaaaaaagatgaaaatttttaaaatgaatcgggaaaatgaccgggtgtaggatatgtgcactttggccacgcccacttttgggtcaaaattattcctagcaagaaatcgaaatcattctttattcaaattctagaaaatgaaacgcaccaatttcaacaatgctcttccaatgagtgagaaaaagcccaaacttcgtcgacgcctgccggctgaattgaacagcgagctgatcagtttcgtgcctttgatctgcctatttgccaatgtgaagcggactccaattggtcctgtgtgctaccaattcgagtgttttcgtagtcgacgccaaaagaattttgaatatttggtaatttcccctttttttattttattac

SEQ ID NO: 3034 - DNA, 3733 bp, Heterodera glycines
gagtaaggaggaatgagcaaaatctcgatatttacattcgcacgacagcatggaaaatggcgtaaaatggtgaatgaataataaatatttgggcatggaaaatagtcaaaaaaacataaacaaactatggcctgaagagcagcacaccgccacccatgaagcacaagacgacagggcacctaaacgactcgtgaaattagtcaagtcaagagaacgacctcaagccctaaaaggaaattgctgccaggataaacggagctttgtgtaattaaagctaccgccctggttaacagcaaaaatattaatttaattatacggtccccaaaatccccaattaaataatacggtccccataaagtaaagaaaaatgagtagaggaggagagagaaacagcagatgtgcaaaaaaagataaaatttttaaaatgaatcgggaaaatgaccgggtgtacgttacgcgtacttaggccacgcccacttgcgcaccaaaattattcccaacaagaaatcgaaatcattctttattcaaattttggaaaatgaaacgccctaatcctttgaaccttccaatgagtgagaaaaagcccaaacttcgtcgacgcctgccggctgaattgaacaacgaattggtcagctttattccattggtctgcctttttgccaatgtgaagcgggctccaattggtcctgtttgttaccaattcgagtgtttccgtagtcaacgccaaaagtgctttgaatatttggtattttcaccatttttattttattacataaattatttatagaagggtgttattgcattattcgatgtgatgtttgaggagaaaaggacaccgaagaagaagaaagtggggagactgcttctacaggaagaactgccgcatgacctcagccgaaatgagctcctgcactacctgtgctacggacgactgggaacgaatttgttcgagacttattttgtgatgacccatgcaacaaatgtaagcgaaaagttttaaatttttaataacaacacaaaatttttagtcaattgccattgggaatttgtttgggcttctgctcgattttgcaatgagctcaccaactccttggctcatgaagcgacccatttgctgtggaattttcttccgacaacatttgccgtggattctgcaacaaccgatgaacgtaatgctttctcatggcttttttccggaggtccgaagtgatggttttgaatttttttggctgttcaacccacacttgaaaaagtatgctgggtatgtcagaattctccctgagcttagtcagcctgacaatttgcattttttccttagcattttctaagcattttacttgaccaatttattcatcattatcattacatacagatcggaatttgtcgatttttccattttctcaataaattgttgaaatgaatgaccttgtgacatatgatacacaaaaacaatacagtgtggggcacatgttgacactaattgggattgataggaacgaatattttttcttaggcccatcggaaacttattcaggaatgatgacacaatgacagatgggattttttgggctaagctgtcataataaatcactggttcttccattcccttcgcataaattgcacaccaatgagaccctcccttgtaatgtgggtcccggttaacaattagagctgcgggatactgtagagtgaccggaggcggtaattgatcactggcgaagcagccccgaaaaagctcgtgcggtcccccggttttcgttcaagattgatgtgatttgcacgctgtccattcttcagccaaaaaatagagcaaagttgatggagaaccaggctgacaataagcatcaagtacaatgcgaacaccgcccagcaaacggcttgttggaataaatttccctcttctggtcggtctttgcacaattggatgagtggcgtgagaccagctgacacttgctcttcaattaacttgtcactttttgggggagaggaggtggtggttgttgttggtgtgattgtagacggaatcgttgttgtggttgtggatgtaagcattgcctttcttcttatatattcagaatactcaggaatttcttctctacatgacactacgggaagagaaatccgaagaaggaataaaataacgccaacttttttggaatacatgtttattattgtaaaaaatgaaaacaaaagtgccttaaatagtgatgtcagtgctgatcgatcgatttttatccaacatcaccagcgagtcgcactcgcccatcaccaccaacattattcctccagctggcaccgcctgattaaatttgatgctcaccgctgtcgtcccgttctttatcaaatcaaaaagcgccgcttggtcgtccccgctgcttgtcaagttgaacacgtaaatgcaatgtgtagtaccgaattgtgcgagagtaatcccgttgctttccgatgagttggcgaatcccaccgcttcgttcatgtcgttgaagggacgcacatactttccgtttgggtagtccaagtcgtaggctgcttgagggtaggagcgcccattggcaattatagaaatttcacgcacattaaatggctgaaagttgaaggggctgcgtgaaactgtgccaacatagtcagcattggccaccaatcccattgtgatacgccggggaatttgatccatgaacaaattagacgtaaattcaaaacgcccatgactgatgaacagcgacttcatcagcgttttcctcactgcatatcgtgccggcttcaactcaagctttcgcgcaatgtccaacgccaatccgtccatcagggacaccttcttcacatacattttcaaaccgacaacttcgaaatggtagcgagtggctgcagcaacaccgggtggtgtgattaggacaaagtcgttgtcgttgggcaaaatttcaatgtccagctcacaaaagttgatcaagtagagaggctggttaaacaaatcggcgtcaattttggcaatgaattgtgctgttctgctgcctacaaacaggttgcgtcgtgcagtgcatccgtctcccacctcaagcacaccaccagtgtcacgatagtaaccggcagcattcaaatgcgagtccttggccgctgttgaataggagagttcgtgtgaaaaatacgatttataggccatcagagaatttgcgttgaacacttcacggccattgatgctcattttgatgttacggatgaatgtgtgtccaatcagttgaatcggagcaacctcatcagctgcaaggtcaaccagttgaccatttgcattttctttgcgaattcgaaactcggataacaaatagcatttggagagatcaatataattttgactggagtgaagcttgaagtggtagggggtgtcggtcagagggttacttgggagcagttcaaacactttggaggatgagacgctgacgttggttggcgggatgcggaaaaagtccaaggcgttggtgatggagttcacactgtcattgtcaattttatggaatgccatttagtaaagtccaaatgcgtcggatcgaacacgttttcttgctggtttgctgattgttcggccaattattgtatggtgacttggtgcatgttttcttcttctttttatacccattcttccaccactgccaaactgttttggtaggcctcccttctccaatacggtatcaattccttttcttcccttcgctttaccagtgcctcccttaagtggcattcc

SEQ ID NO: 3035 - DNA, 2116 bp, Heterodera glycines
taaatttttatgccaaccggcggttgcggtggctctctccaggggtgccctggaaataagcccgtgtgctgcaaatggggcgccttttgcatgacggcaaatgattgtgccattttgcatcggcgcatgcgaaagtgacgacggaggagggcacaaaatgtgaacaaatagacagagaagaaagacacaggaattgtgaaaagaaaaagcttaacttttgacattcctaattctcataattagttaaattgtgattcaattttggataaaaaaaaaccccaaaaaataagtaaaatacgggtgaaattttcatgtttttagattccatgttatgtgacaaattttggggtttcttctttattttttaatcagcaccaaaatttaagccttttttgaattttttcagatttattatgtcaaaaatttactgaaattttgtcccagttattattcacaagctaattgttttggggaagcatttaaaattttttttactcaatttgtggaaatatgaaaaaaatatatattttgaaacttggttggccataaaggcttatttattgtaaaatttttcgtttgttccttatttttcgtttttatgtttgtcgattattttcccttcattattcaacaccgccggacctaacatttttttaaacttaaccgaaatttactaaaatttgatggataatttcacaatctaaaaattgcaaattttgccggagataattaacattagcaccgcctgaatacgaatatatttttaaatttaaattgtgccaattctccaatttactcattgacaaattactcgggtcttatagggcttccagttatatagctgctgaaaacttgaaattatagcttaaaaacctcgcttaaaacagtttattcatacatttctgactgaatatacaaacgtaatatttataaataatgtaaaattatttaaaaattatacaatcatgaacaaaatcaataaaacgtcaggcatttgccagttttaaaatcgaataaaaagcatatgatgatgacattgtcaattgtacacgttgaaaggggccacgtttgacaaggcgaagagaaaatttaattttgaatgcataaaaattattataataataccgtatatactctttttatatgccagtctccattaatctgccggcctccaattatatacccccttctgaggaggttgaaaaataatataccagtctccatttatgtgccaggggggataaatagaattttttaaatattttttggcacattttcaaaaaaaaattaaactcaattcaacagtaaaaggtgctaataaaagaacaattctttcccatctccgactccatccagccctgcatcatcatcagagtagggtcgctacttttagtgacggaaaatctcgaaatagttaactaaaaaaaaaaattctgggaagaatttttaagaaaattttccaattcttaggggtgcattttttgaaaaaatgttggtaatactttggtttgtcccccctatttttcaaaaaaaattttaaaattttaaaatcgcttaaaacatctctcctggggttttggggccgctgatcacgaatccggcatccgtttcgacccatttcgaaccccggacccaaattcgaacaaaaatcgaaaatttatttttcaccaaaattcacatttatctctcaaaatcaattcaaatgcacgaaattagggttgcaaccccgaccccgccccgaccccgaaccccgacatttttggccattttcggggaaaaccccgatcccgaaccccgacgcttcataccccgacaaccccgaaccccgacccttaaccccgatcggggtcggggttaaatcagggcgcgtatcgaaaatttttcaaaataagaacatcaaggccaaaaaataagattttagggtcaaaaataagaacatttcgcaaaattgcttcaaatcagttatttttacaatttattcgatcaaaaatgtatcaaatagtatatttttgtctcccattaacgattttaacaatgtttgggaggaaattagcaaatcataaaattttagtgcaaaggggataaaaaaaaatcagatttttaacaattttttgcg

SEQ ID NO: 3036 - DNA, 1850 bp, Heterodera glycines
aacacataaaaattcatagcgtggctcaaattaaaccaaattaatttttcttggtatcattcaatagctttaattgtcctatatcagaatatgatttttcaaaattttttaaaataagtataaaaaaaattattgtcataacatttcaaaaatcttatgtcagcattttttgttcagaacttttttaaaactcaatgaaattttctaaaattttaaaggtaaatagagaattcttagggctatcgaatatataaattaaattagctcaattgcattttaaagactttaaatgtttattattattagggatgatatttttggcgctaaaaactgccaaaataggtaggctttaggctctaaaaaccccaaaaataggctccaaaaaatggaaaataggcactaaaaaccttcatttttaggggtgtaaaatgacaaaatttattcaaaaaagtaaaaaaattaggccaatcaaaattcaaatgaggccaacttagaaagcactgaagatgagtaaatgaataacagaaaaatgcaaataaataatcattagtgccagatttgggttaagtttaaaaattaattttgaaaccaattttaggcattcggaaagatttcaagaagctacacatcggtaatttgaaacttttttatgcatctttatagcaatatttataatataaaagatgaaaatttgactccacgccgtctcaagccgaaacaaggagcagtatttaaaaacaaaacgccaaagcggggaaaagcagtggagaaaggtgtcaaggaattgcatgtgagcgaaagtgcgaaggtgtgaaacgacaaaaggacgagaaagtttagaagaaagttgaacgaaaagtttttttcatcgatgcccctccccaagttccatggttagccgaaaccatccggtttttagggtccaaaatccgacattttccgaatcgaaatccgacccgagcattctgaggtgacctaaaacacgacctaactttttttttctcaaccctagccaacagaacctaagcatggcaatgccgccaaccttggaaaaatgacacgacactcttaaaaagtgaaatgttatgtctattgttttcaattgccttttcctctttgggctttatcagaaagtgcgagaacaggctttgtaactgagaatgaccgcggaaacaaaaaaaaacgagaaattttcaaaaaccaaggctctttctcgcacaccccctaaagaaatttcctatctccactccatctgtcactatttttcttgttgaaattcttttgtaaaactctgttatgtaaggggataaagtgtgattctatcagaaggatatttcttatttatttaaatgtaagtcataattagtgtccagatttatatggacaaaaaaatccaaaattttaattataatatggacgaaaaaaagcaaaatctttaggggtgtatttttagattttctagtgaaaatgccaaaatatgggtgtaaaatatggacaaaaatctggatggaaataaaaaggcatcctagagcaataaaccaagctaaaaatactatttacgagtttttaggccgaaataagtgtgcaaaaaaatggaaacccatacaaatccgggctctagtcataagcaaaaaaaaaggaacaacacaaaaatggccaaagcattattcatttaagttaatccaacacatttatttttcatgttctcatcccatttctgtcgatcagtcgcattccgggtgcccacagcacataatcttggattttgaaaaaattaaaatttgacacagttcggtgaaaatgctttttctcactagaaaatttgatgagaaaaaatctcaggtactttt

SEQ ID NO: 3037 - DNA, 7753 bp, Heterodera glycines
  misc_feature (23)..(23): n is a, c, g, or t
  misc_feature (278)..(278): n is a, c, g, or t
  misc_feature (280)..(280): n is a, c, g, or t
tttcgtccccctttccccattgntcatgccttttcctcaccctatttggcatgtcgctaaagtaccgctggtaaacggcaatcacaacatcggccgtaaccaaagtagaaagaatggaagcacggacccaattgaattgcatttcgctccaattaatgttgacattggcaatatgcgcagaaagtagagtgtaactgaacttagaatcaatgaaaatgaatatgaatcatgctttttcaaattattttaaaaagattcaatttaactctcttttcttncncacacccaaagagagggttcaatctcattattggcgtcaaaaatcggctcaacagaaacatttaaatattaaaatagagcaaataattttaaaatttaatcatgggcttagcgcttaggaaggaaaattgtgaagggcggggagaggaggacaagctgcttcaatcaattttggcatttctttcgttagtttttccaatttaaaaaattacagtatgcctataatacatataactcacacagtatgccctgccgcggaagcatcgcgcaacgccgcgctgtccgcggcacgcgttgcacataaattgaaaggaaatctggccaatggtcccgcgggcggtgttcacgtcatggaatgtcacctgtgataaaaaaatgtctttttgaaaaaatttatttcccaaaaagtgctgtgagtttcaaaaaagttctggacaacctacttaaagttttttggaatttaatagccataactttttttatactatctcaaaaaattttggatactaatattctggaagacaacacctagaactattgaatgatagcatgaaatatctgatttggttgaatttgggccatattatgagccccgacatttgcgcctatctccaaacccgaattcaaagtttagccgaacagcattaaaattaagaaaacacagtcttctaatttattaggtgcattattctgctgtttgaataattgatgatttttcaaaaaatttattaactataaaattatcagacttaagcaatcacttataaaatgctgtttaggcgatcagggattgaaaaaacttatgtttgaagccgatttggacaaaggcgcgcaaatgttgggcgagtgtccgggagaggaaaacgtttacccccctccccccccgttcacttaccatattgctttgcgcacaagcactgatcaccatcccggcataatgcgagatcatcgacgaagaagacgacggaacggccatccctgaagcggcacaattctgctgctgttgctggggccccacagtgccaaaagtgttacgcgggacaattccgtgtttagtctgaagcaaagggcatagccaatatcttggcttcaggggcggggcgactgacgactttttttttaaaatttaaattcgctatttttggggtggagtgggagggattaaagggagaggaagcgcagagaaattttagaaaatttaggcatattcgctaactgaggaccattttcgtaggtttttgggccgaaatttaaaatttaaggaatttgggggtgtgccgcggcgccgacagacggcccgtcggaggatttttgtaattttttatgagatttgttaatgtaaattttcatcccgttttttaatttaaaaaaatatacaggtttcgagggggggggggaaagctcataaaaataattcaccatttcccttggttaattattcggattaaatcaacaagcggcactttttacactttcattagcttcacataattaattaaggattaattattaatttaatggtaatattcctacttctggctccaaaatcacaatgtcgtcttcctccgcttctcctccaaatccgtcgtcgtcgtccatttgcgttccgccgccgtttggtctgtctccgccatcgccattcggtgcgcgacgctgttctcctcctgcgccattagtccttcgtttgttgtagctttgatctgccaaagatgagccgacttaaaaatgatggcaaaagtaatcgatagaatcatagaaatttatttataaagaattgaaagaaaccatataaatttaagacattaattaaatatttccatcgttttttgtgaaatattcccataaggttttaaaaatattaaaaaaagaatataatttttcaaattttttccatgcgtaattttagagatttgaaataaaatttgtcagttattctaaaaaatattttcttttctctatgactcgcattaaagaaaactcattttaaattgtccatttgtttatccataaatatacagtatcattgacgctttttcgggtcacaaaacaaattgtgcatcaaggatggcattgattccgatttccatttccagaattttaggggccttagatgccacccctagtgtctaccccttgcttttttgtaccttccattttcaccggatgtccgtgcctgcgcaacttcggaatttgcacattgccatttggttgctgctgagcagtggcagcgtttgtgggtttggtgcggtgacggccactcaaaagctttttgggaaaattatttttcgctacaaaagttttatgttagaaaaaatgttcaaaagaattttgaaatatataaattaaaaagggagaagaattgaccaaaaatttaggaaaagaaatgctaaaaaaaatttaaatctcacaaagtttagtggcagaaaagaatgttccggcaaattccaaactatcatattttcaggtcccaaattataaaaatcttaaaaaggcggtcgttactcccttcctctcatttatgtcccgaatcccgggccaaaaatttttgctgtgtaagaattattgctagggaccggtgatttgattttgatcaattcgtcaaaagacggaatgcccaaatgtgatcagtttcaaatgtaaaagaagcgctgagagtattacgttttgatggccaatcggcggcacggcggcaatggaatgggctcgtccttttttggcagtgtcaaccgacgtcggcggcactacgccaaccttacggggacggccccgtttgactgcgcgggtggcgatgctgtcaaacagaaagatgatatgtttatgaagcaaaaaatgaatcaaattgcattgtgaatgggcgtaaaaaaagattaattagtaggattataaattatatggactaaaaaacaccaaattgaacaaaaatatggactaaaaagcccgaaaatatagtaaaatatggactaaaaactgtcaaaatatatcttttaaaccataaaaaattccgaaaaggtgattatattcaatatttgcttaaacagaactaaaaatacgtttaaaaactgccaaaaatggatttaaccttaaaaataccaatttttattaaattctagcttcacaattgcaaacaaaacacatttcaaaattttttaataatctcattctgttgtcagcgaaaattttcggaaacgaacaaaatacctaaaaaaaatttccaaatttcgaaaaaaattctctttttagaagtaaatattgactaaaaacgcaaaatgtcgaaacatggatttattcgcgaaaacccccaatatatatatatatttatatggtcgaagtttctccaaatcaaaaatttttaacgcagaaatgttatttttgagcccctttctttatagcatatgcgcagaaaaaatatgtttaatccatataatttataaccatagtaattaacaattaaaaaagcatgaattccatgaaattatttaaggtattttgctagaacctaaattggaatttggttttttaaattttcgcataaaattggaaaatggcaccaattgtggatttaaaagaaaattagaaaagaaaagaactctctaacaaatgaaaaatatttttttttgtaatatttttccaaattaaaacttacgggcacttcgccatattcttcggcttgaccaatttgctgctgctctcccctttgtgtgccttgcctttgtgaagtgccaccccgcgtggagagatgaattttcggttacaaatgtcgcaaaatgacagtgatgagcaaaaattggcgggggcagagagaacggagcggcgacaattattttgatgtaattccaactgattttttgaaaaaagtgaaattattaatttcttaaaaatctgtccttttgggcaattagggaaagatattgcataattaagcttttgaaatgtaattgttcaatgtcactttttaaccccagggttttctcgttttctcagatggaaattgaggaaaggaaaggaagataaaaacaaaataatttgtttttgtaaaaaaaaatattgaaaaaagagaaggttttttcgcaatggttcaatccccgacggagaagcagcaaactttcttattttctttttcaatgcaagtaaaacctttgttattttctcttaatttgatgctacaaactctttttgaatcagaaatcattaaaatataatattttaaaattaaagccacaaacattggctaaaaaattcttacttattaaaattgacaataaaaaaacaaacaatcaaataaaattaatgggggccataaatcttacaaaaacaaaacaaattagtgaagaatttcagaccaaaaaccctcaaaattaatttttcaacaaagcccaccatttcatccgacttgaaattgatgttgcaatttgcgcatttgaatgtgtccttttgttttttgttggccttttgtttgccgccatcggtgccgttgttgcgcacataaaacaccgccgacgatgagtcggagtcgtccggcgcgtcgtcgacgaacgtttcggaggcgaccaaaggcgaagaagtgtcatgacgggtggatgagtgggaagtgccaatgccattgacagcagtgccaagggtttgagtgccattgctgggagatggagaagggatgtcgacaattgaggacgattccgacagcattgaatttacgaacgacgataaaacagggccaaatgatgacatttagaacacgaatgttatgccggattaaataattatcagctttaattttaaaatgctaaaataataaaacttaagaaaatggacaaaaccattatgaaaagtttgtttaaaattgaaatgatattggaatcagaaaaaaatgaagaggggaagctttttctaagtaaattctaatccatatgtatcaggaaaaaaaaaagttaggagtagggtcgcgacttatagtgacgaaaaatcttgaaatagttaactaaaatagtgataaaaaaatatcaaaaaagtgccaaaatagtggcaaaaggtgcgaaatagtgacgaattgtgacataatttttcagccaaaaattaagcaaaaataatttttattcactagttgctgttgaaaatgagtaggactgggtttttaagggcaaaaaacccaaaataggcacctaaaaaataatttttaaattataaattcttgccaagaaatgaatttttgagaaaattttttcatttcttaggagtgaattttgaaaatttttaggtcgattcttaggggtgtattttttggttttactgtaatgtcgaaaaaatgaaaaaaatagtgacaaagcgccaaaatagtgatttctagtgacgaaaaatgccgttcaaatgaaaaattttgaattttttttagtaaacaaaatgattttttttaatttgaattaaattattatttatatatatttttctatcggtatgaaaatttgaagcaaaagaaatgtacttttctttctcattctctctattagtttgacttagctcattattttgtgtttaccgtagaccatttactaagtacagtatgcctaagctgatcatgtaggccccgcccactttaagtctttagctgccctccagcacattgtactctttcactctttcgagaggggggaattggctaatcccgaactcttccaattccccctctccccctatttgccccggacgaatcggttcacccttccccagctaatcacacatattacacattatatatttgtattgatcaaccttccgaataaaggatattattccatcccactcgtgtaattatggggaggggctaagcaacgaatgccaaagggcatccgacatattcaagttcatctaaaaatgccaaatatgcacataaaatatgcactaaaaatcccccaaatatgccctaaaacccaaaaaatgcccaaatatgcattaaaaattatccaaaatggcttctaacccagggtttctatctgaaaattttcaaaataagaacatcaaggccaaaaaataagattttagggtcaaaaataagaacattttgcaaaattgcttcaaatcactatttttacaaattattcgatcaaaaatatattcaattaatatatttttagtctcctattatcgattttaacattttttgggaggaaattagcaaatcgtaaattttagtgcattcgggatcaaaaaatcagatttttaacaatttttttgcggcgcatttttccaacaaacttttagtgaatgggcgaggggagagggtccggcggtgccgatttgcgccgccgggaaaattttttgaaaatttgaatactattaacaaattttggccaaaaattaccacaatttgcgatatttttaagaaaaaataggagtttttgaggggtcggcggtggcgataggcgccgcggatgaaaattttaagaatttttaatgaattttgttcgaaattatccaaatttttaagaaatttctctcttttagatgaaaataaggcattacccccaaatcagaacattcttagaaataagaacatataaaaaccctgttctaaccatcaaaaaaatgccaaaagttgtgtaaaaatacagaaaattttgattttctaaattatatataactagggttataaattatatggactaaaaaacgccaaatatggacatcttaaaaatacgctaaaaactgccaaaaatggatctaacatttaaaaatgccaatttttattaaattctagcttcacaattgcaaatcaaatacatctcaaaatttttgtattcctcttattcagtttcagcgaaaattttcggaagcggacaaatatttaaaaaaaaaatccaaaatttcgaaaaaattctctttttaggggtgtattttttaaaaattttcaaaaaagtcgatttttatgggtgtatttttcattatttttgcatttttcttgtgaaaatttgccaaaaatggccaaaatatggactaaaaatgcaaaaatgccgaaatatggatttatatggactaaaaactttcaccaaatcaaaaatttttaacgcagaaatgttatttttgagcccctttcttcatagcatatgcgcagaaaaaatatgtttattcaatataatttataaccctatatataacaatttcgaattttttaaattattatcatgtgctaaacaaaattacatttttcttataccctattcatctctcacactttgggacggtcaaagtgaaagaaaaagaaaattttaaatttatatccaagaaaaaagaacaaattgaatcaatttttaaattctcaaaaaataaaatgcaaaagacggataaattaattgattatgcgaatgtgatggttagtagtgacccctgtacttttgtcgccccttttggcgctaaattcaaatttgaattttcgcgtcgatactctgtgggtggagggacgcttgctgggggttgggccataggg

SEQ ID NO: 3038 - DNA, 9130 bp, Heterodera glycines
  misc_feature (32)..(32): n is a, c, g, or t
  misc_feature (139)..(139): n is a, c, g, or t
  misc_feature (8947)..(8947): n is a, c, g, or t
  misc_feature (8961)..(8961): n is a, c, g, or t
  misc_feature (9054)..(9054): n is a, c, g, or t
  misc_feature (9060)..(9060): n is a, c, g, or t
atttttggatctaatccgaaaactgatttttnttttattataacataaaattttatgagtgatttatttttaagacatacaaaattagatttattattttttgaaaaaattaatcctctaaatttaaaagttttgtatntaatttcaattcaaaaaaaaattttcttttttcataatacggtacttctgcttgaaattaaatggaattgaggggtcgccaatgccaacaggcgccgctagtgaaaattttttggaattagctgaaagtgtatgaaaaatgattcgttaacactcaaaactaaatgctttattgtataaaaatttttaaaaaaatgaaagtgggtgtgtgattgattgtatgggcttattaatcgttcaatttgcgctttgtccctttttttcttccactgcaaaatcaatgactaatgtgactttgtcctcattttggtcatacactcctattgctactttaatttgaatttttttttataactttttgaattttttaaaattttttagtcaaaaatttttcttaaaaaaattaaatcgatttagcaacatagcgagcgatctttaaatattaatggattttatttttaaaattaaaaaaacataattttgccagacaatcgctttgtgcagcaggacagcacacggcaaatgatgcgcaaccggcgggaatgggctgtccaacggttgttcaggcattatgccaatgtcggtgtgccgaactcaaccgtacggttgggcgaaattctgctgttgctgcctgagttggaggtgttacaatatggggactcaatgtgggaattacgatcaaatatcgacccaaaaaatcctggggataggccaaatcagtaccaatcagcggggatcaatggacttttttgatcagatccccaccaaggatgttcgacaataaaacatttttgtatacgaaacgaaacgaaatacacattcgatactaaaacgaaatacaaacgaaacaaaaaaaattttgaaaaccaaaatgaaactcaaaaagtgccgaaaatataggaggaaacgaaaatgaaacgaaaattcgtctaaccctgatcccaatatgcatgcaaaaaattgatcaaataactatgatcagtccaaaagagaaccggttgggctcaattttactgtttcgatcaggcaccgattgttctcgctcgtttattaaagcaatgtttctgatcaggataagttgccattaggagagagataatcagaatatttttcattgaaataaattattttcgatttatttttagagttattgcttcgtaagcttttttaatacaaaaaattatgaaaattatcaaaaaaaaaataggatttttattttaatcaaaaaagtttttttttctctcaggtcatctgcgatttgcactgcgtttttcacttgttcttcgaaaaatatctttaatttgttgtccaatttttttgctgttcgctgcccagttacttctttaaaaatgaccagaaaaaagtgatcaaagtttcgaaaaatcgataaaatgacaaaatttgaaaattcataaaaaattcaaaaataatggtagagtaaataactttttttaaatgatcagcaaacaattttctatcaaatagcatcataaaataaaatactgaataaaaaaatgtaggtggaattttgtaggctagtagaaagcacttagggctatcgaaaaatatcaagcttttaacatttcgtacattttaggccaagttataaataattttctgtcaaaaattttccatttgatggtttttgactaacgtcccagcaccctctacacgataaaagtggtttttaaaaagttggcaaatgactcaaagaattcactgcctgtttggaagcaacggaaggggagacggttgaggagatgggcacgcgatggttccattcgaaaaatgattacgcaaagcccagtgaaatgatccaaaaaatgcattttgatcagctaataatgctgcgaaataatgaaaattttgcagaaatttacaaaactttttcaattaataattatttgatttttattttaaaaatatttgaataaaatattttaccaaattgcagaaattcaaaacaacaaaattgctcattcaaatttgtagcaaatcctcacaaagcaaatatgaagaaatgtatggacgaaattggagtgaaatataattcctcattctttacataaatagggctgagaatttaagtcacaaaaaatctcttttaattagaattgcaaaaatggtacattcaaaatttgtaacacattgtaaaaggggacaaatggaaagatttcagagccaatattttttcatgaatgaatctgacaaagttgggcgattgtttcaattccctggggtcgtctttctgtcggatttcaattgtttgtttgtttttggcattttatccactgaaattcaatttttgccgtataaaatgaaaaaaccaaaaagtgcaacaaagtcataaaactccaaaaaaagtagaaaaaataaaaagctcaaatcttaaaataaagcgtgcgataattttaaggtaaaaataaatccatttcgagtcagcagaaaaaagttatttgacttaaattcccatccctattaataaaaaagaataaatgtattttttaacaacttttaattaataatttatctctcgcaagcattttaaaaacttcacaacgaatttaaaaatatgtaatcaaaaataattgcagtacaagataaattgcagcgaatattttaatttatatttatttttccgtatgtatttttattattgactactgtttttcctggccaagtttaaaagggaatgtattttacagcatttgaacaaatttttttttaataaatttgacgaatttaatgagtttttgacaaattttattaaaattgaattatttttaataacataatgccgacctattaactgtgtggttcacaaatctaaatttaaaaaaatgaataatttattcattaactgaatttgttcaataaaagcagtgctgaatccgaaaatccttccgcatcacataaatcaaacccaatctaatcccaaatttccgccccaacaatctcaaagtgatccaattatttaattaatatttgcaattttctttattaaaactaaaaactacaacattctcacaagcctttttttcaaaaaatagataactcgagcccggacctcagttttattaattgagtttatatttattaataatcgttttataagacagatgattcaaacggtaactgtgatggattgtctggagaattaggtggctcaatttcaattttattttgttttccttttgcatttaaaatgctttcttccaaattgttttggttaattgacaattcatcttctgctgcttgtgatgatgttgctgcttgacttttttttaaaaatttttctgttatatttttcgtgagtttctggctgtttcgagcccatggaaaaaatatatacatatgcttattttttcgagccctattcataagcgtcttgctcttttgaccaaaatatttgttagatttttgtgtattttgttcagtaattcctgacaatgttgttgaatttaattttgcaatttataaatattatttaattcgttgttgcatttggtttgattgccgacaggcgccgctgggtttttttgaaaaactaggctaaatttgtcggatttcgaattttcgagtcaaacgaagcataaatatttgaatttgagcagccaaaacggccatcatattcgtaatcactgatcagaacaattcaaaaactcttgaacctgagactccttactaaaaaattttaaaatgaaaaaatagtgataagaaagtgctatgacttacccaaaaaagtattttctattatcatgcaaaactccaaaataaatttagcgatttttagcaaattttttccgaaaaattcggactttttatgaaaaatttcggaagtcggattccgaccccaaaaatatcggaagtcggaattccgtgccatccctggtctacggaatgccaatgccaaccattgagtcgctgatgaaagaatggtcagccgaaaatggagaaaaaaagttgaaggagataaaagtgcaaatagggaaagtgccaaatcgtcgcttttttgatttgtttagctactcataaacgctaatttggatgtctttggaggactgtgccgacctttgcctttgcctcgttgacattccattgcataaaagccggctcgagtcgaagcacgttctgttctcgctgtacgccgaattacgcgcctcccaacacttgcgcaacatggcgcgggacagagacgaagcggacggagcgacctcagtaaacattgaccaatttgtgtcgaacttgaatcggaattttttgggtttttgtctcggcttgactttgcccttgcccgttttcgttcaaatataacgctaattgaacaaatcgactataatagatttcaattttctaattctgttgcttaagtctcatattttttaaaatttttctcatattaattgaattttttaaatttttatcgtttgcctaaaaatagcctggaccttggatttttaacccacgaaaaatccaggtctggatccaggcccaggtcaaactctaaaaatttattcaagcagaaataaatactgatattattttttatttaatgtcatggaaatgcaaattaaaaatctgtaagaaattcaaagtattcaatttttacaaaacataaaaactttcggtgcaaaattggttagcaaatacaattaatattttaaaaattttccctgcggcatctgtcggcacgggtgaaccccaaaaagctccacaatttttaaattgtcacaaaaatcacaaaatttgagcaaaataaatatattacattttccaaaaattttaatccattaatatatgaattttttcacaccaaaaaatgtacaataaataaattatgagaaaaaacatgtaaaataaatggaaatttttttgacttttataatttttggtcggttgaattcatgaaagattgggttaaaaattattaataatgttattattattattcattgctataatataaatgttttaatttcgctgttacttacgcaaatatcttttaaatatttacgcaaatattaatatttacaaaaacgcattatttatttaaataaatgccaataatcacattaacatttttattaagagaaaccatggcatcgaaaaatgaacatcattttttattttattttaattaaattatgaatttctccgtgctgtctttcttcgtatttatttgtgcccaaattttccacggcaatccttttatgtaaatgcatttgctgtaacggctgctgttcactctctctcgcgcaaattccgacaatttctcaatttccatcgaaagtgtcccttctttctgatcggaaaagcgtccatggcacggaaatgccattgggtattgtccgggcgcaccgcggagattcgggtggcaatggtattggaagacgccgatcacttcttccactgtcaaaaggcaggaggatactgtaagaaaaatgaaatttaaaaaaacatatatatttttggtgaatttactagaatttaaataacaaatattttggcaaaacctgctggatcttcaacctttagaaattcgcacataaattcttttaaagacccaaaattggcaaattagtaatggccacgttataaaatttaaaaaacttgaaggtgggtggagaaggggtgttaaggtggttggccggtaccaaataattttctagtaaaatattattattatatatatttttttaattggagtgagagtagtgccggcctgcaaatggggtcttttaaaaaatcggaataaaaaccgagacttcgggttcagtcagcatcggtcggggtcctaatcccaatcaataattgaccggagattccgcattaattaatacaaaaaactaccaatatttagcgaaaattccctttttgtgatcagtgggaaacgaattctggacagtgccggaccaagcacggcacgacgattttcagcggaacattcaatgagcatttgagcacagcgatcgtcggcccaacgaatggcctgaaaaaacaaatgaaattagttatttttaatcgaataattaattaattagtacagcattccaaatgatgagttcgtcggcgattttcaattggtcacgttcgataatttcgcacaacaaattttgatcaatttgcaaaaattcttctgattcaaataaagttttggcattttggtcaatgtaatccaagcagcgacgagagaaatccttaaaataaaacaattaaaaatattttgtataaatttcgatttgtacattttcgttgagaagacgagcttcgtcaaaggcaaggaaaacatttgacaattcattaattggaaaagccaacaaggctttgaccagcagagaaacgttatatttattggctaaaaatgtttaaatataattatttatttattttttaaatttttcaccggcgtaaagcactgccatggcattttgtccgttcaattcgcttaaatcttccgcgtaaatgaagctcaacatcactttgaacgcttctgcttcaacatcggtcacttcaattacgtgaggacagtcggcagaggcaaaaaaatgatgaaaaaaaaacatttttaaaaaatatttcgattttttttactttttgtctttgcgtttttatcatcaaaacggaacatcgacccaaacacatcagaagcgaacatcatcacgcatttgtgtgctaccaaaagctaaataaaaaactcggaatagaaatgaatttatcattgaagttttaaacccaaaagataaatttcagaggcctcactcatttcagtctgtcagaaagtatcattttttggtacttttcgaccatgcggccacacctccaaatttttaaaaagcgacgcgcgctttatgtgtgtccagcgtataaattagcatttgaacaacgccattcgttcttttcccgttcttagtgcttaaattatcgacttaagagtagatttatgtataattgcgacttttagaccatctaaataattgttgcgtgctaccactggagcttttctcttttttaaattttttgtgttcaattcacctccttttctttcccaaccaaaaagtgaacgtccgccccatcgcccgtgctcaacatcagcttaaaccggtcctgcaaactgctcgacattgaaatttctaagaaaaaattgcaataaaaattgttgaatatggaaattataataataaataaatgaggtaataattttgtttttcccaaaaaactatcaaaaatggtaaaactaactaaatttactgttttgcggtcgacttcgatttacaaatttacatagatcgaaagggaatgcgtgaaagaattggttgacgtaaaaaaacaacaacaataactttttatttacacatacacagcagggatgtgccgagccagacaaaatccgattccgattaaatcgccgattccgattatggccaaaaatccgatacggtttcattttgcagcaaaaaaatggctaatttaatctttaaaaaaccaattaagaaaatttgagatattttcatttactgaatattaacaaaataaggacaaatgctagagaaataaggacacttgactattgaaaatagtgttcccttaattgaaatgatatgcttaattaaggaattaatggacatgaggaatggtttttacaactgagacgaggtcataatgatgttggtcatagagaaaaaataaatttattctggaaaaaattactcattatctgcagccttttcggcaccattttccgtggcattctgcaaaaagacataaaacatattaatgaatggcttaagccaatctgtgtcgccatttctattcagctccagatcaaggccagtcgcatgcccttcatttcttccacggacggccaaggcaatgttggcattgtattcgtcgcgcgcttcctctgcggggataaacattggcaaaacacgctggatcaagacccaattttcgaccagtcttgccactctgccattgccatcgagatatggatggatatggacctaaatttaattttttgaagtacaaaatgccgtaaaaaatccaaaattttggcaaattttttatttttttatacatattttgagaatttttgaaaatttttagaaatttctagtgaaaaaatttaaaaaaaaactttttttaaatgtacccctccaaaaataattttttaaatgttacaaggtgattaaacatatttaggtcatttttatgccattttacgcctatttaacactttacgaaggttttttcccaaaaaataaccatttaaacaaattttatttacatattttcgtacatattttgggtttttatacatatttcttacatatttagggattttttttacatatttatgtacatattttgaccaatttttgtacatatttttgacatccctattcattattatcctttttctaaagatattttgtatgaatttcttgaatttaagcaaagcaaatggctgaaaaacctgctgatgtgcgttgtttcgctgaatttgcaatcccccaatttttctggtgcaaattccaaaaaattgtcaatctccataataagtgttccctttgtcttccaaattcgctcatttatcggaaattgcatggggtacagtatgccaaagggcatcgttgcattcggatggtttcggtaggggtacagtatgccaaagggcatcgttgcattcggatggtttcggtattgttccacgccgaccacttcgtccgctgttaacaggccggacggaactgtaaaaattgaataaaatgaatagagaaaggtcaactgctgcttgtttccgggggattanaaaatgtttattanaatctccaaaagtcggattcccaaatgtcggtccccaagttgcaaacccccaaaagtcgggtagccgtcatagtatacgcaaaatttctgttngaatanatcacccaaaaatcatatgtggcatatgatacggtgtggtattcataaaaattttaaaattatcgaaaat

SEQ ID NO: 3039 - DNA, 5420 bp, Heterodera glycines
tctacgcccaaaacttggtgggaatggtcgggcggagttcctcggtaacttgggcaaagtaagaggcgcgttgttctgaattcaaaggctcatttggagagaaaataactgtggaaacgaaccgtccaactgagcctgcgcttgggcccggacttcctcaggctggccctggggcggcaagtcgaattcctggatggtgtcaccgtcagcgctgtgaaagggagggcaatgttaggaaagttttccggggggggggggggggggaggggctcacgtggacgtgcgccaattgttgcgcccacgcgtcgccaagtccccggccgagtagagaacgcccggcacagcagtcggactgcagcagatcccgtgctggtagcacagcgcgtagctgatctgttccagctcgctgagcttgactcgaggttcggcggtgtccaccacaacggtgcagcgcaacggctgggcagtcccctgtggaagaaatggaagtgtcagtccaaggggtgtcaattgcagtaacaacggacttggatggtccgatggccgaccaaaaggaattcagtcaacgaagagtgcatggcctgaaagaacagcaattatccatcaatcagttctgagcgattccgacccttttgtccagcacagtgcccggctgacagttttggtcgggcgcgcgaccgcccggctgtacattcttaggaatgatgcggtagttggagttgcgttgacacacgataagcgtcaacgcgggtttttttggcattttgcgttcattgatcagttcgtcaaaggcagtggtaaacgccccgccctcccaatacgcaaccttcaattggtcttccgttttgcaactctttacgttctcgtcttgcccacctttttgtattcgccttccgaggcaccggccctgaacacgaagatgtgttccgggaagaaaccattttggacattgaaagtaagcaaagcctctttgatagcgctgaccatcggcgctgccatttgtacggtggtgacccgcggctgctgcatccagtacgtgccattcaacttcagcatgtgttttgagatggtgtaggccatctggggaaggcaggcccatgatcaggtgcataatggagaaggtggggtcaaccccttgcccaaatggggaacccttcgcagaagagcatcacttacgccaacaatcgtcggaatggccggcgcctttcccgtacgccgttcgaacaaagtctgtggcggcgcgtgggacatttctaagccgaaaaacatccgtttgctgcccagccattgttcggcgcttaacaatttggttggtacaaataagtcaaaagattgaatactcgcgattctcgccggccgaccacttacagaatgtcatggcggatcccgttggcctgtttgaatgcctgtgcggcataaatttcgtaattggcaccgcccattttcaagttcatcttcaacatgatgttgtctaagaccatgatggcaccctggcgcccagtggccttgtccacgattttaggcgagacatgttgagtcagaacacctttatcaaccaattattattcaaaagatcgttgagagagaaaaatgggatgaaatggagaaaaagttgtgcttgccatgttcgacttcctgcagtttgaacacatggtgcacgtcaccaggatgggctgactccttcccgggcgcgaagaaaagcacaaattggcagcgatggtttgaataaaagacgaattgttcacggacatgctcactaagaaataaaaaatattgcttatgtagaacaaagaacctgggtttacaggtaatttcttatgcttataatgtaacattgaacaaaaatgaccactcacagcgatgtgtcctcaaaatggtcgactcgtggtggcattcccatctgaacgccacgcgcctgcgcacatcggaccaaactctcacagaactgtctggacaacgaacgggaaaccgttttccttttgaattcgttaaaccacctgcactgatcctttcgaacggcgctttgcacgatgacaacagcccaaaccttcggaaattcacacggaagcgaatagcgacggggcaacggttgtccacggtcagccaaacggaagtccaacactaaaaacgacagcccaacaataagtgccagatttgaatctgaaactgaccgccacgattgttcggttcgatttgttcattttgtgccgagaaaccgagtgccggagggtaaaggtgttgcgcctccgcttgcatcatgttcgtctcaacacgaacttcgtgagcacgaaaaaatgggttggcattctgaatcatccctttgtcgcgctgtgtctcaatgccacgcggcaaatcgatgggcagaacttggcattttcggatcatttgctcagtgagtttcggcgtttgtttgtcgagcgaaacacgctgcccatcgctaaacaaaagatgggatgattggcctttgatcaaataattgacttttaaatggatttaccaaaacaggatagttccatcactcacataatctgcaaaacttccatcggaaagaacgattcctgactccccctgcgatgaatgacgcactgaaggcgtgggtagcgcagccgtctgttgtacttctggtcgtaatactgcaccaaattggtttgctgactttccatcataaaagtgatctcgttagcgcctcgatcagtgagccccgaagccgagaaagtcatcttaacggcagacaatgagtgaaaggacgcacaaacgcccatccaaagaaagagacgacctgattttcaggcaaatgcatcgtttgaacagcaagacctgaaaattcagttaagcaaacatgcaaaatggcggaagggttacctttgatttgtttgttaataattcgcgccttttgcaggcagtcagtttcaatttggttgggattagagttaaggaaatagccgacgaagtcgacgagaccaatcgccggaaagaaggccgatttctttgctgaagggcaccgttaatttgagctaatggcggcataacggaccatccaactgaatgatggccatgctttgctggggattgtcgccgacgaagcgcacattcttctgcatgccctccttgcaaatgcgcgggtcgccctgcagttggaggacgctgttcttctcgaacattctgttcccgaagacgaaatgctcatttctgaaaacggaaagaaggaaatgctagcgagggcattcactcgcctttcgtgcattcgctgcgtgctcagcaactccaaaaattggcacaccgatcggtcgccgcccggctcagtcacgcgcacattgcgaacctccacttcctcggtggccgtcagaaaggccttcacgcgttcgcatctgcgcagatacgcacggctacggtcggtcaacgaatcctacggaatttaaaggccaaactaagcgacggaaagcgtagggaaagagaaccaaaaaattttgaaatgcctatttgtgaagattacccaccaaactttcggcagcgatcacaaattcgcgcgtctctccgtttttcatcagacgacgcacggaataaaggagcaaagcgcagtcgtagctgaatttgttcttttcgcttccaaagaaatcggcgttctgatcgagcagaatccgccaaagcgaccaatgcaactcgcgacgcgtctctttgctctcactgaaacgaatcgtcgagtagaaaaacacaaagcaaacgctgtttggtaggacaggaccaaccaaaatcacaacccactcaccccgactttcccaactgctgctactcaaaaagccatggcttccaatgactcactcattgcgtggccctcgtgccaattcgcgcggttccgctggtccttctttgccctttttgctcgactttgggtattctgccgtgaaacgaagctcatgctgatacactttgtcaggcgatcccctcagattcagttcaaatgcgttgatgagcactccaaccggtgcgatgccacgaacttcatggtcgttgctgattttctctaaacataaactgtgttattcaaactaaaggatatttccttgaacttacgtggcaattgaatttcattttcttcttgggctgccatgagcgatgttattcacttgaaaatgaccttagcaattgaaaaatgactataaatttaacgaataaaaatgattagagagagggagaaaggtaagtggacagtcgaaaagatggcacgggtaaggacagaaggggagagacggaaacatatgaaggacgaagtgagtgaatgacggagtgagcgtaggaagggcgagcatttagggggaaggacattggacagcagagcaaatggcgagggtatgggaggcaacgatgccgaaggtggccgatggggagaaggtgggcaatgggcaaagaatgggcgggtggggagggggtggagacgaggggagggaatgtgcaaatggaaccacagaatgggaggggcgggggcggcagagggcgaacggaccgcggggtcggctttggagttgtttatgcaaatgcaactcttaaaaagcattacattcgcaagccgctgcaccaccaccactttacaacacaaaagaaagtgactgaatttggtatcagtggcaaaaaatgagtaacaaaaaaaagggaaagttgcgtaagttgggaatgtctcaacgttcgtcgtttgttcgttcgttggtcagctcctttccctctctccctccaaatccccctcccctctacacacctctcttatctttcatccatcttttctttttcgttatgtacttccaaagattttgccgtttctttctccccacaacaataaaaaaaaatttccgcatttttgccccaggacaatttgctttttattgatcaagcaaaagaaaacagtaataaaatgttgttctgtgaatattattaattaataaaactcaaattatgtacatacatatgtatgtactgtagtagggctggaaatttaagtcaaatgacttttttcactttataacgtaaaatttgaaaaataaaagttcgatcggtgaaaaggcaattgatatccgaaaaaaaaacaattttcaggacttttttatttttttttttcgtgccttggcattttttattactttttgggcgattttttataaatccagtggttcgatcagctgaaaactttgtctctattgcatttcacacgaccataaaataaattggcaactttaaagcaccataactttttcttgaagcatctaaatcaaacattcttagtatcttttggtagccccaagaagtcctctgttactcttcgaaggttgaaaaaaacaccaaagattcaaaaacttgtggttcaaaatgatcagaaaaccaattttttgaaattttctggccataacttttttttgaaattttgcagtcta

SEQ ID NO: 3040 - DNA, 4210 bp, Heterodera glycines
acggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattacccgttgcctaaccttaggcccatccgaataataaaaaactcaaattcgagacttggacatttcgtggcctggacattttgtgggtcagcgatttttactcgatagatttcacataaacatttttttaaatgccaataaatgtacaaatattacataggttaagaatagtaaaactttattaaaatatattattttatttgttttaagatccgcatttgtgctgcgtttgttcggcaacctttcgaattgttccgcaaaagaatgcggcataccagcacaagtcgggggtcagtgaaggggtcttacgatcgactttggccaggcccgtagccccaggggtggaagggggggggattgaaaatttgagcgaaatttgttgactgattttcaccagaaagtgctaaatttttgcgacttttaagtcaactttttaaagaaacattaaggattttgatagacaaaagggaaaaaatcgggggtttgtcgatcgtagaaaaattaaaatttaatgtagttttttttttaaaaaaaaacaggcaagattttttgtaaagaagttaggttgcaaaattcaactgtttttgctaaacttcttgactctatttgatttggatcgttttatgcatttatgaacctctcccaaatgtgactaatttgcttttatcttatttgtttttattttgccggcgtcacgctttgtgtataaatttttttttcacccgcctctcgtctctacgatcgacgaatttttcaaataaatcaggattagttgatcgtagaaaatttggaatttttaaatgaaatcagttaaaaaaaataagcaatttttcgaattcccatgagaaatttttgtataaattttgacttttttctctcactcttttttcttttctccctcttttttccttcaccttcaccccggacgaaacccaactcgtactattatgtagtaaatatagaaacagaaaaaagcgagacagcgttaagtcatcagagaacagagaaaaaaagatactctaaaatagtacgagttgggtttttaccaaactcaaataggtaggtaattttcttttgttcatttggtaacaatctcaaaaattcctgtctctagtgcatgcataagaaaataaagacatcgaaaattacagcgctattcaaattaacattcgaggaattatttattattcatgacgatcgatagaatgaaaatttgattggattggtgaggaaaggacggggaaagggcatgagagctaacaaaagcaaagcgaaacagcagaaatcaataagagagttgtgtgggatgaactacagcagcggaattgttatcggctaatgtcataaatgtttaatgaaaattagttttagaaaaagtacaaataaacttacaatatacaaccatgatttacactttgtttgcacgttttttcaaaaaaaaaaatctgagtaacaggcagggttgccagatctgaggatttatcctcattttgtggctttttgataggtcaatgaggatttttttggaaaatgaggatttgaggatttttgtggctttttgagaaattttgaggatttttgaggcttttggggaaaatcctcagaatcttttaaattttgataaattggcataatgtttggctttttgggaaaagcgccgcaaaaaaatcaacttcgtttttcatgttcagaatcccaaaaaatgcttatttctaacaaaaaaatgctcaaattgatcatgaacaatcaaaaatataacatttgaacattttaaacgtgtttagaatacattttataaaaatgaggctttttgacccaaatgaggcttttttgcctgccaaatgaggcttgaaaattttaatctggcaaccctggtaacaggggtcccgtcaaaaagtcattaacccaaaggattggggcctaatgtgtgtcctatgcgcaatatgggcgtccgattgagttgaggcctattcatcctcacagaatacacaatttattcatataatctgaatattcaatatgcactttctccccgtctcaattggtcattgaatcatcattcctccgctcgaatgcaattcggcgcttgtctcagccgcttttcgtccataataagaccaatagacaatctatgagaagggattgatcagaatggagtttgttggtcagcaaaactcacattgaaaagggcgaacattgtggggaaagcaatccgagagaccttttgaagaaaacaaaattaatttgggcaaattggaaggcgagggccggcctttcgttgttcccgattctcagctctattggctccctgttaattgactttgtctatggattcggcttggacttgtgaaggcacactgagcaaattgaaaaatcggaagcgcaaaggcggcgttcgttggtgaagtcgcactacgaaatcgccatccatcctttaaaataaacttagaaaggaacttaaaaagagcccacgggagcataaaacgcctttcgccgctctgtcggattccgccgaactttggcgataaatcctcgccccgccccgccccgtccgcactgttccggcgccgctgctgctccgctttttccagtggccccccgccgttctcttcccatctctttttgcatttaattagccccgcggggggcgtccttttgttgcgcgggtgcggcgggggcatttcgcgcactttgaagccgacgatggccaactcgagaaggccttaagggaattgagctaagtgagcagcaacgaccgaagggacgggcaaactgcagaagatgaagaacatcgcgccaagcatccaaacatcgattgctttgacataggaaacgcgggggagattcctaacacagaacacaaacaaatatgtaattggccacaaaacaacggagaaatcttcttatttaaagcaaacataataaattaattgtccatttcgattatgtactttccttttccttttttccaattttttattctccaaaatcgccaaattgtgcgtgacttttggccgttttttgcttcttttcccccattgtttttttttatttgtataaaaaaacgatcagtgagttaattacctcataatgtttccaaattgaaagatcatcgcctgaattcaaagtgacaatgcgagttagcagcatttgtcactgttcccaaccgaccaaaagtgcgttcactccgagcattgtccgtgcggggatggctttggagcccaaactgaaggacacccaactgaaaatggggggggggggcaatcacaaaacaaaacgaacgaaagttggactaccttatgaagatggtcaaataggtgggcacataagcctgcatgaagtaccacacataacgccgctcgaaggacagtttcacgtgcaattcgtcctcaattggtgctctcttttcgccttcccctctttcttacccacatccccgcggggtacggctgaaattcggggatttgacggcactttcgcgcccatacctcgacgacaaggtacgcctgaatgttgaccaggttgaagtcgggcaacagaatggtgttgattgggtacacgggggttgggttcagcgagttccaccgcatccgaacttcctgattgttgtagttgaagctttcgtagatcagatggcacatttggatgtccattggaaagtttgtccttcagtcagagaccgatttggccttcccttgcgtttgtcggcacttacaaatccatggcacacggacccttcacacggacacgctaaaaatgaagaagacaacgaagaatggaagaagcaacaagcaacccacataattaacccaaatggtcccattcggataaagcatcaaaaagatgttcctgaaatgggccgcttttggtgcgtgccattgagcgtggtaaagcgactgactgaaagggcgagttgtgtatttgggcaactttggagttgatgaagcacgagtttggcgtccacagcttctcgagcacttgatggctgctcagaaaatggtcccataagcaatttcctccaatcggcgccaatgaatgcctttggctgcccttc

SEQ ID NO: 3041 - DNA, 2483 bp, Heterodera glycines
atcactgggacccttctctcctgcgtttcatcacctggactcagtttttatgcattccaatcactgggactcattctcctgcatttcaatcactgggactcaaccctccagcagttcaatcactgggactcaatccaccagcattccagtcactgggattctgttctcctgcattccaatcactgggactcaattctcctgcatttcaatcactgggactcaaccctccagcatttcaatcactggtactcaattctcttgcatttcaatcactgggactcaacacaccagcatttcaatcaccgggactcaattctccaggacttcaatcaatgggactcagtttttatgcattccaatcactgggactcattctcctgcatttcaatcactgggactcaacacaccagcatttcaatcaccgggactcaattctccaggacttcaatcactgggactctactctattctcgtgcatttcaatcactgggactcaacacaccagcatttcaatcaccgggactcaattctccaggacttcaatcactgggactctactctattctcctgcgtttcaatcactgggactcagtttttatgcattcaaatcactgggactcattctcctgcatttcaatcactgggactcaaccctccagcatttcaatcactgggactcaatccaccagcattccagtcactgggactcaacacaccagcatttcaatcaccgggactcaattctccaggacttcaatcactgggactctattctcctgcgtttcaatcacccggactcagtttttatgcattccaatcaccgggactcattctcctgcatttcaatcactgggactcaaccctccagcatttcaatcactgggactcaattctcttgcatttcaatcaccgggactcaattctccaggacttcaatcactgggactcaattctcttgcattccaatcactgggacctaacctcacctggtccttcggcatcgcaatcatcgagactcaattctgcgatattccaatcaccgggactcaattctgcgacattccaataactgggactcaactaaccagcattccaatcactgggactcaattctccatcattcctattcccgggactcaatcccaccagcattccaatcactgggactcaatccttcacttttcacggattcttcggcatcgtaataaccgaggactcagttctccgacattccaatcactgggactcaattctccgccattccaatcaccgaggattcaatccttcactattccaaacaatgaactcaattttacggattcatcggcatgtcaatcacgggacttaattcagacctgttcagcataattttggaattttaaaaacgtatttctattatgaaatacaatttgcgtagaaaatccttttcattataaatacttgttctcttacatttaaatccatccaattaaaaccgtatccattaaaagaggcataattgacatccgctttaattacaaaaacaaaaaaactccatttcaaggtcaaacaatttctcgaaccaaaactttttcaatacaatatcaaaactaagtgtaagatcatttccattgactttgcatatacaaaaacaattctttttctttacaaaagtgttaagagcattcatttccaaacgctttttgataataacaaaacaaaaactttttctcttaagaaatgcaatagaaagcattcattgcgatttcattatcattaataaacatacaaaaactattttgtcattaaaaacgaaaaaaaagagaaatttattttaactgtgctttttgcaaaaactgacaaaacgaaaatgaaaaagcaaaaccaaacatttcttttttcaaatcattttttaacgcaaaaactaaacaaatcgccacacaaattcaaaaacggacacatacacacactcaactttattatactagcggggtcagcgccttcggcgcattccccgctaggtagtacgattgtattgtaagattatgtttgataaaatcgactggctcggccgattcgcggcctcgcatcctttttttgctttttctccaatcgtcgggactcaacccaccagatttcaatcactggtactcaaatctcctgcatttcaatcactgggactcaaccctccagcattccaattactgggactcaattctcctgcatttcaatcactgggattcaaatctctggcatttcaatcactgggactctattctcctgcattttaatcactgggactcaaccctccagcatttaaatcactgggactcaatccaccagcattccaatcgccgggactcaacctcagcaaatttctttagcatttttaactttgtgtgccttgggatgttgaacagttggggagggctcggccgcttcgcggcctcgtacgggggccttcagccccccaacaattttttgcgccaaaggtactcgatcgg

SEQ ID NO: 3042 - DNA, 1498 bp, Heterodera glycines
  misc_feature (1434)..(1434): n is a, c, g, or t
ttccagtctcgaattctgtaaaattttgtccccaattccctgccaatttctcgtacaattagcttcagctgtttacaattgtaaatgtcattgtttttcaatatttctctccttttgtcaaattctttgattatttctaatatttcttgttcatcaaaatgatcagaatggtagcttcagtctgtggaatctccctgcgttatacgagcgctttcttcatattcgttaaacattgacttctcagtgatcgtatcatttgtttttatcgggaatgctcactaattcaatgcgattcttaggatttatcttttttatttataggaatgggatttcagagaaaatttaaaatgccggatacaacaaatttccggacatgtgattctcctttagaaaaataaaataattttttgtcagtagagtcggtgcggctagagacttccccgtcctccaaggtgccgatcgcgacttcaccggttccgtcaactgccgttacgcggttatgcacaacattcccggcgacaatcttctataattatcaacatcaatggtcctattatacctcttggaatcgtgaacacttggggaggggtctatctcatccagtctttgtacagtggccttcaaccccccaacaattttttgcgccaaaggtactcgctcggccgcttcgcggcctcgtactggggccttcggcccccccacaattttctgcgccaatccaccatcatttaatcgctgggactcaacccaccaacattccaatcgccaacacttcaacgggactcaatccaccagcatttcaatcactgggactcaacccaccaacattccaattactgggactcaattctcctgcattccaatcactgggactcaattctcctgcatttcaatcactgggactcactcccccaacattccaatcaacgggactcaaaccaccagcatttcaatcgccaacacttcaacgggactcaatccaccagcatttcaatcgccaacacttcaacgggactcaatccaccagcatttcaatcactgggactcaacccaccaacattccaattactgggactcaattctcctgcattccaatcactgggactcaattctcctgcatttcaatcactgggactcaacccaccaacattccaatcaacgggactcaatccaccagcatttcaatcgccaacacttcaacgggactcaatccaccagcatttcaatcactgggactcaatccaccagcattccaattactgggactcaattctcctgcatttcaatcactgggactcaacccaccagcattccaatcaacgggactcaatccaccagcatttcaatcactgggactcaacctcagcaaatttctttagcatttttaactttttgtgtgccttgggatgttgaacatttggggaggggctcggncgcttcgcggcctcgtacgggggccttcagcccccccaacaattttttgcgccaaaggaactcg

SEQ ID NO: 3043 - DNA, 2146 bp, Heterodera glycines
ttttgataataacaaaaccaaaaactttttcttcttaagaaatgcaatagaaagcattcattgcgagttcatatcatttaataaacatacgaaaactattttgtcataaaaacgaaaaaaaagagaaatttatttagactgtgctttttgcaagaactgacaaaacgaaaatgaaaaagcaaaaccaaacatttcttttttcaaatcattttttaacgcaaaaactaaacaaatcgccacacaaattcaaaaacggacacatacacacactcaactttattatactagcggggtcagcgccttcggcgcattccccgcttaggtagtacgattgtattgtaagattatgtttgataaaatcgactggctcggccgattcgcggcctcgcatcctttttttgctttttctccaatcgtcgggactcaacccaccagatttcaatcactgggactctaatctcctgcgtttcaatcactgggactcaaatctccagcatttcaatcactgggactcaaccctccagcatttcaacactgggactctgttctcctgcattccaatcaccgggactcagctctccgacattcaagtcactgggactcaattctccggcattccaatcaccgggactcaactcaccatcattccaatcgctgggacctaacctcacctgattcttcggtatagcaaccaccgagactcaattctccagcatttcaatcactgggacttaacacaccagcatttcaatcaccgggactcaattctccaggacttcaatcactgggactctattctcctgcgtttcaatcacctggactcagtttttatgcattccaatcactgggactcattctcctgcatttcaatcactgggactcaaccctccagcagttcaatcactgggactcaatccaccagcattccagtcactgggattctgttctcctgcattccaatcactgggactcaattctcctgcatttcaatcactgggactcaaccctccagcatttcaatcactggtactcaattctcttgcatttcaatcactgggactcaacacaccagcatttcaatcaccgggactcaattctccaggacttcaatcaatgggattcagtttttatgcattccaatcactgggactcattctcctgcatttcaatcactgggactcaaccctccagcatttcaatcactggtactcaattctcttgcatttcaatcactgggactcaacacaccagcatttcaatcaccgggactcaaccctccagcatttcaatcactggtactcaattctcgtgcatttcaatcactgggactcaacacaccagcatttcaatcaccgggactcaattctccaggacttcaatcactgggactctactctattctcctgcgtttcaatcactgggactcagtttttatgcattcaaatcactgggactcattctcctgcatttcaatcactgggactcaaccctccagcatttcaatcactgggactcaatccaccagcattccagtcactgggactcaacacaccagcatttcaatcaccgggactcaattctccaggacttcaatcactgggactctattctcctgcgtttcaatcacccggactcagtttttattcattccaatcaccgggactcattctcctgcatttcaatcactgggactcaaccctccagcatttcaatcactgggactcaattctcttgcatttcaatcaccgggactcaattctccaggacttcaatcactgggactcaattctcttgcattccaatcactgggacctaacctcacctggtccttcggcatcgcaatcatcgagactcaattctgcgatattccaatcaccgggactcaattctgcgacattccaaaaaatgggactcaactaaccagcaatccaatcactgggactcaattctccatcattcctattcccgggactcaatccccacaagcatcccaatcacttgggactcaatccttcacctttctacgggatttttcggcatcggaaaaaacggaagaattcagttctccgaaattccaatcactgggaatcaattctccccccattccaatcacccaagaattcaaaccttcaactattccaaacaa

SEQ ID NO: 3044 - DNA, 8197 bp, Heterodera glycines
  misc_feature (28)..(28): n is a, c, g, or t
  misc_feature (55)..(55): n is a, c, g, or t
aacgctgagctgaaaggtccctgatacnacgcatttacctccttggcacggcttnggtgattcaagcgcttgttgaccatgatcagccaatctccggcgcctgcccatcctgtcgccgtctgtgcccattcaacgctgaccactttgaccgaatcgccgacttccaatggccgagtcttttggacaatgtcattgtccacccaaattagggcaggccattgctctgccagctgaactcgtgcagcaaccacgccgtttgcagcagtttgagcgaccaggtaccactttggcgccttttcgtcttcctttttgccagggtatggcccctgaatacgagtcttcgtcaatttgtctttggcccggccgatggcttggaattcgtcgatcagagccccgtcttccaaacatgcctgcgatgacgaagagcattttgacgcatttgtctggtccaggcgttttgccttgttcgacaagaaggtgtggcgagaagatgactcatcacctgaaaacccgccattcccgaaactatcccccccttggtccccattttgctcatccacttccatttctttcacctcctctgggactaccggctcaaccgtggccaaacccagcggatcgctcgggtttgccagtggcaacacttccacaacaccattttcattatcagtattttgcccgcaggcgttctcctcgatgctttcatccagcaccaccacttcgggcacttgagctggtactccctcagcttctctttccatttcattttcagtatttgcccgcaggctttttcgaaggacatttttgggaaaaggaattaggatttgttatagctaaaatataaaaagaattagttgaaggaaggatttgtgaaatgtaaaaaagtggggaaagggatacagaaaatggtgaactgaataagaaacgagaaaatatgtatgttgtaaggtttatatgtgattggatcggaggagtggcctatttgccagtcggaggaaaatgtaaaatgtgtaatgtcggcggcaaaaataagatgacaggcgatgggcgtttgctccgtctaaggagcgaagatgtgaccgttgatgattcacaaggccgtcgctagctttttgagttaaattatttgagtgggaatgggaaggaaagagggaacaaaaattgaaaattgtgttgtggtgttcaaaaagcgacaatttgtgcatcagcgatgagagagagggaaaaaccggtgggaagagcgaaaagggcaacatttaattgctttttctttgaatgcgcggatgggccggacctgaaagaggcacccatcagccattaattcaacaaagtgttccctcagcgagcggtggagcggagagagaatttgaaaaataaaaaattggaattgaaatgtgaaaatccaatccttaaatccaacggaaaaatttaccaaaattaggaaatcaattttccatttcaaattttgtagccaaaaactgtagggtgtacgatggtgaaaacggagcggtcacacttgcaatacagcaacaacatctgaggatttttatgcagactaatattgccaaaaggaaaaggacaattaagccaattgttagccaaaaattagatgattgactaaatttgtctccaaaatttttgattatttgttcgcaggcccaacgtaattgttcttctccatactcagtgattgacgaattatagtggtaaagtgcatagcatgttgtgttgcagttcattgaacacaacaaatgctgttcgaaaatagccgtactattcggtgttagttgagacgtactgaccgtccaggccatgactaacaacacacaaaacagtttaatcaactttcctaatttcgattttgtacactttgagtctgtattgtgcccgcaggccatttcagtcgattgtcttaggttgctggaggagtgaattttaagaaaggaataataaatttgtctgaatctcgtagagctcgtggatggctgtttgtgccaatcgttggacgtttccattttttgagtcgattcgcacccacaagttgggtttttgttgcacttggagatgatggtagcgaaattgagagcaacttgcgatttttgagatgagtgagaggatgcgcatctccgggtcgaggaatgcgtcctgtgttgtgtttggcagatggattgtgaccgggatgaacttgtagcagtctttcgttgtccggtaactgatgttgaacagtgagattggaacgcagggaaacacttcgattgttgtttcgctgatccatcgggcttgcagattttcgcgcttgaggagttttcgtgcttgaagagttgagttgctgacgcgcacgttgcgctggcattccttcaagtagagctgcgagagtgccattgttgtggcaagttgagcagctgaaagctgcgaagcgagttgctcgggttgcacgttgcgtctcgctcttgtgtggtcgctcatgatgatgtcgtattgttctttcggaatgccgaagttctgctccgacaggacgatttgtctcccgtcgcatgcttgcactgcatgcgtctcggtgaaggtcagggccttttgtcggtcgtccgagatccaaaatgctgttgattcaccgttgagtttggtgaattctccgtagatttcttctgcttctttaaagtcgcacatgaaggaattgtcgttagggcatgctgaagttcagatgagtgaactgttgtcatgcagctggcaatactcggaggcgtaattgcagtggtctgctcgatgaattggcgacagcaattggagactgtgccatttgacgaacagtgttgctggttgcgcaaaacaatttgttgccgagcttgtttgtttccctttgaaaagtccggtgattggtccagggaaatccacttggagttggtcgtttgttgcccaaatacgattgttgtcgtcgtggtgcatttccgttttggcgagtgggcattcttgctgatgtgccattcgttggcagagtcgtttagagaccaacggaaattctttgttgatttcgacgaacttatcgccgacgatgtttgtgtaataattttccgtcgtcgttttgatggagcagtgccatgccgttgcgattggttccggccggtggatcttggtgtacagcgtgatggtcagtggtgtccattgcgcagtaagtgccggtggtggacggcagaatggcgagttttccggacctttaagttcccagagagtgctgccgtgattcgagcaccagaagacgtcgcgtcccttttcggttgtgattgtgctcttgggccagcgaatcaatttgattcctggacggggccgttgttgttgccgtacccgcgatactgttgtcgttcggtggtccattgaccatggcattggcgttgtcgtggttgtgcgtgcggttggtcgtgtggttaatctggttggccaatttgttgtgcgtgtggtcgttgtagtcgcggttgttgtcgttgtgcgtggacgacttgtggttgttgtgggttggatcgttgtccatggcggagttgtcgatctcggcggatttgttgattggctcagacttcggttcagtgctagaaccttgtctatgtatcgctggacgtaagggctgtatttcgttgatgcccgtcggtcgcgctccgtgaagatgttgaggaaatttgaaacatggccgccatgccatgctttgacttgcgtaattcgcttttgtcgacttggtagtccttgtgccgtgccggtgaagagtaggcaaaacatgctgatcagcattagcgagctgatcacttgtcggcttgttgatggaccttgtcgggacgtgtttgttgacgacgatggtcccagctcttgttccaaatccattggttccggaatggcttgtcggatccggttggcgatttgtcttgcttctcccatttctcgattgaaaacgaagaagcccgcttttaattcgcgggtgatgtcgatcaggtacttcttgttgttgatccattgtgcattgtcgtccttggctacgatcagtgtgatttcgatgtctgatcgcagaaatcggtggagcatcggtgcgatttgagccgccatgttgtcggcagttgcttggtaggcaaagatcatgtgtttgacctttggtcccgggataagtcggaattcgtctgctgggaagtgggtgaaccacttggcgtcatagaagagtggcttaaacacttctgccacgttgtctccgatgagaatggttgtgcaattgtagttcaagaaggtcgggtgctgcacttttgctcgagcttttgtgaggatttccgccgttcggttgttgagtcgctcgatccattcctcgtagtcacttggttgctccttttctggtatgattggtcgaaacttgacttgtttgtgtgccggttgattgtagagctcgccgaagcgatcgcatgagttgcgccagacattgatgacctctgtgaagtgctggtcgcgtccgatttgtcgtcctttgctgacgacttgttgctgatggaactttttggcgatttcttccgttacggcgttgagttgtgtgtagttatcgtgagctgcccaaatctcatcagctggcaagttcatgttccgggtgagccaattgaatattagggcttggaagaagttggtcgcgcggcagttgttgaactcttcaacttggaatcggttgccggcgattgatccgtaagttgccgttttcgcgcaggtcgtgtgagagtcgtcgcacggctcaaacaggttgaattcgttgaagttgttcggcttggggtcggccattcggtactcttcgattgttggtgccgatgtttttggttgctttggctgctttgcgttgtcggtggccgttttttctgttgttggcgtgtcatcgagcgttatgatttccggttcttcggttggcacggcctggaggaagatcacatcttctggcaccatgtgtgagtagtatccgccgtccacaaaacggaactcggcgaatggtcgttttcctccatacagtcgtgagacgctgagttgaagtcgatcggttttatgatgaatcatccatcgcccttggtcctccagttcatggagttctcggagaacacgtcctctttgccatgctgacgtccaattctccggtccgtaaatgcgttgaacgtagctgagtagcgtttcgttttcctctggccattcgtctcttgaccgttgtcgcttctcttgcatgtcgatagtcttttttctgccgattcgatgtcgttcaagctctttgtcctttgctgattgctgctttgatttcgttgactgatccgtttcttccgcgtgcttctctgttggatccggctgatccatcagatcatagtcaaattgttgtgctaattcttgccatgccttgctgtgtgcttgttgattggtggcacgttgttcgtcgttttgttgcctttcgatttgttgacgttcggcttctcgttgttgttcttctttttgtggctgcggcatttctcgttcgtgttgctcagtgcgaaggtgtcgtttagcttctttttgcgctttctgcaccatttgttgttcgtgttcgatttgctcatgttgcggcgcttttcgcacttctctgttttctgcgatggcctgaatcgtggccttgctgcttccttgttggtccgcgattgcatggaacaattttagcaatccggagtcgtgaagttgcttgcggcgtttgtgttgtccttgcagtggactttgttgttctccgatgggtcgtaataatgctgagcggcgttttgggattttgaagtcttcggtgttgcgtggtcgttgttcttcgtcgtcactgccggctaaggagactgagtcttccatgattgatgctatgaggcagtggacttgttgaattggttgctctggaacctcagggctcaattccaaattgtacaattggtttattgccctatcccttaattttccattgatttttatcaaagcactgcgcgctctcccatcttttcctattaggactttctcaaccctcgccaagttccacaaggatctcggcatttggtcgtcttcaacgatcacgatgtcgccgttatttggggtttgtagtcctgtcgttgcatttggtcggtcgtgttcgcgcagggaaagaaggtagtcacttttccaaatttcccagaatttgttcagccgagcattaacgtggctcagtgttgtcaccattttgtcgcgatttgttgggtatggctcgtatgttggatcgtctgtgtcgttattgatgattgggaagttgttgtttgctttgctgtatggtatcaggaagttgattggtcgcaacactttgatcggttcctgatccgattcgaacgtgagtggtcgattgttgatgatcgcttcaatttcacagagcattgtgccgaactcgtccaatgtgagaaggtttctgccgactgtccttcgtagtgcgtttttggtgatgccgacaagtctttcccaaatgccgcctttccaaggggcgtgggctgtgttgaaaatccaacggattccgctttgagccatttgttgttgcatgtcctccggcattaacgtgtcggtccagttttctttgatgacttttgctcctgccacgaagtttgtgccttggtcggacatgataagtgatggtatgcctcttctggccgtgaatctccgaaaggctcggaggaatgcttcagccgagtagtcttcggctacttccaaatgaagggcgcggatggccaagcaggtgaagagtgcgacgtagattttcaccacgtcattgctttgtttgaccttgagtggaccgaagtagtccactcccgttttgtcgaatggtcgtgcttcgctgactcttccccttggcaaatccgatgcctcaggatatgtgtacggcttgactcgttctcgacgacattcaagacatccgtgttgcggggagttgagcagttgctgaactgttttgcgtccgcgtggtatccagaacttctctcttaatgttgacaggagtattctcggaccgcaatgtttgagctgtttgtcataatgccggatgatgagcttggttatccatgcgtgtggcggcagaaagattgggtgtttactgtcgtatggcagatccggtgcttcctcgagtcgtccaccgcatctccaaattccttcttgtcggaagagttgcaattctcggatttggtcgttggatggtggatgaagccgctgtgtttctctcaagatccaattttcggcctgttgcagttgtgccatggtcagtggtttgttgttttgatgcggttcactaattgtgccgttttcgattgtgcgaagctttttgatgaagcgcatagcgtgtgctgcggtggctttcagcctgttccaattcgaaaatcgttcgaagtggattgatggtttgaactgttcttcaacatgaacaggtgttgtcagttcgatgattggtggctcttccacttctttgaattcatctccgggccggtagatgacgtttgattttggccatttgtctgctttcgaaagccaaacggggccaaagcgccaaagcagtgatgatcgaaggcattgaggatccgctcctcttgatgccatgtccgctggatttgagtcggttctgacgtgtcggacttggaagttcgcttctcggattttttgtaatcgatttgtcacaaatcgatcttggcgcttgttttctcgaagtcgttcgactgagcattgactgtctgtccacatgatgacttgatgatcggcaaatttgatttgcgcttggatgaatttgactgccttgactccgagagtcagtgcttgaagttccagctttggaattgtgccgtcgtgtgcggccactttgattggtttgacaaggctttttgcgtagatgaggttgcattcatccttcataatcgtcgtttttgccttttgatacacggcaattcccatgccgtatttgctggcgtcgcagaagcagtggaattccactgagtcgatggcttggatgtgccgtggaaattcaattgtgattgcttcgcctctgtcgagccactgtgccatcaatttgagccagtctttgctgatgttcgctggcaattcgtcgtcccattttggattcatgttttgcacttcttgaagaatgagcttggctggcagtagaaccggtgacatgagtccgagcgggtcgtagactttg

SEQ ID NO: 3045 - DNA, 3667 bp, Heterodera glycines
  misc_feature (27)..(27): n is a, c, g, or t
  misc_feature (3513)..(3513): n is a, c, g, or t
  misc_feature (3589)..(3589): n is a, c, g, or t
  misc_feature (3621)..(3622): n is a, c, g, or t
attcgaaaatcttatacaaaaaataanttagtgcaataaaactgaatgatactttataaaaatactacttatcggataggcacaataaaagccttaatgatcgaattccgctaccccataaagaagtgcgaaagtagggacaaggcttccgggattgagatttattaaattaatttattaagcaaataattacttttccaaaaacaacgggggaaaggagggggaggagtcaagcggagccaataggcgactgactgggaggggggcgaggatttgcaaatgattccactaaaaagattaacaaaagatgttgtaaatatgaatattttgatcatctcatcatcacagcgaagatgaataatgttatgtctttagcttacacactttattaaagcaaagacaaacagaaaaataaatgataaataacaaataaataaatgactgaggaaagacaatcaataaaatgaaatgaaggagagaacggcaagtgacccgaatgagtgaaagggtcaacattaaataaacatttccaagtgatgacacagggaatcgtgtcaataaataataaatatatttaaattgtcaaatccacaacaaataacaaatcactattataataaaagagcaaaataaggtggggagtgaagaaagcatggaaaatgggtacaaaatccctttctttgtgttgctacatattttgcttctcactaaacttcttccaccggctgtcccattgttcaccacctcccatacataattttgtttattattgtgcataatgttttgtccaattttcatatggatttaaataaatcatatcaacaaaaagttttgtattttaagtgcgttttatttttgtaatttttcgccactttcaaaatgacttttgagaaaaccgaatttttgagttaaaatatattttttctgtttgccaggaaaaaaacctgcaaattctgatccctgatttcaactaaattcataaaaaaaattctttgttttttgttttaagaaccgttgatcaggcacaaatataaattagaagacataaggcaaaaaataaattgacaatttctcaactgctgatgacaaaaacatatacatatattggaattatatttgtttttatttttaaataattaaacaatttctaaaaatccatgaaaaactgcgtcccaaaaatcgagtaaatgttatatgtacattttttggatttcaaacaatctgccgctgttgttgttggagagaaaaggagtagagccgatatacagtatgagcgggactctgtagcagatacagtaaggcataaattgaaagagtggcaccgtaaggtgctttattttgtgacaaaatttctgcgattaagcaaatcccatgtgttttgataaacatttatacaagctgttgaaaatacaaaaatgctaatttggataagaccaataatggcatagtgaccaaattttcagaaacaagcagtgattaaaatgaagaggctgataacattgcctttcaatcaatagaaagtgatcagatagatttgtgagtgtcggctttagtgcccgatcactttcttttacgaaaatgacaaggcacaaaagttgctgatcagacatttgtgttaattttttgactcgtctccgatcattttccgtcttcagtgtgctggttgatccatcagatcagtccgtccatccccatgcattttttgttgttttttttttgatcaccaatatggcccgtcagtggtcagctgcttccatgaggcgaatgcggtggacgacaaaccgttgggcgagttccaatcgacacggtacggttcgtcacgatcgcaaatgccggtgccggcgcagcgttcaatttgcattggcgacgacgaactgcgaccgtaaggcttaaaattcataattaaaatttaaaaaatatatatttttggtaattattaaaatagagaatgtggaagtgaaagaatgaaatttttagggattattaaaaaaagattttgcatataaaatgtatgattcaccacaaaattatgcaatgatttttaataattagcagattttcaaagttatttaatctgttagagacaaattaacatctttaatgcctgctttttgaagttcggtttcaattctcgtaattccacatctttatatcaatttatttgctaaaatttttcataattaaatagaaacgagggctgctcaacttttaaactttttcgagcttaaatttaggtgtcaaaaaattctcaggatagagaaagtggaaaattgatgaaccaaatccaaatcattgtataatgcggttaaagcaattgcgggcggtcaactgctctcattaccattaattgccattttaaaccataaggaagaaatgttaaatcgatgagacaaatataatttatttacaacagtttttggtcaaatgtattcagttaatccgttaactaattaaagtgattgcggtcagctgctctctcattaccattaattaaccttttctaccgtaaaccattccccttccgtcgacacaccattaaaaagagtcaaaattgttttataataatttattctttatttaataaaaaacataaaataaaaaataattgacaaaattttggggagtgggtcacctattttatatattaaatatttgtttaatgaatatcattggaaagcccattaaaaatgctacaaaaaggttaaggttgtactctatcaaagaattaatttttcaaaaattattatcggaatggaaaattattatgaacaatatgcccatgactgtgccatatgaactgttttgcctgaaagggcaatgcccggcaaaaaactcaacagatttctaaaaatggttattttagcacccataagtttgggatgggcgagataggtcaatgggatgttgatgaaaaaaattattacataaattttgatttttgagaaattaattagtgggtaaaatcttaaattctagctttttgtcagtggaaaatgttaactcttattatattacatctaaattcatataaattaaatataaataattaaagaatcatgttttttaaacattttatcagaaacaaataaaatatttatttaaatgttattgatggctaaaacatttctttttttgagaggggcggagatgtcctaaaatggcaaataaattaggaggcataaggcaaaaaataaatgacaattaattctcaactgctgatgaacacatacataaattgataacggaaattctatttattttatttttacttaatttaacatttaaaaaagtccgtgaaaattgctgcccaaaaaatgagtaccaatatgttttttgtgtacacttttttcttcggattttaaacaaattgccgttgttgttaccgtagggaaagtgtgccatggttagaaaatttaaaaagatgcctaaggaaaaaacaaattttctgcataaatttttggatgtgagaaaagagagacaaatgatgaaaaatgtacaattggaaggctgagncaaaaatatcactcattcactttgataatgatcatcagatcaggcacagttagttactggtgcccgttagcgatanaagaaacattgaattttttcctatattttgcnnacatatgtgtaaaatgaggacgagaatacatataaatgagtaaaa

SEQ ID NO: 3046 - DNA, 2716 bp, Heterodera glycines
agacggacagaaaaacgaatgagggccaatggaacgacaagaaaaaaaaatcataaaaattcttaaacattttgttagcattggcttgaaaatgatggcattgtgccaaaagtgtccatacttttctggtttttaaatgaacaaattgtttttcccgtccacaggccctcaatcattattggggatggcgtctgtatgattttatatgtatgtacagtatgtatgagtgagctgtctataactaggtacagtaaggcacatatggaaagagaaagagagagacatacagtaggacaacatttggtcaaacaaagacactttatttgtgtccaaatctctgcgcttaaaaaattaaggtattttgataaatgtttgtacaagttgatgatgatgacaatggtgatgctgataatacaaaaaatgataaataataataatggcagcaaaattcattaattaataagaaatgaataatggatgagagaaaaagggggagagagagaatggaaagaaaatcggcgaggggagtgggggggggagagattccaatttggaagtaaaagtgattaaaccatcaaaaagccaagctataacagcacagtgatcaattcttcagaaacaagcagtgattaaaatgaagaggctgataacattgccttttcaatcaatagaaagtgatcagatagatttgtgagtgtcgactttagtgcccgatcactattcttttacgaaaatgaccaggcacaaaagtgaaatgatcaacatctaatcacaatgccagtacgatcagccaaaatcatttcactgttctctgatcttttaaggatagtgaccagacatttgtacaaacaacaatgctccgttgttgatcagacatttgtgttaattttttgactcgtctccgatcattttccgtcttcagtgtgctggttgatccatccgatcagtccgtccatccccatgcattttttgttgtttttttttgatcaccaatatggcccgtcagtggtcagctgcttccatgaggcaaatgtggtggacgacaaaccgttgggcgagttccaatcgacacggtacgggtcgtcacgatcgcaaatgccggtgccgacgcagcgttcaatttgcattggcgacgacgaactgcgaccgtaaggcttaaaattcataattaaaatttaaaaaatatatatttttggtaattattaaaatagaaaatgtggaagtgaaagaatgaaatttttagggattattaaaaaaaggactttgcattataattatatattgccaccaccaaaattatgcaaggactttttatcaatagcaaattttcaaaattatctaatttatttatggctgtttttatgatgtcttatttaattttcgaattatcatttgtatttactaattaaatttttttttaatttcgcataattaaattgaaaggaggtccgacgaatttttaatcttctttggaattgaaatttcactaacaataaatctctcggaagtttaaggaaatgttaaatcgatgagacaaatccaattaatacataattttggtaaaagtataagtaatccgttgactaattaaagtgtttgcggtcagctgctctctcattaccattaattacccttttctaccgtaaaccattccccttccgtcgacacaccattaaaaggagccaaaaatgttttgtaataatttattcgttatttaataaaaaaatagaattataaaaatatattgacaaaatttgtgggggatgggtcacctatttcatatattcatgcatgataatgatgatgatggtggcatcataaaatcatatttcataaaagtctgacaaaaatgacacaaaaaggggggcgtggaaaattttctgtctctaaaaaattaattggcggcgccaaaggttggccacatcgttttgagagttggtgcccaggcccaccgctgttttgccgacaccgccgccggtgttgttgtggttgatgtccacaagaaacggtgacgatgctgacccaccactttttggcgttgtcgtccgtaatcggtgtgccgctgccgtcggcgattgatgcgacaatgccaaaaacgatggttgcgatgatgccacactggtgatgacgaagacgctgtcattgttgtcgggaattggtcttgggaaagcagcacaaagtttttgccgtcatttgagtcccaatgctcctccacggagggcgacgagccggccaaaaagcggacgcaaaactcaaaacggatgaactgaaaattaaattgcgattaaaaaggaacccataatccttgacaaaaaatactataataatatctcaattacgttattgtttatagagtatatggtaacaaggaaaagaagttctataaacaagaatctataaaataggattggtatgtaacggagcgcttttcaggtagtgccaaaatagtttttggtgctatgagcaaaaaacaaaaaatcgtctccatttccatccaaatgaaatttaaaacaatttcccgacccgtaccctaaaatacagtagggaatcctcttcccgcattggataatggcaaaatttcccaccgggcattcgttgttgcgcggcaacggcacatcaaagcgaaatgtgtcaaatgccttcgagggcgaacattgccattgcgcttcaacgtcgcagaacgttttccaaccattggctgtgtggcggacgaaca

SEQ ID NO: 3047 - DNA, 6428 bp, Heterodera glycines
tgttgtggtgatgtccacaagaacggtgacgatgctgacccaccactttttggcgtgtcgtccgtaatcggtgtgccgctgccgtcggcgattgatgcgacaatgccaaaaacgatggttgcgatgatgccaacactggtgatgacgaagacgctgtcattgttgtcgggaattggtcttgggaaagcagcacaaagtttttgccgtcatttgagtcccaatgctcctccacggagggcgacgagccggccaaaaagcggacgcaaaactcaaaacggatgaactgaaaattaaattgcgattaaaaaggaacccataatccttgacaaaaaatactataataatatctcaattacgttattgtttatagagtatatggtaacaaggaaaagaagttctataaaagcattagcaagaatctataaaataggattggtatgtggggacgggacgaaatctcgccgccgaaatctcgccgccggaatctcgccgccgaaatctcgccgccggaatctcgccgccgaaatctcgccgccggaatctcgccgccgaaatctcgccgccggaatctcgccgccgaaatctcgccgagacaaaatctcgccgccgaaatctcgccggctgaaatctcgccggccgaaatctcgccgcagaaatttcaaaaaaaaaaattcaaacttagaaatttttcaaggaaaaaattttagaaaatttttttataagaaaattccaaaaaaaactatttgctaagtttttttgaaaatttttcaaaaaaaacagtaaattttcataaaatttcaaaaaaaaattgctgaaaaatttttcaacaatttttttatttaaattttcttataaaaaaatttttctaagaattttttccttgaaaaatttctaagtttgaaattttttttgaaatttctgcggcgagatttcggccggcgagattttggcggcgagatttcggcggcgagattttggggtgcacccttggtatgtaacggagcgcttttcaggtagtgccaaaatagtttttggtgctatgagcaaaaaacaaaaaatcgtctccatttccatccaaatgaaatttaaaacaatttcccgacccgtaccctaaaatacagtagggaatcctcttcccgcattggataatggcaaaatttcccaccgggcattcgttgttgcgcggcaacggcacatcaaagcgaaatgtgtcaaatgccttcgagggcgaacattgccattgcgcttcaacgtcgctgaacgttttccaaccattggctgtgtggcggacgaacacatgcttttcaaatgccatgttggccacctgcaaccaattaaaccattaattaaggcattttgacatgtctcgttagactccaaatttttcagatgatacacccaatgccggacctataattgttttatttttgtcatattgcccattttgttacttttcgccgtgccgtgcctcagtgatgtcaaaaaaggcagtttaccaaatgtttttttatcattttgtccattttggcactttccatgccgtgcctcagtggtgccaaaaaggcagtttgtcacatgtttatttgcacattttggcattttccccgtgccctgccctagtgattccaacaaaaaaaggcagttttcctaatgttttttttatcattttgtcaattttggcacttttccccatgccgtccgtgccttgatggtgccgaccattcggctcagttcattcttcagcatcacattttcaagtgccacccgttgtcggtccaatgtgtcgcggaagtgcacatattcactggccggctgtttgaatgccatcttccaactgcgccgatggattgggccgccctttcgctgcctttcctcctccgcctcaaattcgtccaattcgtccgagtcctaccatgtgaaaaaaaagttattaaaatgaaattaaaagtcataaaaatagcaaattaggtgaaaatctgttaaaagtgtctatcggcatcgtttttgatccaaaaactttcaaatttttggggaaaaagccagtaaaaatcgactttcaaatcttattttttggggtcaaaaaagctcttgcttttagcacagtgcttacattgaaaaaaagttggaagcattagttttgaatataataaaaagaatataattttccatggcatttctttgacaccgttaaaaaattaataaaaaaaatgatctaattaaaatgtaccatctcctcaattgtcattgtcgaagcactgctgctgtttctcaatggttgaccgttcgcatcagtgccaccggcggaatgggcagcagcaattgcggaggaagccgcggctgctgcacgacgtattcgacggagaacagctgaaaaattgaaaaaataaaataaataaataattacttaatttaattctaataaaaaatattaaaatatcaaaaaagtagagaaaataatgaatacaaataagaaaatgaattttaatcattttaaatgttgaacagttaaaaatcaacgaatcaattctaaaacaaataccgtgtgacattaataaaccgtattctatacagtatgactcacctgggctgatctttggcgggtagtcgctgggctcggtcatcacacgcaccgtctccaggcactggccacagtcgtctgcgaaccgcacgcgcttcagagggcgcagcgcggctaccacgagcgggaacgacactgtctcggcagaaatggtgccaatgccaatgtggccgctgcaaattgccggtgttgtttccgacggtggcaaaatgtcaatgctggcaacggtgccgcttttgctgtcgttcggacaaagggtggcggtgcctttgccttcaaagaatgcccgtggagacggttcgtctgctgctgtttcactgccggcattgttggccatcagtgaaggcggttgcggcaacagtggcggcacaacactgccgtcaatggtcggacgacgatggcacagctcgacattgagcagagggacctgtgccggaaaattgaaatattgacgataatatattcttggtaatgcggctcaagaaaaatatgccaattatatagtataacagaaaaagcgtgatggtacttatatggcatataaaaagctacttcacttgtttttgaggtttaatacagcgaaaaattttaccattaatatgtttaagttccagatcacaaaattacagtaggattaaaatataaatatacagtatgactgaaagaacatttatttctccaattttccccacgcaacccatcgtttttgccccggctgtttgtcctaagccttataatttgccgttttaaatcatataatcaacgcacctgaaagggcagttgcaccaatggggacggctccgctggcatcgcaaggtccaccgaggcgagcattggcggcacggtcatatagtcggagcagggcggctcaaccaacgacgatggaggcagggactgctgaaaatacgaaaaaatatttcattgtttttttgtttctcgaaatttcggacttggaaaggtgacgccattggcacggcggcggcacagacattgttggcaccggtgtacagacaagcggacccggagtcggaggggacaagcgaaatgttgtccagccaagagtccgcataacgcggcgccggcggcatcggctggtgatgctgttgctggtgcaggtggtcagagaggccctgagggatttttttttgagtttcaatttttcgaggttagcgcggcccgggagagagagggaggggtggctaattgcaaaccacccgccagttgagaaaaaacccaaatttttaatacctcactgttcaacaaagatggtttgaaattcgaaatcatttattgatccgaattggctcaaccttaaaaccaaacagtttgccaaacttaaaaaaaattcaaaagggattggctaatttgtaggttatggaatcttaattttttcggtcttttttcaaacgcttaatgccgggaaaggcattgggaaactggcattttcattttgctgcgcacagaaaaagaatttttaagtataaaaattattgaaaatccaaaatgtggagcaaccaaaaggaaaaaagttacagatgaaaaccctcaaaaatattctaaccaaattattggaaatgagtgcaaagtcgcggatggcggtcgaactcgggaaaaggaagcaagaggaggaaggcaacaaagttggagttaagggcggaaaagtgtccagcaaaattgactcgaaaaccatcatcggcgaaggccgaagccaaatcccaccagaaaatgagaagaattcgaaaaatcagaaaaattacgaaatgcatgcaaaaccaaaaaaaggggaggaagtccctaaatttctgaaatccatcactttttcaccaaaattcccgttcaatcttttgaaatataaatttagaaggtgttattccaaaaaagccaaaaaaaatctgtagattttttaaaattgctatttttagtggggaggggagactttttgagtgcacaatgaacccgtacagataatatgcgaattagtggaccaatgaatggtgtaaatcgatgagaaaatgaacggacgttgggggcggggggattatcatctctcatcatcgtttattattttgtgtgtgccgtcgtccgtttgatgacccagaaaatgtttttcttcttttgaatgcactcactgatttttactttaccattcacagacagagaaagagaaaagagagacagcataagcaatttaaatttggaaaaaaagtttggcattttgtttatacaattttcataaatttgacgaggcgcggaaaatccaagacatttattcccatttcaaactcgagaatatcttaaggctgcctgcagcactcaccattttgtgttcttgctgttggtcgatgtccaggccctccaactgtcctaccaattcgtccaacacgttcagcatgggcggcccggtgccgccctgatgctgctgctcgtcctcctcctcctcctcttcttcggcacatgaaccggacgggctgacctcctcgtctggggacaccaacgagtcctcgccctccgagtcggattgcagcggctgcggctcgccaaagactgtaagatggacgaaaattgatttcgaatttcatagtgttagagtgttagcccggaataatatagggaaaacaatgagtcaaaaagttaaggaattcaaagtaggagtcgaaagctgagaacagtgaagacagattctcgattaggagctaagtatttcgggaattgacatattatccaatggtgccaagaaatccggggagaaccatgaacggaatgccacactaattttatttgaatttcttgcagtcgcccctcccactgccctttatttttggtttggaatgaggaaataagcattttaagggtggagaacaagccttaattgagttgaaacccgggggggggggggcggggggcgggatagttgcgtcacttcattgcatccaaattgctcgtagtcctaatcccgtatcttattctcaatttcccaattcacgtgatttcaataactttccatgtccatgcttctctaaccctccctcttcccgcttatatctcacatttgacttctcttccgctgccgaccgctggaagtccggcggactccgtgccggactgagcaccgccgttcccgcttttccggttccgccaaatttcaaactcgtccaggaagtggcgcggtttatgctgtgcattgttcagctggaccagcttgttcagcgccgccgactcggattgggagcgaacctgacaatgaaaaaatttggagaaatgttcaaatttgacttttgataaatagtttgcattttattttaagcacattttttcattttaattcttgactaaatgaatccttccttgggttttgagtcccggctcccattctttaatatttttttcccagaaatttcaacgcaaattgtcacgccgctcgagaccaggacatttcggcactcatttttccatgtcaaaattttttcgcattttaaattaggtagacagtttagcaattttttcccagttcctctgccatgccgtacaaaggaattggtgcgcggcgagggcgggacaacggcaccgcaactgcagcagcccattggagacaaagatggcacatcataatgttggtggtgaagatgatggtggtaatagtggtggtaatccatgctttcatccgcagcagcattcgtgttcgtaacatcgtaaatgccgagaaaagggttgccgccggtgtaatcgatggcaccgcctgcgccaatctgatgtgttcggcacggtgccgaaaatgaatggaacagccaatggctgttgatttgattgattttgccagtggatgcgatttgaatggcatcgatggcggaaa

SEQ ID NO: 3048 - DNA, 1199 bp, Heterodera glycines
caatgagtggtcgagagcgcgaaaaaaacaactgcgcgcgaaggtttttgggacgtacacacatacaatgtgtttgttttttgtccatgaaaagagagaagggttttttggaggaaatttgtaaaaaaaaaatttggggatttgtttttctggacagaaatgtttttttagagaaagaggagatcaatcacatgatggtgaagaagaggaatgtttttgtttgcactgagttttaagcgtttaaaactttaaaactgatttggaattatacaccggttttaatccggccatactttgatcatttgagcgtgggattttgaaaaacggaactccgttttaccgggatctcgaggcgtaaatttgtttttgttggctaaaatcaaaaaacaacctcaatagggtagcaaaaccctaacaaaatagccaaaaaccggcataatcgccaaattctcgttatgatcacaaaaatttcaaatcaaaatttttgaaaaattgaagagcccgatgctctttaaaaagatctctctgttcaataaacatttttcttataaaggaaggcatatagttcacacccttttgcacacaattgttattatgatgatgatgaccttctcaatttcattcgtaaagtgatcagcccacccaacaattttctgatctgatggaccaatgttacaaaacgccaaaaaggtataatcaaaacggttggggtggtggacattccaatcgccaaactttttttcttaaaaaaattgagaaatcatcaacttaaaaacataaaaatgacgcaatattagaaaaaaaatttcattgaaatattaataaatcaaatggccttggaacagtgtgtgtgtcttataaagtggcaaaaaacaaatttgtgctgataaaaattgataagaaatatatttaaaataaaacagtaatattatgaaattcgaatataaaattaaatcattttttgaaaacaaaggttgaaaataattttgaaataaaatatttgaaaaaataaaaattaaaaaacctcataaatttatcaaaaaaaattttaaccgaaaaaataaaaaagaactttccaatgaaaatatttaattcattttttttattacattaaaaaaccgattaaaaaatttaagaaaacagaacgacgaagggggtgtgaatggtggagaaggacatttgcactttgtggtttataa

SEQ ID NO: 3049 - DNA, 6358 bp, Heterodera glycines
  misc_feature (133)..(133): n is a, c, g, or t
tttgtggctggaggaggggccggcgttattggttttgtgattggaggagggacggttactggtggctttacagttgtgggaggcgatggtgttgtatcagagggaggagctggcgtttttactattgttggtntagtagggcttatggcaggcggtggtgtcggcacttttggtgtgacgggcgttttcacagtttcttttggtgtttcctcataatggggcggtgactcctcaatcgccccttcttcttcttcttcatgatgaggcggagactcatcaattgtcccttcttcttcttcttcatgatgaggcggagactcgtcaatcccaccttgatcatttccatcgtacaataagggggagtcaagctgttttccgctctcattaatcactggcgatgacgcagctcttttttctcttttcaaagggggtggcgaaccgagaggttttgtccgattgcgattctcttcctcctcacgggggagtggcaacaactttgcaccactatgatttcgcaaagtgacagtcaaaaaatctctgagctgttcaaccttactatgcgatgccctgggcactggaactctgatcacccgctgtctgtcctcatcactagcacggcgatcggtgaagtgaatgtcaatccattggtcgtccaatgtgccaatggttgaccatgagtaggggtaactaatactatgcagcccacagacccatgagccattaaaatgtaaaggcttcgggaggcggacccgaaatttgttgggctgattgtcgggataatccgttacattgctcggcaaaaacacaaagaaactgtttgacattattgtttatcaacaacaaaatgaaaaatgtgatcgcttttatacaagctgagattcatgaatccattcccgattgggatatcctataaattttacaagcatctctgaggacccatctgctctttttctctttctgtacaccttttcaatacggtagcttgtgtctgcatcttttcttacgcgcgccagctcctgctcataaaagctgcccttgaatttctctccatgttcatccctcagtttgtaccgaatagggcgtaccgctttcaatacctcatcaatctccaggatttcgtccccataatttggcaaatatcctttctcaaattgtcccttctctctgctcatgcgcacaaattcgtctttacggaagcgtggcgaccgtttttgtattgcagggtgcccatataatcgcttccacactttttgggcatttgaaaagtcgacatcaatcgggcgcatcccatgaacacgagagggtgaactgttaatcccgtccacaattttctgtaccgcatccacccagttcaacgtctccttttccgcaaaatacctgtacaatcgctgcttcacattccgaatggcccgctcagcaaccgaagctttgacggacgaatggacgggctcgtgcttttcaatttcctgttcctcgaaaaattccttgatcaatctgttcttgaattccgtgcctttgtcggagaaaatgcgatgggggaccatgggcatttgatcgatcagttgcttaaatgcgtccaacatctcctcggctctcttgtttttcagcggtacaacaaacaaacgtttggataggacgtcaaccgcaacgaggaggtagcggtgaccccgattgtgacgcgaaagggcttgaaaatcggccaaatccacctggacatcggtcatgaatcccgctgctacagtttttgcccttggaaagcgtgccctccggggccgcatcagagtgtatgtacggtgaccctccaaataatgctgcacgtcccttttccgtaaatgtttcaacttttttcgcgcctctttccacaacgctgtaacgcctgcgaacgccgccggggaagatggactattgtacagcttgtcaagagtggtgttgatcagctccattttttcggacgaaattccttcttgattttcggtgccgtcctggtggtcgtgctctttgacggcctctttggcggagccgtccatgaatacaaaattgggtcctgcctaagcctctcctcaaaaatggccgctccaggtggtctaatggtggggcggcccgctctccggtcaattatatacctgatggccattcgcaaattgctatgcgccaacggcttaccgtttgctgtgttaattgtattttcccgaacacccatacgatccgcgtaacggttgcatttgatgtacagtcgttccacccgttgagtcatggtcagctgatttgatggaatggcaaacagttcacgttgttgctgttgttcatcactttgtgcagatgttgatggacccggttcgggcgagtactgtactcttacccttctcggttgcctaactcgttttcttatgcgcacctcatcatcaccatttacagggtagtggcgtttggtccccctcctaggcggaggaacatagggcatttcttcgacgacagcagcaggaggaggttgctgctgctgcgtctgtggtggcttttctttactttttggctcttttttcgggatacggtacggcatgggcctctttgtcggttcatgttttggctcgattttgtatgttgcgggagggaagtaaccggcttgtctagatgtggatggtcgagggtcgagcccggacattggctctcgattcgcccgaggcgctggagtagggtggtcggcttgctttggcgtcgaggctttcatttccaccaaattttgttcttttttttctatcttgacggaaggacgtcgtggaggtggaggagggggtggaggaggccttagttcagcttttgttttcaaacgaggtggaagtgggagtcgtggaggtgaagggcgataggtcctatgtcttttaccttgtaaatcggcatcatctgtctcgtccttttttaattttcttctggtagcaatcctgcgctgagcagtgtccatctcctcaatttcgtccgcgttgtcgggcagcgcaggcaaatcgccataatactgtgatggcgctggcagcgcaaacccactctccagcatataatcatattcatcatcactttcaggcaatggcgcagcagctgcttccgcaagaaggtctcgcacaattggccgttgtcgttgtatatcagatcgccttttatgccattgctccaatcgactatctctcctagaaggcgcagcagctctactcggtctgggaggacgttctggatgaggcggaggacttgatggaggataaggagcgggagctggaggaatgggtgggggccgaaaacttctcccagccggcgttggtggtggaggaggagccggaggactaggtccatgtcgaggacgtctcccaggcggaggaggaggtggtggcggggcgcgaggtcggggtgctgtgtctacaacctctccatcttcatcttcgccgcctttccttagcagtacacttattcctttcgtcagctcaactttggctggtctatcttcaagttccctcctcattttcaagtatcgcctaagctgttgattgtaatggacattttttgtactgggatgtgttcgctcgaccctggcacggtctaaatcatgtcgaacagcatccagatttaggtctcccgtgttggacatggaggtgagaccacgataaatttcttgcgggacaagtaaaaatttatttgccatctctgttaaatgaataatggaattcacaaaattcaacaatgatgagaggtatttatgcgtttttgttcacaaaggattttgccacttccattagaacgggtgtcaatagggcagcgaacaatccgccaaatcctgcgcctttctggacaagcactcgcttggcaccccgttcacttctcgctctgctgattcggcgtacagtatccacataaggcattagtcgcttcttctgtctggttgtcaattggaagcgcgaagcgacgagattcaaacaaatttcaaccagcgatagtagttgttcagtgtttgcttttcgtataagtttcctgcatttttttccggatttcgtcttggccaaagcacacaaccagtcgcgattctgttttatcagctctccaatctttacttgttgctgcttatgccgctccatttttgggaatgaatacaactgttccttcgtcttcaccctcctgctcatccttaaatatgttggttcgcagccgtaacgacggatctgatgcagcgtgcatatcaatcagcaaatagccatagggacgggcggtcgctttgcgataagcatcaaggaaaaagtcgagctgacgcggaaagagttggacgccaatgttgcgaatggacaacagggaattaggggcccgcatcaacaccaggtactgagcggacaggcgggccactttgattttacgttcaaacaaattttgagtgacgaacaccaccgcaaattggtggtgatgtgactttttagtgaacaaatcggacaaatatttctcgtcaatggacagcattaggtcatcgagaatgagcaagaggggctttgggaggcgtttgagtaattcttcggatgggactcccgaatacacatcgactcccgccttttgaagcggaggcactgccgaattcatttcaccaaaacaatagagcattgagacgggctttggtgtgattaattgatccgcttcagcaataaattttaacaaaaattcagtttttcccgatgaggagggacccgaaatgattagaccaaacggcaatttaaaacaaatatctttattggtaaaggattgtgtattaagcatttttagggacaaaatgatttacatgtttgaggtcgaagctttaatactatcaaaaaactcgtcgagcgttttgtcaatgtcgccaaggtccttcttgttttcctcttcgtctcttctgggctcttcctggacataattctgttcctccacaggactgtttgtcactttgttgtccaacgattccgctaaaagtaggttcccgagtacactgattgcggttttggccttcttccaacgcacgccgtcctgcatggcatcggccattagcccggcttccactaaatcaagtgctaccttagctttgcgcttcaggtcctgctgctgcatatcggtttgcgttccttgcgttgtggtggtggtggtgggagtaggagtggtgcacgtgtcggagggcaggtcaccgtagggcacgttgaacaccctggccttgtttttcacacggaagaagcagtggccaggtagatcataaacggcatcaaatgggacgaattgggacttgctgacccggctgcaccacaatgtgatcccctctttggtcaccattgtgtccacctcaacctctgttgctttacatgcgcggcaacggccgcattcatcgaacggaatgaaccgtggtgtggacagacgtggcccactcacggttatgccgcttgttgtcactgtaatgtccgcttgcccgaggatttgattcacaagcgctttcttgtcgcaaatattaattgccatttttatttgggagaaaatttttgagaatgaaatggaggacggcagattgaccagctgcttatatacagccagccgtttgtgaagacccgcccattttaagtttcaaattacgcagacggaatttgaaaagatgggcactcttaacagagccccgtgtgagtgcgtcgctgattgggcactcagaactgagtcccgtaccacattcaacactgaaaccaccccccccccccccaccgccccaacaattcaatataattctcacaaattaaaatgaacttttattttaacagtgccaaaaaaagcgcatcaatttaaaaatgaattcgatcacaaaacgatcactttttttgggcgatctgagcacaaattttgtccaaaatttgcttccatttaacaatcttttcaaacggcatgcggcgctcttgtgcaaatgctaacacctcctggcaaacgtcgcgagccgtcaccggtgtgaaccaatttaaaatctggaataataatttttgaaaatgaaaaatgaaaaaacattttttacgttgtcgtcgtcatcctgcaaaatgtcgtaccaggatgacaattcgcaaagctccatgtcgggggtaggtgagcgacggtccgctgagtccatagctaaacgggcggatttttagttgattaattaaaaaatattaaattaaattacgttgttgagacgttagtgaaaatttgcgaaacggaaataataataataatattttatttattaataaatgagtgagtgaatgaatctcgctcgtacaatttccttatttatagtcaaattttgatctacaactaattaaatgtgttacttgaccccctatttgggcatctggcg

SEQ ID NO: 3050 - DNA, 1380 bp, Heterodera glycines
ctcacaagtgcgggaaattttccctcaaaaaactgcccccataggcaccccccttaattactacataattattttttttaaattcacaaaaaagttttctcccccttcaaatgcgcgaaaatttcccgcaaaaactaccccctcgggcatcccttaattacccacgctaattaattacccccccccccccataggcatagactcattcccgcactaatttgtcaccgcggcaacttcaaaagaaaccgcaacccatcaatcacccgctacccgctacccgccagggtaactaactactggcatgcaggttgttcagctgggcctgggcgacatgtttttgtccaggcgagatgccgatcgaatgtcgagcaggtgattgcgcactcctcccattttgaatcaaaagccatcggcaggactgttagttgcttattcgcatttcggtaatcaaagtatacaatacaagaaccattggacgtttcggaaggtatgaaattttcgattgatggttcgaaaagcaaagtgacaaaggagagaaatacgaataacatattttgttcagtaaaatagtcacaaaatctctttctctttaccttatttatacccagtaaaatgcacttttatcacttttaagagaacgaatttataatctccacttggctgagtactttaattaaaaaggcccagacaaaaataattggttaaattcgatgaaagaactcatcattcgtaaacaaattaaaaaaataatcaatcttccattcgccactttaatgaaaatttaaaaaaaaattaatatgataggacgcgtaaaatgtgatgggacgcgtaaaatgtgatgggacgcgtaaaatgtgatgggacgcgtaaagtgttgttgggacgcgtataatgtgatgggacgcgtaaaatgttgttgggacgcgtaaagtgtcatgggacgcgtaaagtgtcatgggacgcgtaaaatgccatgggacgcgtaaaaccgactagaacccttttttttcagttgaccaaattctataaatctaatgtcatttaaaagtactttacgagctctattagctttataaaaaaaaatcataattattgtccaacatgtaaaaccagggctctaaattttttaataaggacaaacgaggttaaactaagattgtgaccccaaaaataagattttttgaaaaaagcgtccttttagagtagaaataattaaatacagggctaccaatttcaaaaccagcatttggacgacaaaatccgcattttggaaattttagccagcgactcgcttttaccaaaaaattttcttggcaagagggggccagcggtgccgataggcgccgccgggaaagttttttttttgttaaaattgagtta

SEQ ID NO: 3051 - DNA, 1580 bp, Heterodera glycines
  misc_feature (1317)..(1318): n is a, c, g, or t
  misc_feature (1393)..(1393): n is a, c, g, or t
acatatttgcttgtttttgtgtcctcgtgccctaataaataatgccaccgcaattccatcgattggattagtcaaatccatcagcaaaaaatgccaatgccatacaaaaaaagaaagaaaattgaataattaatttcaaaaaatgaccccaaatttaatttccctaatgcgtcgagagatgaaatttttttcgttttttaaagctttttatgcgcctccatttaaaattgaaaaaaatataaattattttaaactgatttaattaatgagcataggtgccgcaaatgtcacctccaaacccaaggaaaacaattgggtgatccatcgaatcttatataattgtttaattcaaaggagaaaaacaacaacaaaaaaagacaaaaaatctgtgacggaaaatttggtaaaaaacatcaaaaaagcagtaataaaatatcatttcctccaacacacattcacctgatcagtgcggtaacgttgtgtgtaagtgcactgaaaaagtaattttcataaaaaatgataaaaatggcaattagtgagtgagtgaattaattgcctggtcaagcgatgctctgagtccggcacgatacatttcccagccggcctaaaaaacaaatcattgaaattggatggcgaatgattttttcaaagaaaacccttcaaagatctatccggggataatgcccccccccggggggcatggctgaaattcaatttgttaaatgcaaattttaaaccggtttcagctttaaaaacggcagtgccgagaacaggaaaggccacgcttggtcaaagggaattttgaaaatttgtgaagaaaaatgagaaaatttgtcataaaaccctataaatattcttagtgtattttcaaattctttcacgatcttaaaaaggaagttcttttctattaatttgaacaatattttgaaaaatttaatttatgctaagaaaaaatctctaaaaaaagaaaaaattattgtttttttttaattttggaaggaacgaaaaggggaaggggtcaaattactccccagaggcacaaaaaacaaaaggtcaaattagaagccgtgctttgctgtgtgtcacccctgctgaaaaacacctgcgcaatcattgcgccgttgtcaatgcaaaagcgttcgtcggtggcgaacagtttggcgccccgttcctgcgccattgtgtccatcatttgttgcagtcgctcgttgcagccgaccccgccgacgatgagcacctcggcggtaccgctgtgtgccatcgcacgctcagtgatttcgacgagcatggcaaacactgtctcctgtgggtgtgtgnngatacggtatacgctacagaggggtggatacggtaggacaatgctacagtacaaaggtgcactaattcaccgccnacgcacgcccgaaaattttttgaaaaatttttcaaacaaaaattatcaaaaaaaatcaaataaaatttttccataagaatgaagaaaataaaatttttgaaaaaattttcagcgtattttgcgaattttttgatcattataaaaccttaaatcgctagaaagttttttcaaaaaatataaaaattaa

SEQ ID NO: 3052 - DNA, 2731 bp, Heterodera glycines
  misc_feature (26)..(27): n is a, c, g, or t
ctaaaaaaattccttcaaaaggtcannattcttaggggtgtaatatatcggatttcaaggcaaaatccgattacgattatccgattccgattatggcccaaaatccgattaattgcgattccgattacgattccgattcggcacatccctggtggatacgatatgataatgctacagtacaaaagtgcgctaattcaccccccacgcacgcccgaaaattttttgaaaaaattttcaaataaaaattatcaaaaaatcaaataaaattttccataagaatgaagaaataaaatttttgaaaaaattttcagcgtattttttgatcattataaaacctttaaatcgctagaaagttttttcaaaaatatataaaaattaaacaaatttccggcactcaattttcatgaacgatgcaaagctttgtttaggcttttggagaccaattcacggccgacaacaattttatttttgttacacgcagcgaaattttaaaaattgttcaattttttggaattaaaaaattccttaattttatgttttgatgttccgctagaagttcacctgaagtgagtagcacaggtcggcggctgtgtacgcgccggagcggatgagcgcgggcgccgccttttcaatgtgtgacagaatgccggacagtgacaggtccatgcccttgacagcgtacggcaacgggtagaacttggtgccctgcttggccaactgttcaatgttgtggcccgggcttggctcgttggacaggcaaagcacacgcgcaaagcgatctttcaaaaaatcaaagttttgggtaaataaatttaaatttttttttttaaattagggccgaaaatgctaaattaaggagaaatgtaaaaaaacaaaaattgttgcaaaaaaattacccaaacagttgccgacggcaatgtccaacgtttcgccaaaaatgcaatagcaatggttcaagtaggagatcacctggggcagaaaaaaattcatttgtaaaatataaaaaaatttgatatccgacgaatgatttctattttttcttaaaaaaagttttttgtacgtttctgccctttccgaatttttttttttaaaagaaatttcaataaaaattttacagcgattttttttgtaaataaaatttattaatttttcattaaaaatttcaaaaatcgctgaaaattttatccggattaaaaaatgttttttttaattctatgctaaatagtttctaataaaaacatttcgggggagggtaaaggcggggggggggggagggaaactgctcgcccacctgagtgtttccgccgctgacgtacaaaatcaccggattctcggcaccggtgatcagacggcccatttcaatgtgtccaatgcaatggttgaccggcagaattggctttgcccacagttggccaagcgttcgcgccaccacagcgcccacctaacaaaacgaataaaatattggcaccacagggatacgcgccatcacaaaaaaattgtaaaacaaagttcaaaaaacgccatgccaatatttttacgaaaatccggcacggaccaacccaaaaaacttgggcaaatgccgggcttttagcaacaaagtaaatccagttaaaaacccaattcagtaaaaagaattttccgtattgggtgagggaagaaaatggaatatatttctaaaaattccattttcgggaaggaggatggatttacggctcgtaattacgtataattgtcatgtacaaccccaaaatccacataaaataatgaccaacagaagagagcatcatttgcattggttacctgcagctaaaataaaaaatatttaaattttgattttgtttgctttaccggtgctcccatgcccggtccctttgtgtagacaatcgcgtccaactccaacacgggatccttgacaagaaaaatgggctattattaaacctttcctggctaacaattgtttgtgttagggcccctaaatttggaaacaaaaaattggacctggatttccgagattttggcttggtaacacgaagggggggggagatttttttggggtttttttcccgatttgtgagcatctttgaaaataaatttttgcttcttggtggtttttggggttagttttccgcaggacaaagttaaaaattcagcactcggaaaaaaaatttttcgtaaaaagtttgccttgatttgcgcctcctgcagtgcctcgatgaccaaactgacaatatgctgacggtggtggacagccgtctcggtgggccgaaagccttggcccggcggggcatggaatgtccgtctcgggttggccaacacagtgccgtcccgcacaatgccaacgccaattttgttggcactcccctcaatgcccaaaatgcacaccattctcctcctcctcctcactccactgctcacacagaatcagatgaccaacttctgcttcacaatctgctcaagtttctgcaaaaaatgggaatttgaattgggtaaaaaatttattttttttttaaatttaggattttcacaaaatttaaatttcaactcttacaactttttagggcaacaactgttaacaaatctcattaaaattaaaggtttcccgtgagattcgtttgaatcattcggacgcccaatatttttttgaattttcggggagggaacgctcccaagtttctgaatgtaaataaccacaccaccacccaccttcaatttgtgctccgcctgtttgttg

SEQ ID NO: 3053 - DNA, 2133 bp, Heterodera glycines
gttaaaaattcagcactcggaaaaaaaatttttcgtaaaaagtttgccttgatctgcgcctcctgcagtgcctcgatgaccaaactgacaaatatgctgacggtggtggacagccgtctcggtgggccgaaagccttggcccggcggggcatggaatgtccgtctcgggttggccaacacagtgccgtcccgcacaatgccaacgccaattttgttggcactcccctcaatgcccaaaatgcacaccattctcctcctcctcctcactccactgctcacacagaatcagatgaccaacttctgcttcacaatctgctcaagtttctgcaaaaaatgggaatttgaattgggtaaaaaatttatttttttttaatttaggattttcacaaaaaaatttaaatttcaactcttacaactttttagggcaacaactgttaacaaatctcattaaaatttaaggtttcccgtgagattcgtttgaatcattcggacgcccaatatttttttgaattttcggggagggaacgctcccaaatttctgaatgtaaataaccacaccaccacccaccttcaatttgtgctccgcctgtttgttggacaattccttgtttgctctgaattcgtcacggattcgttggctcaaatagtcagggtcggacagttcaaactcggcacagaagcggcgcaacaaatgtttgtaaatggaaagcacttttgttcgatgtgcaaccacggagcggacagggctcatcaaacaaaccaaatagaaatttgaatgctctaaaaaagagagttatgtttatttatcggacagaaaattttggagatattaactggcacaattactgtagccaacagtaatcaccacttttttacagtaaaatgagggctccaaaaacccagaaacttggggagtaccgtatttactaaattagactcccctccctctgaaataaagacctccttttgatggggtttgaaaaatagagtccccaggggctcgtattcagtaaatacggtacattacaaccatttaattaggtgagaaaccctcatttgaaaagtcggacaaaaaaacttttaaaatattagaagtatatatgtaccattattgcacgggcgaacaaaatggcaatgaatgaatatcattttcttgttgataatatatttcttcttgactagagcatacattatttcatgcattttgtgaacggaatgataaggaaagctcggcatcaataaaatataatcgtggtcaattgcatccgtccgcctctctctccatgttctcacattgtttcgcccattttcacaatttgttgcgccaacaacgggatgttgttcaatggcattgccgtcgtcgccaactttggcactgtttttgttgcgttggcaccggcgatgccgccgtcatcatcaccgtttttgttgttgttgtttgtgtctgatggtccagctgatgcagtttgtgcagcaactgccaacagtgtacggcatcgttcccaacaggccaaactggcgtacaccatcagtgccagactctgtgttaaatgttcaaaatgttggcaatttttttggcgtaattatcggctcgcaaatagtacaccaatttgaatttttagatggacaaaatcgaactgtcgaaacttaaattttttgttcctcgaaattaatgggttctcctcactcatatttgtgtgctcaaaaactaacggaaattttgtttcgatttattattaatttttcgatttcaattggaattttattttccaacaggccaaactggcgtacactttgtgttggatgttccatgataaatatgattgatcattcacctggcgtccaattgcctcggtggccaaatggttggcgtagcgcataaaaatttccacaaaatcacactggggactcatctgtacaaaagtttccaaaattattacaaaagcctgctccacctcctccaccaatggcatacctttgcataggccaaactgtcgtgccaaagtcccctgagagatcaaatatttgcacgcgtcgaatgcctggtcaatcagcgaaaggagtttgatgccttctacaggtaaaagtggggctgttaaatatttcgagtcaagtttctgggtaaggcaaaaa

SEQ ID NO: 3054 - DNA, 1153 bp, Heterodera glycines
tacattacaaccatttaattagatgagaaaccctcatttgaaaagtcggacaaaaaaacttttaaaatattagaagtatatatgtaccattattgcacgggcgaacaaaatggcaatgaatgaatatcattttcttgttgataatatatttcttcttgactagagcatacattactatagtttcatgcattttgtgaacggaatgataaggaaagctcggcatcaataataaaaatataatcgtggtcaattgcatccgtccgcctctctctccatgttctcacattgtttcgcccattttcacaatttgttgcgccaacaacggaatgttgttcaatggcattgccgtcgtcgccaactttggcactgtttttgttgcgttggcaccggcggtgccgtcatcatcaccatttttgttgttgtttgtgtctgatggtccagctgatgcagtttgtgcagcaactgccaacagtgcacggcatcgctcccaacaggccaaactggcgtacaccatcagtgccagactctgtgttaaatgttcaaaatgttggcaatttttttggcgtaattatcggctcgcaaatagcacaccaatttaaatttttagatggacaaaatcgaactgttgagacattaatttttcttccttaatgtagaattctcctcactttgtgtgttcaaaaactaatgaaaattttttgcgttttttaaatttacgttttcaattaggatttttttttgctcttcccagagtacaggaccaccaaaaatttccccagataaacattagagttccatgataaatatgattgatcattcacctggcgtccaattgcctcggtggccaaatggttggcgtagcgcataaaaatttccacaaaatcacactggggactcatctgtacaaaagtttccaaaattattacaaaagcctgctccacctcctccaccaatggcatacctttgcataggccaaactgtcgtgccaaagtccctgagagatcaaatatttgcacgcgtcgaatgcctggtcaatcagcgaaaggagttgaatgccttctacaggtaaaagtggggctgttaagtattttcgagtcgagtttctggttaaggcaaaaaatagcatttttagcattcatttcgacaaaaataa

SEQ ID NO: 3055 - DNA, 3448 bp, Heterodera glycines
  misc_feature (222)..(222): n is a, c, g, or t
ttaattttaaaattttttgtttttcccgaaacttttcccatgaatcgtcagagttgtcttttagcaagataaaatcaaataatacggaccagaaacaaaaattggatgcgatcagattggttgcagtcagcttgacaaggcagcgcgactcttccgtggcaaacgacgcgggacagagtgcaggcgcggaacgcgttcagccgcgcgtcaccgccacgcgcnggcggttgcggcgccaccgccgaacgccaattggtcattgttgagcaggtaataaagtgccaagtcattctgaacaagtcgtgtttaatttctgaagatatttcggggaataaaatgatggaaaaggcccaatgaaatgagggaaaagtgagtaccgaagcaaaaaaatttttattttcgaaattccggtctaaaaacgtaaaattgccattgaaaatgtgacctttcgcataatcacgcatttctcaatggccatttccaattgccgttctgtgcgaaatgtggacagcagcaagcgggtgaagcgttcaacgcgtttctgtaaaaatgaataaaaatgatctttcaaaatgatgccaaagatttccatggctacgccaatccgtctcacaatcaacaaaaagaatttcagtacaaatggcaggtgatcaaaagttggacaccacactttcaaaaaacaacccgtttaagtgtacttactacacacaaaggttggcacgaattccaatttctgtaaattttcggggcctcgaatgccacaaacttggtacgcttttttgggccaaaaaagcatcaaattcggtggcaacattggctgacgcaattgtggcggtggcggtcgatttgctgcgtcatctccagcggtagaaattgtcgtcgtcgccgcacattggacaatccggccaaggtcagccaaacattgttggccgacaaattggtggaggacaatggcacggtctaacggtgttcggcagcattttgcggacaaacggttgatcaaatggtcaatgtcggggtcgtcaaatgtgtgcaattggtggccatcatggtcaataccaaatgggacagcattttcttggttggacttggtggttgtgtcgtcgttgttgttctgttccgccaccgccgccggtggtgtgtcagttgacaacaacgacagcaatgcttgacagtacgacgggcgcaacaacaggggaatgtctgacaacaaaaaaaaatatttaaaaaaatttgatgtcacaaaatcgggaccggatttgatgagtggcggcgatgtgttcaggttggtgttgttggtgcgacttttctcatccgtgtccgaaaatgcaaaacgaaacatcccatcagaggctatgtacactaaatgtttttattttttatatttaaatttgagagtgagtgggagagagaaaaaagggccgaagagggagagagttgacagacagtcagagaaaaccaattaaaaaacaaatagaaaaaactatagtataattgagtacccggattcagtccgcacatgtcaatgtcgatgatgctgtggcccggtttttgcagtgaaaacagcgactgcaaccgttcagtgtcccacactacaacagaggttggatgctgggcctaaatttagtaaattttttttttgaattttcgaaaatcatttaatgctagctagaaggaaaatttaattcatgggaatcgaggtgaaaattagcaagattttgttagcaaaacagcaacaatcgcaaaaaaattggctattttttgagattttttgtagtaattcttccatttcccccgtggtacgtacgggactgaacttaccgcaagtgtgtagtcacccgtaagccgtgagaacaccacccgttggactgggccccgtgtggactgactaaggcccgtctgacgacattgactcctcaaaaaattaaaaatccgaattcaaacattgtacaaatacctggccaagtcccaaactccaactcggccggcactgtccccaaatgccaacacgtcgtccttccacaccatacagcgaagcaatgcggcgccggatttccactttaatacaacaaattataaacagatattgttgctctttatcaatattgccatgaaaaagtatcaaactggcaaaaaaaaaatttttttttttttgagggtgtattttcttatttcccatgattttttatataatgtatctctaagtaaaccacctgtgtgctcacttccttcccatctcgcacatgtaaacccttgacaacaacatggtaactaaattttttataaaccattaaaaatggaataaaatttcttacgctaggcttgaaaattaaaaaaaaaatccaacttgcaattttttcatttctaatgaataatatgtaaagagaaatatgtaaattgtgtacagcaaattgttgttgtccaacacgaccaagttttccctatggatttgcgtcttctcgttgaccagcttgacctggtggtgcttggtggaccaggccatgtccacaatcactggacactttttggacatccgacggagcagccgaaaagtgttcaaatcccaaatttccaacggatcactgcgaaacgaaatggccaagtaacagctgaaaaagtgcaatttaatgaatatgttaaaaaattagacgattttgagccaattttttccaagagaaataaggatttttagtgaccgcaagtgaaaagtttcgaaatttaatgaattttgttagaaaaggttgttcaagtttaaaattgttcctctttttccgcttcattggatcgggaccgggaccatggaaaatgggactgataaagctcctggaaattccactccaatatcaaatcccggttccgtctgtttcaaaatttccctgtctctgatttttatttatttatttttaatttataagattttgccatattgctgctttcatttgtccaccccaaaaacggacccgtaatgactgacacggagcagttcaacagggccctcctcctgttcgggccgtactcgtcgtttggttcccgttcgaatgtcagtgatgaaaatgtcgttgcggacggtggaggacgaggcactcaacgaggacaaataggcagccgaaatgaacgcgtttggaccacaccattcaaggcatttgaccgggcacgagtgcaccttttggggtttatgacttatttggacgaattttccattattaaaaactggggacgaaaatttttaagaaaaatggaaaaaaatttttgaaaaatttttcgagcatttttttcaaaaaaccacctgcaagtcgcgctcaattcgtcccgaaaatacgtccaccaaatggatacagccggtgctggtgccaaccgcggccaaatgtggtgccaaagtgccgtcaaaaattgttgtcggcatcgctggtggtggtgccgatattgtgcaaattccactgtcctggtc

SEQ ID NO: 3056 - DNA, 2391 bp, Heterodera glycines
caagggtactcgtcgcccgtgccacaaaatcatggatacctcagttgctgatgcctgtccatttcactgtcaagtgactcagcatcagtgtcatcgtcgtccgtttgttggagaatgtcatcaattgttctgatccgatagggctccaagcaatgcgaaactgtctcctaaatggaggagttaaatttggttttttaatggaaagaaattttcggtgttgctttttatagatgtggaaatacttattgttagttgtaagtactaaaggcccccaccccccgccccaaaattttttgttttttttttggcaatttttaggaaaagttggttagtgactcaactcaaaaattttttaaaaatcgctagaaaattttttcttttattttttttataaagaaaatttcgttttttgtgctttttagaaatttttcggagggaacgaactgctcccaagtactagaccccctccccccccccccattttttttgtcacggctcaccaactgcagcacaacaattcggccggtgttcaacagcagtgcaacggttgactgtgtgaccgggcacagcgcggcgcccatcagacggacgcgcgccgattggcgttgcgtcgattcggcaacgcaacggcggacaaaggccaacgaggcgctcatccgttcgtcggccaagcggaaatgggcagtgcgaaaggagcacagcgtattctgatggaccaggaacatggcgtcacgacgagcacagggcaacacctgcaattgaaaaaggaaatttgaatagggtaatggatttttttaaattttgaaataaagtgcctcattaaatcagcgaagcaaaaggtcggaaacgggacaactgggcgacggcacggttttttgggtattcgaatcgaatgaaagtgatatgaaatttttaacgagaaaatttctgtcccattttgaaggcgaatcaccatataattaagcacctggaacagcggtgagccggcgtcaatcacagcgctgtaaacaagttggaaatgttgcgtttggaccaagcaaatttcgttggggaacaacacaatgaggtgatgttcagctgccggactgtgcaccatttgcacaatgtgtgtctccgttttgctgtaaatgcaacggttttaatgtgatttgttgtattgtttggttgaagaagacggattttctggtataatccgtggcaaatccctaatccctcatacaccgaacgttcaatgggtgcgccaaatgaggcctaacctgtgttgcaactgctgttgttggtgaccacaaattgcattcagcgtctttggctccagttggagagtggtgttcaatctggtgataaatattaaaaaacacgataaaaaagtgcccatcaaaagatgcaccgttgggaaaaattattaaaaaaaagtatttttttttttagaaaatgcaatagcgataaaatttgtatttacaaccattgcttttttgtttgcccacttttactattctttttggtcatgaaatttacgaattacccatttttataacctctgattgttggtgttggacattgctgatgatgaagatggtgatggttcggctgcagaagaaagtgcagaaaatggtgaaaagccatggacgagcaaaacggaggcgcattgggaggacacttaaaaaaagtcatgcaaatttaaatttttagaaaatccatccacagttttatttaagagatacatgcgcaacaggaatgtctcgaaaatgcagattccgagatatttagggctcggattttgtatttcgagattttttagccgtcagaatttcgatttccaaaaatattccagtcgtcggaatgccgttttctgatattttttcagggcgtcggcacatatctcttatgcacaaaatgaagttttgaattttacatgtaaaatccagaaattttcttacgggcaatcctggaatggtcgaacgggtcgatgctcaatttgaagacggacgtgccaaaacggtgctcccaaaggcgttcctttttgcccacatcccacacaatgagcgcattgttggaatggagtgaggcgagaaaatctctgctcatatcaggcaaactcagccattgcaaatctgaaaaaatttgcaaaaaatgattttttgaaagtgctaatctttgcttttaggcatcagaaatccgctgcatggttttttcattagtgtgcctttgttgacatattttggaatgggtttaactggagaccgggccaagtctcgaaaactgacccggcgatttttggaaaaatcctgtttttgagaggtttttgaaaatgtgtttgaaaatttcggtttctaattttaacccctttcgccccagccttacgaaaattgtcagtgtctaataaataccctg

SEQ ID NO: 3057 - DNA, 8074 bp, Heterodera glycines
ttcctccattatcgattttccatcgccattatttcgccccctataaattcacatttttttttttgctattttatcatttaaaccgcatttcatctctctctcctcttattagatcaaaaacaaaaaaatggaaaaccgtcctccaaaacgcccattcccattcactattaatgatattctcaccaccccgccaccacccaaaacattacagcaaggcttcctcatcaatcagctgcttggtctcaccgttcaggagggtgaaggggccgagagctcatccaacaaaaaactacccagcgaatttgttgaaaagctggagtgcagcgttgaacatgttgccaaatttaactacacgaaagtcaaatcgagcttcgtcatccgggatgtgccagccgatcccgaaagtcttctttcctccatattcaagcactgcattgacgaagcaaaaagcgacagccgtgagaagagcagcgaaccaacacaccttggatgcctgatcagcagtgcattattggatggcggtgatgtttttgtacccgtgcgccaaataactgccaacacaatcgacgccattctgaatctgttcaccaaagttgcgcagtcaaaacaacagaaaggtgttaccctatggggagagccgttcaccattaccataacaacaattgatcgcagcggacttccggtgaaacggcacatcaaagggggcgccagacgtcgtttgacacacgttcagcaccaagtgcatgagaagtgcttgatcaaggtgaagcgtacaacttatttattatatcatcgactgacaatttaagatcaataaccaaaactgggacaacagtgacaacaattattgccttttctatgctctacaggcaacaatggtatcaaagacacgcggatggccgagctggaaattttttcgctacataaacgatcaatttggacaacgcggattgttacaccaagaaactgttcaactgatgcggcaaatcaaagtgccactggatttggacgcatacgatgccgacacttatgtgccgctggtcatcaaccactggaataacgcgcaacagcggcatcgctttgccgttttcatctttggaacaaccggccactacaagccgctttacaaatacggcaacgacgattacgatacaccattggttctatattttaacaacactcatttcgacgatgtacatttcctcagcggactttttggtggaaaaaagtattgcctggagtgcgagaagccttataagaagccgtcggaacacaaccagacctgcaaagcgcactgtctgatgtgctcgcgtgttggacctgcgtttccgtgtccctcggagcctgacttcttccgaaaatgcaaagaatgccacaaaaacttcaacaacgcgggatgctacaatcaccatcttcaatccaactactgtaaacgttcaaagaagtgcaaagactgtggtgtaatttggaatgttgccgacaacaacagacgggggcgaaagggacatgtgtgcggtgaaaaattctgtcaactctgcaacaacttccacagcacagagcgcggctgcttcattgcaccacttgagcccaaggatgagatggaagcttatcgattcgtggcgtttgacctcgagacgatgcaacacctgcctgctgaccctcatctgcctgaacgacgcaaccacgagcccaacttcatagcagcaaaggtgtcttgtcccatgtgcattgaaaatggcaggtggaagcaaggaactgccggatgttggatatgcggcccacaccgaaccgttgctttctgccaacgaccatttaccgacactccggttgacaagcaagtggtcaccgacaaccccatgcaagcatttgttggttggctgatcaacgacttgccgatcaaggccaacaccttcgcctactcacattttggtggccgtttcgacatggtcatcacattccgggagctgttccgtcgcggatataacccggagatgatcagacgggtgagtatgtttttacatatattttattctgataaacaaattaagggcaataaaatgtatgaaatgaagctgagggcgcagaagaaccgacaccccaacatcgtcttccgagattcgttcaatttgatgccctgtgcgctaggtcagctggtccccgcctacggcttggacgtcgaagagaagccattcttcccgcatatggtcaaccgtccggacaactatggccgcgaaatttttccgacccccgacgactacctcgcccatggaatgatgccagaaaagagacgacagtttgacaactggtacgaacaacatcggagtgaaccattttttctggacgaggcattggccagctactgcaccaatgacgtggagatcttaatggcagcgctggtggcatttcggcgggagttcttggaaatcacaagacgtcaagaacctgtggacggccgtgaaacgcacaacggaattgatgttctgaagcagtgcatgacaatcgccagcgcctgcatgaagcacttcaggacaaatcatcttcctgctggtcatttggccatcgtaccggaaagaggctacgacaacgcccaaaaccagtccctgttggcccttcgcttcttcaaatggtatgcagagaagcacggagtgcagctgcagactgcccactcggcaggcggagagaagagagtcgccaactactctctcgacgcttggatcgaagcggagaagagggccattgaagtgaacggtaatttttacaaaaaaaatttttttttttaatgacagcaaaatttgtgtaggctgtgtgtggcacggatgcagcaaatgcttcccggaggacaacatgcttctgcccaatgggaaatcggctggagaagtgcgggagcgagacgcgaaacgactggaatttttgcgaaaccaagtgggcgttgtggacgtctactgggaatgcgagatcgagcgaatgctggcgtcagacccggagatgcgccaggcctttgcaggctacgtggatgacggaccactggagatccgtgctgcattcatgggcgggcgcactggcccgctcaaactcttccacaaagcgcgggaaggcgaaaaaatctcgtattacgacttcacgtcgctctatccattcatcaagtcatttttgatcagttgaactaaatttgttattacatgacattattagttttaccacgcgctacccaattggtcacccaaaggtgcacgttctgaatgaggaagtggaatggaagtgcgcaacggacaacccctacgatttgtcgctgctcaaagtttgggtcatcccgccgcgtcaatgtgatgtgcccgtcttgccggtcaaagtggatgacaggctgtgttttccgttgtgctacaaatgcgctaaaaaatacccgactggcggtgttgacaacaactaccattgtcggcattccgatgaacaacgcggttgggtcagcacctgcacctcgcttgagctgaacgccgcactggacgaaggctaccgggtcaccaaagtgttccgggtgttacaatatgagcagagcgacgaccaactcttccgttcctatatctccgagttcatggcgttgaaaatccaggcgagcggcttcgactccagcatcaaagggaataccgaaatggagcaagagtttgtccgcgagtgctacgaaaattttggaatcaccatcgacccagccaagatggagccgaacaagggcaaacgctcaattgctaaattgtgccttaacaatttatgtaagattttttttcatttaattcatcaaatcaaatttgaagggggacgattttcgctgcgcaacttcggtctgtcgcagactctggtgaccgacgaccccgctgtcttggctgaatacttggacaaccgctcgctcgaggtcacggcgatcgatgagcttgatgctgagcacattttgatcagctatgagacgaaaaaggagtgggtggaggaaaactcatgctccaacataggtggaaattttttgtttcaattgaactaataataaaaatacctcaagttatctccctgtggaccacttctgcggcgcgtctcctgttgttgaaatcaatgcagaaggtggtgagaactccttcctgccaactcctatacaccggtaaaaatcatatattctatgtacataaatacaattgttcagacaccgacagcattattttgacccatccggatgacaattgcccactaaagaccggcccacaccttgggcaattcacggacgaataccctaagcatgagattttggagttttgctcgggaggtgccaagcaggttaaaaattttcacttttaactattaattctaaaatgaattttagtatggactcaaattgcgcagaaaggacgcaccacccgacgctgagaacgaatatgtgctgaaagtgcgcggcatgacgctcaactatgacgtcatccaaaaccaagggctgcgctacgagacattcaaggaaaaggtgctacgatttgctgaaactggtgagccccaaccgatcaatgtgatataccccaattttcttcgaccaagcataaaagatgggagagtcatatcctgcccccaccaaaaaatatataatccctttgtcggcaaaggtattgtcggagccgactataaaattttagattttggtcacactttgtaatcatttttgcatattctttgtatttttcattttattgcttgcattattaacgaatggaaaataaaatatgaaaataattaagcaatggaagatgtaacttttaggtagaaaaaatgcataattaacgatttgaaaataaagttttgaaaaaattaaggattagaagatacaagtttttaagccaaaacataattaagcgttgggagtatttgtttttaggcgaaaaaatgcatagttaagaaaaggaagatataattaacaaaaaatatgaattttgtggtaaatttgggtgtagtgctgtgtgtatgtgttcaccagtacgtgtgtgctgatgatgatgatggttggctgcactcaccacgcccagtgttggtaatttcgtcaatgctttcataccatttgcagcctttaccgttaaattgtaaataggaagagttggaagaatgtgaagcttcacttttggtgtcctcctcctcctgctcctcaattcaaccgtccggacaactatggccgcgaaatttttccgacccccgacgactacctcgcccatggaatgatgccagaaaagagacgacagtttaacaactggtacgaacaacatcggagtgaaccattttttctggacgaggcattggccagctactgcaccaatgacgtggagatcttaatggcagcgctggtggcatttcggcgggagttcttgcaaatcacaagacgtcaagaacctgtggacggccgtgaaacgcacaacggaattgatgttctgaagcagtgcatgacaatcgccagcgcctgcatgaagcacttcaggacaaatcatcttcctgctgatcatttggccatcgtaccggaaagaggctacgacaacgcccaaaaccagtccctgttggcccttcgcttcttcaaatggtatgcagagaagcacggagtgcagctgcagactgcccactcggcaggcggagagaagagagtcgccaactactctctcgacgcttggatcgaagcggagaagagggccattgaagtgaacggtaatttttacaaaaaaaaaaaattttttttaatgacagcaaaatttgtgtaggctgtgtgtggcacggatgcagcaaatgcttcccggaggacaacatgcttctgcccaatgggaaatcggctggagaagtgcgggagcgagacgcgaaacgactggaatttttgcgaaaccaagtgggcgttgtggacgtctactgggaatgcgagatcgagcgaatgctggcgtcagacccggagatgcgccaggcctttgcaggctacgtggatgacggaccacaggagatccgtgccgcattcatgggcgggcgcactggcccgctcaaactcttccacaaagcgcgggaaggcgaaaaaatctcgtattacgacttcacgtcgctctatccattcatcaagtcatttttgatcagttgaactaaatttgttattacatgacattattttagttttaccacgcgctacccaattggtcacccaaaggtgcacgttctgaatgaggaagtggaatggaagtgcgcaacggacaacccctacgatttgtcgctgctcaaagtttgggtcatcccgccgcgtcaatgtgatgtgcccgtcttgccggtcaaagtggatgacaggctgtgttttccgctgtgctacaaatgcgccaaaaaatacccgactggcggtgttgacaacgactaccattgtcggcattccgatgaacaacgcggttgggtcagcacctgcacctcgcttgagctgaacgccgcactggacgaaggctaccgtgtcaccaaagtgttccgggtgttacaatatgagcagagcgacgaccaactcttccgttcctatatctccgagttcatggcgttgaaaatccaggcgagcggcttcgactccagcatcaaagggaataccgaaatggagcaagagtttgtccgcgagtgctacgaaaattttggaatcaccatcgacccagccaagatggagccgaacaggggcaaacgctcaattgctaaattgtgccttaacaatttatgtaagaattttttttttcatttaattcatcaaatcaaatttgaaggggggcgattttcgctgcgcaacttcggtctgtcgcagactctggtgaccgacgaccccgctgtcctggctgaatacttggacaaccgctcgctcgaggtcacggcaatcgatgagcttgatgctgagcacattttgatcagctatgagacgaaaaaggagtgggtggaggaaaactcatgctccaacataggtggaaattttttgtttcaattgaactaataataaaaatacctcaagttatctccctgtggaccacttctgcggcgcgtctcctgttgttgaaatcaatgcagaaggtggtgagaactccttcctgccaactcctatacaccggtaaaaatcatatattctatgtacataaatacaattgttcagacaccgacagcattattttgacccatccggatgacaattgcccactgaagaccggcccacaccttgggcaattcacggacgaataccctaagcatgagattttggagttttgctcgggaggtgccaagcaggttaaaaattttcacttttaactattaattctaaaatgaattttagtatggactcaaattgcgcagaaaggacgcaccacccgacgctgagaacgaatatgtgctgaaagtgcgcggcatgacgctcaactatgacgtcatccaaaaccaagggctgcgctacgagacattcaaggaaaaggtgctacgatttgctgaaactggtgagccccaaccgatcaatgtgatataccccaattttcttcgaccaagcataaaagatgggagagtcatatcctgtccactccaaaaaatatataaaccatttgtcggcaaaggtattgtcggagccgactataaaattttagattttggtcacactttgtaatcatttttgcatattctttgtatttttcattttattgcttgcattattaacgaatggaaaataaaatatgaaaataattaagcattggaagatgtaacttttaggtagaaaaaatgcataattaacgatttgaaaataaagttttgaaaaaattaaggattagaagatacaagtttttaagccaaaacataattaagcgttgggagtatttgtttttaggcgaaaaaatgcatagttaagaaaaggaagatataattaacaaaaaatatgaattttgtggtaaatttgggtgtatgtgctgtgtgtatgtgttcacccagtacgtgtgtgctgatgatgatgatggttggctgcactcaccacgcccagtgttggtaatttcgtcaatgctttcataccatttgcagcctttaccgttaaatt

SEQ ID NO: 3058 - DNA, 2280 bp, Heterodera glycines
attaatacaaaacagatccatgttgcccaagttttcatgcatttaccaagatgggtcaaatccctcccccgtttttcggcatttaaccccccccccccctccctcccttcgtcccatgactgacttggcatccgatgccgccttgtggtccgtgaagtcaacaaagcagaagccccggttcttgcggccatcatttgagtccgggttcgagtaaataatgcaatccacaacattttctgcaggttgaggggggaggggcatttgttggaatgaatgatgaatgacacaatgtgagtaataccatggaaaatatgacaattttcatgggcaatttctaattttttccatgtttttcactcttttttaaattttctttttttttgtacgttcgttactcgtctcgtccacccctcacctgcatgttttctcaactcttcgagaatttcgtctttcgatttcgatttggggatatttccgagaaaaaggcgtgtgtttgcaaccgaaacgttcactttaagtggttttccaggcagaatttcgtgtccgtcaaactaaaaaatgtgtgagtgtgtttgttggtggcacaaatttgtctgaaaaattttcttagaaaaaaattttttgttgaaaaatgaaaacagaaaagagagccatcagattttatgatgcgcatctctccacaaatgaaaatgaattgtgtttattgtgttcattccatcaaaatgagggatggaattggggttggggaatttggggggtgtactcgtcgaagatgttggaaatgtgtgaaacgggagcgacgggacgtggggaaatgacatgcaagccgtacaacatcacaacaaaaaaactcactggcaatggggtacacatcacttcaatgtaccgtatacacaaaaccgtaaaaataatgcgccgaaaaatataagcgaaaaatgtcaacagaaaataaaaatgccaaaaatgcatcaagaagagaataattaagacaagatttgcaattgtttgtacccaaacgctgccaccaaaaaaacacttttgtaaaattatgtcatggcattacttgtgccagttttggttatatcatgctatgtcattatttgtgccaagttttacaaaattgggaactatgtacaatcttactgtttttccaatacgttttttggtggcaacaaattgagtacactgttggttggtgtaactacgaagaaaacatacctttttggctgcctcttgcgcatgcgttttgtccgtatagatcagaaaaccgtaaccacggctcttcccattcaccggatccatcattatacctgaacaaaccggggaagtaggtttcatatcagaaatggaaaaaattgaagggggggggggaatttcggtattgaggctgaggcacgagagaacgagggccctcatttcaaaaagattttttgcaaatttccatgaaaaatgcaaacgaatagggtaggacatggaatttttgcaagaataattcaaaaaaaaaaaaatggttacgaagatcatggatgacaccgagtggttcaaacagtgggacaagcatgtcctcatacacatcctttggaatttggccaatgtatatctgtaaaaaaaggggggaggaaatgtgttgtaattagtgctcattaaaacagtagttggcccaaagtgtagcaaaattttggtaaatattgtcttacaaatgtgtcaaccaatttttcccctctttgtataaatgtacaataattgtttgcttgacttacacatccgccgtccgtttggttcgggtccggcccctcgtagccgggcggtgagtggtatttgcgctggccaacagtcacttccaattggtagccggatttggctaaaaagcgccaaatatggtgttatttatgcactatacaaccaaaaaaaagggatgaaacaaactcaatgttttacaatacgatcaaaaacccattgtttgttcgttttttgcgtcccctgtaccatgaaacagtcccagggaaaatgtattacaccatatatctttgtgtggtgcggtgagagggttcatttcgtatcacactcaccatcggccaagttcgaaaagcacaactttttgttgagcaaatctaacagatttggtatcttttaaaaccgtggatgatgcggtcgcttgaaaaccgtaaaaagacacaattttgtaatacatttttttttgttttgttttcactgtgactattctttatacttacaattaaacgaaccccaggaccgggtacacccaagccaaactttgag

SEQ ID NO: 3059 - DNA, 5853 bp, Heterodera glycines
cgaatagagtaatgccataacatgtcagaaaggccaatcgctcgaacaacatttactattgtactgactaacttggtgctctttgttgggtaatgtaaaatccggttttggttaacccacgttaatcatgacaatgtgtaggagagcctggacggttcgggatcccttccgtgatttgccgggatcccgacaaaaaaaaatcgggatttcaatccgaatactcatatgccggatgccggcctgatgacaatctcggcttctttttcaaaataacagcctctggtgccaacccaggtaaaccaaaaaaaaaagtgcacaaaaagcaaaaccttgagctctttgaggatgaaattggcctgctcaaaggggaatgtggccagcatttccacggcacgctcatcaaactcgtccgtgttcaggccgagctcgtcgaacatgcgcatcagtatgacggccaccggcttggacaaactcttgcccatgaacattttgaatgtgtcagtgtcatcataggtggtgtcgctttccaactcctaaaaagttcaattgtttttaagttgacgatactaaacatttgtcttaagccgggctttcacaaaagagacaatttttgggtcattttgcatcatatttttgatacaaattgtggcgcacgtgcatttaatattgccttagagtcagaaaaaaaacgtttccttttggagtggtatcgtattgtttacagggcttggcttttgctctgtttctgtcggtgctgtgccgtcttggccggcctctgcccctccgccgtcctcatcgttcttcaccaaatcgttcggttgtttctgttcttgatgttgttgttgttgctgctgctgcacctcttcagaaacatcgtgcttgaagtcaccattttgtggcaccattttcatgtccaaatcggatggtgatgccatgattaggaaacttttgcaattttctattttgctaaaaacaaattgaatgaataaaacaaagaaatccgacaaatttttaggtaattgtacaaagaaaatgtcgagaaatgcattgaaaataaagaattaaatttaaagattttattttaaaaagtaatggccgacgaaggaatgggacaatagaagaaagggaacgaaagaagtgagcagacaaacgcgaaaatcaattgaaatgtatggcagtggaaaagaaagacaagagaaggagaaagaggaaaataggtaacctaatggaaaaggaagggaaaaaaaggaaaaagaaagaatgaagaaaatagagaaaaattgcgtctgagaagaagtgagtgagacaaatagagagtgagaaacagagtaagtgagagtcataacgaaaagagaaaaatagaggaaagagaaaaaacaaagagatacctagacgagaaagaaccgcgagagagaaaaggaaaaaatggatgctagagaaaacaaaaagacaaagagaaagtgaagaaaggagcaaaatggagaagaaaaaaatgaggacaagtttaggttaatcgttaattaaggagcaaatttgcgcttttccaaagtcaaacaacaaaatcttacgaatttggtagctgtacatatttggaaacaattttcaaagggtcaagcaaatgatcgtgggaatgaaatttggaaatatgaacattgaaggcattggcaccatttcaaatgtatcattttagaaattttcagacaaataaaaaatgctttttcggtgggtggacccctccccgattctccaatattgtcacggatttttcgaccctgaaaagccttaaaatgtggtttctcttggaggaaaaagctttgtttcaccaggaaattcattgatggacccctaattctccagtattgctttggattcgggttttacaaccttgaaattgcttttcccggggagaaattgaagaggcaaatcaaaaaaaacaaacatgaattatgggattattgccatttatttacaagacgactaatatgaacatacaatgcaatacaaatacaatacatattgtacagagcatacacacacaataatatcaattggatttcgagttcatccgcttgtagacacacaataatatcatccgttattctcttcgtcgctcagcaccgaaggattcgcattggcattgttgtcgcgctcggctttcgagttcatccgcttgtagtacagaaggaatgcgtgcttgctctaaaaaggggaaaacaaattattatttttttcatttgaatggtcgggaacgaaattctcacaacgggcgaaggagcggtgccgcacggaatgcatgcttcgtcgtcgaaactcagccactcccgatcagtgctgatcaaattgatcacggacgatgtgtaatggccactgttcagccgaccgctgtgatcctgaagggggaatggtgaaacatagttagtgtgattagtgacaattttaaccaaatttgatcactcaccgttatgccgtagagactgagtgctgtgttgtgatgcggagacttctcgtggagaaagggcgccaggtccaactcggccacatcaaacgttacttcgacctgaaaattgtttaaaaaatcagtgaaaattacgctcaaaaaaaaccccgacggaaacttacgttatttttgacgtagtgtccatcattcagcgaaaatctcttcaaatggacgatcagcaccttcgggatctcccaaatttttgtgctccgtgtcgccggctgtttgcttttgcacttcggacaatcccatttatcctcgagactctgaaaaagggaggggaaatgggatcagacacaaattcaggctgaggtgctgctcactgctgatgaaaagtgcgcctccaggcagtccttgagcgtcaggtcgtcggtgttggtcggcaattcgaggctgaaaaattcaaagggaaattcaaattagggattttttttgggtctgtgaaaaactcaccttagttggttgacgacctcgaagcgaacactcgtcgtattgcacgtgctgcattggaccatggagatgtttgtcagctgaacaaaagggaaaatgattagaaattggcggcggacaaacaaaatgaatatggctccaaactcacgttgaacagatcgttgaccggcgacgaagagaacagtttcgacctctcattgaaatccgaagcgctggcgcccaaatcggtgtcgtcgtagttctgttcaaacgattgtcgcttgttgacctgaaaatggggaggggggagggtgaaaaatggaacataaaatggcaaaactcacccggttggtgtcctcgtgaagcgcgtccagcagatagagttgaaattcttgggcgtcgtgctgccgtcggtcggccatttcggtgttgacacggcgagcgaagaattcctggggaaaaaaaggaaacatttgattagaatggattgttcaaaggcacagagtcactcaccaggaaggtggtgggccgaagtgcgttgaacttgccagaccagatcaggtcgatgagcgcagagaatgagccggagatcatcccattcgtgccaaacgagttgttcctgaaaagggaaacaaaaaatgaattttatgaaaattcgaagacggcgctcggctcccccctcctgacgcacccattgacgaatcgctgcgcgctcttttcttggaacagttgagaaaatccgggcgtatggaacagtggctgaagagtggcgttcatgaagcacgtatttcccatattgaagaggccagtttgtccgaggggctgaaaaatgaatttaagccaagttttttttctggccaagtcagtcccccgaaacccaccgttttcttccactccgaattgctggcgatcctctgcgctgacatggcatatgcgctcaggaagaagttgccggtgccatcatcagtgctgaaagagaaagggacgcgattcagtgacttaaacacaacaacaaaatggggagtgcatgcaattcactgacagaggttgcgctggttgtcgggttggaacaaatggcgctggtgacatggtcggatgagttgttggctgttccgtcacgtcgtccgaagtgggcagtgactttcgtctgcgcggatggggagggcctgcatggttgccaaagttgccgtccggaagcggtcgcccttgactcgaggcagtcatgtcttattggctacagaaaatgtgaaaaaaatgcgttacaaatacacaacaagtggtgttgaatgtaaagcagcattagagtaagaatgaaaacatggagtttgaattgacagcgaaaggagggcacgacgggtggggggggggggggacggtaggtgtcaatggcatttggccaactgcgattctgagacaattttaagaagccatcacttttttctttgaagaaaaaagttatggattctttaagttggcacagacgcgcagtcgcatgattctggagggggggggggaagtgaataattaggttactggtaaagcagcggtgtttcaagagcagaaaatgaatggggaacagttttagacagcagcgaattgtcgaatgtttggaataggtaaatgggaagaatggtaacaaaagggaaaaaacagcgcatttataaaggaaaatcgtggaagaaaagggaaaactgacaaaaacaaaaaattttttgaggcgggagggattataaaaggtcgactcatgatctaaccattgccattatattctgtattggacgccggtacgtttggcgccagcatgtttttggctataactttttctttgtcaaccaaatccaacattgttggtatcattggaaagccctaagtgtcctctattatttctcattaaggttcaaaaaagttatggccagaagaattcaaaaaaaaaaaaaccaaattttttggttttcaggctactagagcatgtgaagagctctcgaataatacccaagattgttggatttggttgacaaagaaaaaaattatagtccaaaacatgctggcaccccaacgtgccggcgcacaactgaagtagaccgttagacaatttgtccgggtaccgatttgtccgttctgccaagccagaatcttgcaaatgtactgaaatttcgctgtcgtaagtcgggattcattgccaaaaatgtcgaagtaaatcgaaaatcattgaaccaatgctcaataacaaaacgataatgcgagctaagaaacgaaaaacgcatttctaacttggtgtgaggcttccaaggcccaatcgcataagattttcgaaaatcttcccatagggccttcggcatatccgcccaaaatcctaattttatcaaaacgtcgatccgatccgtccgtcaatgggggcaggaaaattggacactgagctaatatgtattggacacaaattcgagtaaagcgaaattctttctcaaaacttcatgccaaatcgcaatttacatagaattaattgtaagctgtttacacgacaacacattgatcaatttctattcattatccgatctttgaaatggtggcattgtctgaaagccctttccaaatcagatttatttgtaaaccttaatcaacatcccacggaaatttatgccatttttcgaggtatattccgacccggacgctccgcaccccgaaccatcacccgagtcgggaccagcagggttacacccccctaagaatggcatttcatttttgtgagggaaaaggcacacattttgctgttgatggcccacgaaaatattttacaaaaaaaatgtcgggggcaccgacaccaaacaaaagtgccaacaagaaatttttaactcattttgcacgtaaagcaaacaaacaaaaaaaaatccatttttactaatttatatgatagcattttataatagaga

SEQ ID NO: 3060 - DNA, 1851 bp, Heterodera glycines
ccctaaaccgtatacacacaaagccacatcaattaagcaaagcaaataaattttattaagcaaaataaatataattttatttatattggtttatttatttatttattaaagttaaatttttttaaactaatttatgtttatcaattttataatttgttagtaatattttttaaatttattttgagcttgcaaggctccaacatttgcattattctgtgtaaatcagttacacacgtacaagtctaaacgttttccattggctaagcaatatagcaggataagggacggttttcttcgtctttttagggaatttaatatcattacggggttgcaatataactcttccatcgtctgccatacgagacaacaggcaataaatgagtatgaatatgcgtagacaaaaacgaaaaggaggccacacatgacaagggttgtgtaaaacattgtcatgaccacgggacgccaaaagggatcagtgaccagccaaaacgggggcttaggcgtgacgggcgtggaagcatttaacggcatttgctggaaaatgaaaatattacagttacaaaaaagaatttaaagcaaaaaaaaagaaacacaaactttgttggtaagagttggattggaggcgcaacataacacagaaaatgaaaggagcaagaaaaccaagcaaaaggacatcttaaaaaaagaatttacgtcccttttgatttcggaagtgataatgagataataatatgttcggccaatcacttgaacgactaattgaaaaagtgtctttttaggtgaataattttgaggacacatacctgaacccgtgaaaacattttgcagaacttcttccacggctcagctttctcctcttcattgtccgtggtgcacattgttttgatgttccgctttagttgggctgaaattttggttaaaaaactgagacaaatttaaaaaaaaccgtaaatttacgcatttaaaattccgctgggtttgaatcaaacgggcaccaccagcaacagcaggagggcatcaaagaagaatccgaatttgtcaatatgaataaaaaaaacaacaattctcttgccaacctttgttcggcattctgctttcccctgggtaaaattcacaatttttgatttgctagactcattctctaattagctaattagtgtaaattatgacagtggcccaaattttgcattttaaaccctatcaagcaatgtccactgtccgccgcactgtcgtccgcggtgcgtccgctctcgcatttccgcgcattgttccgcttgcttccttctttacggcgcgggcatccgtttttggcacacctttccgcgcttgcgcccgactcagtttttccacccgcttcatctcctattcatcgcttttccgcttcaacttatactttgcgtgttgacaaagtttgttcacaatgatttacaatataccaaaagttatgaacaagtttgtttttccttttaagttgctcttttttttcatcctgttttgttgttttactactgtctcttctgccgatttcgactttcgagtatgtagggagttttaaacgggtgtatttcatttccatttcccctcgcatattcgcagaaatttattggcaatttcttctaatatttattataaaaaaatttttaaaatttttttttaaattctatgatagtaaattttaaaaaattctcaaggggaaacgatgcggggggaggggggggggggaatgagctgccccctttttaaaacttaacaataaaaatttcttttctttgctcaggaaattgctttggaaaacaaagtcaaggcggatctatatggagtgaatttatcttttgtgtatgcacttggcgg

SEQ ID NO: 3061 - DNA, 8068 bp, Heterodera glycines
aaaaatgggcaccgcgaaacgtgcaaatttaaccgaaagagaccgggcctcatcagtacggtgtctctttgggttaaataatttaaattaattattatgtgtgtttcgccctaaaccgtatacacacaaagccacatcaattaagcaaagcaaataaattttattaagcaaaataaatataattttatttatattggtttatttatttatttattaaagttaaatttttttaaactaattttattgaatatgtttatcaattttataatttgttagtaatattttttaaatttattttgagcttgcaaggctccaacatttgcattattctgtgtaaatcagttacacacgtacaagtctaaacgttttccattggctaagcaatatagcaggataagggacggttttcttcgtctttttagggaatttaatatcattacggggttgcaatataactcttccatcgtctgccatacgagacaacaggcaataaatgagtatgaatatgcgtagacaaaaacgaaaaggaggccacacatgacaagggttgtgtaaaacattgtcatgaccacgggacgccaaaagggatcagtgaccagccaaaacgggggcttaggcgtgacgggcgtggaagcatttaacggcatttgctggaaaatgaaaatattacagttacaaaaaagaatttaaagcaaaaaaaaagaaacacaaactttgttggtaagagttggattggaggcgcaacataacacagaaaatgaaaggagcaagaaaaccaagcaaaaggacatcttaaaaaaaagaatttacgtcccttttgatttcggaagtgataatgagataataatatgttcggccaatcacttgaacgactaattgaaaaagtgtctttttaggtgaataattttgaggacacatacctgaacccgtgaaaacattttgcagaacttcttccacggctcagctttctcctcttcattgtccgtggtgcacattgttttgatgttccgctttagttgggctgaaattttggttaaaaaactgagacaaatttaaaaaaaaccgtaaatttacgcatttaaaattccgctgggtttgaatcaaacgggcaccaccagcaacagcaggagggcatcaaagaagaatccgaatttgtcaatatgaataaaaaaaacaacaattctcttgccaacctttgttcggcattctgcttttccctgggtaaaattcacaatttttgatttgctagactcattctctaattagctaattagtgtaaattatgacagtggcccaaattttgcattttaaaccctatcaagcaatgtccactgtccgccgcactgtcgtccgcggtgcgtccgctctcgcatttccgcgcattgttccgcttgcttccttctttacggcgcgggcatccgtttttggcacacctttccgcgcttgcgcccgactcagtttttccacccgcttcatctcctattcatcgcttttccgcttcaacttatactttgcgtgttgacaaagtttatgcacaatgatttacaatataccaaaagttatgaacaagtttgtttttccttttaagttgctctttttttcatcctgttttgttgttttactactgtctcttctgccgatttcgactttcgagtaaataaaccgcagccaagcggactcgaaccccagacccccttctcatatgacccctcggtgattagaattgatttttatcaattcatattttttgtaacatcataatttttaaaaaaaattttgatatgtaacattttgccataaaataaaaaaaattttaatttaaaaacaaagaaaaaattctcctttctccaaattcttcacttttgttagttatttcccttggaagtcaattaaataatttcaacagtgaaaatttgcaacgtaaattggctgttaaatcgatgcttaaacttatataaaaatcatcaataacagcattataaaaaacgatcaaatgaaaattttttaataaaaaattattcatatttgcccaaaatcaactaacctgcttgcttgtgtacttttgtctataactttgttcaaattaaacaaaatttgttgaaatttttaggctaatagagaatttttagagctagcgaatggtttcaagactattccgaactcggacccgaattcgaacaaaaagtcgaaaatccaaaattttcgaaattcttacttttgttcctaaattgatctaaataagctaaatttagtcagaagccattgcaacatcaaaaatggtcattttttacagggacgaacataaaagaaaatttcgaactgccctgccagttggagtgtgaagttctttgtttaaaaaataaaaaagatattgatcatttttatcctatgcaataaagcaacatttttcattcattcaaaattggtttcatttaattttccgtttcgcgtgccctgtattatactacatttttcctctccaaatttagctgcaagtgctcggctacgacatttcctggacaacatttaacatcattgaagtgatgtcgagcacgcgttacagcgaaaaacgcattggttatttggccgcggtgcaagcattcaatgacgaaaccgatgtctgtgtttagggccctggtttttcaaaaaaaaatttaaaaacaccagtgcaggggggtagacagacttctttgatacaaataggttcaattattaccaaaattctcaaattttttcatggcagcgtctgatgggtcactcattcctcgaaattttttctcttgttaaaggccgaaaagcaaaaaaaaaaaaaaatcgtcgcccaatgcggcctaccccccccccccccaagctagggctaaccccctcctcttttgcttttttcacccttttaatttttttaactgcgttttttaggtgctcatgttgacgacaaatcttatccgaaaggatttgcaaagttcaaacactgatgatgttggcgtcgcactgattgtgagcggactttcctgtttcaccaccaccgatttggtgctggacaccgcagaggaagcaacgttggcatatgtttttttggtggacaacaacggcatcggcatcgcttgtttaagtcccaggtcaaaaaaagcatatggctgacaaacgccatgaattctggcaaattcataaaaattgagttgcttgccaagaattctcgggtcgttttaagagagaatttacaaaaaaataatttccttaaaatctgcactgttttgaagattgtacactcggggagcagttgctttgttcgccgtccgacgaaccgtgtgccatcgaatttcttccactctgctactctccaacatttgcgtgccattcgccaggccggacgagttggttcaccaacagctgctgtgctacatcattgactccgtgccgcatcgtgcccttcttgaaactgagcccggcacaccactgatgcggcacttctgggcgcgacttgtgcgtcgacagaagagcggcattggcacggcaccgttggtgaaggacgcgcagcgacaagtcagtgctgcgtttgaacttctgaatgcaataatttaagctcatatttttgtcacaatttagagcaagtttataacaggaggccgatcgtccttattcataagaaatgttctgaattgaattcaatttccccgacagcgcctgccggcaccgggatttgaatccgacccagagaatcaaatctctattatatccggatcacatttgtccgcgaaaattttgtttttgggttcattggagaattaatagctaatctctttgtttttgggggctgaggggaaattctcgtataaacataatttttgccaaaatttactaatctcgggcttggcccactttttccctccccctcgtttgactaatcccacaggcattggcatcttatcaactggatctttggtggaaatgtgccgtctgttgttcttccactcggccccctcccgccactgaacatcacatcccgcccgtcttcgccatcggcccaccgtaccatcgctcgcccattcgcccgcgcccgccccgccctttggcccaagcacatataaaagaaagatggatgagtctcgagatcataaccttttcctcttcgttttttgccctgctcttcgaagatcttcaactctctacaaaccccttttttcaccactttcgcttataaattttgggaagaacaaaaaaaaaatcaaaaaaaaaaagcggtacacgccccatgggacaatggacctggccaagttggaccccaacactccaagcctccaccacgtcccatagagacaataagacgtgcttttccagtggtgggggagacaaaaaggggatttccgaatcggttatgctcactgtgcctacgggagggacatcagccctccaactgtacggcctatcgaacggcggaccagcgaagggctcgcctcgctgaacaagggcggtgctccctttgcgcccgggaagggcactattcagacaattgctcgtcacgggcactttgctttcgatgtggagaaaaacatcacgttttggtatgcccgagtccggaaaagacacctaccaaggggagcaatttggctccgttaggcacccgtgcaccaggcggaaggacaccccagtgggaaaatgcgcccactacttcttcggcatccccccctcagggcaacagaaatggcactcaaattgccttggcaattgctgagggtgaattttttgcccctactaatgagttttacgccgaggaaaaaccccgaccaaaggcctatctcatgatcaaaaaaattcctgtttttaaccctaatggaccctctccgatgccggtacctgtcttttttgacccgggttcagcccgctttcatttcatcgcccctcgtctcgcggatccgccctcctctgatgtcacaagaaaacatgacagttgggggcttcttgtgggatggaccatcccacacaatgaaatttgcttcctctcgtttttctgtccgcctacgtcggaaagacggtggttgggagactgtggaattgaatgagagtcccaaaataatcctatcagtcgagtttttgagggaaatccattggaacccttccgaaaacgtaaaaatgggagtgacagttgaggagccacaaattttgcttggaatcaaggaaaacttcgggtggtttatgacgcttccgtgcatgagaagggcaaaccctctctcaatgagctgctcctccccggccctaatttagtccctgagttggcgggggttttactccgcttccgagcctcgacctgtccagtgctaggggatatagaaaaagcatttttggccgtgggacttaaggaggaggacagagaagcggcaaaattcctttggttgagagacccctccaaaccactgaccccggacaatttaatcattttccgtttcaaaaggattgcatttggcgtgagttcttctccgttccttctggcatctgtcctgcgctaccatttggcctctttgggggatccattggggctaatgagcaacttttacgtggataatttgcttatttgttgtgaaactgccgaagaagccgccgaatctgtacgcaaggcacgagaagtgatggcccgggccgggatgcgcctccatgagttcgtagccgcaaatcgagccgttttacggggtctccctaccgaagaagtgctggtgggtgatgtccaaagggtcttgggcatttcatgggatttgtcaagggataaactgatttttgagtttcctaaggcggttaattttcccccgactcggagaggagtcctgagctcaattgcctccctctttgaccccttagggctatgtagcccgtgcctcgttaaggccaaggtctttttccaatctttgtgggattaaaacacgggatgggatgccccgatcggggaaacgctcttgagcgaagtgccgttcacagacaatcccccctcaggcaaaaagagggaccaacggcgacaagggattttgaagtgggctgaccgccctccactctcaaaaaggcccaccctcggagccgacaaaggcaagcctatgcattttcactgggcgacgcgcttgcccttaatcacagtttttattccaattttaacccttttttgtggtacggatgctgccacccgggctctctcctgcgacgaacagggaatttgggtatttttgaacccacaggcggagaatagcatagtgtgctgtgagggcatatgcagcagtaggggaaacccttcaccctatctactgccccttcccccggacctgttggcaagcgcttttgagtgccacatctcctattcaattgcaggggaaaaaatctcatcacaaattcagtgcgagcccgtggaggggtgtagcctcatcaaatgctatttgtgttgggaaagagtccttaattcccattgctccccgttccttcttgcctttgcggtcggcaaatgaaggcgaggttgtcatacgccatcggaacttaatagggggagtggacccacccaatcggtcggaagtcgccggtcccgaggagttttcccgtccaatctcgccccgaatggatgcaaacaatccaaaccgtttaactcgtctaagttatgcgttagccccaacccttctcgcatttttggccattttaagtttttccttaatttcttcggtaaatggcggcctggaagtagtgtcagtctcagcagacacggaggagtgcattgttgaccatggggggacgaaatgcctattcaacagtgtcacctcccttactcttttacctattggccaaagggtggaattggttttccataccccccatacagtacccatgggcagtctatccttcgtcctaaaagggttggcccttcggtgcatcagagaaaccagcagttggacccggtcataccgactcaacatatcctcaatgctgcgttgtcctgcagcagggtcttgtacgggctccttttgttctgatttagagccctatcaatcagtaccagatttaagtgatgcttttccaggggtcaatttttgcaaggaagcatccggttttatccgccagggatgtctctcgccttcttatgcgtgcttattttacagattgtttgcggcgcctctttccccctacccctatgagctgtacaagtgccctgtttggcaattccaattgagactcgggattattttgcagcttaatgggtccacaaaagctgaagaaataactatgtctccagggattacccaccattggccgttagctaagttgtctgtcacctttacccccagcggtttgccacccttaccaattttgggaagcgattttattgctaaccgttcacatgcggcattggtccccgaatggcattgccaagaattctcgggtcgttttaagagagaatttacaaaaaaaaataatttccttaaaatctgcactgttttgaagattgtacactcggggagcagttgctttgttcgccgtccgacgaaccgtgtgccatcgaatttcttccactctgttactctccaacatttgcatgccattcgcaagggcggacgagttggttcaccaacagctgctgtgctacatcattgactccgtgccgcatcgtgcccttcttgaaactgagcccggcacaccactgatgcgccacttctgggcgcgacttgtgcgtcgacagaagagcggcattggcacggcaccgttggtgaaggacgcgcagcgacaagtcagtgctgcgtttgaacttctgaatgcaataatttaagctcatatttttgtcacaatttagagcaagtttataacaggaggccgatcgtccttattcataagaaatgttctgaattgaattcaatttccccgacagcgcctgccggcaccgggatttgaatccgacccagagaatcaaatctctattatatccggatcacattcccggcaaattttggctgggtcccggtcccgtaaggcttctaaaaacaggaaaatgtaaattctcaatcatttgtaaaaaggcaattggatttttagcccatgttttttgaataac

SEQ ID NO: 3062 - DNA, 2442 bp, Heterodera glycines
  misc_feature (8)..(8): n is a, c, g, or t
tgctcgcncagcaatatacattttctgattttttattttattttaaaatttttttgttcataaatttttcataaacatttttgtcttcagagatattggcccatattttataaagcataaaataataaataattaaatgaataaaaaaatacattaatgtgtcatttaaaaaaataataattacaaaacatgaaaaaagatgaacaaaaaaagacatctccacaggcattaattaactttttaatttgtttgtatttaatatattttcgatgcatttaatcaaatttgacaaatctttgtacataataatatatatatatatatatatttcttgtgtatttaagagaggatatttttgtactttttgccaaaaaattatatagcacatgctgttggatgatgtgtttaaaaatgcgtataggactgaatagagagggactcaaaacaatgacactttaaaaaaaaaataaatttgctgattggaaattggccaatgctgatcagcggcagaagacagatcatccaatgatcactgatctcccccttttctctcatggatggccaacaaatggcacgaacacatggataagtgatgaagcattattggccaagaatggactcggactcaatttttgccaacggcgggcggctgttcttcgacttgcaaacttttggactgttttggcacttcagcaactgcccaagcttgcaagcagtggacttcgtccacccgaatgatttctttggtattcggcttactgtagccccaaaagcttacggtaccaccttcggccttctgtaaaattagtcaattaaaaagggtttttgaaattagaataccaaactcacataacaaacaacatcaatccgagcccaattgtatccaggatttttttggatttgaattccattgaccttgagtttacaagtaaatcatttgtccttatttctaagatttgcacttatttcgtccttattaatcgttatttgttcaactttgattcaaaaggaacaaaaaactttaatttttagtgcctaaaaattaaattgtatatttaagtgaacttttctgtggcggtgccctttggcattaattaattaaccaattaacgaattaattacctttaatattgggcaaacaaagtggtcgtgtgaccatttttcttcagtgaggcatttcttgtcaccatcactacaggggcaatcattgtatttttgcttgaccgcgtcataacactgcaaagtgccgctgccggggttccttttttcggcatacaaattgccggcataacggcacttgctcgattttatgagcttgacgttgccttaacatttttgaacagtttcagttgtgtaatggttctgatttaccgaaagcctttgaagaaaagtcaatttaaaataataaatacttaaaaaaaaatttaaaaaccaataaaatttattttacaattttccttgcctgaatacgtcagctcgaatacggtagatggtacggtccattttgttgaaaggcgcgcggaaatgacaatgtccatgcccggcttttccgcctcaatccaatttttgtattcatttgcttgcagatcagtgagtgatgcggcacaacaaagtttggcaccttaatgagccatcattttgctaattaatgattaattagttaattgtttgtctttttgccttgggctcttttgtcggctcggtatttgacctcgacatacgccgatgagcagttgtatgtgcactcaaacaaattgctcaaacttttgaactgaattcgcgccttcccagcttcaggctgaaagcaattaaaatttgcatttataatactcaaaataaattcaaaaatttcataaatattatttattgccttaattcgccaatggcatcggcacggcttattccccacacatttggccttcgtcttcaataacactgctgactgattggccaccaattctctcggaattccactcaaatcctcgcaattcaaatcttcaaatttatttataatttattttaattgttgaattaaataattagttaatctcactctcttcgagttctttacagtattggccaccgtatccgtccggacaatggcattttgtgcaatcattcggattcaaatagcccccgttttggcacttgtcctcatgtcctttgcatgagtctgaaaaatggaaaatcacttaattatatttaattgatttgcctttgcaataaatttgattaattatggccgcgtctttgaaagagattcgttcggtttggccaatcgtttgttggtaaaagcgtggcaaagtgatcagttcgtataagcccctttaatttttcatttcactcaggaaatccaacgttttcttactgttcatgatcgcctccagatggataatgcatcaatgatccgaaatcgtaagcgaagccaaagttttgcgcgtt

SEQ ID NO: 3063 - DNA, 5986 bp, Heterodera glycines
ttagggctggtcgggaccgggaattctgacaaaaaccgggaccgggacttgccgggaccagaaaagtcgggatcgggaccaagtttttcgacctggaccgggaccgggaccgcgagaaaagccgggaccaaccgggaattttcccaagagaaaattttttgaaaaaattttgaaaatttgagtgcactttgttacgaaaatttcctaaattcaaaaatgtgcccagaagattttaaaattttcttttgggggaggaattcgaagaattttctattattctctgtttcatttcgggggggggggggatctggaatcttggaattttctgggtcccaaaattctggattttttaataaattaaaatttcttaaattttttgcttttaatcgctgtttttgtggcgctgttttccaaaaaaaacttttgggaacattggtgagggggcggcagggtccggcggtgccgataggcgccgccggaaaatttgaaattttgagtgaaatatgttaacagaatttgtcaaaaaatgaccaatatttggttaatttgttattttttagcctgtttgaaaattaaataaaaataaacttggaatattttattttttaattgaaatttcaattacaaaaatggtaaagaaaaactagaaaatattctgttcaagtggggaattgaacccaagcgccaaataatgaaagtcagaaggtttagccacttgaccacagaacgatgtgaaaaaaaggcaataaaataaaaaatttatttatttttttctcaaagatttctccttcttcaccaatttccttctcttttctcaccccccattcttaccagtgcttatttagtcccgccgggaccgggactggcaaaaccgggaccgggatttctgtttttccaaaaaccgggaccgggacctgaaaaaaccgggatttcccgccccggtcccgaccagccctaaaattgataaataaaaataaattaaatatgccaaattttgcgaatgaaaattcgcacaagtgaaatatgaatttaaattaccgccaacaccatttttaaccgcaattccattctgtcctttcaccattttatcgacaaattcaaatcgaacacaggtcacctccctgtacagaagagagagaaatgaataaaaaatatatgaaacctcccctacgcatttttttttttggttgtataaaaagtcggctgaagaccccgacattttcccgaaaattaactaaacctaaaaatatcattctcacattatcaaatcggcaccaatttctatcgcatgcttccatgattggtacccgtcctttggcacttaaaacatttgttcaaatactgtatgatgtggcaagattattacgagcatctttgttgaatgcgattttgatcgggaattcggtccatttttcgaatgggttgtattgtcgttttttccgctgactttccacttcctcgggctgaagtccacaaactgtgaattttaatttggattttttaattttgtttttaattaatttatttttaattaattaaatttgcaaattgaactcactcttccgcaatctgttgtactgttgttgaagccttcgtttgtcacaaaacatatcccctccacataacaatgtttcggatggctttttccagggcatctctggcggaagtggggcccagtctggctttttgaaaatctaaaattatttttaaatatttttaaactgttttttctattttttactgcgtttgttttgctttcgttcttcccacagtttgccaatgcctcaattttcaacaacaaatttctgatcggcacacaatctgcgccgtattcatcacatgggtctagactgtcttaaaaagtgccgaaattaattttttaaaaattcaatttattttttactgactgaatctgttcggatcatcttggtagggcaacaaatccgtgtcgttgattatgcgttttgaaaatattggcctttcaatttggaaaaacgcgtgcattttgtcatcatccgatggcggcacaaaatgaattatttttaccaaagtgccgttgaccatttgcggcgaaatgtctttgagaatggtgccaatgccattgctctgtaaaaaatgattaatttatataaattaatttatgatttttttgaccgttttgaattcttcacaaatgcttttttcgtcgcccttttctcggattgcgcttttccgctggtcggtgccaaattcgattaagaatgttggcatccaatttgttatttctgttattttttccaacgaaattggaaatgttcgcgtccgtttgcaacttaatgtttttaatttcaattaaatattatttttaatttttattattttaattcgactcaaatcgattcaataaattacatatttctacataattgcttagaagcaaaacgtttaaacattcttgctagcattagatagccctaatggttcctacctacctatcttaagaaatttcagaaaatttttcaaaagtccaaaaaaaaattggtaaattgaattttgtaagatcttttttggccatatactttttgatattttacttcttaatgaagtttatttaagagttactaatgaataatataaagaaagttttgtttgattatttctcagattaaattttaaatgcaaaatcaatattatacgtttcattggagaaggaaatgttgaaagttgactcaatgacgagatcgttttcgttacggtgggcgcaaattttgacaatgaatccggcaacattggcattggcatcggcaccatccgaaattccttccaaatgtttttggcacatttcggcgattggactgtttccgggccattttttcgagcttttgtagcacccgatcagctcttcggaactgaatgtattcctcattaaagcaagttcaaattttaattgccataatccctaattattgccaggccactttgacgccaactattttgtcgacaaattaaatttcaaaatttaatgagccacaaatatggccaaaagcccaaaaaattgtgttttctggaaattttggcattatgttactttaaatttggtagcgccaaaaatgccgctccaaagtgacccgacccaattttaaggcacttaataaatctgtgccccgctcattaattaatgactgtttcactaattaatgatgatccaattttcttttacttttcgcatttttcttccgttggcactttgttacaagcatcgaaataacggtgcttttcgctgggcggaccttccggatctttcattttcaaaggccgctgatatttttgcatgcaatttcgtatggcgtcgcggtgatattcaacaagaatttgtccacttccgtcgggaagaaaatgttcgtacaattcgtgccaaaatggtccacatttcgtgcaaatggcacaaagccaaaagtttgttcagttgttggcacaatgccaaaagtggtttttggcacagagcgtggcgttgtgccatggaatttggttgtgccaacaaacggtgcctttgtttttggggcgaccaatgtttgggaaaggcactaaaaaatgaaattatttataaattacgaattttaaatatgaaaattgaactttctctttgcacaatttggtggtaccgccgttttctccgcaaaattttgcgccaaattcaaatgccaaaacaaatggcataaaatcatcaaaaaatgcagcagaagaaagaccttcttgaagttcgtttccaagtggttcagcatctgtaaaatggtaattactattaaaatattattattaatttggctttacttttggtcaaattaatttccaaatatttttccgtttttttcatttgttcggtgcccaaaatgtcgtcgaatccatggcttaattttaaatttaaatccaaattttaaaatatttttcatttgaaatttgcctcgattcgtagctgatcactccgtcttggtgcttggaaatgatcagtccgtgccattggtcttcgccaatttcttcggcacattccacaaatttcagtttgccaattgttcctttgcccaccccaaaacgttttccaatttttctgtttttggccatttcgctttggtagcagagaaggaacctaaaattgatttaaaataattaatttaaaataaatttttcaaatattttactttgtgcagtcatttgccaccaaaattgtgccattttcgccattgcacgttttccaaatgccaacgtcggatgacaaagggctgaaaaattgaaaattttaaaaattacaaaaaaaataatttactttcatttaagaaattaccgtatcggaggagctgagcaattaatgaccaagctcagaaagacggtcagtagattaaagaagttcattgtctattgattaattattaatgaatattaatactatttaattaatgaaaattaaaaaattatttgatttattttatgaataaaatatttatttcacaaatgatcaaattaaatgaattaatgaaagtggtgggatggaagcagtgaattccgtcgttggaccaatcactgaattttctgtgtcgacgtgtaaaaaagtgaaaaaaaagggggaaaagccaccagcagaaggaaaagcggacaaacgaccacacattttgtagcagagattgtggacaccgataaatgacaaaagtaatttatttatttattttaacattttggccaaatcatcacaaattaattcgtcgacaaatttccaccactttttcatcggacaatttggcgtaaaatgtgaatgaatacataattaattatttattgcataattaataattgtacgtctttgtgatgataaaacaaaatgataaaattgaataaatgatgctgtgataagataaagcatagaaaaggtgtataatcgtcttcattagcgtaagcgccgccgccggggtcattttaactggactgactgatcaggattgcgattgtcttaaaaaatgatcaatcattactcagctgataaagccacaattatccgtttagttggttttgagcaaagttagggctagttttttgttgaaaaatttcatttgatggcttttttataacggctcagcacccggcggaggctgcctttgatgccgtcgttgctcattttgttgttgcccttctctggcaaccgaggaggacgaagtggactaatttttaagattaaacagcaattaaacaacacaaaaaagtgaataatgaaaaaatatgaaaacatttttaataaattttcaaacactcccaaaaattaaaaaatatttattagtgttcaagttatgacggtttttttgtgtgtgttagaatgatttttgaatgaatgaactctctcttttttttgactgatttagaactgatttttttaacttttcttttgaatgaatgatttcttttactgatgatttttttttgttttgacttttgattttctttcaaatatatttaacggccgggttataattagggatgctaattttatgtaaatacatattttacatatttcggattgtcccaggactgaaaggtcttaatcttaggaatcgggccctgatccccaagaagtccaaagggtccaatcgtttgtatggctctttattgtcggattataatgcgcgaaatatgtgaataattattcacatattaaatgaattaataaataattaatttgcattttgatcgctccaacgtccgactatcatctcctccgactcgactgactgattggtgggggaaaaaaattgaacggaaaaggggcggagatttgcggggatttgtgagagttagagaaaagagaaatagtgaatgaaatgatgaacgggggaatatcgaaaagatgaataacatcgattggccaaaaagggaaatgtgtgaagggttcgtcttcgctcatgggtaataatttgaatatgttacaatttttaataaattttcaaacactccccaaaattaaaaa

SEQ ID NO: 3064 - DNA, 5422 bp, Heterodera glycines
  misc_feature (88)..(88): n is a, c, g, or t
  misc_feature (5304)..(5304): n is a, c, g, or t
  misc_feature (5319)..(5319): n is a, c, g, or t
ccctagaaaaaggtgtcttaacaaaattttccaaaattttgtttgaaaacaaaaaaaaaggtgatttttcgtgcaaaaatcagcggcnccgctttcccctgtgccggcaaaaaatgtagagattttaacggctttcaccaaaattaaaggatttcatgagaagataaattaatgttaacttaattattacaattttacacattgagaattgagaattgaaaaaaaaaatttcacttcctaaacttccaagtttcggcatttcttctcaattttttaagttaaagatagatagacattttaattttattaatttattcatttgaaaaaatattaaatttgtttttccgtttcatgaaaatttcccggttatttccaggatattctggccctagcaattctctgtctcgggattttcactatttttcgtggctatccccgatcccgacgcttccaatcccgaccattattgctaatcctaatgttcaatttattaaattatcataatttaaaatccatgatttttaaataaatgtttaaatttattccttttttccagttttttgtcagtgccaatgccgccgccggtgttgcgctgacgcatgacgcggtgctgcgcgagttgggcgccgcgctgacgttgcgcaaggagcagtgcctgcgccgtgagcgccgtgcgttggcacgcgcccgcggccttccggacgaggcggcggtgcccgcggaggagttggaccgaacgccattcgcggcggcggcagcggcgtgccgtgacgcgacgaccattgtggcgccggcaacagcagcggtgatgatgacggcgctcaaccaggcggcgttaatgccgagcgccgaagcggtggcggcacagcgggtcgcaattttgagcgccggtggcggcgcggcactacatcagcgggacaagatggagcagttcggggacgatgaggaggacgaggaagaaaatgctgatgatgacgaagcggggacacagaaacagcgatgactgactcataaaaaaacattttgttaccgtatccgccgcgtgtatctctctcttactgtagtgccgtgttcataaaacccgagactcaccacttttgacctcgctgtttttggctgcgttctttattgaacgtggattttatcatatggtctcggcaaatacagtacaccacagagtactgtagtcgccggaaaaaacaaaatttttgtttattgaaaaaacttatccgttgatttgaatttaaattttctttcaatatgatttattttattttgtttttcatttaatatttttgtcaaatgaataaattaataaaaaatatttgctatgaatgtaaaattgagcaatttaactattattttaatgttctcttcacctgaaattttttaccgcactttgtttccaaaaaaatcattagtggacgggggaggcaggccgaaaagcccctggggaaaattttgaaaatcaattataaaaatggtcaattatgggtttacacaccgtttcaaaaaacgagagatgaaccaataaatagagagcgcagagaaaaaacatctctctttttggcgtactatttttttatctctgttaatagagaaaaactgaatttattcgctctatagaactttttttccgccttacagattttctttaaattttgcatatcgatagagaaaaaaattcttcatttttctatgctgatttattattattgtctatgctcaagtccctgggcaccagggttggacgtaactgattttcagttacgaccatccgtaatccgtcatgacgggggtcaaaaaaggccgtaatttggcgtaatccgtaatacgtaatccgtaattttcaaaaaaaaaacaaatttaatattttttcaaatgaataaattaataaaattaaaatgtctatctatctttaacttaaaaaattgagaagaaatgccgaaacttggaagtttaggaagtgaaatttttttttttcaattctcaattctcaatgtgtaaaattgtaataattaagttaacattaatttatcttctcatgaaatcctttaattttggtgaaagccgttaaaatctctacattttttgccggcacagggaaagcggggcgctgatttttgcacgaaaaatcacttttttttgttttcaaacaaattttgaaaatttgttaagacacttttctagggtaattttaggtgtttattacgaatctgacaaggctctgtgcttttatccatgactttcgccatgcaaagttgtcgattatttttccaaaaattccctcgggcggaattttgaagaatctcttgagcaacagctgaattgcttctccaatgcttttcatcttttgatctcccccgcgggggagatgcgccgctcccggaggtaagtgcaataccgggccgacgcgcggtcgagagggggcaagccccctactgcgacctttttccaaaaattggttaatctctttgaccccggtaggggtcgttacggagattaagccgtaaagaacagatactacactttgatcttagccaaaaggccgagaagcgatgcctgaacaggcaaaatgggttccggaaacggaaccggcaccatcgaaaacatatgggtagcattttaggcgaccaaaattgcacatttgggagcagagatattgaaaaaattggggaaatagcgtttaacgggagggacaaataggggaaagaaacaagacggacgagagagagtgcttcctgaagaggaaagcgtaggagagagtgtgtgccacagacatgggaagggagaaagtggggggggggcgaggcagcagcagcagttggtcgtcatgtcgtcgcacgccgacgaccacttctcttctttctcctctcattgactctcgctcgttctctctctctctctcctctctctctctctcttccactctttttccatcgaagtattaattattattaaaataattagtaaaattaatatttaaaaaaactttatttgaacacacttcgtcctcctcctcgcaaatgcttctccgtttccccgcctttctgctgttgttgttgttgccattttcaacagcggcagtgtccaactcgaaaatctaaatgtaatcatttaattaattacctaattatcacgccttcattggtgtataatttccttcactctctaattagccaattaaaaattaaattaattttcccgtttcgaaaattcaattttcgcgccgccaaattctcgaccaccaatcactaccacctgataatcctcctcattgtccaccattgatccgcaacttttcgcttggcattgtgccaattcatcatcggcatttttccagtgaaatgaagcgtcgtcgccgcccccggcgggcaattggtgcggcgggcacagtttttgttggcattctgttacaataaatcgagagacattagacgaggacggcaatttgtgttacacctaaaaaagtgccaaactttttggtaaaattgtcttgaatcgaggaataaccaaccccatacagtcgtaaaattcgaaatgggagggacggcgccatggataaatccccaaaaaagcgggcaaaaatccaaaactctcgggcgcaaattcaaattggcgcccacaaatgcttgccatttccctgtaaaaatggtgcgccccggaatgccacggcaccttccaatgcgtgccgaagtgagacggccacttgttccacgcatttgacaacgtcgggcggaggcggccacgctgagtcggcaccgccgtcgtccggcgaaggttgaagccttagaaaggcgcaaaactcagattggcatgacacgcgaacacaattccaaatgccaattttgactcgcctctccagtgcccattccaactgagcacggcacattgaggcccgggaagcgacggccaaatcggcgctgcttatcaacacattgttggcatttgtcctgctgctcgttctgccgtacacattggggacgcacaacggcactgatgttgttgtggcacgtacggtgttcaaaatgagcgccaaattgcgacagaacgccaaatgctcgcggcgtcggaggtcgcggctgagtgcgagcagtgcacaacggatgaactcgctgcgcacgaggaaatggtattgccacaagctctgaaaatgaattcccaaaatttttgaatccatggattcaaattcccgacatttcgatatgccggttccggcattttgaacccatgggcttccatttcccgacattttttggttcggctgccaattcccgacattcttgaatcgacgggttgcaattcccgacaattttttattcggcatgccgattcccgacacttttggattcatggactcccaattcccgaaatttgctgtgatcggtgccaattcgtgaaatttgaagcttcggattttaatttccgatttttcccggctgatcatatccgatttcgacatgccttcaggctgttcatgtgcaaatcgttgtcgtcgtccaccgccgccgtttcgccggcgtcgcaaagagtgcgcatttcgtcgcccacaaaattgaacaacaaactgtcccgttctttgctgaaaacgtgccaaaattgttaaatagacatttgaccaaagaatgacatttggggtttatttgtgctgttcgagaccgaaaatttcccgagactcgagaccgagaccaaaaaacccgagacttttctcgagtcaagaccgagcgtcttgaacagcactaggatttattgagttcgaggaagcagtcagtgatagccaaatgagatggaagtggcatggcacaacaaagaagcacaccccgctaacagtggtgggatggcacatcggttaagcgccttggacaatcaccaaatggagagtccaccccaaaattgcgccgcccgaatcggtgaaaaaattttttgatggaattttcttataaaaaaaatcaggatttttctcttgaaaaatttcgaagtttaatagtgctttttctatcgggaatctcgagactttgtgggggtcaaatgttgtcaaaggtcacaaattctcgacagagacaaatgggtcgagactttgggaaaaccaaaaggttcttctcattgccagggaatgaatggttggaccgggtcaaaacgagtcgagccgatgccgtgttaaatgcccgcacaaaacggcacaattggcgaaggcattggacacgcggtgcccgaaacggaagaacagcagaagcaaacgatgggggggaagaagggagacgacgagaagtgacgaagactgacaaaaaaaaatggaaaaattanaattaattccatganaaaataataatttaaatattttttggattaatttttattaatacaaagatattttttgtgtttataatttatattttttttaacataacaaatgatcattaat

SEQ ID NO: 3065 - DNA, 1741 bp, Heterodera glycines
  misc_feature (18)..(18): n is a, c, g, or t
tcttataaaaaaaatcancatttttctcttaaaaaatctccaactttaataatactttttctatcatcaatctcaacactttcttaacatcaaatattatcaaatctcacaaattctctacatatacaaatctatcaacactttaaaaaaaccaaaacattcttctcattaccactaaataaatccttacaccaattcaaaactactctaccccataccttcttaaattccctcacaaaacttcacaattatcaaaatcattcatcactctcttccctaaactcaataacatcaaaatcataactatatcaacattactaatactactaaaaataactaatacttacaaaaaaaatataaaaattaaaattaattccatcaaaaaataataatttaattatttttggattaatttttattaattacaaagatattttttgtgtttataatttatattttttttaacataacaaatgatcattaataaagaaaaaaggaattagttgaggaaaaaatttagaaacaatttttttttaattgaatgaatatttttaaaatgcaaaaaatattgaattagttgttttttagacaatttaattaattagtttaacaaaagaattactgtatataaaatcaaaaactatttttattattaattgcaaaattaaattattttattttaatggaaaataaattaaattgcatggaaaaaaatatattaaatttattacttttggattagttttaattaattaaaaagtagtatcttttaggttttgaagctataaattgtaaattatttttgaaataacaaataattattaacaaagaaagaaaatgaataaaatataaatttaatattaataaagaaaaaaaaatgttttattatttattttcgaatttcgaccagcacccgaacagtgcgagttcgcgtcgtcgcaacccgagcacaaagtgccgaaaacggtcgtccacgtgccgggcccaaagccaacaagcgagacgaggcagcaacagaatgaggagggcggaagagagaaggaagagggcgagagcagcggagaggagcagaaacactgagaaagagggggagaggaagagagatgagagagtgaattttaaataggaaattggggaaaattgggaccgaaaaaacacaccagagtcgagactaataattgatcccacgaaggtcgagagtgtaattacctagataactcggcaatcgagaaatgagatccgagaacagagacttgaattgaatagcgtccagctctgcgcaagagaacatgagagagagagagcgagagagagagagagcgagagagagcgaaagagagagaaatcgagagaaagagagagcgagagagagagagcttgtggcacgcgagagtataatttcagtggtcaaatcaccaaaatttgccgaaaaagtgcacatggcaatggctccaacgacgacgacgccaaacgaagcaacgggaagcaggttcaatttttgccgcccaagtgctgtgccatgccgaccgctttgtgtctgcaattggtcctcgcccccggcgctgtcctcaagttcgagcagttcaatgtcctgctcgtccaacagctcacgcgccgccgcacaatgccaccattgacggaacagtgcatgtgaaaagcaatttcccatttaaacagcaaacacttcaagaatagagagctaggaagtaaaaattagaattttccctgacatcttggcaac

SEQ ID NO: 3066 - DNA, 3146 bp, Heterodera glycines
ccgaaattttataaattcggaaatttttgccagatctataaaaaagccaagttgccttaaaaaactaacttagaatttttaagaaaaaaaaatcttagaaagtttttttttataagaaaattccaaggaaatttctcgaaaattttaatggtgaagatttttcaaaaaaatttccaaaaaatctcttaaaatttctcgaaaaatttcttttcttagaattccaggtcgagaaaaatcaacaaaaccgaaatttttgtcgtatagtttgccacccgatatgtatataacaaatttaaaatattatccggtagtgagtgacacattgccaaaagtgaaatgccgaaattttttttttcatattttttattccttcgcttcgtccacacacaataaaagtttatgcgcaaaatttgtctgtccatataaaaatttaatgtgagtcacacacaacagtgtctgatcatctcatttgatcatcaaatcaatggttgtgttttggatttagctttttctcattaacaaatcagcatcatcaacagcagcaacagaaggcaggagggttgccaagtttatgtattgtgtctagagatcggcctagacctggatttttactggatccaggtccaggaaacccaagtccatcaaatctggaatacatccatccaggtccagaggcgtttttcaaaataccgatctctaattggctctactttcatccatcatgcctttctttattttttgttccaattttccatggcatatgccatatatatgttatgtacttgtttttttttctccagcagtacataaactcttggcaacccgcccattttgagcggtcatcaaattaaaaaaagggagtgacaaattggcgtctatccaatgaaaaaaaaacatcggcaaaatccaacagcacagaaaagaagaacaaaatgtatgtatgaaccagtgtgtgtttcatatcaccttaacacatatatgtggagagcaaatttacgtgtcaatttgttgtacaacaacaaaaaaagggtgaggagataagtctaaataaaaacaaaaaaacagcgaaaaatgaggggaaggattaggaggcggaactgaaacagcagcacaacacacgcgcgtggtggtggtggggaaatggtgccgtgcccagggacggtcccatggagaggaagtaaacaaggggggcacgtacaccctgcctaatggcataaaatttcaaaaaaatgacaggaaaaccccaaaattgggccaaaatacagacacacttttgcccaggagaaccaagtcccgaaaaaatcccgaatttccatggaccgtcgccaggtgtgtcgtcacactttatatatttaaaaaaaatgatgatgatggagcaacgaatatatgtatgtatgtattatctatttttaataaaatatgtggcgtgccggtgccatcggtccccgtcaattaattaattaatgagtcataatggtggtggtgtgttgtcatcattcacatctctcctcatctcatcatcatcagcaaaatgtctctctctctctcctctgtctgtccgtgtgttgttttgtgttaattctgcttctgctgcccgtactccttcccctcctcgtgctgctgcatttgtgcttcttcgcctgccatttgttgaggctgttgcccgtcctcctcctcattcccatggcgtttttgttgcggttgttgttcgcctcggcgacgatagtacctgttacagggtggcagggtttttttttttgaattttcaaaaaaaaatttttttaagccaatttatggcccctataaaatgaatgtatattgggtgtacaaattgatatgccagtgccagatttgaagatgagcccgcatttttggattggggaaggtgcaagacgaatgggcaaaaattttggtgttttattgtcctatcaaaaacgcaagaaaaattataaacccctttcgaaagaaaatttttcaattttttttttgttacaatttcaattaaaaaagtgtaacataacaattttacaaaacttggcaataaaaaaggactgaactgcacaaaaaaccacacttacagcatgtaggcctcgcgtgagttaaacacatccggcacatcgtgggtcaatgggtgggcggccgagtcgttgaactcgcaccagttcaacccgttcagggcacaagcggagtaatggccggagccaaggcctgtgtcgcaaatttgccaacatcagaaatgcgattttttttgaggggggggggggggtgaatacaaaatattttaaatttttattaggaggaaagcgattttttttttcaattttgtggaagacgcaaccgaaatctgtttttaaatggttacaaaattaatggtgaaaccaggcccgtagcctgcacaagttttaggcgggggaaatcctaatgttttttttgcccttcgggttaaaactttttgtttttcttaaatgttcagcgccgagaaaaaaaatatataattttttagacgttttcgctgataaatgccatttttttgtcgttttggagtcaaattcccaaaagtacgagaaaaatggtggaggggttcaggcggtgccgatagacgtcgttgggaatttcaaaaaaattttcagattttttcttgagtaaatttcataaaaaagcgcgcggcttaccgcccgagtggttggagatgccgatgaggtcgtacttctcctggctgtgctccgggttcaacaccttgtcactgaagtccagcccgcgaatgggcagctccagctccgtctcaattttgtcccgcgtgtaccgaccgtagctgaaccgcttcaggtggatgaccaggatttggggcagtgtccacaggtccaactttttgaaggcgcgccgatgcgttttgcagttggggcagtacctgcacaaaaagtaacagcaaatgaatgataaattggataattaatgtatgccgccttaattatggctaattaatgtatgcagcgcctcaattaaagtgtattaaacgtagccacaaagttaaggcattcgaatgtcaacacatcctggaggaggaggcgcctttatcggcaccgtcggattgatatattttgttcaaaacaagtgatacggcacaacaataagatgccatcaccacg

SEQ ID NO: 3067 - DNA, 7399 bp, Heterodera glycines
tctcactctctcttctctattctctacctattatcacgctctctctctctctcgctctctcctctccctctctcctttctctcgtctcaaaatcacaaacttctttctctgttgtggcttatgcgcttgagcaaaaattacggtactccaagaaataacaaaatttaataaaaaaaaatatttattttgattttatttattcttattttcaaatgaaagatttgttaaaatattttttacccaaacttttctccctaattcctaacatttttgaaaagctaaacttattgggtcaatggaaaatcgtacaatcaactcgtattttacaaaatgaagcctacgagttgaaagagagagggcagagtggagagagcttggtgagagtaacaaaaataaaaagaatggaagataaggagtatgggatagaaaaagagataaagggagaagaaatgagatttagatgaagaatacaatacattaactattgaatttttatcaaagttttttaaaaaattatttgaagataaaatagagcggttggtgacgcaaagcagcgcctaactaaacgttgatatttatttatgaggcgtttatgaattgactaatatgactagaggagttgcaaatgtcctaataaagacggaaaaaaattctattttattgttaaacaatttttaatacaaaatttttctttaactgtcgtaatgttcactgtccagttgtccggttttgtccaaatgacttcattgtccaaatatcctggcacgtgtcttttgtacgagtcgtcatgatacccaaacttatttatgccatatttttaaatcagaagccttgaaataaaaatattttaattttatttggttttgtttcctttaactttttcctttttactttcattcttgtattgcttttgtcttcataattaaattaactttattaaaacaattatttttcaataattttaataatgaaacggcaagcaactgaaaatctgcaggaaattgctgcaaagaaatccaaattgtaaaacaattttttaaattgaatctctatgaaaaaacaattttttaaaggaacgagcccgcgccaattcgagcttctttcgaactttattgggaagggtaacttaaactattttattcatattttttatttaatttttaaatattaattcatattttaggctgtgaccttttcgcaatattggcaagggtaaaaaataattaattgttatgataatttttatattttctttaaattaagagacctggtcagtaatgtttctgatcacaatttcgccaaatcgtaagtcagtgggttaagaaaaatgtagagttgagcggtaatcggtaattgcaaaaaaaccggtaccggtactgaccggtactgcaaaaaccggtaccggtaccggtaccggtaccaactttttcaaccggtaccggtaccggtaaaaaccggtaattttagaacataaaaatttttggacaaaattttccaaatacaaaatttttattcagttttcgcgtgagtacctgttttttagcattagaattgttcagaagtatatgtatattcaggttgaccaagtttttttttttcaaattcaggacgtacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaagtcccatttcatttttaaaatattgcttctctggatcagcattaaaaaaatctaaaaaaattcaggtaagcataactttggatgctgatcaaaaaaggtagcaacaccaagttgatcagatcactccttcatggtgatctgatcagcccattttggctgggaacgaggggtaaatttcaaaaaaaatttctagggggttgggaaaatttttctggaaattttgagtaggcccattttatagagcacaaaatttgctaccgaattgcctttggaatagtgggtctacgatttaggcccgctgagatacgtcgacttttatttcggtgcctataaaaagtactgtatttcttaagaaaatagtgcattttacactacgtcaaaattgaagtgcccatacctcagccggtataagtcatagaaacatgcggttttttgaataatcagcggccaattttccaattttgcgaaggggtctccggccatgtaaattaatgtaaatcaatgacctttttttgctttcaacaccgctttttacgcggcacgttttttccaagacttttgggggacaaggagggccggcggtgccgataggcgccgccgggaaaaattttgtaatttttaatgcgatttgttaacagaatttgtaaaaaaaatgaacaattgattaagttttgggtttttaggatgcttaacatgaaagaaaaaagttggaatattttttaaaattaaaattttaaattttttctcaaaaatttcttcttcttcaccaatttcctactcttttctcgaccagacccccattcttaccagtgcaaatttttaccggcggtaccggtactagacaaaccggtaacggtaatttcatttttgaaaaaaccggtaccggtaccggtaccggtaccaaaaaaaccggtaattaccggccagtaccggtaccgctcaaccctaatttgcagttccctcttttccttgccaaatttggcatttattttccttattgccgtggactatcagtgccaatgtcaccaaacgaatgccattgtttttcgattgacgtaaaaggtgcacttttatggaaattggaactcacttacctatgtttgtttgttgctcatgtgacaatgtgtaaaaagagtacgaataaatgggaaattcaaattaattttatttccttcgacggcaccggcaaaaagcgttcttcgcatttgaccatttttaccttttttttaaagtgccaatttaagttgcgtctaaataaatgtttgttcgtctcgtctcgtctctcaatttaataataataattttttaaaaatttagtctcatttttatttttctcatttttgaaactttgttatgaaaaaggggtaatgcggtgccaatggtgggaaagtgtgagaaaaggcgacaaaattacacaaatataataataatttgcctggcgggaaacttccccttttggccttataattttggagcaattggccagccgacgagaacaacaattgccatttgtataattatcattggcataatctgtgccttaatttctgtaataatcttaaattttaaattttttgccccaaattccccattaattaattaattaatttagcgattaattaatttctccttttaattttcccattcttcaaaatgtcctttcttttcggccattgtcctttttctctttcccttttttgcttcttctttttcctctgcttttcgctgctcgttttggctgatgaatttgccgaaaatggccaaaacggcgctttaaaaagccaaagtcagcccaaggaaagacggctgcgaaatcgcccacgcgactttctgtcggaatgtgtgacggggtaccgggaacggatcgaattccattgccaattcccgaacatggacaagccttgtctgcgcgaaaatgccgaaggtgtgacgacgttggcactcaaattcgttttttaatggcgatggggcccatattgtcctcaaaatgatctctttcacccacagattccgtccatcagttggacgtgttggctgccgagtgctgtgcctcccctcgcctttgctccgtcgatgacattgagtcgttttgctgtcgtacgatggactgcttgggcctgtgctatggcgactccttcttggcacaaattcaaagccgcttccgttatgcggacattttgctgaaacggcactcatcaaaaggggcggaaaagaggggacgaagaacgacggaggaggaggaggaagaaaaaagagatgaagaagaagaataatgagatggacgatgaagaagatgatgatgatgatgatgatgatgatgaaaatgatgatgaagaagaagaataatgggacgaccgagtgaattttgaggggagatagaaaagaaattttgcagatcaaaatttacaaaataaactttataattatttatattaagaatacaataaaattaaataaacagctgctggagtgaatgtctaattctttcacaaattcaaaaaatttcgttattcgaaattaaatttgtatcagaattcttaaatttataaaatttgttcaacattttaaacaaatcctaccaaaatttgcaaaaaagttttcttgagctgtcaatggtcaaaaaagcgtgttcaaaaaatttaagaaaaaaatccacaaaaaactgaatttgagtgaggatgctttggctgggaaattgatttgaattaaatatattattatattgtcaatatcaatctttatattaaattttgataaaaattcacaaaaatcacaattttaatatttaaaatgtttgttaattagttcttaaaatcattaattttctgatttaaatgctgatccttagttcatttttgaccagctgacttagctttcgatcactttctgtcttcaatttccatcagatgcttttgagtatgtgaaaggacccgcaaattttgtccaatattaaatttgagagaaatttttgacaaaaattgaaagaaatcgtcggaaagataaaagaaacgtcaaaaaggagcagaaaaattcttctgctgtttataaaaggaagtcaaagaggcactaaagtattgttgctattttttaattttactaatgataaaacaattggcctttaaaaatcactagatattcgtttttttgtgactttttcggcctttttaggtgcctatttcgcgattttttatgcctaaaaacgaatccctaataatcactaaacgtaaagcaattgaatttatgcaaatgcagcttttaccctgcactgtgaaaatcaagtcaaaaagctgatttttaatttcagaattccattcctcatccggcattttttcggctttagcctgcggctatagctcttatgaagcttctcaaatttatttaaacagtataatttgcacatatgattttgacatttctgtaaatttttacaaattttgtatttcttttcagtatattctccctcttttaaaacggcttctttagcctcttaaattggaaaatttagaaaaaccacttaaatggaaaatcttagaaattaagagaaaatactttaaatttcaaaattgacatcataattgttcaataatttcatttaatacttttaattagagtgccacgggaccgggaattttgggcaaacccgggagagtcactcttcccgtttgtagaatcgccaatttttgtctggtaaaaccagtactcaagcggcgactagctaccggtaaccgcggcagaaccgtttcctctggtactcagatatgcacaatagaccacgacgatgcaccacagccaatgctgacgaataaccagcaaaataataatcaaaatgcacaactgcctattgtcctttcataaattgtattattaaatgatagttaaaaaattaataaaattgagttaaaaatatccggcatttggtgtgctgcctatttttgatcccgaatcctgcgtgtttttttttaaacgcgggacaatccagcggaaataatagtgactccctttgttcaaggaagcatcttttctcaaaaaaaagtactttctagttttttggcaattctctaaattagagttgcgctccgacccctcgggggcaaaatatcgggggcggggatcttgttaaattgtttatttttattttttgaagattttctcccttgcaattttgttttagtttctgttagtttttgttttgttggttgacttgaatgattaggaaagcatcaaaaattgtttaattttagaaatatttaattcggtttttaagaagacaatcatttttctaagtatcgggatttttgggtctcggtatcgagtctcaggatcaagtctcggtcttggtctctagtacatattctgtgctattatatgtgccgaagtattcaaatatcagcagagttgccggatacgaatggatacgtatgaaattattatgagagcatatccgcttttatgaacaaagaagctatagtaagtattttcgtgatcgaagttgggataatgtaaaaatttgtgagaaaaaattatttgatatcgaaacaaagaatttattatcgaaccaatttttattaatttaaatttccaatgtttcataaatcctcaaacaagccgaaacccatatttaccatcgaaagctcccccaactcgctcattcaagcgggtccaacagaatagcgtcaatacctacgaaaggcggaaaaattaaggagacatttaatttccgtattatatgtaacttttcttattattatggattattaaaaagtaataatgacactaaattataagatttatcaattggaactttttaatctttcattaatatttgttcaaaattgtatttttccgtaaatttttgaccccaaaaacttctgaaggcagcgcctccgccatctgtcccaaggatttgagtgagtgattgagtggggcactattatggtaatatatttctgctgcaacagcaggtgagttatttggtccaccgccgtaaaacaatcgctttttcttcgccatcgctttggatgtcgttgacatggcgaatttgtccgcgacaggagcgagccattggaaagacactttttggggcaaaatggaacaaatttggtgataatttttgttgagattgagtcgcccatatgtatgtggtatttgtgtaaactgaaaatagtaaactcatttttgggagtttgatcacttcctgtgaatcaaataatgttgtcccgttaaatttatcgaaacccaaaaaatcaatattttgtatgcctaaaaatctgaaaaaattcattctaaccgaaattttgatgctgatcaaaaaacattttaatttgaatagatttttatgtaaaaatcgagtactgaagtgtccattttcaacggacactcagttatccattgtcaaaaaaaaaaagaaggaaaagccataaaatccaattttacttggtaaaaaactaggtttggctgcagataaagtcatatgagaatgtataaaactatttttaaattccgacaaaggtaaagccgatgcccggagggcccccggtcgcgaaaaagcccatgcgaagatgctcctttggctaaaa

SEQ ID NO: 3068 - DNA, 737 bp, Heterodera glycines
aaaaggaattcagtgccgccgctttggacgcttgggggcacaatgccgttttcggcagcttcaatcggatccgtttgatgtgttggaatcagcgaagaggagcctgggacgaggcaaattcgttgatagtacgaatctaatacaaaaataattacaaaaataaatttttaaacaaagattcacaatttgtacacggtgtgctcattggcatggaaaagtgatgggtcgacactgatttgtgccaacattttgggagcagtgattgccattgactgcgcgatgagagtcagtggcaattgttaaataattaatattaattatatagaattaaatcaataattgatccgatggaatctttgctttaagaaaacaatattacgaaatcggtttgaagtcactttcgtttcgccatcgcaagccataatcaaggacctgaaattggaaaagatgccaaaaggaggagacgaaaatggggaggaagtgcaaatggacggagttcagcaagtaattaagcaaatgactaaaataattgatcgtcaataaacaattgattattattgctttaacatttcatatgctttttagagttgcgtactgcgctcggccaagggccatgagctcggcgacattcgaattatgggtaatttggcaaaaaaaaagcaaaaaataattttaaaatgtttaaattaggccgagaaaaaggctatgccatcgcatacacaacgtccacactgatt

SEQ ID NO: 3069 - DNA, 1639 bp, Heterodera glycines
cttgcgcagctcggacatggtcccaaactgaatcatcttttttgcaattaattgaagtggagttaattgaaggttcccctattgattggctcgagttgaatgagcgtgccaacaaattgctgttccgcgacctccgtgccgcactccatctgtactcgttggagaatggcatcaccacgcatttggtcggccattgttcctatgttcaatgggtaaataagcaaaaaataataattaaatgtgacttattataaatataattcaaaggtgccgcgtagtgacgtaatagtggcacaatcgaacgaacaaatctgtgtatggtacggtaaaatactgtaaaatattaaaacaattcgatggcattaaaattattttatcaatattccattttttgttgaaggtataacactgatgagcagaacggatcgacagaaagagttgtccattttacagtacaaggcgaagttgaacaagtgatttatggggaatttattttccataattatttttaatttttggcaattcattccaatttgtcctaattgctctcattaccttctcaggtcgcgcgcgatttgtcccgcacagaagtgattgttttggagaacggcgtgcagcgggtcgcctacgagttggactcggcactgatcgagttcggcacggcacttgacgagttggacttgggcagggcggtcgcttttctcgaacaaagcgaaagacaaggcgagaaattggtccaagcatttagcatattgtaatttcatttcaatttcaggaattgatgtccaaacgatgtggcgccgtttggcccaagtggcgctgcagcacggccaattaatggtggcccagcggtgcttcgccagcctcaatgacattgtccgtgtccaattcctgcaacagacccaaatgagggcggaacgccaatttggggggccaatggaagccgaggcattggccgaacactttgaggtgggcaaaaaagcagcaaaatttggcatttatagtatttattaattaaaaaaataaaaacgaccaaatgcgaaaggtccgagctcgactcgcaatgatggccaagcagtttaaaatggcggagcgaatttatttggaaaataacgcaacggccgaagcgattgccatgtggcaacggatgggaaattgggaccaagtaatggaagaaattaattgaaacaaaattttaatacccttttttaattgattattaaggcgttggaattggccaaagcagtgaattgggccgatttggaccagcttcaagccaaacatcagctttggcttgaagagacgggacaaatgggaaaagtggcggaactgaaggcaacacaaaaacaaaaagccatttaatatttaattagatataattaattttaaaaatgatttaggcacgtgagggccttttgcacgaagcattggaaatgtttttgagcgccaatcagccgggaaaagcagctgatttactgttggaaaacaagcaaatgctgcaaatggaagcagaacgagttggaaagcgacaataaaaaagcaaaagattaaatgtttagcttaattcctccgaggagggcgacgaacagccaatggtcgagcggatttactcatcgctggcccaacacgaacagctgga

SEQ ID NO: 3070 - DNA, 1192 bp, Heterodera glycines
aaggcgagcaattatactaattaccaatgctaattgaattggtggctaaacacacatttaggcaggccaaatgtttgaagctgttggccaattggagagggccttggattgctttcggaggtattcaaaattaaatttcaagaaaatatgaaaattcaggggccattcctacgcaaaagccatccaaattgcccgtgtggaattccctgaacgcgtgctgacattggaatcggagtgggccgattggctgtttgagcaggccaattacagccaagcggtaccgcattttcttggcaagaaaattcaaaaattaaaataatattcaaattaaataaatgtttagaggctggcaatttattacgtgccattgactcgtcaattcgttctcgggaatgggaaaaggctttggaggtttaaaagtaaaagagttcaaaagcattgtttcctcgttaagattttacaagttttggagccatcggatgaaacgaggcccttttatggacgcattgcgcaacattttgaattggagggccaattggacaaagtgtgccattttcaaatgataactcaaacactttcaaacctaattcgtttttggctgaacggctttacgtcgatgctgccaatttggcgggtgctgtcgaaatgtacaacaaagctggccgatgggtggacgcatataagtcgagaatttgggtgctcaaatttaaaaaaactctattttaaagattggctttggaattgttgggaccttcggaaagccatcagctttatctgggaaaagcattggaacttgaagaggcgaaaaagttccaagaagcggagcaagtaaattacaatttgttgttggcaattaactcactaattaagctttacattgcgcttggggagccaaacgcggcgatttccatgtataaaattgctgatcgaatcgacgatatgatgcgattaatggggtcgtaaaatgaaataattctcattcaaaatcagtaaaattaagcgaaattaattttaactttagccgcttccatgtggacgaaatgcaccaggcacaccgaaggctggcccaagaattggaggagaaaggcgatttaaggggagccgaagaacaatttttgctttcgggtaattaataacatttaaatcaaattaattattattattattattattattattatattattattat

SEQ ID NO: 3071 - DNA, 969 bp, Heterodera glycines
ttagtactatcgtactaatttttaattaatttttaaataattaatatttaaaggactattttcctaatctaatcttaatttcaaattatgaaagcaattttaattaattttatattaatttatattgtataatttaaatttactaatttatttaaataattaaagtaattttaatttttttataaactacgccttgttgacccatttgactaaattttggccacctaattcggaccagggacgggtgagtttcgaatttcgagcttcgtacttcgaaaacttcgcatttttggggctagtacttcatactgcgaaaaaattgggcttggtttcgagcttcgacatcaaatgttaagccgagcttcgcccgtcgttgattttgacttcatccagcatcggatttttccacttagtaattagtattaatgactttttactgcattttcaggttgcttaccaatgggccaaaagtttgggtggcgattcggctgtcaaattgttgaataagcaccaattgttggaggagaccattaatatggcagtttccaaaaagtgcaacatttataaaaaaatgaataaattctattttttcgcagtgattttgactttgctttcgaattgtgtcgccttggcgcttcccatcgatttccattggtacaacaaaaatttgcggagaaattggaagacgacgcaaagtttgaacaagcggaggaaatgtacttaaaggtgtatcaattgtaaattgccttgttaattaattgagacaggacgggactggggctccgccgggattttgccgggactcacggccccgttttttgagcgtaacaccgggaaaataagtcccgaaaaaacggaagttccgtacggcccttcccttccattttattgttgaaggagtttcggttcctcgtcatgatacaatatttattattttaaatttaacaatctataaagcgggatacaatt

SEQ ID NO: 3072 - DNA, 6018 bp, Heterodera glycines
tgaggaataaaaatatttttatctggtgctatttcgagaccgcgcacttttttgggggggggggctacaccaacaatcacggactaagaagatggacgacctccttgaacttgttgaccaattcttgtccccttgatgcataattgcctgtgaagcggcaaagcaaatgctttggttggccatcggttgtcggcgtgtgcaaccatttggacaacacttcgccagcagttgcattttttccgtcataagcaattggagcggggaacagacgataggaattgatcgatttcagttgcgtcagatcagtgagaattgtcggggaaacgaaactgcgcaaattgttcaaatttgcaggcgaatagaaggccaaatgacgaatggttggcgcaaaaatgggccaaatctccctgaccaacacatcccaaatcgctgttccagtggacgcgtgcaatttcaatttggtgccccttcggtcaaagatttgcttgtttaaacggaaaaattcgatgacagtttggtcgatgtatctgcgcaaaagtggggcaacaacataaaacgcgttaatacacgtgtcccgacatttgaagcacacaaatatttgtggagcctgtaaggctgaaacaaatataaacataattaaagcatttgataatatctttatgagaagcaagtacattccatggaaaattttgactgatcaagggaaagaatttacagctcattcagtaaaaaatattttgatacaaaagatgttgaacatttttgcatgctgacttcccctcaattccacgctggtatggctgagcgtgccaatcgtagtataaaagaacgtttatatcgttacttcaccgaaagagacacttacaaatggattgaggtagttcaggacattgttaagggcattaatcagtctataaactcctccattggaatgcgacctgctgacgtaaattttgaaaatgcagaggaactgagacaaaagttatataatgaagcgaaaaaatttccaaaaaagagtcctaaattcaaagtgggcgaccgtgtgagaatagaaaaatacaaacatgtattccaaaagggttatttaccacgatttaccgatgaaatatttacggtagcagaagtacatacagaacgctcgcccgttgtctacagattaagtgacgatagcaacgaaattataaagggatggttttattccaatgatttatgcaaaattctcaaaaacaaagaatcactatatgatattgaacaaattttgaagaagaaaaaacaaaatggtattgaatacgttctggtaaaatggaaaggatacagtattaaattcaatagctgggttccattgagttctatctccgagaaaaatatataaaaactttattgcgctttatcttttaaaaaaatgccatccaattctttttacattgttcttccttcaaatacaaatgttgaaggtatcaagacaaattcattccgggttcgtttaccacgaaaactacaattcaactccgaatgggaagttggactcgctgttattgtatatcctcatacttggccttcgattggtactgttgaacagcaatttgtagaagttgaatggcaaacaggaaatacggtgcgtattgaagtaccaccatcgaatgtcacaaatccaattgacttgggtaaaagtctgtataggctcttagacgaaggaagtgaaccgttagcaaaaaaggtacgaaccgcacagaattctttttcgcatgctacaaactctgctcgtcgtggggctagagaagaatacataaaacgaaaaacgagagagaaacgaagtattcgagatgaagaaaaacttctagaagccttattgacggacattgaaacaatggttgacctttttggtgtgactcaaagtcttttagcgcgtgagaagcgcgcggagacgagcaaaattccgttgagaatgtctgctgatgacaatgaatcataccaacataaattggatgaatatttttcaaatttaagtggtcccgatttggacatactcgaagaaatgatcagagcaaaattgaacgaagaaattaaaaatatggtagaggaggaccgtacaattcttgatgcaacgaaagaaatgggaatggaagcgtgggttcaagcgtaccgtaaagttaggctcgtttgccgatttatttttgatgtcaacaaaaatcgtttcgagttaatatttgatcagcgatatgtaaggagggttaaaatttcttcacaacttgcgtatatcttaggctttgacagtacagattttacgacatcggaaaatgaagcaaaatttatgccagatatgaatggtggcgtatcatcttttcaagtttatactcccgatctcattgaaccaatgatgattggtgatgtcacagcaccagtgttacgcatcgtcacaattcgaggaaaacctgatgaaatagttgaagaacaatttttagcaatacaatatcacaaaattttaattaaggaaatttctgaactcctgatcgaaattcgcacaaatagcgggagcctaatgccattccaatatggaatatgtacattaactttacatttccgaaaactgtcctacttctgaagatgaataccttggaaattgataaaattttatcgacaagcccactcacaaaacagacttatatcggctgttttgcggctgaccagataccaaatatggaaatggtaaaatttccaaattgtctggtaatgaatattgacccaatcacctctaaaggatcacattgggtttgtgcttacagtccttctccgtcacacattgaatactatgactcgttgggcatttggccaccacctagcatacacattgcaaattatttgtcaagattcaaacaaattcgttatagtataattctacttcaatctcccaattcaagtgtgtgtggtcgtcatgtgctcttcttttacgtttgttcagcaattaaaagtgaccgttggaaacactgaagtttacgatagcggaaatttatatccatacaaagcctacattaccaatgaattgagctttccagtaaatgcaaaaaagaactttctcggctcaacgggatattatcacacggaacgtcacgatgatccaacggatgatggatttaaagaacgttgtaaagtttttaaaggtggtaataatgcacagttcctctctcgccttgactttgacttgggaaaccaagaactctacctgttaaataatttggatttgttgttcacaatttacaaagcgaaagacgcatttcttttgaaaacacttaaagctaatgacgacacaaagtaccgtttgaccgtgcacgatgttaaaatttacgctaaaatgattgaggttcagccctcactcaacatgaatctttacaagacactagaaaagcagccggctacttatgctgttcgtaaaaccgaaatcaaatcttcatacattagcagtgggcgctacgaatttgaatacaacgtgttcagctcgacaatacctcgtcgtgtaacaatagcgttggtcagtaactcggcttttaatggtgattacaaattgacgcccttcaagttcgatccatttgctttgcgagaaatttcagtacatgctgggggcatggtctatcccgttgtaccacataaattaaatttttcaaagaattactatgtaagagcattcgtggagatgtatgaagcgttgggcatggctaattcagaacgttcatttgacgtttcaatggatcaattcaaaaatggatgggccttttttgtcatctctttgaattcaaccttagacgatagctgtggatttgagctgttgagaagcggtacaaccagtattagggccacatttgattcaccaattccaaagggaggagtggaaatgattgttctcggagaatttgaccaaatgattatgattgattataatcgacacattgtctccgactcgaagcttgggtaaatttataaataaagctcaaaattatattagagaaaaatgaataacacgacgaaagaaggaattgaggtgttacgttcatcagatgagactaatgacactctttttcatcttttgctcctttcacattatgcatttgccttccctgtttttctactctgttggttcataataattaaattcctcaagaggagaggtcatatatccccaagcgaagcggaaaccatgattgaagaaatgaaaaatattcaaagacaaccaccaatattttttcaatcaaagtagtgtaacttactttttttacaatgcattatttttttcttataagaatttggtataattttaattgttattggaattttttttgttaaagacaaatttttaaacatttaacagtttaaaaataataaattattgtttataataaaacttaattcctgttattaaaaaaaagtttggtctctcgccgccacacgcccgcctccgcagcgcttgtagtgaagcaaagggaaaatttttcaccatttagtcaacaattatcccattcctttcaactcaccctgtggccaagtggttaagctcctcgcttccactctcaacggttcgagtccactaccatgtttttgatttttcacaatttttcggaattttcatcataaagtcaacaattatcccatacctttcaactgcccctgtggccaagtggttaagctcctcgcttccactctcaacggttcgagaccgcgaccatgtttttgattttccacaatttatcggaattttcatcataaagtcaacaattatcccatacctttcaactgcccctgtggccaagtggttaagctcctcgcttccactctcaacggttcgagaccgcgaccatgtttttgattttccacaatttatcggaaaaagtcgcgcacaaaaatatttaaataattaatttaaatttaaattaattaaattctcgcgcacaagtccatccaataggtttcggttgaagggatcaaagatcatccaataggtatggggcagggggggggtccgaaaatatggattgaaaaaaatcgataatcaaagtactcgtacattgtagtctcttaattaaaaaaaataagtttatcaaaattaaatgttgcaattaaaaaaaattttttgttttaatttttaagtatcaataaatgagggaaagattaaaacaaacaagcaaattataaaaaataaaaaatggaaaaaattaaaattcaatatttctaaaaaaaatctaactgttttctgaaagtcctatgaatttgagccaaattttttttataaatatacaaattaaaatttaaattaatttattaaaaattttaagatttaactaaaatttatctcttaagaaaagaaaattttatataccgaagatgatgatgaagtatattttaaattgggtctacatttaaatataaaataagataaatgcgaaaaaaataaaattcgatatacctctaataaagccatgacgaagcttgattgcagaaggaacatcgtgtatcgatcacaacgtgattttataaaatattaatgatttaaaatgataatatatttaaaagaaattaaaataaataatttaaaaacaaaaattataacataaaagattcaaaatttaatttcttcaaaattaaagaaaaaaattattaaataatgaaatagtaagtaaaatttacatatgcgtcgacatttataaaataattcaaatttaggtgaaaaagaaaaaaaaataattttttaaaccaaaagattataataaaaagtcagtataaaaaaataattttataaaggaatactgaataccgttgaaaaatgcaattaacagtaaaataaaattttcaatagctcattttattataaaaaataaaatttttgttttccagcatgaaaataaattactttaaatttagcaattcttcttagagtgttaacagcatttttcattgcatagaatttttttctgctcatttttacaatattatggattttctaatactattcgaaagagaaatatgcaaata

SEQ ID NO: 3073 - DNA, 1566 bp, Heterodera glycines
taatctgccaaatgttgttaatatcgctttagtaaaatttcagctaaatatatagtatatattttaatacaaaaacagaggtataaaattttgatctaagatgcagttaaaaaattatatttcaagatagaattttcaaataaagatattttttatataaatgtagagaaaacataattattagtaaaattaaaaaaattttacaacaaaattttttaattttattaaattatgcaatattcaaaatagcaaaattctcgtttaaacaaatcaaataatgaaaacattaatacaatttccaatttaatttaattatttttgattgcgatttgccactaatagcagccacagcaattgtaaccacgccctgctccatgaaggaacagcaaagattcgtcatgtcaaagtttgaggacaacaacttgtttgatcgccatggctcatcaacaccactaatgaggactgcagatgtcccacaaactattagggcaattgaaatgaaacatgtacactctacaaaaattatacttttgacaaatcaattaaataattttcaacaaattaagaaacaaaataaaagtgtctttgaatctaaacgacaaatattgaacgaaaaaataattaatcgcggaaatttaatcgctataattcaataaccaaataattttaaaaaactaagaggtaaaaatggaactgaaactaaaattatttattaaaattcattgattgcaaaaaaatacggcgtcatttaaaaaaaatatcatgcaaattctatgggaataatttttgcagcaaatttttaaatatttaaagaaactaaattataataagaaaaaaatattataaaaagcaaataaaaagaagcattataattgatactatcatattacatcggccggcggactgttggattttggacgcttggggttttttcattttttttgcttttttaatttaattttttgcagtgggatgggccgctgcctttttgcagctggagggcagtgtgaaaaaaccgtgttgcagacaaaaacggcaacagttgcttcatcggtcgccaggatggccacaccaagggccactgctccaacaccaaattggtggccgaatttcaaaagttcaagttttttttcaaacatacattgttgccacggaaacgccgaagaaggaggtaaaaaacatataaaattcaaaaaaatttacaaaaaacaattttgttagccaccggttgccggctacgacttcgtgccggcaaaaaaggctgaggaaatgtacaagtgccatggccttacgcagttcctcctttgcatgtacgttttggcaattttttcgatttttttatgatattcaatgcaaaatgtgtatttacaggggtacccttgtaaatgtatccaaagtttatgaatttagtggccgcaaaattccgctgctctattggttcgatgaagagaccggcattgcggcactgcacctcacccaccgccccgtcctccacggccccctggttcccactggggagccgccgctttcgacctacaaatacaaatgagttgggcagctgcctgc

SEQ ID NO: 3074 - DNA, 1112 bp, Heterodera glycines
cagtttgatttccatcaggagcaaaaaaatagaacagcgagcggcaccagtgaattcacatgttcacgctttctatgcttggacacttcatcgagtttaaaatataaagcttataaaagataaaaaacatggaaatatatttataactatataaagcaattttttatcaatcatattataaggaaatatatacgttcgttaaccatttaaagaaattaataatccgtgtcgagacaaaataaagcaaatacgcaccggttgtagaacaagaaatttataaaataacaaaagattgtggatataataaaaaataaacagcatagaattattgatgattcaatagaacaaggatatcattacaaacaaacatttaacaaaaaattaaataattttcagcaaattaaggaacaaaataaaaaatgtctttgaatctaaacggcaaatattgaacgaaaaaataattaatctcttcaatttaatcgctgtaattcaatattcaaaataaataaaataagaaagcttcattaaccataacaatactatcaatagaaaagatgacagttaccagtcccatacagatttaattgaagaataaaaatctcttatttagtttaaataaatttgataatcataacaagttaaaacaaaataataacaatgaattttaaaaattcgctacagaaatattaaatatcatttttgaaaatattatttaataatctatgaaaatcttttaaaaatttccacgaaaacttaacaactggataatctcgagggtctcgactcttaataaaaaaaaataagtttatcaaaattaaatgttgcatttaaaaaaaattttttgttttaatttttaagtatcaataaatgagggaaagattaaaacaaacaagcaaattataaaaaataaaaaatggaaaaaattaaaattcaatatctctaaaaaaatctaactgttttctgaaagtcctatgaatttgaggcaaattttttttataaatatacaaatttaaatttagattaatttattagaaattttaagatttaactaaaatttatctcttaagaacagaaaattttatataccgaaagatgatgatgaagcataattt

SEQ ID NO: 3075 - DNA, 3632 bp, Heterodera glycines
  misc_feature (1006)..(1006): n is a, c, g, or t
aagagccggaagagcatcaaattttgagtgctattaaccctttaactctgctggaagcagagccagcaaattcattttttatgcgagttgagttcggcacattctgatgattgctgtttgatccgttctacaaattccattatttgttgctcatgacgcgaactttgcgtggattcaatccgattgtaaattcaaaatagtaaatttaattaaataatttttataaattaaatgataaattttagttaaattaaattattaaagaatattgcatatttgatttatttatctttgttttttatgcctttttcaacattacatttctcgccattattgcatttgtattctttcatcaacgaaattgcgcggcggaaaaaatttttgcactttgaattttgaaagtggtacctttttcggaattggtcaagagctatgataaccgacaaaaagtgcaaaaccatggactcgatttctctaatgattttttgtcagtcaattatttgcctgtgcctttttattacatctgaccattagcataattacttgtgcatatatcttttttatatcctattttgtccaaaatcctttttttttgaaatgtctactttttttattccgttttttaatttgtctactttcacaagatctgaggccataattgcaatgttggcacggacgaatgcaaacagagcaattgaaggaatatttagtagaacttcatctgttaactttaaaaaagtaatttttttgaaaaattattaaaaattattgggttttttaatagagtttatcgggcgggaccgaattgagccgggaacttacggtcttcctaagcgcaggtcacggttttcgcaaaattccccgatcccgcccaactcttttttttacaattaaaatagtaaaatgtaaaatgaatgaaatataaaaatattaatttattatgggatagagatggtgaaacgaagaatatcaattttattaaatttgtgaagataatgcaaatganaggaggcgcaaggaaaagggcaaaagaaagattgatcttgtcgagagtgaggcaaaatgaataaaaaaatataattctattttattaaaaaacctatattatattgcatatattggtgttcggatttatatttatgaaaaatgcgaaatattttaaaatttgccaaaaaacatcaaatatttaggaattattgaaaaagccaaaaatatgaaaaatttaaccattattagagaccggcggacgggctcgggcgggtgcatttcattcccccccccctgtcaagaaatggtttcaaaatttaccaaatatagaatttttatatctaagtatgaaaaaattgaaacccacccacaaaaaagttgtaaaattcgcctttttcaaattataatgggctcgatcttccaacgggcttttatcaggccgccagtgctcggatcgtagcgaagggtaaacacagggaaatctttgaaaacagtaccgcaggtttaaaagtaataaaaaataacatctatttatatggcagcacccttttgcaaaatttttggttgaccccccccccaagtttaaaaaagtagtttttgaaataaaggcctcttagtcatcacaaactgaaaatatatttgcaactgaatcaaaaaatacgagaaacgacctctttgaaattgttggtccacgcaaagtttctgcctggtgattgatgcagaaaacccaaaatttaagcaacgcattctcttcggttgtccgtcgctggtcggaatgtgcaaccatttggacaacacttggccagcagtttacagttggcccataatcggcaatttttaataaatgaaatttatcttgtgaaataatattttaattattatataaacgttatcaatgtaatcagcccattttatttaattaaactttattttacaacttttatattttaaactatttttataataacgatttttatttcttttcttgaaaaggttttctaagtgcattatgatatttatgttgtttaatttaatgttttataatttctttatcgagcaaaaatgagaaaagcttcagaaatgatcttaaacatggatgttttttcttgtcattgctatcttgtttcaatgaaaaataaagattataaaatttaattttgttaattaaatttttgttaaaatttaattgaatttttttttcttttcttgctttggtacaaataaaaaaagatttttaattgctttttatcatatttttgaaactttgtgtttaatagaattaaaattgtttcaactattccagatgaggctatcgaaaataatcctcttctttgtttagtaaacatgaagtaataataaataaaagatgaatctaatcaatgaatatgttcactattttagatcaaatattattttaatatataaaatttattgatcctttgtccttgggtccttttgtttgtggaatcttattagaattaaaaattcacggcactgagctagctataatacattaaaagcattaaaaacccgtctcggaaaaaaagacgggaaacttaccgtggttttccttaggaatccgttctcgcatacaaatttaaaaaagttaagaaatataaaaaataaataaatacaataaaaatgaataaattggtgaaaggttcgagttaatataatgagcatagttctccaagtttgactatttacgtaatcttatgataattaaaattaaattttattccatttttattgtaattttaaatgatataaaaaatattaaatttttatttaataataagaacaattatcttaaaaagtcttttttgccattttaaatgcattagaaaatttgccaaaattcgattttgtaaattgacaaaattcacaaatttgaagatattcaatttctttgatgcttgatagtttatttcttgtataaaaataaatataaattgttttcagaaaaaatatttttaaaaaaatattttaggtttataatatttttagtgacccattagggaaaaaattaaaattctataaaaatgtaaaatttaaaagattgattttcaatattctttttattttttcacttatcatattattattcattttaaaaattttctaataattattttccaatttcttatccacaattgccagtaaaaaagaatttttttaaatctttaaattttttaaaggtaacgagggatgcctacgagcagcgcattgagcgtgtcaacgtggctggcggaaaccgacgcgtgatttcccgcgaggagaaagccttgcggccgcgctcatggtggaaggccacgagcagcgcacctactgatcggatgtgaactgcctgagcaatgagtcatccaacattgcaaataacctaaagaattattaatatttaatcatttttatagaatttattttttcagaaatagttgggttaatttttataaaaatgaaaattaatatattattgctatgcctattactgattaaaaacactatagatcagattgtctcaatgaaaataaagcaaccgaaaggatttgacgaaatatttggccaaagatgggacgaaagagcagaggacaatgaagttgatcaaacttgaacaaacggagcaaatgaaaaaaataattgcccta

SEQ ID NO: 3076 - DNA, 1282 bp, Heterodera glycines
ttatgggtattttaaggctacagaattgaagcatcattctgaggagggggggggggggggggaagcgttaggtccggatccgggtgaagtaaatgatttttctatattattttttcatgtttataaaacatttaaacgaatttcaatttagaattaattaatttttataatattgaaaaagaaatattttttcgaaaaaaataaaaaattttatttatcccccgggcagataaatagagacggggagattatttttcaagctagttcgaaatggtaaataattgaagacgggcagattaatggagacgaacatataattagagaaaatacggtaattgaaattctatttttgtgttttggaaaaacagaaacaaaatttttagacaaccaacaaaaggtcactcaatttcttttgtgaataactggttaatttttgtagtgagaaaaagtttattgaatttgcctgccgttcttcgtagtattaattttatcttttggttattcagccgcatgccgaaattattaaattagagacaaaacgccacaattggcgcgcaacagttttagacaaaatctctttttttgggttacatctttttcttgcagagaattttaaattactttttttaaatgcttaaatttcagctaaaaaattaactgatgaagaaaagaaaagaattgcgattaaatttattaaattaaaagatcattttgagaataaaaaaatgccaacaaaaatgttagagaaagaaattgccaaaactttaggcgtacatgaacgaacaatttatgattggaagaaaaagtttggagtaaacggaagtaaattttaataacataaattaaataaataaaaatttatgctttattaatcattgaattaagaaagcaaaattaaaagatattccaaagaacaaaaattcaaaattgtacaacaatttgacgaaatcaaaagtcgaaagaaaggtaaatcaatcgcaaaatcggcaaatgaaatggaccatcaaatttctaaggaattgggagttagccgttcaatgatttgccaatggaaaaaggatttttgcatgacaagtacttttgtgaacaaatacgttttctcttcttggaataaaatatttttaaattttagagtataaaattttaaactttttttatttgtaatttattgactatatttttttcaataaatattaatacttttacagttttttataattatacattattattttgtgtttactttcaaaattcaatgtcagtgagtaaatgcaaataaaaa

SEQ ID NO: 3077 - DNA, 5130 bp, Heterodera glycines
  misc_feature (2281)..(2281): n is a, c, g, or t
  misc_feature (4845)..(4845): n is a, c, g, or t
  misc_feature (4899)..(4899): n is a, c, g, or t
  misc_feature (4986)..(4986): n is a, c, g, or t
  misc_feature (4997)..(4997): n is a, c, g, or t
  misc_feature (5002)..(5003): n is a, c, g, or t
  misc_feature (5014)..(5014): n is a, c, g, or t
  misc_feature (5064)..(5064): n is a, c, g, or t
  misc_feature (5089)..(5089): n is a, c, g, or t
  misc_feature (5117)..(5117): n is a, c, g, or t
tatacaaaaagcaaataaaaattccaacttttggatgcaaaagatgagtttttttcctactatttagagcatatattttagaaattataatccaataaaaaatacgggattccgggggaagcccgtttggttaaagtcgcacaaaatttataaaacctacagattctaattgggatcgaaccagtaaattattcaaaattcgaaaggataatattttgtacttaaaaacattttgcaatgaatctcattgagaacggataaacttggctttttacaaaatcattaatattaaataataaaaattaaataaaaaaattggaatatatgaaatattatctcttctcactttttaggcataatttatatctcaataataattttagaaacaatttatttaaagagaattttgttattcaaatcaaaagttgccaattgaatctgcaccaaaaaggaatttcctctgcgcaaaattttttttttaataattttagacaaaatctctgtaaatgtaaattggttaatttatacacaaaattttgtgaatttgctgccatcttttgacttttaaatgtgtgcccatttcggcaatgttttcttttttgcctccgttttgtccctttcacttccgccgtcgctctttgttcagatcagtgacacgtgctcatcgccgatcgaaaaaatgcgattgccgggaaaaggcagcgaataacgcgagaattgcgggtagaaaagccgacgttcgaccggcccattttggacgagttggcggaagagacggatggactccgtgttggtggacggagttttgtagatgaacgagtcgaacttggcggagggatcggggcccgcaaattggagcagaacggcacggagaagagccgaggcgatggactgaagcaaaacggaggagcgtaaagcgggggcaaagaccgactgacctcactgttggcatagaacagactgatgccgagccgatcgccgagtaaatgccgcacttgacataagccgaccacgtcgcccgtctccctgcacacggctaccttaagtcattaaaatagcagcgaatgccaaaaactagtcgctgctgacctttgcggcactttggggaaggcgaagtgcctcccgcaaatacgccgatctgtcaatgcccaccgtctgctgacggtcaaaaagcaacagtttgtcgaacgaagcttcacgccagtccttcagctccacgctcgagtcgtgatccaaccgttcgggtcgcacgtcagcacatttcgcaccgaatgaccacagtcgccagtccaaatagtgatggaatgcgtactcttcctcgtatttgtgccacatttcaggaacttgaaaagaacagggatactgacaaaatcaatcgattggccatcaatcaatttatcagtcggcaaagcgatcgatgggccatcaatcgattaatcattctacggagcaatcaatcggcaaaaaagcatttgcaaaactgccgtatgttttctgacctgcataaccaaatacgggtctgtcccctgcaaattccagcgctctgcgagcgagcgcacggccaagttggtggccatgataagggtccttcacgtagaacatgctccaatgtgccacctgcgggtacaatgccatgctaatgcaacccatcggcactctgttttggtcgaggacgaagaacatgctgaagttgggcccaaatgccttcttccacatgtcatagtcgtgggcggaattgtcccagccaaatttgtcgacaatctgtcaattttagggacaatttgtcaccgacacggacaattaataattcattaatgtctgagaaatacctcttggacaatgctcagaaaaatttggttttcggcacagttacgctcaattcgaagtccggcctttttccatttgggcatcggtcgctgtgccatcgccgcgtcctcgtcgaattcgtccatcgttttcagcgaaaagggcagcggagaatgcgccgctttttgcgttgttgcagcgaagttggcacagttgcggagaggcgaagacactgcacggaaagtaaaggaaaaagtgaaaggagagataaaatggaaaaaaagattaattaatttattaattaattggctatttgagcgttcatttgtgaataatgaatagggatggtgatattttttaggctctaaaaaccgccaaaataggtaggactttaggctctaaaaaaacctaaaaacaggcaataaaaatggaaaataagctctaaaaagcctaaaattagggggggggggagagntgtaaaaaaaaaaatttcaaaaagttaatcctaatttgtaaggggaaatttttcgtttttgttacattttgttaataaatttaggcaaaaacactttttcaaaattttttagacttttaggctctaaaaataaaaaacatagaaaataggctctaaaaactcgaaaaattggcttaacaaccaccaataaaacttgttttatatgtatttcaggacactgggagctcaggaaaaaattgtaaaaacctaaaaatatcattgctaaactctaataatgaataatgaccggaaatcagaagtggagagaatttgttgaccaaatgttgttgaaaggccattgataaaggcgaaaatgcaaatacaacaaaaatattgtccgatttgatcagaatttattgggaaagaaaatgatggattttattggcttttcccatttaaatagccaattaattgagtggggtgagcaaaaaagggcaaatgaactttcgataagtgagaagcaaaggaaggaaaatggagggtaaaagttgcactttcgtacacaaaaaataaaacaaaaaacgaataaattaatggccaatggaacgaacgaaacatttaattggcagaaagagaattatcataaaatatttttatctttttcttttaattcttttggaaattaatgaaagggcaacgaagcgaaaatgaaagtgtaaaggagaagaaaaagtgaaatgtgaaaatggaaaacgcaattttgagagggaaagttggacaccgaactcccgggcattttcaagaccgggatttgattttgaaaatccaactcgcataagccggtagatcaaaatacactgataagggggaaggtgacttggcgtaatgagctttctgacgaacgcctaaatttaacattttttgacccagaaccccattcttaccagtgtacttttggacccggtcgggtacccggaccccggccaaccctaattttgctaacaatggagcacaatcatttataaatttattccacaacattatgacaaaattaaatattaatcaaaattattaaaccatttattcgaaaaaacttttaatgtttttcacaatgtctattgcattttcctaatacataacaaaactgtgacttccttccgtttttcagtccaaattaactgcatagacataaacaaacgccaactcggcaaaattacgtgtcaaaaattgattgcataacaaaattattttttataatagctgatttttcaatcatcaaattaattatcatttttaaaatgcatcatactttgaccattttattgtgctcattagtctcgacggttgcttcgattgaagaagcgaaaattaaaattgagccgaaagaagaacaatttacagcagaaattaagaaagaatttgctccaattacaacagtaaaagttgaactcgaattagagcaaagaaaagcggtgaaaaaagagccaaaagaagaagccaattattacggtttaatggaaagcaaaagcaaccgatttagggaaattgaagagggaaaaaacgattcgtcttgtgttgatcactctgacgaagattcagccaaatctgatcagtccgaaggaggtttaaccctatctgatcggcatacagaccaaaatgggcaaagcagaaagcgaatgaaggaaaatgatcgaaaaagatggaaatttacaaggaatatcggaaaatgaaagaaacaacggcaaaatctgaccctgaaatagcgaaaataatgggtgtaaatattagcatgattcggaggttaaaagaaaagtttggacaaagtgaaaaaattaaatttaaaatgattataaaattaatttccaaatattttcagcaaatttaaaaaaagcaaaaaaactcgcttttttattttgttacaatatattacattataaataaaaattaattttaaagatttaaagtccgaaagaaaaaatgattgtcagcgacgtgaaattcttagcaaattttttaaaatgaaaaaggagcgttttttatgtgatggaaaaaataaaactgtccataaaattgaagaagaaatatcggaggaattgcaagtcacacgaaagtcaatttacaattggataaaaaaattcggaatgaaaaacggtatgatttagtcaaataaaattagtaggatgattctgcatttgaaaatcactatgggatttaaaaacaaatttttgtgggttatttgttttacagaatttctcagaaatacctgagaatctaagagaaatcaaatgcttctaagttgagcttaggtgatttttttactgaatattgtatacaaaacatttatttaatttcggggattaatttttagatttcagactaaaaagataatttcttaaatttaagcctctaaaatatattccgacgaagacaaaagaagcattgtgaaacagtttaagaagctcagaaatgaaaagcaaaaagttaaagaaataccaaaaatgttgggaattggcgttgggaccttttataaatggaaggatgaattttccggtaaatttacaaaaatgtcatatttattttcttanaaagagtaaaaatttcataattttcattagtaaaagcttcttttaagttaattntgttttagatgaagaagacagtgaaaaatcagtgcaaaatgactctaatgaatctgatcgatcgatactacccgaaactgatcagtncgaggaagaanaattnncagaactcccnaaagatgatatgattctgctgatgatggaccaccacccgttgatagcaangcgtgggcatggaaatttagcgtgncaaaaaggaaaaatcatttaaaaaacgnataaaaattaaaa

SEQ ID NO: 3078 - DNA, 1833 bp, Heterodera glycines
ggaaaaaacgattcgtcttgtgttgatcactctgacgaagattcagtcgaatctgatcagtcgaaaggaggtttaaccctatctgatcggcatacagaccaaaatgggcaaagcagaaagcgattgaaggaaaatgatcgaaaaaagatcgaaatttacaaggaatatcggaaaatgaaagaaacaacggcaaaatctgaccctgaaatagcgaaaataatgggtgtaaatattagcatgattcggaggttaaaagaaaagtttggacaaagtgaataaaactaaattaaaatgattataaaattaatttccaaatattttcagcaaatttaaaaaaagcaaaaaaactcgcttttttattttgttacaatatattacattataaataaaaattaattttaaagatttaaagtccgaaagaaaaaatgattgtcagcgacgtgaaattcttagcaaattttttaaaatgaaaaaggagcgttttttatgtgatggaaaaaataaaactgtccaaaaaattgaagaagaaatatcggaggaattgcaagtcacacgaaagtcaatttacaattggataaaaaaattcggaatgaaaaacggtatgatttagtcaaataaaattagtaggatgattctgcatcactatgggatttaaaaacaaatttttgtgggttctttgttttacagaatttctcagaaatacctgagaatctaagagaaatcaaatgcttctatgttgagcttaggtgatttttttactgaatattgtatacaaaacatttatttaatttcggggattaatttttagatttcagactaaaaagataatttcttaaatttcagcctctaaaatatattccgacgaagacaaaagaagcattgtgaaacagtttaagaagctcagaaatgaaaagcaaaaagttaaagaaataccaaaaatgttgggaattggcgttgggaccttttataaatggaaggatgaattttccggtaaatttacaaaaatgtcatatttattttcttaaaaagagtaaaaatttcataattttcattagtaaaagcttcttttaagttaattttgttttagatgaagaagacagtgaaaaatcagtgcaaaatgactctaatgaatctgatcgatcgatactaccgaaaactgatcagtcggaggaagaaaaattcaagaaactcccaaggattgattatgattctgctgatgatggaccaccaccgtttgatagcaaagcgtgggcatggaattttagcgtggcaaaaaggaaaaatcatttaaaaaacggaataaaaattaaaatttagaaactgggaaaatgaggcccaaaggcaaaaacatacaaaagtttagtttttcgaggttgtggaaacgataaaaaaatcaaaaaaaaaatgcagcaaatgtttaacagatttttgaacaaaattatatatcagtggatagaataagagtgatttgtattgtgaaattttttccttttataaatttttttttaatatatggaaacaaaattaagttaataaaaagattcaaatataagaattattttgtcagaaatgacattcttttgatcggagttttgttaagagctcaaaaatgccgggggagtgtgataatcgcggatcaattaatattgtatatgtgtgatgccagaaggaacggagtgtgggagaaagtgggataaaggacctgagagaacctctaaaagaggcgcccgtagctcagttggttagagcacggcacggattgctggggtcgtgggttcgagtcctaccgggcgagttaccttttatgttctacatatgactgtaccgaataaa

SEQ ID NO: 3079 - DNA, 1639 bp, Heterodera glycines
ttggcacattcaactcacaaaaagataataaaatgatacgaaatgtttaaagattaaagaataaactggaatacaatcagtaaataacattcaaaattataagtttgttgacaaaataaatgcgatttgctttaaataatttatttttattttcgttttttaatcagtatattaaattctatttgattatctttgaactgaactacgaattaattgataaataagagcgatactttttaaagatggtgataatattaaggacaattatttaatgctggaaatgaattagtgtatcacgacgaacaaatggaattggaaccatcatccgataagctaaaatttgaattaccaataggcaagaaataaaaaatattaatttttgttaaatattttttcttatggaaatgaaaaaataaaattatttttttgtttaaaatttagttaaaagtatttgcagaaattttaataattaattgtaaagacttgctaattagtcaaatttttataaatcaaaaaactagctttgcaaaaatttgtcaaggcttcatttaactgtacggaggcatttaatctaaaacttaatggttgaaagagggaataatattttttttttcaatatttttttaaatttgaagtacttcttattaagagattaacaacaatgttgacctccctttttcatatcataatgttgaagtcgagcgaatgttagattttgggaatgttaatgggatgccttctgcatctgttcagcacttaactgatcaaccaggtaatagtaagaaaacggtttcttttattttatctttaaatttaaaatgggtttaagtaaaataaatttaaaaaaactaatacaaaattcggatgtcacgcaagctaattatttaaatttagttaacaaacaaaagtatgggccaatttagacccaaacttttgtgcaaatttcaacattgcatctatgcagaatactcaaaaaatgcgaaattaagaaaataaaaaaatgaaacatcattagacacatgctaaaaatcctaatgggtccctaatttttactggcatagatttaacaagacgagatcgattatttataatgatccattttaaaccagaatttgagggctccgatttgtgaaggcacaaaccatattagggataacatagtaattagtttcattgagtccatagtaaatttaaaaatattttcgcttattgattgctcttttgttgtattttcttttatttttgaatcgttataatcctcaagggcctttccttaaattttaaatgaaaaattatggggggggttctaatgtcggatgaaatatgtacagaaactttagtttataaagcgaaatacggaccaaaaactggcaaggaatcattgcaattaaattaacaataaaataaaattaaaaatggaatgtgaaaatttaatatgaatttaaatttagacccaacaaacttttgtgaaaattttaaaagggcgtatgcagaatattcaaaaacaatgaaagataaccaaattgcggcacaaatttacaaagtctgccagtctaaaattagttattggaaaaagatatgcggaattgagtttaaataaagaaaaagatgacgaagaattaaaaaagcattgactttc

SEQ ID NO: 3080 - DNA, 2656 bp, Heterodera glycines
  misc_feature (2456)..(2456): n is a, c, g, or t
ttcattttaattatgtaaaaaacaacattcacttcgtgatgtttaactttttttctgcatgttaaatccacaccaaattttgcatatcgatagagaaaagaattctgcataatgtaatacagccattttatgttttatacactttttcaaaagatatatataaaacatgaaaatgcattactttttctctctttttggcgtactattttcacatctctaacacacaaaaaacatcaaattcgtaaatgctaacaattttggttatatggataaaaaatcactttggacatttagaatcaatagagaaattaatagttttagcatttttggtgaaaacagcagtttaggacttgagttataacataataaaagtttgaaattcccacaacttttttctgagatgacaaattacttaacattagcttagaaaaagattccccttttcaaaaacttttttagataccaaatttgttcagtttagttgggaatgaagcgagttatggcagatcaaaataaaaaatacaaaaaaggcattttccagtgtaaattttgaaatagcgcgcaaaaatttacgccaaatgcgctatttggcgttatgagtaattttgtctaacactgggcttgacccatagtgccatagtgctcttttttactcaaattttttttttttgttttttattatcagaattgctttaaataatttttagcagacaacgaattctgctcataagacgagatttggcacacacagatcacttttttccacatacatttctgattttttgtggcgtaagcaatttggaggactcaatttgaattatcattgaaattcaaaggttcctcttccttgtgtgtaaagtattattttgttccctaaaaacttttttgtttgtttatgccaacttttcttcaacttcggcgtcgctcttttcccacaccaaattctgcatctttctcctcaactgttgagcaccatttaccaagcccaaattccgctcgaggaatctacggatttgcgctttatttgggcgtttggattctgtttgtcctttacctgatttgggcgttggttcgtttttatttaatttttagccggactttcttttttcaaacatatttcattttttacgcttcatccttttatgtccccgattatctgctgaaatctcttcacttaacctatcttccagcaaagtattgggcgttagctgtgccttcgtttttagtcttttccatttgtaaggatttttttctttactttttttaaaggtttcctcttttttagttgcatacattttggtgaatttctttttcaatttggtcaactttcactcactttatgaccaagaaacaacaaaatttcaattggtgaatgatttcctcgattggttcgttttcacatctttttaattttcgttattttttaattttgtcggtgttttctcttcccatttttccaaattctctttaattcatttgaaacagaaatgttttcttctttgtgcccttccgttgtccgtcacaaatgccttcgctgttctactcgcactttggcattttctggccataatttgtccgattatttgcccgctgctcagccgtcttctcgctctcaaaaagcacgcgaaattttgaaacgccatcagtacgcgttgaagcgaaggcccaaaaagtggaagggagcggagtttggcacatttgttgaacaaatggactcaatcgcagcaaaatgctatttggggtgagcacaatttgcattcgaggcaatcatcaagaattggtgtcccgacgaaaaaaatgttaaaattttggcaggtattttttctaggcttaaaaaatgcgacgatcacgaatctgagctcagattttgaaaatcattgatttttatctaagatttttcgtcaactacttgatttttttcgatttttaaagttattttttaaaaaaagtttagcaatgaatttgggttaaaaaaatattctgatcacgaatctgagctctgattatgcatgaaccttcattttgtctatgatttttcatcaagtgtcataaaaaaataaaccgcagccaaacggactcgaaccccaggtctccgtctcatctgacccctagggattaataattgaatttgaaaaaatcgtaaaaaatttaaaactacttctttatacattcaatagctcattcgaaagctctttttagtcactacaacatctgtgcatggttttttacgcccgactaaattccttaaacttttgaaaaaaaatcaagtagttgacgaaaaatcttagataaaaatcaatgattttcaagatctgagctcagattcgtgatcagcgcattttttaagcctagaaaaaatacctgccaaaattttaacattttttttcgtcgggacaccaattcttgatgattgccgactttttcgtgcatagctcgtcgagacgaattcgaatttngttataatttatgtcatttttttccggggggttgactatagtatatccgtcttcttttgtttttcttttttaatgacaaaatagattttttgtattgaaaaagttttggttcgagaaattgttttgactttgaaatggagttttttttgtttttgtaattaaagcggatatcaattatgcctcttttaaaaggattttct

SEQ ID NO: 3081 - DNA, 5830 bp, Heterodera glycines
agaatgaagagaatgctccgacttttgcgtcaggtactgccctttgatttgttggggcattttattgttgccaatttccttgggtattattcttgaccaatggcaccctttcagacgaagagaagggatttttcatctgcgaggaccctttccaggacgaatacgcggcgggttcaaccgcggaacttccggaggaggaaatgacagagtgccctttctgtcgaattaattcattgccttatttattcattcccttcaaagagttccctttgcatattttggaaatgtaaacgaagcggtggaaaacattgaatttcaactccccggccaatcgcccgagaacaaagtcgtttaaccccaaaatgtcctccttaagcactcacttttagaaggcattatccattaaagagcagaatgaagtgttagaaaatgaagaagttggggattggctgagtaattacggggaaacggtgccaacggagggcgaagcgaacattaggaggacaacgtcggaaaatgcaaagtgtgccggatgcggagcaaatttccactgccacaatccgtctctcccggggtaatttttgcgaaaataatacgtgttcacggggttgaccagccgaccttcgggtgcactacgttttgtgtttcacttcccatcatttacccccgtatcgtccccccttcccaaaatttttatgtttgaattttttttaatttggctggtgggtgagctactcctttctctacctttccccgggattcgttataaaggggcgtggagatggcgcaaagggtagaaaagtgtctatttttgaaatttgaaaattgctttcagatttatgccgttggaactttatcaagaagttgagaagaatgccaaccaattgcccaaataccaaaggacggattacctgtgcagacgttgctatttgctgaaggagcacaatttcttggtatgctcaactttacatgacaagctgttattgttgtttatcggtgatgatatttcagttgaatcttaatgtgtctccggtggattacgagtcaatgatgggacatctcaaaatggtccacgaggctctgattttgttgattgttgacatgaccgacatggaggcgtcaatcaaccggcagttgccctcaatcattgggaccaaaaaaccgatgattgtggttggtgagtttgtccttcgtaaaaaaattccaaattataacacttttttcattttaggcaataaaattgaccttttgccccccgacttccacaagggttatttgcgccattttctcgcctctctcaaggcggccatgcacaaagccggagtcgcacagcaattcaacattctcaaatacttgctgttgagtgctaaaacgggatttggcgttgaggatctgatcacggcataaatcttttttatacgcccaaaataaatgcctattttcagaatatttatcaaaaatgggtcagtccgcggggctcaattcgaagtgacatttacgtggtcgggtcgacaaatgcgggaaaatcgtaagcaaaggaaaacacatgcaattaaacagattgtaatcgaataattttagtacacttttcaacgccttccttcagtccgatttgtgcaaagtgagggccatggatttggtggagagagtgtcggtttctttgttttcatttgtcgtcacctttaccttcccctctttaggaccacttcaatttggcccggcacgactctttcgctgctcaaatttccgataatgaatccgtccacgcaacagctggaagtgcgaagaagaaggcttttggcgatgcaagcgtggaagaagaaggtccagctattggggggggggagttgcaatgggaacacccaaaaacgggagacagtccatcaaacatttagagaccgtgataaatgccaagaggaaaagtccgccttggacctgacagttacaaccgaccaagagggcaattactacatcttatttttgtatttaggagtccctaatgctgaggtcggccttcagtaccaccaaacatccgaaatacgttgtgctccaagggatcatcggcagctcttttcgggttcgcctaacatcacttgcctacaattttgctttcattttccaaggaatgggaagagaataaacagcccgtgtccgtggacaaaaccatcaaatacttcgatgggcaattggaaaatgccgacgaaattgcccaaattgagggcaatggaccgaaaaagcggcccaacatgaacctcaacgacttcaccttcaaactgggcaattggtgcttcgacaccccgggcactgttaacagcgaacaggtcgacaaccataatttgttgtgagggcggtaattattgttgaggcatttttcaattccaatcgccgaaggcccattttacaatatttatgggatcaataaaccgattctcccccgcagttttcatttgttttaaacttctaggattttcaaaaaaaaaattaattagtttttattacgactatttccgcgcctttcatttgcccatctttcttttgcagttgttagatttgttcaccttagacgaactgatcaacgtcgtcccccgttccatcataacccctcgcattttttccctgaaaatgtgccattctttgctgatcggcggcttagtgcgaattgatctgctcgaaattgacacacaatcaattacacatcagccgacagtttttgtgagttcactcgcataatttaaccccctttttttgcaaaatatgtaattaatttattgaaattcacttttcagcttacagtgttcgccagtaaccgtctcagaattgagctgatggacacggcccgtgtggatggctttttgcgccgtttcaatggccatccttcgcttggcgcgcccattggtgggccgaaacgaatggacaaattcccaaaggtttttcccattcatttgtcttttacgatttgttgtatttgcctatttcagttggaaccttgcgactttgtcgtccaaaatgagggggcgttcaacgaagaagagtcgggttttgcggacgttgttttctcctcagtcggctgggcgttgctcacttcttcggcggattcggtgaaggtaagcggactgacaatgaggaaaggcatttgacacattgtaacagttaacgcaacgaagtatggcatggcatttccatggctcttttcagatccgtgcctggacacccgccggcaaaggtttgctgctccgacaaccgccgctgctgccctacgcggcgaagtatcgcggacagcgacagccaggcacggacatttaccggatgcgaccgttacagcactgcgagacgttcagcgacacgcaacggagcgagcgaccgaaacgaattgtcggagaaaattacaaagcaccgccaaccgctggccaaattatggaatatgtgaacttcgattttgattaacaattgcacgtggatcactggtcactttctgcttccatcgtccaaattgtcgttttcgaatgtttacaatgagtaaaaatatatgaatatatgtaattaattattccgttgctttatttaatccaattatttaatacttttgtccgtatttttcttacaaagacaatttgtcctttttttcttctcttttcgttccctttggtgtgatgagtaatcatccccattctttgtcaattggccaaccacaacaaaaaagtcgtcgacagcgatggtgcggcgacggtccttttctgctgcttacactgacaatgagcatcggaggggccctcttctgtttgttcgtcgctttatgggcggttggcattgagtgagtggggaaatttgaaattgaagcagggccatgacggaattgcaaatgattttggaattcaaatctttcccaattttctctgttgtctgaccaatgatcactctcgttgtctctttgtcgtgtcgttcgttgcccactctcccccttttagcgtcgtttttcccctttctctgcttctgtccgcttctctcggctttctgtccgcttcttcgctcgtccacaatgcccacctgtgcttcggtgctcaaattgtactcgcccaacttctcaatttgttgccctccgccgatgactccgtctcaaaagggcaaacggcggacgaacagcagaaaaatggtggagacgaagagaacaaagggcaacggcacttcgccactttcaaggggagtggccatgccaatagaaattacattgtaccaccgtgggaacgcgttgaactcgacgcacggctaaaccacgagttggaggagctgtttgagacacttttggagagctatgtgagcagttggtcagttcttttctgacaatttgaccaaatccgacccaaaaaacaaacgacaaaggtacaacgggctgatcagcacggacaccgcctttctgctggaagtgcgtcatctgatccgccattcctccgccaaactgatcaatcgtttaagcagtgtcgacctgcgctcgcttctcatcaacgaactgttcccactggtgttggctcatgttgaacgcatttgtcgtcttacaaatgcaatttttgggcatgaaaatcatcaagaaattgcacaattggtcatctcacatacgcaatgattcagcaatcacactttttgctttggttttagcccgtctctctcatcgaattcaaagtgttcgaccaatgggccgacgacgtgcactgggcgatgcggtcggaggccaaccgcgacgcgtacttgcgaatggtggccgatctgttgatccgacagtttgtggacgacattcgaatcggcggatgctttgtggacgaagagcacgcgaaaattgtcaaccgaaacggggagggcaccgacaattatgccggtgccggcggcggtgctgcagcaatgcccccggcgacgtcgaaagtgttttgccattatttgcgcattttgccactccctcccatgtcagtggtcctgccacagttcgcggcactttctgcgcgagttgctcttttcctctgcgcttctccccactcttgacgccctttccgatcccgactcgctgaaccgactgatgctaaacgcactcacaattagcagcagcaacagtggcgactgcaacgaatatttgacgacaatcgccgacggagtgtcggacggagaaggaacgcaccgagaaacaacgccacgaaatcagcaggtaaatgccgtaaggagaggtggcacggcatttgtggcaatttaattttaacccatttgctgaaattgaggtgcagccctcgtttttgagccgatttgtggaaccctactacaccaacacgcccgactcgttgctgggcctgaagcttaacgatttggtggagaacccgtacctgaccaagctgttcgagttgtatttgcgcgatttgagcggaccgactcatcttttggactgttttatgcaggcacgcgacattcacatgcgcattcaaatggtaatttacaaagggaaatgatggcattttaaattctgaatttgcattttcagttaaattccgccaaatttggtgaaaattgtgaaaatgacaaacgacttgaacaggaagtgggcgaagtttgcttggattcttggcaactcttctcaacttttgtccattcaaatggaccaaatcgaattgcattcaatgaacaaattgagaaggaatttttgaccgtttttgagtcgttcaaaagcaaaaattacacgggaaaaaataatttaaatgcaaatgatgaacgaattgtggaccaacaacaacatcaacaacaacaaagaaatgccaaagggttgaagccactcgaaaaagtgatcgaagccatttac

SEQ ID NO: 3082 - DNA, 1489 bp, Heterodera glycines
attgaaaatggaaaacaaatgtttatttagatttttcacatgttttttggcggtcgctacgtcatctttcttatgggattgttctccatttacaccggtctcatctacaatgacgcgttcagcaagtcgttcaatctgttcggcagttcctggctcaatccgtaccccgtcgacatacttgagaaggcggacccggagcaaattcttacattggacccatgggaaagttatgtaagtgtgtggcatttaattttttgagaagttttaaaacaattttgcaatttgttctcaaggcttcgtcaccctacccagtcggtgttgacccggtgtggaatttggccgagacgaacaagctgaacttcttgaactccatgaaaatgaaggcatcagtgatcatcggcatctctcaaatgacttttggtgttgcgctcagttactacaatcataagtcggtgcttctttttgtttatttgttcctttctatcttcaaatttgatttggttttcaaggtattttggctcggatttggacatcaaatttacgttcatccctcaaatggtcttcctttcctgcatctttatctatttgtgcttgcaaatcattgccaaatggattttctacgatgcattggtcttttttttttgaataattttccctcaaatttccctgttataataattagaaattccctctcattattgtcagggcggtcatccggtgttcacctacgaataccccggcgccggctgtgccccctctctgctgatcggtctgatcaacatgttcatgatgaagtcgcggaacaaaggcttcattccgccgggtggcaaggaaccctacccaaattgtcatctcaactattggtaccctggtcaggtgtggttggtttgatggtcattcataaattgggaggggccgcggttggagccgccgcggacaatagtgagccgaacatacaattcttgtttagatttctgttatggagtttggaactttgacaagaagttaaaactcggttctcatccttttatgaatctgaaattaattattaacgggggcggcgagctgctcctgtttttgaaccatattttttgatagatcaaggcccatattcttggtaacaattgaaagagtagtcggaaaatcgttaattttttagccgtttaaacacttacaaaaaaagcagtcttgatcgacataaaaatggggtggttaaggtctcaaaatggaaattaagcctcttaaaaagttttatacagacatttacaaacagacaatggcttaatcaatcggaatttagtcattttttgaatcgcttttcatcccaaccgctgtcggctgcatttttgtgatgctgtttgccaaaccgtatgtgctttggcaacagcgtcagcagcacagccgttcgttgtccggcgggggtggcggcgtccacacccaattggtatttgttggcaccgcatttacccacatttatagggcgtagcgg

SEQ ID NO: 3083 - DNA, 2709 bp, Heterodera glycines
gttgttgggggtggccttcccggccattccgggtgctgtttttcgtgaaaccgttgttgttgtggcgtcggttggagcgtcgtcgccaggccgtcgaagcgacgcttcgacgtcggcaaagctccgccgcgcacagaggtggcggcacggacaatgccattgttggcggcttggccgatacatttgccattccgcaggacgaaggctttgttgatgaacatcatcagcagcagcacattagcactgtccgtttttgtggtggttacggtgcctttggacatgtaactattggggattgctgtcatttatttttttttgcttttccgactttttgtttgcttgctgttgcttatttttgtgcgctgtttatgttttaagatgcttttcagttttcgttcttttcttcactttgtttgtgtgcatgcttacaattagcttgtttgcctgagttttacggcatttttgcagtttttttttggttttttgcattttgatggatttgcatcactaattgcatgaatgctgttgctttttccgctattcccttcgtttataagtcccccattttttgatagtttatgtatcaaaatacagtcttttcattttcagagtgttcatgccaatatgcaggaagacggagctgaagttttgcaccacgaggacacttcgacaacccacaaaaaccacgagacagcgacgggcggagagaagggcggaggtcaaggccaacaacacggggacggctcttttggggacataatggtctaccaggcgattcacaccattgaatttgcgctcggctgcatctcgcacacggcttcctatctccgtctttgggccctgtccttggcacatgcgcgtaaggaggccaattggatgggggaagaaagcgcattttgaatttgaacagtgtatttttgcgttttttagctgaatttctcatttatgtctattttctaaagcccggaacgaaccctggaacctttaggggtttccgatgacttatccgaaaaagtttttgaaaacataatccttgatatggatcgggaaattttaaacgggtttgtgttctttttccattattgcttcgtatggttgtactctgaccacctttaagaattgtccgacgtcctttggtcaatggtgctccgcaatggattcgtccaaagcggttacctcggcgccgtcatcacttatctgatcttcattgtgttcggcacactcactctgtccatcctcgtgcttatggaaggactgtccgcctttttgcacgcgcttcgtctccattggtcatttcttcattttagatgttttgtttactttttatgcatttgtttagggtcgagttccaaagcaaattctacggtggaatgggccaccctttcgtgccgttttcgttcgagaaaattcttgaggagtcccgtcaaagtgaagacagttgattgatgctctgacttatcaccgctttaccagtggcaatttgcttccattcccttccccctccctcctaaaattcagtcaaatttcgttagaaccaaaggtgttactataaaatgtacacatttgtcaaatttcacccatttcttcccaatcccttccgctttttgctaagtcgatcaccaaccaatccgaatgtctccctttcctgtcaaactgttatttaacatgtgtcaaatccgtcatatttagttcactgtattttactgtcactgtccccaccccgccaaataattgtgcacgcacgatacatccgcgttaagtttctgttttcttctgatgtccaaatggctgatcacaccaaaatgtattggctctttcgttgtgagcttatttgccatgattttaattttataatgcatttccaaccttttcactaagcattattacttgtcgcttcatttaaaaagaatttcatagtgctaattccctttcttctgaattaaatataaatggtgggcgaatttaaattgaaattagctcggttttggttagtcttaatttaaaaaatttatgcactgactacaaaataaaatttccaaaaggaaatgattggctggtcttcgtgatttgtcatgttcatcgtgtgacacgtttcgtgttctggcccgacgaaatctgtttacggctgcctttcttgttgctaccagatgaccaaatgttagccagcatgtcggccatgtctgaaatttggcaataaaatagcttaacatttgctggaaattcgtttttattttacgtccagtgagtgttttacctggcatgtcaacctttggcagctgcatattttgcatttcctgaaatacaaagaaagggaaaagtcataaggttattgaagaggaagcccaaagaaaattcgacaaaaaatggaatcaaggaagaaagtaaaaccgaccttttgcacgttcgggtcttgagcggctaatttgggctgaattgttaaaaaaacaattttgtgattaattggatttaaatctgaccatcaacacaacgaggataaatgcggcgcccatcatcagcatcatcgggttcatcaacacgtcagtgacacgccattcttcgcgcactcggaaatatctcatcggatgccgtgcggttaatttgacagggtaaggcaatgtggagacgacattcggcttaaaattggaaaatgcatggctctgattgtccatgattttcataaaaagctgtattttaagtatgatgagctat

SEQ ID NO: 3084 - DNA, 4110 bp, Heterodera glycines
  misc_feature (4044)..(4044): n is a, c, g, or t
  misc_feature (4082)..(4082): n is a, c, g, or t
tgtgatgtccacacggacggactcgaatgaaagtcgccactgcccacctcgagaatgtaggagccggaaggcacgtcgggaacaatgaaagagcggtcctgtctaaaaggaacggcaaagttatacaaacgacatatccttattgtaagccaattaaggtatgcagcaaaatctcaattaatctgatttaacgggtaattgaaaatttattgttttcataaccaaatgatatgagaatgatggttctcccgtatgacaatgtatagaattcacctgataaacccaacgaattttccgtagtccaaaaatatcctcgcccccgccttccaatttggctttatccgctgcaattcggcattgacaaccgttttgccctcaatggtgaacaattgttgttgcttttgaagattcgcattttgttccgctgctgatgaaacaaaaacggcgaaaaataagggaaaagagaaaaaagagaggacaaaaagcacagaaaattgatgcataatcgaaaacggagagtacaaattaggtattgtgggaaagtatgcaaaaagtaaaggaactggtcgacattaccaataaacaaataggcaaaacactattaattggaaaacatttatgccatattttatataaattaaatgtaaacattctgtgggtattgcatggacacagtcacagtaaaacaatttgtgggaagcaaaattaatcaaagggagcaaccaagggcatagccggcctcaagttgggggattataaccgaccaccaaaagatcccgcgaaacaaaaaacgaaggaactgtgcggttggtggaagcctaaccacttgaaaaacagagcccggctaccctcatactatcatgcatattatttcaagctgaataatttagttgaaccgcttcaggaactcctcagccgatgttcgcgccctggcgttcagtgccaatttcatttcgctaatttcctgaatttaaatgttggatcgatgagaacgtaaattttaattaatattcagctgtccatttcaattttgttgctttaaaaaactttaatactcaatttataccactgggacagaccttgtcaatctcttgcataaaatggatgagaaagtcgatcaacttgtgcttgtacatgacttgggtatgtgttgcggtgatcagaaaactgatgtcaaagccgggcattggtttgcgcctcaaaatgatgaaattgtcagcgcgttggcacataaactaaaaaaagcactgattggcgatggataacttcgatcaaaaactgttgattttaaatttttacctttacctagaaatagatttgcaatgggttttccctttttttgtctcaccctcgtgaatttgttgcacagaattttctcaatttcatccgcctgtttgactctgatgctcatccggaccgaatttatggacggctcaatcagaacggcttcctgtttattgcgacacaccatcaccggcgtcaacagcagctctttgctggtccgaacttcaacctaaaaaaatgattgaacaaaaccaaaagagcaaaacaatgaaattgactcaaaactaaatgaataattgtttggagaaatgtcagcggaaaacctttgcccatggctatataaacaaataaattgtaaattcacaacgacggtaaccactttcttgcctctggtttgttgtgccgttcaacaacttgtgaaccaaactgctgaagacagagtgccgcctccagggaccgacgaaccgcatcaaggtatggttgcaaagtggtgctctaaacagaaatgaatgggtaaaaacaattggacttaaaatgagtggcccttaccatatcagtttttgaaaatcagtaatttacaacaaattgactttaattaagttataataaatgggaatcagtcaagcggaaaagcaaaatagaaaggtaaaattcaagaatacttgtacctcaccaaatttcgccaactagtcataaacagggatgccaaaaatatggaaaatttagcctcattgacctatcaaaaaaccacaaaatgaggctaaagcctcagatctgggagccctgtgataaatcctcagatctgggaaccctgtatattagcaaagtgcatatggaaatgaatgctcttaatttttgtaaaaaataattgtttttgtatatgcaaagtcaatggaaatgatcttacaattagttttggtattgtattgaaaaagttttggttcgagaaattgttttgactttgaaatggagtttttttgtttttgtaattaaagcggatgtcaattatgcctcttttaatggatatggttttaattggatggatttatcgcacttattgtttgttttgacaaaaagaagttacttttaacgatataagatcagtttatttgttctttttttgtatgcagatgtttatgcaaaagaaattattaaaatgtaagagaacaagtatttataatgaaaaggattttctacgcaaattgtatttgataattgaaatacatttttaaaattccaaaattatgccgaacaggtctgaattaagtcccggtgattgacatgtggatgaatccataaaattgagttcattgtttggaatagtgaaggattgagtcccggtgattggaatgccggataattgagtcccgttgattggaatgccggataattgagtcccgttgattggaatgccggagaattgagttccggtgattggaatgccggagaattgagtcccggcgattggaatgctggtaagttgagtcccggcgattggaatgcaggtgagttgagtcccggtaattggaatgatggagaattgagtagaattgagtcccggtgattggaatgtcgcagaattgagtcccgatgattgcgatgccgaaggaccaggtgaggttaggtcccagtgattggaatgccgaagatttgagtcccagtgattggaatgcaggagaattgagtctcggtggttgcgatgccgaagaatccgtgaaattgagttccagttttttgaatagtgaagaattggtcccagtgattggaatgctggtgaaattgagtcccgggaatgggaatgatggagaattgaatagaattgagtcccagtgattggaatgctgctgagattgagtcccattgattggaatgtcggagaattgagtcccgatgattgcgataccgaagttggggggtcacaggttcgaatccagtgaaagcttcgaagcatgtgtgagcccacaacatgtgtcgtttctttgtcatgccataaaaattcggttgaattcatatcataattgcttagaaagtccaaaaatattgagaaaaaaatgagccttttctgggccggtgagtgctcagttgagctccatctataaaagtggaaactttgaaatggctgagctcccttatttaaaaatccaaaaagtttaagaatatttgaatcatatgaaattcatcgactggattctctaaaatctatatgccatatttttacttgaaagcttcgaagcatgtgtgagcccacaacatgtgtcgtttctttgtcatgccataaaaattcggttgaattcatatcattattgcttagaaaagtccaaaaatattgagaaaaaaatgagccttttctgggccggtgagtgctcagttgagctccatctataaaagtggaaactttgaaatggctgagctcccttatttaaaaatccaaaaagtttaagaatatttgaatcatatgaaattcatcgactggattctctaaatcgggagatttacttgtgaataaaattcaattttctttctaatttttttttagatttttctaaaatcttttaaaaaaccaattttagaaaagttgaccgagaaattcaaattaatttttctgttgggcgtggagaaattctttttatgaaaataccaccaaaaatagatctatcaaatgcgatttttttttatccattcgtaaaatttcattttgcatcccttcgctataaatttttcttgtgaaaatttccaaaaaatggccaaaatatggactanaaacccaaaaatggcgaaatatggatttattcccgaanacccccaaaatatggatttatatggact

SEQ ID NO: 3085 - DNA, 562 bp, Heterodera glycines
attggcactttgtccccatggcattttgcttttgtttatacggaagaaaaggaaagagagaaaatagaaaagaaacatcgcagggaacagctgctgggggtgaaaatgaaagaatgaaatgaatggtcggagaagaaaaccggcaaaattggagaaaattgaaagaattaaagtaaaaagccaaaggaattggacaaattggaattccacttccaatgtactttcattgccttcagatttattatcggccgatgaatttcactgatcagtgccatgccattccgtccggtgctctgatcggacggactccgtgtgcccattcagtgtgtgtgacagtgatcgaaccgcgggtgttggctggtcggtgggaagggcgaaaaggggtgaaaagcaaaaatggcacctaatcaggccaatatctgggcaacaacgtcatccggggctgcttctcttccgtattcaaatatggcgatgcacccattgatcagctcgtcggtgagtggttccatcggcatccggtcaatgacattatggcattatgaggaccctcccccccccctac

SEQ ID NO: 3086 - DNA, 3710 bp, Heterodera glycines
  misc_feature (3675)..(3675): n is a, c, g, or t
ttagaaagtgttgacagatgtgtccccgacattgtccgtaactattgaagcatgaaattgcgagaggggggggggggctttgtttgcctaattggctcggatgccctcgaggaatcgtgaaaagcgagtgaatgttgaaatccaagcccaaccaaatgcttgggtttgttttttacatttcgcatttaaataagttcttatataatttgactttttgaattacaatgttaatttgtataaattgtcgctttttcctgggaccgttaattgagctaatgacagtctcaaacatttttggcgccgattaggatttttgtgccgtcattgaaaaattaaaattccaagggctgatcactcactgaccaacatggctttattccaatagaataaattgccaatcgcttttccattgaattaccccacagatacgagctgttccaccttcccaatgcgcactttgctgccgcgtcatttggctgtgaagtcgtccaatcggacggtctgtccccctttccccctttgaactgctccgtctctctctctcttcagattgaattgtgtcgctgtctcggcaacctctgtaatgactatccctggtctcccccgttgctcagttcgtcgccccgtcgtttttttcctccgttttcctttttttcgctgctctttctcttccgctgttgtgcatttgtcctcgctttttcattacatttcactcattttcatcttttcactgctttcttttgacccgaaattccgacaaaaaaaataataaaataattttaatttataaataaattgaatttatttaaaacactaaaaatacaaataataaaacaaaaatgcataaattggggacacaattaaatggacggctttttaattttaaattaattttgcgttcattcccttgtgattaaaaaagcaaaaaagtggcgacaaaacaaatttaaatgtgctgtgcaaaacaaaagaaaataaaaatgccaaaatataaaataaataattgggacaaaaggggcggagatccaagggaaagtgaagaaaggggcaattaaagtgaagaaaggggacaatttgtgggtgcaaagtgcggatggaaagtgtgggacggaacgacaaaagcaatcgaaagggaacggtccaatggtgtcatgaaaattcgtacaaaggcaactcgtacaattgcttaggtttgtcctaggctttaggcttgggcttaggcctaagctttaggctgagtgtacgagttggcattgacccgggtccaatagggggggggggagtgacttgggggacaatcaaacggacaaaagaggaaaagcgggggaaaagggggggagggagggagggaagcgcaaaaaaacaaattgccgaaattgaactcgttcacgggggctttctctgatgctgctcaattcaacacttgcaatgggatggcatttcctccgtttatggcgcccgccagcgaaatgttagcctcggccatttcgcccttctgctgctcccgctgtgggtcgttgtctgtcgcctccgcgtttctcatttgcatattcctcgcttctgttgttttctccgcttccgcgtctttcttctccgcctccgcgtcctttttcttcgcttccgcgtcgttattttccgcttccgtgtttttcttttccgcttccgtgtttttgttttccgcttccgtgtttttcttctccgcctccgcgtcctcttgccccgctttgttcgcttccgtttgtgccgcgtgcgtttccgtctctgccccgcggcagtgtgcctctcctccgccctccgtctgttgttcctccgtttcctcttcgtatccttcatccaatcgctgactcctctttctgtactcgtccaattcgtacattagtgcacctgaaaaataaataaaaccaaaaagtggttaattagtgactaattaattgcccagtccattcgtacgctgctgattgatcgattggattgtccgttggtattccgtcagattttcctcgctgcgctccgttaggacggataatttgccactttgtgcgtcctgttgctgctcgacagtcgtggtgggcctcttcactttgtcctcataatcacctgacagaataaggattatcccggataaggtgaaatttgaattgccaatccgccgattttcccttttcgaaatgactgacaaatcgaccaaaatgatccccaatttgcgaaccttcgttcttcagctgacttcgttggtgtctgtgcaccatgggaattatacagctgaccaagccggacagaaaaatgagaaggcccgcgtaaatgaaggaagcgccgtacgaatcactcaagtcgtagacaatgccggcgatcggagtgccgagcaaagaggcgaaaccgcgcgaaacgaccacgaggccaaaagaatttgtaagacgttcgacacccaaaagatcagccaaaacgatggaagtaaggcaaacataagcagctaaaagtggcaaaatgagaggcaattggacaatagaaaaaagaatggcatcgaccgacgatgaaaccgaacagagaagcgtagagagacaaggacaaaaaggagggcagcaggggacaaagggcggtgagcaagccgcacagcaccaaagaacagttggtgatggacagggcactcacccagcgacggtcggccatccaaccgaagaaaacgcggcctaaagggggagggagggaccaatcagaaacggacgaaccgacggcgaatagcacggcattggcacaaagtaccaaaagtgttggcaattccgatgaacggcaaaaggaaagttgcctcggcgttggaaatgcctttggaagtggccaaatcggtgaggaaaacaaaaggcacgtaaaagccgagcatcgcgagaatgttggacacgcaaatgatgcacatgacaggctcaaacagaagcgaaaagtcgaccatttgggcgagggcgtggcgaattgggaagggaacgcagcgccaattgctgaaggacggcattccctctgagatggacgacggcccaattgcctgtcattggccgtgccaagttcgtcctcctcaacgccaaaggcaccgccagtcactcggctgtattggctgcccccgaagcggcaactgttcgactcggccatttctccggctcccacttgggacattgcgcacgacagattttgtgccgcgaccgtcaaagggatggaaatttgcgagccgcggtagcggtggtaattgcttccttggaaaagagggcgtcagatgagcgtgcctcaaaattggccaaggaaagagcagcacttcttaatgctaaccgggccgaaaccggacacccggctttttcaagagatggaactggctttctgaaaacccaaaacccagaatacgacgcggtaggtccgagtccaaaaattaatttgagcagtgaaaagcggtgccgaaattggagtgaaagagccacccaccttcgttctcaaactccttcaggtttctgatgctcccctgcaaaaagatgtcgtttctcgacaatggacgagcaaattccttcggttcggcgccgctcaaagcgattgaaaggacggaatcgcccgctttgatggactgagccggggcttggcttatccgactgagcgactgggcgtaggaccgtgccgagacgcgcgaaagttggctgcaaaggntgagccgactttggcgcaattgcgtgctgctgccc

SEQ ID NO: 3087 - DNA, 2104 bp, Heterodera glycines
gcccgtcggatgtcggcccaacgcggcccccgcttcggcaaccccggattgctgctgctgctgctgctgctgctggtggtgcgggttgtgatgctgggagccgcccctctttttgctcagtcggcgcaccactctttccaaaatgggcgacagcggagggcgattgtgtggagtaatgggcgaagagtccgcctcgttggcctcctccgcgtgctcccctacggcgccaagttccactccgttggccattagcaacggttgtccgtccgtacactccgaactcgtccgagtggcgcccgaccgacgcggtggcgaaatgcccccgttgttcgcttcctcctcctcttccgatacattcgactcggactaaaattggttttttatgtggatgatttgccctacaaaaagtctttcaatcggtcgtctcaaatcgtccgtcttttttctcatcacctcaacttgctgtaaagcagcgatcagtgcttgttgcttcagttcctcgttgagtttattctgtttctccaagtcaaacgtgggcattggcaacggacggaagagaatgccgcaaaaggcacaggaaagagtgagaagggcggtgacgtaaagggccatttgccagccgaatgcttcacaaattggcagtttatgtgaacagttcagctaaagcaaaggaaaagcaccttcgaggaaaaacttcaaaatgagcggaatcaaaaaagtgccgaatccgctgcccgccacggaaatgccagtggcaagtgcccgtttggactcgaagtattggctgacgatgacaattgctggcagatagatgaagctgaaaccaatgcctggagatggagaagagcaaattgttaccaaaacaaaaaaaatgaaaaggcgcccaccgccaaaaacgccgtaaagcaaataatggacgaaaatattcggtgaaaatgcggacaaagcgaatgccacggaggacagcacagtgcccgcgatgaccaccttgcgcgcctcgaaattgtttaaaagggcaccggagagtggaccttaaggcaaatagagaaagtgccaaagacaagtgaaagtgccaattttggcaagcgaagggaggaatcacccgcgagtaaataaactccaatgagcaaagaaccgatcaccgaagtggcagcctttgtggtatgaaatgccgcctgataggcactcataaaagagccgaacgaattggaaacgccgtccacaacaaagttacagacgaaagcagcagcaacaatgacccagccgaagccgcctgaagaaaaggcttaaagcggaaaaagaggcaaaaacaccgtcgggaggagttggcaattggttgatgatgaggtcgcccttcagaagatagccttaattagggaaatgaaaagcaaaagggaggggaggggcaccggcggggagctcattaatggagtaattgctttggaattcgctgttgttgtccggcaaaaggttgttctcttcaatgcaacactcagagcacgaatcctcgtggaatttgttgcacacgagcaaagatttcccttcaaggataagccaaatattctttttcagaacgattctttcttccattgtttgtttgtcatcctccccctccctttctatttcatttttgccatcatctgtccctctctctctcctctgtcgtccatttgtccgttaatcatcccctctatcccctctctgttttgtcatctatttatcattaatcaatcatcccctctctctctcccctctatcgtccatttgtccttgatcaatcatctcctctctctcctctgtcgtccatttgtccgttaatcaccccccctctgccattaatagcgctcatattggactcttcggcgtcgatgagatttcatcggcgaccgataagaatggaacagtagcaatttctgacgcttttccaaagtaaagatgcttaattttaattccatgatgtcaatacccttttgttacgcttttcctcggattggcattcgccgaatgattgtcctcttcagcggcaatttgctcattttgtggcatcgaaataaaatgcccacacccaaaaatgggtggccaaaccaaacaaaaagaggggagg

SEQ ID NO: 3088 - DNA, 1720 bp, Heterodera glycines
ggggggagttggcaattggttgatgatgaggtcgcccttcagaagatagccttaaataggaaaatgaaaagcaaaagggaggggagcggcaccggcggggagctcattaatggagtaattgctttggaattcgctgttggtgtccggcaaaaggttgttctattcaatgcaacattcacagcggagactctctctctctcactttatcgtgcacttgtctttgatcaatcatcccctctctctctcccctctatcgtccatttgtccttgatcaatcatcccccctcctcctctcattctatagtccatttgtctttgatcaatcatcccctctctctcctctgtcgtccatttgtccgttaatcatcccctctctgttttgtcatttatttatcattattaatcaatcatcccctctctctttctctctcctctgtcgcccatttcatttcttcaacgtactgtttggcgagaaatcagcctccgcagatgcttctgccattatttgcgctcttattggactcttcggcgtcgatgagttttcgtcggcgaccgttaagaatggaacagtagcaatttctgacgcttttccaaaggtaaagatgcttaattttaattccatgatgtcaataccttttgttacgcttttcctcggattggcattcgccgaatgattgtcctcttcagcggcaatttgctcattttgtgccatcgaaataaaatgccaacaccaaaaatgggtggccaaaccaaacaaaagaaggtgaggggatggaagtgaagccgttcagaaacagaaccgtactgaggagaaaagagcaaattcaaataggagaattaatataaaaggaaattgtgaaattaattagtcattgtcatttgttaattatgctttaattgccttttgctgactaatgaatcgatgcgattggactgactaatgacagacattcgaaaggcaaaaccgaacaaaaaagcagaataaatacaacagtgggcagaactgttggctcactcactattcattaacgttttatttgccaaatcgatcggtggctttggatttgcaaaacgcagacggagcaaatggggggggggggatgacagccgaacccgcgggggcagcagcttcgtcccacgtttattattagtaactgcgcttttcgcttctccgcgggattaaaccaattttgccttaagcaaaatttcattggcaattcgttggttttgtgcctttgcgaacgatgaaaaagccaattttaaattatgtgcagatgaatgatgatgattgacgtgaaaaagaaggctcatttatcagatcgttgagatggaaaaggcttttaataatgggaggaaatgaaaaaatgggaaaagtgggaaaattgcgaaaagcgaaacgcacgacaataaataaacaattaataattgcaggaatttcccatcctatccatcgaatttggaaatgctataaaagaaaagccaatgaaataaatggggaggcaatgaaaggaaaagaacactttgggaacgaacgaatggcctttgaactcggagttaaacggagcataaatttggaaacaaacatttcaaaaataaatttagaaaaagaagggaaaaaggaaaagtgagggatctgatcagatagagggaagtgatctgctggtcactgatcaaaggagaaaaggtataaaagtcaatggacgacgaatccgaatttatc

SEQ ID NO: 3089 - DNA, 1578 bp, Heterodera glycines
  misc_feature (30)..(30): n is a, c, g, or t
tccccctgcctctctctcttccctgacacncgacagccagcagaaaagcaaagaagggattccctcccatcgattgtatcccccccttctccagaaatgctttctcccgttggctttttgtttgggtcagacagcaaaaagaggacgccggcggcacgactaacaaaaagagtgacaaaaagaaaaagcagcagcgcatcttgtcaacaattggcgcagtgtctgtgttaggtctgtcatccgccgaataattcaaattgttcctttcctcccccgcggcgatttacttaattatggcacaagcaagtggggtaatcattttattgtattgcattaactttagcaaattaggcaaaaataacattcacaattaaaaatttacaaaaaagtcatttcaacaaaaaaaaagtaaaagaaaagaatacgaaagtcaacaattaaagtaataaataacattgtaattagtgaccccacctgaaaaactctctaattaaaatgcaaaattcagtcactaatcacaaatataaaaactgtcatttgtaagtctatttttctgcttcattcgaaactaagaaaagcttctggcaaaagatggtaatggacgctgaaatttgagaattattaaacaaaaaatgttcaaacaaaggaccggacgctttgttgaaaaaggaaggcctttccttccaacaaatgaaaacgaggtaaacgggcaccgaagtgagcataatcgcaattccaattgcttacataaattagcattgtttctggctttaggtgtaaaaagggactgacccgtgtcttttggcttgccaacgattggaataaccaccaaagcgacacagccgagcagaaagatagcggggaaaatcaaattgaccttacagaaaatcaaatgaaaatcccattggagcattaattagcctctaatcacttgaactcactttgattggcctcggtgcgtttggcattttcatacggaaataaaacaacgaggcaatggccaagccaatggcaagccaataactaatcgcaatgtaattgatcagagtgagcgcattgtcaccaaaggcgagataaaccaacgacaaaaggccctaaacacaaggggaacggtggaagggagctgaatggcaacgaagaaaagcaccagaaaaacgacggcgggcacgggggtacgcgttcgtcggttgatcattgtgagaaggacgggcatttgctcctcccgggcgccaacgtaaaaaagtctggagacgacgacaacgatgagaatggcatggccattccaaagtcagaaagacaaaaccgacctggatgaggtgaaaatgctaaatgggaagaaaagccaaaaatgtgggaggggaatgcttctgttagccttacactccgttggctgagccgagcgtggaacacgcgacgaagaggggcattgtaaaggcgaacggaccgtacattttgttggcgaattcctgtaaggcaaacgaaagaatgaatggacatgggaagataaaagagggagagagaggggaagagaaagaagagggggagagagagagagagggggggagggggagggggagg

SEQ ID NO: 3090 - DNA, 1767 bp, Heterodera glycines
actgatgaccacgtaaagggcgatgttagtgagcacgtaaatgacagttacagaaacagtggaaatcaaaatggccaacggcaaattcctgaattggtaaaatgccaacggtgcaaaaatataaagaccgttttggattttgcaattcttcaacgatgaaattgaggtagttccagccttggtaagcgaagagtccggaataaaaagcaatggaaactttgccaacgtttgtctcggaattttcgaaaacatttcgaaaattgactcgatattgcggatcgccttaaaaagtaataaaaaatgagaaagactattaaattacaccttggatcagaaggtaaaagccggtgattataataaaaatgagggcaaaaattttagcaagtgtaaaagtgtcttggatgaaagtggccaatttgacggaaagacaattgagagcagtcagaaaaactaaacggaagcatttgcaaatgaaagcggcatttgaaagtgccaacttatcagggcagccgcaattatttgagcagaaccatcaggggttttgcaatttgagaagaacgggtgcaaaatgtatttggcaaaagttaaagcgacaattgtgcaagtgcacggtctaaagatgtcataaattcgcgtttaaattcaaatggacaaaattttagcagccgtccacctgacgacgaatgcttcgacccaaagtcgtacgaatgccaaaaaaggaccaaacgcctccattatgtaggcatagtcgccacccgactttttgatgagagtgccaagttcggcatagcaataggaaccgagcccaacgaagaggccgcaaaagagccaaatgagcagggaaaggccgatacttccagcatctaaagcgttgatttccaatcgcaagttaaacaacggaatgtgcacctttttggacacccgttggtgacaaaaagatgccggagccaataatacaccttaaatgacacatgttaattacatgtttaattattggacaaatgacttattcttcccgaattctcaaattcctcttcagttgatttggaaaattcttttttgagtttgtttgagtcagcttttcccccactgtatgcatggtgctagggcacttcgcgaatcggcaaataagagggattttcgaatttgacaaaataattaacaaaaagagaccggccctcatcagtacggtgtctctttgtgtacaaagagccactcgtaaaaaagcaaagaaaagcattttattatgccaaaataaatataatttaatagatattatactattttagttgattgaaattactttaataatgaaatatttagtttattaattgattaaacacatatctcttgaactaattattttatatattaaatcgaattatttatagtcctctcctccttaatcatgtatctgtattcaatggactcgcaccgacgattcgctgaatggggccaccttcaaaatatataaagatggattggaattctctttcctgaaaatttgcccctaattttgttgtatgccctttccaataacaaacgcttggaactttatttggggagttaatttgcaaattttgctggttagagccttcagcaagctcaaaataaattaaaaaatttttaatttaaataatggcttgagttgcttataatttgacattatgaataaataataatttaattaaattatatttatttttgcttaataaaatgctttgctttgcttttttgcagtgggttttgtacacaaagagaaaccgt

SEQ ID NO: 3091 - DNA, 751 bp, Heterodera glycines
caaaaagatgtcacaggccgcaattacaaacaaatgtatggaaactattatagtaagtaataatacatatgaacgcaatgaacgaatggaatggttactctttggtcttttattttttgccccacgtgtcaatcttttgtgcttaataaaaaaatatctttaaggtcaaacacgtgatttattgtttaagaaaatttttacaaaggaatcaattccatttagttaaaaaaaagtatgaagaaaaggcacaacggagggcaatgaatgtgaagcgaagggcaaagggggggggggagaagcatttacggctttaagggggacggacggaaggattgggaaaaaggagatggatgacataataaaagtaaaaaataatgaagtaaaaaggcaaaacttctgctgtgtgggacctaattaggcttagaataaagcaaggacgtgccagccagacccttggctttggcttcgggggggggggggggggtgaattcaaaaattcgatttttaggggtgtatttttttaaatcccgagaattaggagatttaatatgtgttaattaaataatttacaattattatttttttgttttaatttacttattgattgatggcttttagtttgtttccatgtgtttatgccgtttttgaaccaaaaatgcaaaatttaaaaatttgaattttcaactttttttcgaatttgggtctgggtttagggattggtcgaaatgaatgccggattcgtgatcaacag

SEQ ID NO: 3092 - DNA, 2561 bp, Heterodera glycines
  misc_feature (2250)..(2250): n is a, c, g, or t
  misc_feature (2320)..(2320): n is a, c, g, or t
  misc_feature (2341)..(2341): n is a, c, g, or t
  misc_feature (2374)..(2375): n is a, c, g, or t
  misc_feature (2395)..(2395): n is a, c, g, or t
  misc_feature (2404)..(2404): n is a, c, g, or t
  misc_feature (2473)..(2473): n is a, c, g, or t
  misc_feature (2518)..(2518): n is a, c, g, or t
  misc_feature (2542)..(2542): n is a, c, g, or t
tcattttgaggacacagcgacgcatcagaagaagaagaatggggggggggggacaaagaaaaagaaagcaacatttgttgaaaagggcttctcaccatagcatggaaaatggaaaacttttatttttatatgtatgccattttttgatttcggtaatcaaattaagcctcacaaataacccaatggttaagtgacaaacaaacattgaaaccatgagaaactctcattgggttaaacttctttaaagcaggctttgaactcagcttttaaaatcctcatggagccctaaatagcccatttgtcaattaataactttttttaattagaaatacatatgagcaacagagaccaaaattttaaccacaccagcggactgccaattttaataactcagcagaattgcgagccctaaaattttaagttaattttaaattattatctaaaaaagttgcctaaagatgcatcaaagaattagcgagatgaaattaccatattgctaattcctaccgtaaaagattaattttgaattaaaatctttggcattatgttttatctttctgtctaacaaagttaccattaataaaataagggcggcagacactgtgagagtgtgttttgctagcaacgccatttccacttacctaaattgttaggaaattcctttgcgacgaatcgatttttattttagccatttttaactttgtgtgttcaaatgtttgtccatcaatgtctttactatgatatcaaattcagttcattagttttataaaaagtaggtgcttagtcgacctctaaatgcatcagtgtctgtttcatacttttaaagcgtttgaggcatttatattgatataatttgtagctaaaatattacttttgacttttcaaatgtcatctcgacgtggcggtggtaataatgttgagggaaaggtttacgttggcggtctgccagaggacgcaacttccgaagaggtttcaaataattttttagttaaattagaatttacacagttcatatgtcacaatttcagctcgacgacgtcttccacaagttcggcagaattcgtaaaatttgggtcgctcgtcgtcctccaggttttgcctttgtcgaatttgaggacacgcgcgacgcggaagacgcagtgcgatcattggacggaacgtaaaatagttgtttttttctgggaatattcaaatggtttaagacgaatttgcggtgttaaagctcgcgttgagttatcaacgggccgttctcgccgcgatcgcgatgaccggggcggtggtggtggcggataccgaagcggcggcggtggtggcggcggcggttaccgtggcggtggagggaaccgcgactattcaaggtttttgttcgaaaagtggccgaatttggaggatcataagaacgcgaaattgcagagtagcaaagtcattcgcctttttcagcaaatcctccactcaatcgtttcttcaaagcgtcctccaccctttttcctccactgttcctcctcttcctcctctcgtctttttcttcccatccttctgaccaatgtgttactataatgtgttgctttgtccaaaatggcaaggcattagaagtgaatgattggacctacgcgttttgcccctaagttcggcttaatacgattgtttcttcgatacaaaacgccaatttgggcccattgttcgccttctcaatataacttcactccgttacttccctccctccaaactcttcactctctccgcttcactcctccataatcgttccactctccaatcagatctcgttcgcgttctcgttcgccgtaccagcgtcgcggaggaggaggaggccgttctcgctcgcgttcccgttgaaagatgggaggtgaaacttaccgaatttaccaaaaaagtgcgaacccaattttagggatctacaatttccgaagaagttgtgacgaactgatgcgatttcaaccattggcgattttaaatttgtttcacgtttttggtataattttgggttaaataaatcgcctataaatattgaatattcttttatgcgaataattgaatatatggctctagtgcactttaagcgtccaatcaatgaccatcttcaattcttttcaaatcccgtaaattctaaaagccgaggacggagggccccagtcgcaaaaaagcccatgtgatgtggagccggtatgttgtagcgcccgagcgagcggtgccctacctaccaattgcgcaacgagtgtggactgagtttgngccctcagattaatattatcacggaatttttcttaatttacatatttttttgaatcaacaaaattcattntaaataggaaagacaccctanaacagccaaaggagttgcccctgtttgctgtgnncaacgtgaatttgatagaanagcaagttncagaggaaaacgttagcttctcaaaaaagggtatactggagaatatgggctcccaggctggagcgcggncgcgatccgcgatttcgcggcgtttttttttgcgcgatccgcggnccgcgcaattgaatgcgcgtgggngcgcgcggttttttttttt

SEQ ID NO: 3093 - DNA, 3677 bp, Heterodera glycines
  misc_feature (2989)..(2990): n is a, c, g, or t
  misc_feature (3001)..(3002): n is a, c, g, or t
  misc_feature (3009)..(3010): n is a, c, g, or t
  misc_feature (3023)..(3023): n is a, c, g, or t
  misc_feature (3031)..(3031): n is a, c, g, or t
  misc_feature (3035)..(3037): n is a, c, g, or t
  misc_feature (3043)..(3043): n is a, c, g, or t
  misc_feature (3049)..(3051): n is a, c, g, or t
  misc_feature (3057)..(3057): n is a, c, g, or t
  misc_feature (3064)..(3064): n is a, c, g, or t
  misc_feature (3083)..(3083): n is a, c, g, or t
  misc_feature (3089)..(3089): n is a, c, g, or t
  misc_feature (3096)..(3097): n is a, c, g, or t
  misc_feature (3099)..(3100): n is a, c, g, or t
  misc_feature (3103)..(3105): n is a, c, g, or t
  misc_feature (3108)..(3110): n is a, c, g, or t
  misc_feature (3112)..(3114): n is a, c, g, or t
  misc_feature (3128)..(3128): n is a, c, g, or t
  misc_feature (3142)..(3142): n is a, c, g, or t
  misc_feature (3152)..(3152): n is a, c, g, or t
  misc_feature (3157)..(3157): n is a, c, g, or t
  misc_feature (3163)..(3166): n is a, c, g, or t
  misc_feature (3170)..(3170): n is a, c, g, or t
  misc_feature (3176)..(3177): n is a, c, g, or t
  misc_feature (3180)..(3180): n is a, c, g, or t
  misc_feature (3188)..(3189): n is a, c, g, or t
  misc_feature (3192)..(3196): n is a, c, g, or t
  misc_feature (3201)..(3203): n is a, c, g, or t
  misc_feature (3210)..(3210): n is a, c, g, or t
  misc_feature (3214)..(3216): n is a, c, g, or t
  misc_feature (3218)..(3218): n is a, c, g, or t
  misc_feature (3220)..(3220): n is a, c, g, or t
  misc_feature (3222)..(3222): n is a, c, g, or t
  misc_feature (3224)..(3224): n is a, c, g, or t
  misc_feature (3228)..(3232): n is a, c, g, or t
  misc_feature (3247)..(3248): n is a, c, g, or t
  misc_feature (3261)..(3261): n is a, c, g, or t
  misc_feature (3264)..(3265): n is a, c, g, or t
  misc_feature (3274)..(3274): n is a, c, g, or t
  misc_feature (3277)..(3278): n is a, c, g, or t
  misc_feature (3286)..(3286): n is a, c, g, or t
  misc_feature (3288)..(3288): n is a, c, g, or t
  misc_feature (3302)..(3303): n is a, c, g, or t
  misc_feature (3314)..(3314): n is a, c, g, or t
  misc_feature (3316)..(3316): n is a, c, g, or t
  misc_feature (3320)..(3322): n is a, c, g, or t
  misc_feature (3324)..(3324): n is a, c, g, or t
  misc_feature (3326)..(3326): n is a, c, g, or t
  misc_feature (3328)..(3328): n is a, c, g, or t
  misc_feature (3333)..(3334): n is a, c, g, or t
  misc_feature (3336)..(3338): n is a, c, g, or t
  misc_feature (3345)..(3352): n is a, c, g, or t
  misc_feature (3367)..(3368): n is a, c, g, or t
  misc_feature (3376)..(3381): n is a, c, g, or t
  misc_feature (3383)..(3383): n is a, c, g, or t
  misc_feature (3389)..(3389): n is a, c, g, or t
  misc_feature (3393)..(3393): n is a, c, g, or t
  misc_feature (3396)..(3396): n is a, c, g, or t
  misc_feature (3399)..(3399): n is a, c, g, or t
  misc_feature (3401)..(3405): n is a, c, g, or t
  misc_feature (3409)..(3409): n is a, c, g, or t
  misc_feature (3413)..(3414): n is a, c, g, or t
  misc_feature (3416)..(3416): n is a, c, g, or t
  misc_feature (3434)..(3434): n is a, c, g, or t
  misc_feature (3441)..(3441): n is a, c, g, or t
  misc_feature (3443)..(3445): n is a, c, g, or t
  misc_feature (3451)..(3452): n is a, c, g, or t
  misc_feature (3460)..(3460): n is a, c, g, or t
  misc_feature (3466)..(3468): n is a, c, g, or t
  misc_feature (3472)..(3472): n is a, c, g, or t
  misc_feature (3483)..(3484): n is a, c, g, or t
  misc_feature (3492)..(3494): n is a, c, g, or t
  misc_feature (3506)..(3506): n is a, c, g, or t
  misc_feature (3510)..(3510): n is a, c, g, or t
  misc_feature (3512)..(3514): n is a, c, g, or t
  misc_feature (3523)..(3525): n is a, c, g, or t
  misc_feature (3530)..(3531): n is a, c, g, or t
  misc_feature (3533)..(3534): n is a, c, g, or t
  misc_feature (3536)..(3538): n is a, c, g, or t
  misc_feature (3542)..(3542): n is a, c, g, or t
  misc_feature (3547)..(3548): n is a, c, g, or t
  misc_feature (3552)..(3552): n is a, c, g, or t
  misc_feature (3559)..(3559): n is a, c, g, or t
  misc_feature (3562)..(3562): n is a, c, g, or t
  misc_feature (3567)..(3567): n is a, c, g, or t
  misc_feature (3569)..(3569): n is a, c, g, or t
  misc_feature (3574)..(3574): n is a, c, g, or t
  misc_feature (3576)..(3576): n is a, c, g, or t
  misc_feature (3590)..(3590): n is a, c, g, or t
  misc_feature (3596)..(3596): n is a, c, g, or t
  misc_feature (3598)..(3598): n is a, c, g, or t
  misc_feature (3608)..(3609): n is a, c, g, or t
  misc_feature (3611)..(3614): n is a, c, g, or t
tcttcagaaaatgcactttatctctgatgaattatgatcgcacggtcatttacaattaatattccatcttatgcgtctgatcatcgatattgttcttttgtccgtcactcattgtcagcagaagacgtcccctttgtgatgctttgtcccgcttcatcttccacttcttccggtggcggagacaatggcctaaattaagcgcaaaattcaaattcggataaaaatcaaatgctttttttaattgctcacccaatgcaattagtgccagcaacaagccaaatgaacacattgttacaattgttgtcccaatttccgtcttcccaataaaccgccgcggtctccccaataattttgcatcgtttcattatccatcggttgtccaattcatttgctttggccaatgtcagcttttcctttgtccattcgttcaccaattcaaatggcaccatttgtattgacagcgcatgaacagaaaaatgaatttggtagctaatggaagaaatggcattggcacggagaaaatgctaaacaatttggaaaacaaaaatcagtgatttgtcgaattatggccacacctccttgaaattgttgacccaatcgaagtccgtttgtctgtataaatctgcgcaacgcaatcgtttgggttggccatcttttctcggagagtgcaaccatttggacaatgcttggccagcagaaattgttgaatttggcacatcaaaatcatcaccaatcgcagcgggaaacaaatcaaatgaatggattgaagtcaattggttgagatcagtgagaattgttggcgaagtgcgacgaagcaaattgtccaaatgatcaccatgccataaagctttgatttttaattactaaatccgaaggtgattaaaacggattttgctgggcaacggacggtcgtctgggaatggaaatggcacaaatttgtcacccatttgtacagatagtttcggttctggtcctttgtccttgccagggctggagcgcggccgcgatccgcgatgcgcgatccgcgattcgcggcgtttttttttgcgcgatccgcggtcgcggccgcggcaatttgaatgcgcgatgcgcggtgcgcggccgcggttttttttttgcgcggtgcgccgcgcatttttaagcactggtaagaatgggggtctggtgagaaaagagaagggaattggagaggaatgagaaattttttagaaaaaaaaatattttttttatttcatttaaagtattcctccataatcttatgtgttgtagtggctaaaccttctgaccttcagtgtttgtctcttgggttcgattcctcaacggaacagaaagttttttcatattttctttacattatttcaattgaaatttaattaataaagaaaatattccaacttttatttttctttaatttttaaacagcctaaaatcacaaattaaccttggtcattttttgacaaattatgttaactaatctcgctgaaaatatcaaaatattccggcggcgcctatcggcaccaccgccccccccccccacaatgttcccaaaaagttttttggaaccgcccacaaaaacgcgatttaaaaaattaatagattgttaatttattcaaaaaaaatccagaattttgggactcagaaaatccaagattcccccccccccccccgcatgaaaatttaaaaaaaaatttctatataatggaaaaattcttcgaatgcctcccccaatgagtacatattttaatataggcaattttcgtaacaaagtgcagtcaaattttcaaattttttttcaaaaaaactttcacttgggaaaattttattgattaaattgaaatttttgaaaattttgtttttaaatgcgcggtccgcggccgcggcaatttgaatgcgcgatgcgcggtgcgcggccgcggtttttttttttgcgcgatgcgcggtcgcggccgcggcaatttgaatgcgcgatgcgcggccgcggtttttttctgtgcgcgctccagccctgcttagtatagtggaagggattgtgccactaccccaaaatcagaacatttcttagaaataagaacaaatcgaagccatgtatattcgagttctgctgctctgagattagaatcgggttaaatggggagtgatcagagacccagaaaatatcctgaacacatttcccgacttgacattctcttaaaaaattgtttgcaaactaaaaaactaaattcaaactcgacaattaaatagtgcctgcctaatagaaaacatgaactactatatctaccagccctttttgcaaaaattaataaaaaaaaatttttaggagttttcgagattactgatacgagtattcagaacacaaagtcgaaattaaatgttttcgttttttccgcttaaaaatggtttaaatcagggttacacggatccgggtacccgaccgggtccagacgcggatacccggctttttcaagacctggacgcgggacccgactttttgaaaaaccaatacccggttcccgacccgataggtctgggtccactggtatgaatggggggtctgggtcaaattaccgttcaaatttgagggaaggaaaaattataaaaattaattaaaatgttcaggttcaaatccctcttaatccagcaaaatgtcctttttggataaaatctgtaaatatctagcaaaaaatcccaaaaatcttaccggcagcgcctgtcggcgtcccaggcgcccaaaaatccactaaaattaaaaaaaacaaaaaatccacaaaattgtcattgcgcctatcggcactgccgggtttcaaaattctcacatgtttaaattcataaaatcgacaaaaactgatattgactatttaataaatctattcattagagctcgagctggacctggatccaaacctagatttttcccagatccaggtccaggccatttttggcaacctgacaagtaattgtccaattaaggtacttggacattccacagtannatgtggttcgnnttttggnnctgtcccgcctcncggttggncttnnntttttnccgccnnnagtatnagtggcncatgcccttcttttggttntttttntttttgnntnnatnnnatnnntnnncctgctgggttggncctggggttctggntttttgtccnggtcnttcggnnnntcgntttttnncgntttttttnntgnnnnnttttnnnttcttcntttnnntncntntnttgnnnnngttcctttttgtccnncttttggtgctgntcnngtctttgcntcnntttggtcngntctcttcttcttcnnggtgttcttgncnctgnnngntncncttcnngnnnttcttcnnnnnnnntcccttggggttggnntttttgtnnnnnntngtcttntggncgngcntnnnnntttnccgnngntttttttccgtctctgcntttgctntnnnttcccnnctttgttngccttnnngggnttgttgtcccnntttggccnnngtctgtgcttcnctgncnnngccttgccnnntgctnncnncnnntttntttgnngtcntcccttnttntttgncnccttntnctttgttagagtgnttgtgntntgtgtggctnngnnnncggccctctaaagacaatcaaagctgtgtaatcaatgagtttatggaccgcaggcagcaagct

SEQ ID NO: 3094 - DNA, 2078 bp, Heterodera glycines
  misc_feature (9)..(9): n is a, c, g, or t
ggaaggcanttgaagaaaaatttatttaatttatttccttcatacaatttcgcaacacagaataatggcacttggataactggatttttaaaaattaaacaaattctgggatagaaaaaaatgtgataaaagataagaaaatgatcagcattaaattgctcatgatcagagaaacaattaagaaaggactgatcaaaaattgtacgcaattttcctgatcaaaattgcttatgggacaatgccaacgttttggtcaaagacagggaatgagaagggaattaattgcacaatatgtatgtatgtgagtttggaaatgtcagtattttacccaatcgatcggttgatcgatcaatggcaaacgccagttgatcaatcaataatttcgctacagcttctggaaaatttcctttattttttaaatcgactcaaaaaccgtgaatattctaagaagtataaaaatttacaaaatatattgctcaaaaagttaattatatttatttatcgaaaagggttggttggtctctagaaactagagaccggcgcgggattttgcgggatcccagtccgcaatcccgcattttttgaaaaatttccgatttcttgcatcgcaaaaaagtggttttgaaaagaaaaaaaagtcaaatttatgaaccgttaataatttgatttccgatcaactttttaccgtcggatccaatcgaaaaatcttagtcgacccatcagccccttttaatgcatcccgccagcccctaaaaatttattttcagcattttttgatttttggaaattttttgaatttaattgaaattttttcgattttccaaaatcccgcacgggatcccgcaaattttaaatgcgggatttccgggattaatcccgcgggattccgtccctcaaaaaattttgagttccaatcacgcagcgggatccgcaaatttgaaatttccggtctctactagaaactgcgtcaattgataaaatttgatatttaaccgaaattatgtgatgaaaaaaattttggaattaaaaaaaaattttgaaaaaacttcggcttcgaaaacttcgggttttgtgggcttcgagcttcggacttcggcttcgagtgctaagccgagcttcgcccagcataatataaaattacattaaattattttgaaaagcattaaaaaaaattttcaaataaatatagaaatatactaaaaacagtttgaaatcaccttttacatggtttagaattttaaatttgcctattaaatatttaaaaattttttattatattgtatatttttgaaaaatttccgatttccgacgtttttggggttggaaatccgatttccgacacttccgaaaatttttggggcctcggaatgccatccctgataaggaccgccggacccctgtatttatttttcagcattttttgatttttggatttgactttaattgaaattttttcgattttccaaaatcccgcaatcccgcacgggatcccgcaaattttaaatgcgggattgcgggatttccgggattaatcccgcgggattccgtccctcaaaaaattttgagttccagtcccgcagcgggatccgcaaatttgaaatttccggtctctactagaaactgcgtcaattgataaaatttgatatttaaccgaaattatgtgatgaaaaaaattttggaattaaaaaaaaaattttgaaaaaacttcggcttcggcttcgaaaacttcgggttttgtgggcttcgagcttcggacttcggcttttaattgatatatatattttattattttttaaatgaaaatccgtacaaattgagcctaataatcccaaaaaagaagccattttgttgaaaatctgttaacaaatctcactcaaattttcaaaatttcccccggcggcgcctaacggcaccgccggaccaccttttttcccaaaagttttctggaaaaagcgcgccggaaaaagtggtgtgataagtaaatttaaatttcaaataatattcgaccatttagcccaaatgattaattgcttgaaataattgaagaaattttgatttgaaaattttcattaatttaa

SEQ ID NO: 3095 - DNA, 3707 bp, Heterodera glycines
caattcaataaaatttaccagagaagaagtatttggtaagaaagtaataaaaaaattagttatactattatctatcgagatataattcaaatgaataaaaaacagaaaaatttgaacaatttgtaaatttccacgccaataataaccaagtcttaaaacttatgacggtatttagttttttggagttaggtatattattctacaacatttataaaagagaaagggaaattaacaatcatttttgaatttaaatcaattattcactcattaaaagttaataattatttaataattttcgcgtaaaaattataagcaacatgttaatataaaaaatcaattactgatgcaattattggtgggggaaaatgaaaaaaatatttttaaaataatttttgtcaaatcataaaattaatatatgcagaaattctaaataatttaattttgaaaatactttgactcaaaaaatgttgaaaattatttttgagattattttcttcttattcattatcgtactaattgatggaattgatgaagatttatttgatgatttgttgaaaaatctaaagccatcaaattcaaaaaacatcaaaaaaccgatatttggagaaattaatacgataaaggaagaaatagttgttaaaaatgaaaatgatgaacaaggaaatgccaatcaaattgaaatggaagacataaatccaaaattattacaaaagattaaaaaggaaaaaacattggaagaacaaaataataatttaaaaataaaaatgccaaaaattgaaatggaacaattggaagaagaatcatatgaaaatgagtttgatgagcaagctgatcagaatgtttcgtctactgatcacaacgattctgttgatcaagcgtattataatattatggtaattcaacaatcctgtaaaaaattatttaaaaattcattggttctaagttttgcattaaaatttgcacaaggtagtggcaacgaggtccggtcaggtatggtcgggctcggtcgatgggtcgggggcaattggtcgaacacacaattcacacaacaaaataatgctttattgttccctctcaaacttgggtacagtgccaaagagcgaaaccggggaatgccaatgagggaccgggatgggtaatgtatcacaattggacagagaaagggactaggaaaagaaatggttaaggcatgggtaaagggaaagagaaaggaagagagagagtgtgagagcgggcaaagggataggcattgattgcccgtaaaagcgaagtgaatgtgaattgggagtgatttgggggccatttaaatatggaatagggaaagagataaaaaattggggcaaaaagtgaatattgttaatttacaattaatatgggctgatcactacaaattgggggagcaacgtactttggagggaaaatttggcgaacaaacgtgttcggtctttgaaccgactcaataaaatgtttatttgtaaaacaaataaattaaacaatttaaataaaaatgggcgaagtcggtggcgcgaataaataatggaggagaacaaatatttaggcgaagtgaaataagtgcataaaaagcaactgaatgaatgaggggaaaggacatgagacataataaatcaatagtgtcttacattaataaaggaagacacaacaattagagagtggggaaaataagaggaaaagaaagagacaaatgcaaagggaaaataaatgcaattgtgaactcactgctcctttttaatcgttttaattgatggaactgatgaagatttttttgattatttgtggaaaaacctgaaaccatatatttttaaaaaatcgctaaattctcagatttttttcttaaaaatgaattatttcaatagaatatagaagaaataaatgaaatcgaaattttaaataaatttaatttgatgaaaaaggaattgcgcaaagaaattttttattaaaatttaacaatgtttcaatttgaaagtgaaattgcaaaaaaattgggcacaagtcgctggaaaatttataaattgaaaaaaaaattggaaaaaaaaagagagaagagaacggaggaaagtgaagaaacaaaaatgcaactgatcagaaaatttgatcaaatgagaaaagaaaaaatttgtggacttaaatatgacgagaagaaaagatcagtaattgaacgtgaaattgctaatgaattgggaattaatagaaagaaaatttataaatggaagaaggaattggaattaggtaagagaccaatggtctaatcgaattttgacaaattaaaaaaatcaatttgaaacaaaattggaaaattgataaaaaaaatagcgtaaaaattggggttgtgtggaaaacaatttatagatggaagataaaatcgatcaaaatttataaattgaatataaaattaagaaaatttccaaagaaaaaagaggaaaatgaagaaataaaaacggaactggtcagaaaatttgatcagaccagaaaagaaatgatcaattttaggaaaaagcatcggtcacaaataattttatcctatgacaacttcactattcagagaaaagcctagtgtactatctctttgtttcttttttctttgtaatgcctttttggctaggattaaaaaaagctctaggctaaatattttgttgaaaaccaaaacaaaagtactgatgaaattctttttttttcggtaagacaatgcacgaccaaaaaattgagagttcaattcaataaaatttaccagagaagaagtatttggtaagaaaataataaaaaaataattatacttattatctcattgagatataattctaaaaaacagaaaaatttgaacaatttgaaaatttccacgccaataataaccaagtcttaaaacttatgactgtggaaacctccacaaaatttgcacaaggtagtgccaacgaggtccggtcagggatggtcgggctcggtcgatgggtcgggggcaattggtcgaacacacaattcacacaacaaaataatgctttattggtccctctcaaatgcgggaaaaaccgggacagtgccaaagagagaaaccggggaatgccaatgagggaccgggatgggtaatgtatcacaattggacagagaaagggactaggaaaagaaatagttaaggcatgggtaaagggaaagagaaaggaagagagagagtgtgagagcgggcaaagggataggcattgattgcccgtaaatcgaagtgaatgtgaattgggagtgatttgggggccatttaaatatggaatagggaaagagataaaaaattggggcaaaaagtgaatattgttaatttacaattaatatgggctgataactacaaattgggggagcaacgtactttggagggaaaatttggcgaacaaacgattttttattgggggagaaaatgggcggacaatttcgcacagttgcgattgcgggagaaaaagtggggcaaatttgcggcggagggaaacttggggaggaaacaggatgtggaacgggcggggaacgggcggggaagggattaaaaaccaaacaaacaacgggagggaaattgagcagtcacgccacctcccttttaccccttttatcattattttaatgctaaaatcaaaatttgatttttcgagtttcgacatgacggtatttagttttttggagttatgtatattattctacaacatttataaaagaga

SEQ ID NO: 3096 - DNA, 3474 bp, Heterodera glycines
tgatgtccatcatgcactttgttctgttggatgtgcgcaacgcgtcaatgctctccccgtttttgcctccaccaaactctcggtgcattccgcgttggcctacccatttgcaacaccaaatttcaaccggcaatcctcgacatcctcaacagcacccatggccggctctgaaggagtcggccaacaaaaacggcaaaatcatcatcttcagcatcatcggctaactccagtgaaaaggcacgtgtttcatttgctttttctttctggtcattaaaaatttgttcccttttttgaagttgggcgtcggcgggttcagttttttatttaaagacgaggattaacccgtatttttgtttaaatgtagaggatttaaaaatttcattgtttttttaaaggatgttgacggattttgtgcgccgttgcggcagtcagtcgatcatcgaggacaaacagatcagcaagacaattttggaggtttgccaaagaggaaaccaaaatgaccttttgaaaaattttaaatgaacaccagagcagctgatatccgaacagcgcaaattcctcctgcatatcagtgcccccccagaatttttttttgaatttttaaaagctaaatttttcaagaaaaaaactgttctcggcggtgtctcttccgttggtggggcatccattaacattttaattttgccggtgaattgtcctatttggaatttcatattgttatattgaaaatttattccgaaaattgcagtttttacaaaagaagggagcagggaaaaatctgaaaatttttttttttttttttttttgcgtcggttatgtccaggcgacgttttggaatgtatccacaaaagaaattcccaaaaatctcttggaaaattctgtgcattaattttttgaactgctttctctgccaaattatttaatttttcacttcagctttgccttccacaacctctgccggtggtggcgctgcttcgtcttccgcctccgtgttgcgttctagcatcaaagacagcagcggcggtgcggccaacaaaaaggacccgtccgactcgacgcaggcgctgtttctgctggctgaggtcagtagttagccggccggctaatcaaattaacggctacttaaatctgatacctaatactcttccagaatctggctgaacttatcgactcggtctgcaaaagtgaggacaaagaaaaactgttgcccgcactgcaagcagtttggaacaacacattgccctattcggtcgaagggtacgggggcaattggtcgaacacacaattcacacaacaaaataatgctttattgttccctctcaaacttgggtacagtgccaaagagagaaaccggggaatgccaatgagggaccgggatgggtaatgtatcacaattggacagagaaagggactaggaaaagaaatggttaaggcatgggtaaagggaaagagaaaggaagagagagagtgtgagagcgggcaaagggataggcattgattgcccgtaaatcgaagtgaatgtgaattgggagtgatttaggggccatttaaatatggaatagggaaagagataaaaaattggggcaaaaagtgaatattgttaatttacaattaatatgggctgatcactacaaattgggggagcaacgtactttggagggaaaatttggcgaacaaacgtgttcggtctttgaaccgactcaataaaatgtttatttgtaaaacaaataaattaaacaattaaaaaaaaatgggcgaagtcggtggcgcgaataaataatggaggagaacaaatatttaggcgaagtgaaataagtgcataaaaagcaactgaatgaatgaggggaaaggacatgcaatggacataataaatcaatagtgtcttacattaataaaggaagacacaacaattagagagtggggaaaataagaggaaaagaaagagacaaatgcaaagggaaaataaatgcaattgtgaactttcatctctcggggttgaccacccgaacaaaacgattttttattaggggagaaaatgggcggacaatttcgcacagtttcgattgcgggagaaaaagtggggcaaatttgcggcggagggaaacttggggaggaaacaggatgtggaacgggcggggaacgggcggggaagggattaaaaaccaaacaaacaacgggagggaaattgagcagtcacaccacctcccttttaccccttttatcattattttaatgctaaaatcaaaatttgatttttcgagtttcgacatgacggtatttagttttttggagttatgtatattattctacaacatttataaaagagaaagggaaattaacaatcatttttgaatttaaatcaattattcactcattaaaagttaataatttaataaacaagtaaaaaaaagacgaaatttccaaaaattttttcgttcttaacattaatgacacaaacatggcaaaatttttggagtgtcaatcaaaaccgtcccaaacatacgatgaacttttaatggtcgctaatcgtcttagtttggtggaagagaaaacatagggacgttcggttcaaatcagaaattcacaaaatccattccaattgccaatcgcgaaccaaatcccataccaaaacgaacaaattcgttattttggtaaaagaatttccaaaattcgtgttctcttttcaaacccattccaaattttgcaccaaaatcccagggtttcgtctttcctatcttaatttgggttgatcattgtgccattgcttttcaatcccttaaaaaatcaaggatgaaaaacaccaaattccaagtcgcaaagacaaacggcctctaccggttcggagagctgataaacgaggctatggaagaagtgaaagccaaaaatattttgggttttcaacaattggaaaaatcaaaaatggaaatatttgcaatttttttttgcggtgtgtaaaattttatttgtgggccataactctttcctcaaccgattaatatttcttaaatttaccatatataaaattttttggaattccataattgtttttcaagggtttactatacggaaacggaaatttacatgtaaatgaaattattttttaatcaattatttacgattaaaaacaagataaattgcaattaatttgataatttctactttatgaaattttttttttataaattacataatatatatatctatctataataaatataagctgaaaacaaaaatcatttgatttttttgactcaaaaaaatggaaattaattttgtgattattttcatcttatttctaatcgtactaattgacggaattgatgaagatttgtttaatgatttgtggaaaaatcttaagccatcgacctcaaaaaacttcaaaaaacaaaaattcggagaaataaatgcaataaaggaagaaataattgttaaagaggaaaagtatgaacaacaaaatgccaataaaatagaaat

SEQ ID NO: 3097 - DNA, 1950 bp, Heterodera glycines
gttccgcttcgctgttcaacatcaaaacgttgacttcataccaggagttgcacccgttcttccatgcgttgaccatgcaaaatggcactggacaaaagcagcgacacatttgcaatggacaaaggcagtaattctcggagatggacaaattaatgagaaacaaattgattggtgatcaaagaagaaaaaaaaagttatttgtttttatttgcatgccttttttgttgttgtttttatattatttgtgttttttccaccatttaccgctgcccatagtcttccccccccctcggcaacaaaattccgtgatctgcaaaactggaacaaaaaaaccaaaaaaggaatactgaatggcaatgataaaatgaaaaataaataaaatggcggccaagaattagtagtcttatcttgtagcgtacgctgacccctcctattcctcctgccttccacttacggtggttgagttgactgctgctgttagaggcagagatgacaaaacatggaaagactatttgtatatgcccgcggggcagtgtctaaccaaaaattttgcataaatctaaggcaggaatgagataaatagtaaacagattttcacttcatcagcaccgcaggcaaattcattctcctcattgcaacgatgtcgctccacccctcactcttggctcctcctccctttagattcaactgattcgcctatttttgatttagatattaaagaattactacaatattttcagcaatggcggcgcaaaatgttgacaatgtaaaaaataatagtaaaattaagcttagtgtcagaatgcccgattcaggcacgacccctccacagcaatccaaacctttttcctaaatttgttaaacttaaaaattgaaaatatgcgcaaaatgcaaaaaaaaaacatttgtagtctcaacctctgaagattccaacacttgaggactccgatatctgagagcctcgacatttgaggactcctaaatttaaggactccgaagtttgaggatccccactcgaggatcgatacctgagggcctctaaatttgaggacatttggtgacccgaaacttgaggattccgacatttgattgttgcccaacattgtagatccgaaatacgaggcacgcaaaatttccaaaaggctgactcagtttttaatcaaaaaaggatgccttttccaaggcaaacgggattattgaccatttaaggacattcataaatttctaaactccctgtcgaatggattacaaagcaataagtcctgatatcaccttttatgtttgattttcctggttatcattatgctaaaccatatgcaatttctttcatagcaccgtgctatgtaatacaatggtgcataattgtgcaccctaatttcaacaaagggttctgatgaccattttaccaaaggtttgcctaattccgaacccctgactcaacctggaatatttctacttgatttgactctaagaatgaatacgatccggtattccgtattatataaccagagaccgactgactaaaaagggcatcaaaaatcgcgaagaagacaccaaaaaaattcgacaatgattgagttctacagtagcgataaatttttacaaacaccagtaattaaaaatttaagcataaaatgaagtgatatgagcacgcaagtatcacgactttcattcagaatcttcgacgagggcttgtggatcgtgatttgctctccctgtcacgcttcctttatgatttttacaattttttcaaccaattaaaactttttatgtgcaagtcgctaccattcaaaaggcaatccggtagtaaattttgtgctcttccaatgagcttattcaaatttccagaaaaatttttccaaccccctagaaattttttctaaaatttccccgattttcaacgtattttgtggtgtcccgatcactatgaagaagtgatctaaacaagtt

SEQ ID NO: 3098 - DNA, 2402 bp, Heterodera glycines
aatccgggttgacgtaacatatcatcacatttggatctccgctggtggactcagccaaaaaattgtgtgggattatgcagccagaattgatgcagatgtagccgagtatctccgccgtcctgaatttgaccttcgtggaactatgccagagcacttgcttcgatggttcgcgcgcaatgcaggtctcactaaccaataaaatgtgatcccaatacattttgccaagtttctcctcccaaacatggcagtttccttttccatttgttttggctatttgcaaatccaattgagtctttgcttcctttttcataaaccataaactcttcaaaattggcaatccgtcaacatattttttcttatattcccgtgcaaaagcacaaattcgtgacaaatctatgaacaaattttgttggtggcattttatttaataaaataaactaattttttataaattaaatttcaattgcttaccaaaacaaagttctttaacaattttccagatctttaaataactgtcggaaaattccttcaataaaaaaattttgtttttgttttcctcaacagattttttgtagtttaaataatcattattccttattaatagcaagattcaaagcatttaactgttctttaattggtaccttgcgcatattatggctatttgtagcgacaaatgcggctttaattacttttttatggtgaaaatagtcataaaatggttaagccacaaaataagagcattttcaaactccaattttgaataaaaaaatacttatgttttgttaaaaaaaatatgttctgtcgagataggcacgttgtttagcagaaacaagtgaaaagtacccgaaaatttttaagaaaaaattctgtaaacttataatgtgccagattgttcccttggaaatttttattttccatttcgggggattgggacccatctatttttttccaaataattacaagagagtatcttccgaaagcattgaaacttactcgacacaatgtcaaaacggtcgctgtcatttaaatcgtttatcgaaaaatttgttgaagccattaaagcatcaaatttttcaacactttttgctgatggaattgcaattcattctttaattcactgagttgttcataggctagatttgaaccaaaaatgcaccaatttcccaatgcttttgattttctaattgtaccttaagaatttgttttttttattttataaaattaaattttacatttattttcaagtgatttcccgtgccacaatcgaataggtctcgattagctgctttgatcactagcattgctgaactcatttggagttcgccttgcccgaccagcaggaattttggcttcatgcaatggcattccaatggattttctaataaatttaaacaattttttgaatttttaaaaattttatttagtgccattttcttccgtcttaagtgtgtcttgtgcccttgttgaacttgtgccaacttcagcttcgttctcctgttttggtccttttttgcacctcttccaacttttcacatatgcttcagctgctattgataacattttccaatattcgcaaatttcaaccaattcttggtaagattttttgaatccaatttcttctggctttttaatggtattatttttgcaattcattgccattataactcgccaaaagaatcttttgaggattttaattgctttttccatgtcttcctcctccgttgtgtcatcttcgatcacttcaaattgggactgctgatcagtgtcttcgtttgaaagtaacggttcttttaacttttcatatttgtagtccattccattcgcaacattgacaattccattcatggttatcagaagaagagataggtggatgaaagggatttggcacattttattaaaaaatatatttaagccttttaaattattatataagttttcatttaaaatgccacttttatttaacaagcatttcacgtgctccacaaatgtacaacacaacatcaattttctcaataatatttgcatttatctgcaaaaaataaatgccaaacttttttttataataaaatatgttagaccataattcggtagaagattctttcgacaacatattttcaaaaataaaaatttcaagtttgaaatgtttcgtaataaaggcattattaaaaatttatttttcatccaaattattttgcgcgaaaaactggcggaaattcatgtattatataattaatgcaaggaaatttccagaaaatatttgcatacactttaaatttgggtaggtctatcctatgatgaaaaaaaaatcctgttttgggacatgctcattttgctcacggtgttgtgttgcttgaccgttttggtgccgtcaattttggcctgctgttgcgactgttgctgct

SEQ ID NO: 3099 - DNA, 2136 bp, Heterodera glycines
ggggctctgttttagggaatatggtataacaattcttacattcgccaccatgttgaggtggcggtggaggctgcggatgttgtggttgttgcggttgtggcggtggcggtggcaacaacaacgacgccgcactgttagcagcaatcaccgcagcaaccgcttctaccacgggtcgacgtcgtcgacgacagcccggcacattttgggacagtatcatgcaacgtttggcacgtgcaacagcgataacaacggcaccaagccaggtacacgtagaataagctgataatgacaatcttatagttcgttttgatcagtggaaaatcaaaatgatcatatttgcgaaatgaaaaccacaaatagaaaaattatacctatcaaattctcgacattttttagaattctcaagtttttgaataaaaaagtatttataaatttgatcaaattaactaaatttttatttcttcctttcattaggtagccctaattattattctctattaatctgctagttttcaaaaatttttttgtttcaaaaaaagttatgactagaaaaattttagtgttttaaaaacgatgatattaaaatagtttaacaaggtttttataatatcggaaaattcttgtgcataaatgaaaaaattggaaaacaaaaggtacaaaattcatctgccctcggcggaggagtccaatgcaattgttgttgtgagaatggacaatgtgtgaaatgtgcccagggacagtgttgtgtgaatggaaaatgtggccaatgccaacagggaacacaacaaaaacagaagcaacaacaagttcaagcagtacagcaacaagcgcagcagcagcagcagaaacatcgattttggcacagaatgttgagaaagaagcgcggagcggacgacgaaataaacatttgaaaataaaattaaaaaagtggcaaattgcctgtttttcgtgtataaatttgctttcgtaatgagttttatatgtatgtatgttatcaatttgctctattgattaaaccaataaattcggttcggaaaataggcactaaaaactttcgtaaaaaataattaataataaaaataataattaacaatattaccaataaagatttcctcccttcctcaattcttatcatttctgaacatataaaagcaaaaaaaaaaaaatagaatttacaaattattaaaaagacaaattataattaatttttaataaaaaatttttaaattaaaaaattgacattttcttcatttatttctctttctgaagtgaagcaatgcgccaaatgttcgcagaaaatttcccatttatatacatattcagggaaccagtattttttctatggacaaatttggtgaaaaatgatcacacgatcactattgtatggccaatggtgtcaatggtcaatgaccggaaatttttatgagacaataaatatttaaaaaatgtacacctcaggagacaggaaattgtaaataaatgaacatatttatctaaacaaatttcgcctatttaaaaagtggctgatcaattgaatattcacagccattttttgtcatttctgatcacaaaatgcggagaaatctaagcctagacaaaaaactatttagcatggggcagttcaagttttctttattcttttaaaaaatttagaaaaaaaaaattgattttcaaacttctattagttttatttttttaaatttatgcccttttgaaatttatccataaaatttttccacataatttctatttgaaatatttcacgttattatatctcaattgctcaaatgtaaaaatattttaataaaacaaaaacttttactattatttaaccaattaaaacacattaagaaatgccatcaaacaaatcccatgttaatgatatttccctgccgattctcttcgcgctttgttgcttgaccatcttggtgccgtctacgactttggattgctgttgcgattgttgttgcggttgcggtggtggtggcggaggtagcgtgggcaacagtgcccataatattgcaactgcgacagcactcgccaccgcgttgaacggctccttggttacattcccgggcacgagcagttcagttgcctcattattccattacaaaattatttgctcgttatttttat

SEQ ID NO: 3100 - DNA, 1099 bp, Heterodera glycines
  misc_feature (1083)..(1083): n is a, c, g, or t
taataggccccaaatgtcggagggagggatcggataatttgcccaaatctcgggggtggggtcggataataggcccaaaaatcgggggtatgttcggatgggtcggataataggcccaaaaatttcgggtggctcgggatcgggaggtaaccttaaataatttatgcttcatttatctcgaaacttccaataggctccacctcttctggcggtggatgttgctgcgactgttgctgttgcggtggtaacaacaacaacaataacaataatagcgatgccgcaactttggctgcacttgccgccctttcctcgtcgtcatcgtccggcgcgccaagcacaatgtcttccggcggtgttccgggaattcgtgtcgtgcaaatgccgggccgacgccgtcgtcgacgacaaattgcctccgttcagacactgattgcccgtgcaacacgttcaactccaagcaaaccagtggtaccaagcatggtaaaagtttgacttgtgtaattttgcataaacaaaataaaaaatgctaattttaaatatgaaaaaacttttaataataacaattaattggtgaattttattaggtatatgcatataaactcatgaaattttaaaaaggtgattttcttattcagttaatggttgtcagaatgacttaaaatcatgcagaaaaaaaccttggcaaattaggactgccagtagcaaaatttccaaattaattcagtcattctgataaataattaaataactgaaaaagaaaatcattttttcaaaatttctaagttttatttacatataatttccagcctagaataataatctgtttaaataccccaaaaagcacaaccgaacacatgcccaaattcttgtttaagatgttgagaaaggcgcgaaggatggacgttggaaaaaaacattaaatagaattgaaatgaacaaaatgccaaaattagcaaatctgttgttaatgccgtaatttttgaattgaataagaaaatccgcctgtttataaaactggactgtcctgtaaaaaaccatgactgtttgtaaaaaatctagtgtgaatcaaatagtttgacaaanagttttcccgactata

SEQ ID NO: 3101 - DNA, 3140 bp, Heterodera glycines
  misc_feature (3129)..(3129): n is a, c, g, or t
gggaaaagatgagagagtaagagaaagagagtgtctcaacagggaggaacagagtcgagaaaagacaaagagtagaggagagagatagagaggaacaagagagacgcataaaaaagatggtggagagagagagagagcaatggaaatcagatagatttttttccctttcactttgcactttcttcaatctcctccagtgtttgtcctcgcaatggcaattggattagcccgggggattacatctccggagtggggggggaggagggattagctatggaaatgtatctgaaaatgggagcatcggatggacgagaaggccggccaattccaaccaagccatccacttcaatccacttcagatgaagcaaagaattgcctttcgttcgcctaatggcatcgcaaagtcgataaatcaatacaataaaaattcactttgtttattttttttccatttttctattggcataatatttgaaactctccattaattcatatatagatggtaataatcttttttcgttaaaatgagaaaatcgaaaatatgaattttcgacttcttgtttgaattcgggcaagcggttcgaaattgggtgaaatggatgttatattcgagttacagcggccccgaaaacctattaatatttttttacgacttgttacatttttgaaaaaaatttcaaaaagttgtgctaccatcggaactagggttcagccccgaccccgagccccccgacccgacccgagacgtttttgggacctattccccgacccgacccccgacatgtcgtcccccgaggtccccggcccccgacattttccccccgaccccccgacactaattcgggggaattgggactccgaacgttgatatatttaaaaattaatgcatcgatattgtaaactttacctaacactaagccaaaataaatgcttttattactcttttagaaaaattaataatatagctttacctatttaactttgcacatattcacaattttcaatgaaatttaatagattttcacccaattgattattaatggcttcaaaagcatctgatatttggaattttttcattaaaatttcttcagaagttgctaagtgccggctttgtgaaaaccaattagcatgtaagcaatcgtgcaccaaaggattgtgggggcattttaaggcaaaacacgctaaagaattcgaaagctatttgcaaaaagccgatccatcaacggtagtaatacaatatttcttttattgaatataaaaaatttcagaaaaaccaaggcattaccaaaatttttggcaaagaagacccacaaaaaaaggcggatgaacaaattgcaaggctgataataagaatgaattgctcttttttgtttgttgaggcaccggaattacagaatttgttctctttagcctatccgaaactccaagtaataattttcacccatttttactagtgaaataattttttaagcttcgcagcaacgattattttcggaggaatttaattcccaaaatggcagatgaaattcaacaaaaaattgttgagcgaattggtcaagacttttttgctgtgacctctgatggatggtcgcaaattacaaaattacccgcactcttaaagttctctattccttttcatagtttataaaaacagactttagtgttactgtacaccatataaacaacaatttgtacgcgccgatcttgtacttgatgtaatcccaatgacaaatcacacaggagttgacatagcggaagaaattggaaatacacttcggacaaatggattaaacccagaaaaagttatttgtttggttcgcgacaacgcaaaaaacatgataagggccactgatattttgaacatgaataggttttacctaattctggttttttaattactattttttaagctttcaatgtgtgtgccattttcttcatctggttatgggagacgtattgcgactgcctgagttggctggactcattttcaaaattcggtcttgggttaccttttttcgtacaagtaaaggcctgccctgtccttgctaataggtcaaaaatcaataaatatattaattattttataatttaaggctttccggcaatactgtgcgcaaaattttgattgtgaaggccaatttggacgcacttttactggcaccaacgcatgaattagaatcagatgatgaaaatgaagaaaagacgatttttgagttcttaaaattttatttacgtgcatttaaaaagaaaaatttgattttttgttaaaaattttagttgatcactacccgatcggggtccccgacccccgacaattgagctcccccccgacccgacccccgacatgtcgtcccccgaggtccccggcccccgacattttgccccccgagggctcggggctgaaccctagttaaaagcgccgccgcaataattccaagaaaaacatattctaaaattttcagttacataggctaattcgaaaaaagtttaatgatgaaaattacaaaaaaaagagaaaaaaaaagcattttttaatgtaattgatgaaattttgtgggttttcccatagtaacttgtgaaaatttaaatttttaccaacccggactcccgggcccggcaaagtgccgaaagactctggcaaaatgacaaatcattctgacaaagtgccgaaagactctggcaaaatgacaaatcattctgacaaagtgccgaaagactctggcaaaatgacaaatcattctgacaaagtgccgaaagactctggcaaaatgacaaatcattctgacaaagtgccgaaagactctggcaaaatgcctgccgaaatcggcggcgagagagaatatttgttgctcgaaaaatatggacaaaagattctaggcaaaacaatcaaacacagtgaacaattgagaaaggtcattgaatggatttacaaaaaacagtgtctattggagccagttttcgataaaatttcaaaggtcaatttcaaaaatttcgtattttgggacaggcggtgccgaaagaagccggggaatttatgaaatttaataggatttttgttaatagaatacgttctaaaattgcgaatttttggtcttaaattaatttcttaggaaaattaagcccaactgntatcataagtt

SEQ ID NO: 3102 - DNA, 1664 bp, Heterodera glycines
aaaaaattttgaatttaaaaatttatatatgcaattttgattttttttttttttaattttttttatgctcaaattaaaatacttttttttgtatttttgcatcaaaattttttttcaaaagttcttataaaaagttaaaatttctcgattttcaagagtgtattttttcatttttattgcatttttcttatgaaaatttgccaatgaccgaaatatgctttaaaaacgaaaaaatgctttatagccctaatcataaggtacagcggggaaaattttttttattgaaaattattttctaacgaatctcttcaaaattaaaatgagtattgggggttttcgagggcgctaatcacgaatccgaactgggatttgcccaattccgaatcccggacccgaataaaaatgaaatatttttccagggatgaatttttctgaggtaaaagctttgaatttatttaacaactatttattttggtgtaaaaccagtgttcccaactctgcttatttgtaagcattttgctgatttctaggggtcaaagatgatttttttttgttagattctgatttgctgctttttgagaaaatttgctgatttttggaaaaaaatcagcaaaaatatctgtttttatgtaaaattgctaccaaattaccaaattttcaaatttagggcgatatgttgatttttttgtgtgtgactttttattccctagaaattttatggcttcattgttattaactaattagtttctcgattttaagtacatttatgactgtaatgcgcaaaattttcaaaatttgctgatttatgctgatttttggaacaaatctcaaaatggctatttttaggctatcggtccaccggtccctaaaattccactgaaattttcaaaatttgactaataaattcccaattttcagtgaaaatctgtttaaaaaggttcaacatttccaattttttccacggcggcgcctatcggcaccgccggaaccacgccccatgtttccaaaaggtttttttggataaatcgcgccgcaaaaacctttttattaagttttatggaataaaatttaccaaaatgctgatttcaaagcatcaaaatttatgccttttttgtggtgaagcaattaaatcggtaaaattactaattaaaaataattaagaaaaaaataataattaggtggaatttgttagatccatcgtcaacacaaaaagcagcacaaacacgagtcaatgagttgacaaggattaacgaaattcgacagccacaattattccaaaaaaaataataaataaatgaaataaaaatgattgcagaattttattaaaaattaaattcgcttgttttttacaaaatatttctaattcgtgcaatatgccttaaacaaattcaatttttcatggaaaagtcttgttaatgaattaattaatcacttcccaataattaaaataacaataaaatctttttgtttttaatattaaagcaaaaaaaaaaagaataaaaatccttctcattattaatcactcaaatattgcataaattatggaaaatgtataaaaataaataagcaataaatttggccaaatttttatttttttaaatcaaaccaagttataaaaaacgggaatagcacaattttggtattgtaatttcctttaatctctc

SEQ ID NO: 3103 - DNA, 1651 bp, Heterodera glycines
ttaataagattattataaatgatttgtaaataattcttcaatttaaataattaaattttttgtcatttcattcacttttattaacataaaaatcaattaattggagaaataattcggcgaaattatacaaataaaaaacataaattaaataaaaaaaaattttattttttcatgaaaataaatttattataatttatttcttcataattcgctcaatcaaagaaaattcttcagcagcataacgtctcgaactgtgcatccgcagactgcagcaggtgcctgcctcatcagtcgccggaatgggcatttttggagtgaaaagctgaaaaattataatttttatcaaacaataaatttatttttttttttctggggagtgtaagggaagcgtggtgagccaaagtgacaaaagtatcaatgttcataataattaaatttaataattattttaatttaatttgctaaataattaatcataaattagcttaaacttagtctaatttaccaatcttggtattaaaatgttgctttacgtaccctctactacttatataattttagaaataagtaaaaatttacaaaaagttgtaagcaaaaaactcgaaaaattagacttcaacccctacttttttttgaaattcactaaaatttttcgaaatttaactgaataatagagaaatctttgtgctatcttttcttatcaagtgcgatgttaagcattgtgggtgtttttcgatagctctatgtgtttattattaatttgtaaaatttcaaaatttttcgttaagctttaaaaaagttatggccagaaggaactcaaaaacccagtaattcgaactttttttgctcagatttttttgtgcataaataaaaatttttgaaaatttgcaggctaatagcatttttcgaatgctttcgaataataccaagaatgtttaatttggttgagaaagaaaaaagttatggtcgaaaaattcgttcgacgacgtttcggctgacgacgttttgtcctactccgaccagaaagacccaaatatatagaaaatatgtattataatataaatataacccgaaaaaaagtaaatataaaaaaaattctccgcttttatatatttttttcccttagaacagaaaaaaagtacataaaaatttcaatcataattataattcatgccatgagaatattgaactttttttcaaaaaaatttatcgagttttaaaaaaaatatagacaaaattaatgagtctaacaataagtctttcggatgtttttgtttacaactttttgtaaatttttgttagatttttaagttataattagggcatccaaaaatatggatataaaatcgcaaaatatggccataaatggcaaaaatatggacataaatttttccaattttaggtgtaaatttttcaaaatcttcaaattcactaaatgtaaagtaaaactttcataaatggttaaatagcattaaaaatcactttagaagaaaaaacacacgataaagctaaaatttactcattttaacaaaaaattaacccgaatatcaaatatttcgttttttcttttttttcatatttttgacataaattaaccattttttgagaaatttaaatttattcagtattttcgagaaaatttgataaaaat

SEQ ID NO: 3104 - DNA, 3510 bp, Heterodera glycines
tcaattggggttcgattttgaaaaccattattttaagtctcaaagaatgtgcattttgaatataattataccatttttctatattttactattttttacagggagtggacgaagtgttcgaaaaatggttgcccgaactggtcgaaattgtcaaaaaacagccggtaattcaacaatttgcaattttacgcccatttttctcatcagattaggcctcgaatcgggatgaaaatgttcgaattttggaaatgcaaaaatttttggtggaatttgcgccctcaaatttggccaactcaagccaataccatccaatttcggtggttgccaatgaccgactcactgaccaagcgcatttccaagacacgcgtctcatcactttggcaacacgtccatttgagtccgagctaaggttcatttttcacatttttgagtagggaggggttcggtatattgtttttaagaaatactgtttttttttgaaaatttcaagcgaactgaaaaatcctttttaataaaaaaatgggtggtttttttgaagacagtgtcgattttgataacaaattcgttaaaatgtgcaaatttttctcctcggcgctttttgccaacgcctaatgccaaaagccgttaattttcaaaatttggctcaaaatacaaaaaaaaacggtctttttttggcaaaaattgcttaaaaatgccattttcaatgtatttcctcttacaatttcggctattctcccggcgatgttctgatggtgctgccagaaaaccttccccaatccgtccgaattgccaccgatgcgttggaccaatgccggcaccgtttggatgagccctttcacatttgtcgtacgagcccaaatgtgccattgcgtccccaattttcacgctttttctgtaagtttttttttgagggtttctgcctcaaaaattttctcatagacttttttttttcaaaacccactcgtgtgcagataattgcgccccggacattattttttttaacaaataatctctgggggcacttggagtatattttgaatttttctaaatctttttcctttttcgctttgtttaagggtaccaatcccaacccaaaattgttcaaacccgttgaatttgcttaaaaattcccattttttagcttcggatgttccgctgactctccgcgactgtctctgcttttattttgacctccaatcggtgccaaaacgttcctttttgcgcgcgttggccaaatgttcgccctcagaaatggagagggaccgtctcatggagctgtgctcggcggagggaattgtaagggacagaaaaaacgggagcagctcgtccccccgtataatttctcccgaaatcgttttaaatttctaacaatattagaattttaaaaaaaattcggatcggccaacgcagttcattgtcagctagaaaaataaataaaaattttttccctaacaaattgctattattgtaaaaccgtatgaataatttggactaagctttgggtcatcacaaaaaaattcactttttacgcttcaattcaacgcgaatcaaatcgtattgttggctaaagaatccgtgaaatttctattttttgaaattcgtagctaaagaacccataaaaattgctacaacttttctcaaaattttttgtttcaaaaagattgtttcggtccatttttaggacgatttccttgactattgccagcatccgcggcggacattggccgaacttttgcgcgactttccgaacactgcttctcgcctgggcccgtccgaactgttcgactttttccccgtcattcggccccgtgcctttagcattgcctcgtcgccgacggcacatccgggccaaattcaaattttggtcgcacgagttgaatatgctgtcaagaaaatggcctccttgaggtacttttggttgggtggagttgggcgggggaaatttcatttttcgaaaacatttgaaaatttttggcgctatttgctaaaaattttaattgtaagattttgtctagtcatggaaaattgttcccattggttttcgagattactgaccacgaatctgacatccttttcaaccaattccgacttcctaacctaatttgtaaaaaaatcgaaaaacatgaattttcgacgttttgttcgggttagggattaggagaattagtcaaattaggtgtctgattagtgatcagggacccaaaaacttttgggtttgatccaaaaatccacaaaattgccaaaagactgcctaacgaatgcccctgtaaaattccaaaaaaaaaaaaattcggatcggccaacgcagttcattgtcagctagaaaaaaaatataaatttttcatgtgtgcactacgtttgcatcttcctcttttctctctctctctctctctaatctttctctttccttctctgtttctctctatcaccacttttctattccttttctgacatttccttccttttctttatcattctcgcctttagttctctttcttttttatcgtctctcccgacttatctcacactctctctccccttcactcttcctccatctccctctcttctctcatctttcgctgtctttgtctctcgccgaccgctctctctctctctctctgtctccctcgcttctcgctctctctcgattttctctctattgtcactctcatcttttctcaatatctcttatttctttctgtctccttctcttcctttatctctctttctctctcaatctaactatgttttaattttctttctctcttttctctcggtcaacctctttctttttgtctcactctcttcctccatctccctctcctttaatattaatttaataaatgatttaggagcagcggaggacgcaaacaagaagaaaaaacgaattaagcgcaaaaagcttactcttggagccatcatgaaaaaaacgggggaattggtcgcacccgctgcaattttcggagcggttgatgtggcaataggaggacgaggagcccctgctcttccgacgccccctcttccgcccccgccccctcctcctccgcctcccccgtccgcgatcgcgcaatccgacctgatgtactacggtggcattggctactcggtttcaattgccctgacttcttcaacaagtggcgcaaaaaggcaaaaattttcatataatctttaataaatttcaaataaatttttatagtttcccagtggcaccgtcagcctctttcattttttgagggcagcttttgtgaaataaaatgccgaaattcgccttcttgaaaatttccatatataataatcttttaaattgaattcactttttttaatgcgttttttataaccgaaaaagagtaaataaaattatttcggtaaattattattatattttcaaataaaaataattgtttcgggtcagatgcattttagtaaaggaaaaatgagagtcactgtaaggttgaagaaaatacagtatgccactaatgattaagtgaattcaatttaaaagattattat

SEQ ID NO: 3105 - DNA, 5484 bp, Heterodera glycines
agttaatgcattgccagaaaaaattaagtacggaatccctcttttagaacaaatgtcccaacattggcatagaactccaatactacattcaaatatcttttcattaatttctcattttgtttaatttcttttatttaatatattagtttatttattaaattaatttattcatttgcttttttatcttttgttttcatcagtggaatttccacagttttccaatttatcatcatcaccatttttccactgctatcaaaaaagcatcaggcaaaaatcggctctgattttgctgatgaatctttcaccattatatgcataaatggtgcaaaaaaatatgttaattcaataccaattatcgaaaatagcaaatgataaaaaaaataataaataaatggaaaattaaaaatgctgaatatacaaaaaatgatgtttttaattcattttagtctcggcctcgagcgcaaattcacacaattcaatcatattctctagctaatccattgactcattgttcaacaattttgtttcatttgtgccccaaaataattctgtatacgcacattgtaaaatttctgttaattaaaatattatggtaattaaaactgtattcatccaccaacttatccacacaattcatccatacccaattaatccatatcaattaatctaattaattcatttataccacttcatccatgccatcataaccgcacatttcggttttcgcgtcatggcatttcttttgcatggatgaattgggtatggaggatgagttaggtttgcccccacccttttgcttataatcaaattccaagatccccaatttgttgcaaatagtgccaaaatgcgtgtcactgtttttcattaccaattcatcataaatttgtcatttttagccaatttatttgcctgcacataattattaaacaaacactgttgatattgccgaaaataaaggcaaaaattttcatataatctttaataaatttcaaataaatttttatagtttcccagtggcaccgtcagcctctttcattttttgagggcagcttttgtgaaataaaatgccgaaattcgccttcttgaaaatttccatatataataatcttttaaattgaattcacttaatcattagtggcatactgtattttcttcaaccttacagtgactctcatttttcctttactaaaatgcatctgacccgaaacaattatttttatttgaaaatataataataatttaccgaaataattttatttactctttttcggttataaaaaacgcattaaaaaattcattcgttttcgatcgtcgctaagtaccaactgccatcgactcttttttttgcactgctttcacgggatcggtggaaatttttacataacgtgtcacagtaccacccaccgcccattccgcccgcccatggggtggtggttggggacgagtgggatgtacgcggtacccgcccattggccgcactgcttttgccgcagggaccgcccatttgggcgctgccggacatcgcatttaagcgctgtacgatcagcgaaaaatcagtctgttccaaatttcctctacaattaaaatttttagcaaatagcgccaaaaattttcaaatgttttcgaaaaatgaaatttcccccgcccatagaattgactcttgattctgaaagcaccaatgtataaagcaattattaacttttgaggcattttattgactttgacctcgattttattttcatataaatttttcgttattgtttatttttaacctgtgatctcacttgatattttttcacttactctgtgactattttactgtgatcagtcatcagagtaagtggttcccgcccttctgatggcaattttttctttatcgaaaaaaaataaataaataaacattgcttttgccatcttttcctcggcttcttttcggttgtctgacattttgttgagagtaaattattaaggacagtttttgaagatttaaattagccttagtaaaactgaaaaaactttctggatttttcatagacaaggtaataaaaaaatttaaaatttgcttatttgtgtttttcttcaaaaacattaagaaagacactaattagtagggacggatttgtagggatttccatatttttttagcacacttatttcggaataaaaaccacgtaaatagtatttttagcttggtttgatgcttctagaatgcatttttatttccatatttttccattttcaggtttttgtccatatttccatatttacttccatattttggcattttcactaaaaattccaaaaatacaaccctagatggaaaatttttggaaaatacgcttctaaaatcgaattggaaaaatatcaaaaattatgtaaaaaaattttcatcagcaaaattcgtgtaaaaatgcatttttgaaatttactaatttttgctttttttctaagtaaattcaatttttttagtatagaataaatagaatgcctcaattatcaaattctataattcatgttaaaatgatttttttctttcttgacaaaaaaatttatgggtttatgaattttttcaaaaaaattccaaccaattttcagaaaattttggtccatattttcgtattttttgtccatattttgcatttttttcgtccatattataatccatattttggctttttttgtcaatggtccctactaattaggtatgtatctaattaaaagttggttctcggtgacggtgatttagtcgtcagtgaatgatctcgtaatttaaatttttctgttcccatgtctgcctttttgaaatgcagagacgcatattttgagtgtctctctccattctctccaatacaaacaatggaacagagaaaacaaattgtgaaaatagtgtgtggaaagacaatttctgccgttcaaaataatttcgccaaaagtgggacaccaaacttaacaaaaaaaactacttgaaaaataatttataaagccaatcgctaatgattattttgtacggctctgaatcgggcactgcccaagattttgccgaacaaacttggcaaaccttccacaggaatggcacaaaaattgtggccaaatgcatgccatttgacgattttcaaattgcggtgggtttaatttatacaaattcctaatttaatgccattttacagcaattatccgatgaaaaaatgaccatttttatcgtttctacgagtggacaaggcgaagtgccgacgaatatgcgcaaaaattggcgctatttgctgtcacgcaaattaagcgctcaatggctttcaaatgtaattgatgtcacctttttgataattggattaaggggattttcacatatatttgtgaataagaagggccgaaacgaagggcgggattggggttactttttgggttcgaaatccggggttttttaatgaaaattccggcaaaatactgaaaagtttggtgtaaatccgctatgaaatcgggtgcaaatttcgaagttttcccggcgtccgcctatagttcacctccgcaaaaactcaccactatagaaatttgaagatgtgttgaatttcgtccgatttcttatacatgaaattattaaaaacaaaaaattcgttatttataacattttatgctcttcccctcctgaaacaaaacaaaaaatatttttgatttaatttgccataaaattaaaatgccgttttttagttgcattttgccgtgctcgcgctgggcgacagttcctatcagaagtacaattttgctggcaaaaaattgtacaggcgtttgttacaacttggcgcaaaaccggtcatggagttggtattggcagatgaacagcacacacttgttagttttgccttgattttgagaaattgttcgaaaatttattttttcgggatttttcaattgggttcgattttgaaaaccattattttaagtctcaaagaatgtgcattttgaatataattataccatttttctatattttactattttttacagggagtggacgaagtgttcgaaaaatggttgcccgaactggtcgaaattgtcaaaaaacagccggtaattcaacaatttgcaattttacgcccatttttctcatcagattaggcctcgaatcgggatgaaaatgttcgaattttggaaatgcaaaaatttttggtggaatttgcgccctcaaatttggccaactcaagccaataccatccaatttcggtggttgccaatgaccgactcactgaccaagcgcatttccaagacacgcgtctcatcactttggcaacacgtccatttgagtccgagctaaggttcatttttcacatttttgagtagggaggggctcggtatattgtttttaagaaatactgggttttttgaaaatttcaagcgaactgaaaaatcctttttaataaaaaaatgggtggtttttttgaagacagtgtcgattttgataacaaattcgttaaaatgtgcaaatttttctcctcggcgctttttgccaacgcctaatgccaaaagccgttaattttcaaaatttggctcaaaatgcaaaaaaaaacggtctttttttggcaaaaattgcttaaaaatgccattttcaatgtatttcctcttacaatttcggctattctcccggcgatgttctgatggtgctgccagaaaaccttccccaatccgtccgaattgccaccgatgcgttggaccaatgccggcaccgtttggatgagccctttcacatttgtcgtacgagcccaaatgtgccattgcgtccccaattttcacgctttttctgtaagtttttttttgagggtttctgcctcaaaaattttctcatagacttttttttttcaaaacccactcgtgtgcagataattgcgccccggacattattttttttaacaaataatctctgggggcacttggagtatattttgaatttttctaaatctttttcctttttcgctttgtcaaatggccttaaccttttggccccgattttgtcgaccatttgtccgttgtcggccatttgtcggttggcgaccatttttcggttgtcgtccatttgcccccaccccatttttatcgataatttttcccctcatcttaaccatttgtccctccttaaattaaataatttttaaatgtgccagcttcttggagaaccgaacatttgtccacaatctggaagacaaaccattaggccaccgtaacataagagattttatgattagtttgttaattctggtgaagctttaacaatccaatatgcattggaaatcataatcactttataaacatgtaatttagcaacataagtttgggtatttaacgatcgtagtataattacgagctaaaaattttaaacactccatcaagttgttcacgacaaaaaggacaggtaccttcgatttctaccacttcagcgcatcggttacaaagcgcaaaaagaccacaaggaatataaacataattgcgctaaagtag

SEQ ID NO: 3106 - DNA, 2090 bp, Heterodera glycines
  misc_feature (29)..(29): n is a, c, g, or t
tgattagacagtgagtgattttgacagtnaactatttagcttttttcattgtctacgcgtaattttgacaatgaatgaatttgacaaataatgatttggacagtatcaaattgtgatttcgacagtaccgataagtttttttttaagacgaatatattaaaaagtgtatcgaaaaataaaggtgaatgaccacgcccaaaaaaatattgtaaatcaaagaattacggttttcaaaatcttcgacgaggacttgcaaattattatctaggcgaaagtttttacaattagcaatattcttgtggccgaaagtacggtgttcgttaaggttccaaaaagttacggcaaaaatttttcgaaatctgattttttgtattcttcgggccataattttttcgaaccttaacgagatttttcgaaattttgcaggctaatagagaacacttagggctttcaaatgataccaacaatgttaggtttggttggcaaagaaaaaagtatagtccaaaaactgggctggcgcccaaacgagcggcgcccaaacgaggtggacccatttaagaaacacgccagcacggtttgcaagttttacatctggggcctattcaaattagcatcgtatcaacgatgcgatgatacgatgatcatatgcgtgttcaaattaaagactttcgccatatgatgagctgtcgtttgcagctcatcatacgctgaactttgaaaaaattctacccaaaaagataacttaattcttggacgaagattatatttgattgtctgtcaatcttcatatactttcatattcatttaattttttaaaatttatcggtactgtcgaaaatcaatcattgtcgaattcaaataaatttttgataactgtcgaaatcgctcgttgtcgaaatgctcctgtcaaccacgatgccctctctaacttcaaatgggctcccggacaatccgtccagtggacaatccgtcagtggtcaatccgtcagtaatggacaatccgtcagtggataatccgtcagtggtcaatccgttggacaatccgtcagtggataatccgtcagtggataattccataagcaaatttatttttaaaacacccggattaattaaaatcgtgtgaaaaataatttattttgctaaaaatatgaattaatagttctgttattttataaaattataaaataatcatttttaaaagaattaaatgataatttctcgaaaaagtaaattaattaaagtataaaacaactagaaatgttaggaatttcataaaaaattatatttattaaatttaacaataatttttgcaaatttttgatctttgctcaaaaaaaatttgctgatgaattgcccaactgacggattgtccattactgacggaaaaaatttaattaaatttcaaaaatattatggacaaaaaacttaaaaaaaaatcggttttccgaatgcgcccaactgttggcgcccaatcgacccccaccgcggaattggccgaaatggatgccggattcatgatcaacgaccccaaaacccctgtaaacttgtttttatgacaaaaaaaaattagtattcagtgacccagcaaaccttaaaatactcatttttcaagttttgataagatttaaattttcgatatttcgtggttttttactcttatggacttttcgtggcttggacattttgttggtaatttattcctcattattatttcttataaataacaatagttgatccgagttgtaattttagccttagacaaagggccacagtggcaaaaaaccttgacccaaaatgattgggctaaaacggtaaggtttaaacaataattaaagttgccattggcccattaatggcggtccgttagtgtcttttgaattttgcttatgcatttgaagttccattgcaatgcaattcaattttttaatttctcagttgttttaaaatggtcttttattctatttataaattcagattattttgcctgcagcaaaatggggtattgcgctccatgccgtcgtgtttctggcgttgatggttcaccagcgacctttcgctgttgaagtgctcagtacattgcacgttattgc

SEQ ID NO: 3107 - DNA, 1183 bp, Heterodera glycines
ataatgagtactgatcggaaagaggaaataaaaaacccacaaaagttggcccttaattcggtagtaaattcttattatttaactcgttttgggcttaatattaaaaaacaagttaaaacgcaattaataataattttatttttaaaacttgaactaataaaaaatcaaaataaattttcaaaagttaattagcattaaaaggatttctatttttatcataaatctttcggaccgggacagtatagtccgttataatcagggggtggtttagtctggcaagctgttttcgccatcttacaaatatttttttgtcagtcataaacaaagaaaaaaactttaaaacatatacgttaagctgcagacaggctaaaccgcaaaggtgaaaaaaaacatttaatttcacaaaatatctctgccgtctgttggctcaatgttttcgatttgtttccacgttcagctttgcttatcattacgctgatcagccgccaatttgactatttcgttgacgaacacttcaaaacgcgcaaaaggacattggacaaaatgtaaattcgacgcaaaataggaaagaatggcgccaatgaaatcgaatttttattcgtctttttcttatttttatttcattttttggcattttctctacttgttctcctgctgttttctttatctcgatgctgcttccccttggccgagaagtgatcactgatcataaacagcaaaaaatgaattgtttggttgattcactgtcgaaatccctcctcagaaaacgtgcaaatatcatgctggcgatgcgttaattcttcgactcttaccgcgttacaatgccatcaacaataaaccggctcaacaaaaagactacaataccaatgtgtgttaatcccgagaacatcatcaattttctctttgttatttctcgaaattatgaatcccgtaacccggttcttagatggcgtcgatttaactttatttttggatttttaaatgtcactcgtcaagagctgtcgaatgataccaaatttgtacgggtttgatctttttaaaaggtttagagagccccattttgttaattttctgagttttgaacggttaaaaaaccggtttaagttgaagcgagtaaaattttttgattgcttaatcgttttcagcgcataagaaaccctataaaagtggttttgagcaattt

SEQ ID NO: 3108 - DNA, 5293 bp, Heterodera glycines
  misc_feature (78)..(78): n is a, c, g, or t
atattaattatagttttttttgcttacaaattgtccttgtccatcggcgggttgaatttgctgcgccatgtgtgaatncgaatggatcgtaaataactgtattcactaatttactgttaatacacgagtttttcggataaaaaggagaaacggagaaaccgtgactcaatcgtatatatcaatgcaaatgataaaaatgctgttaagtatgcggtgaacctctcggaacaaaaacaaagaaaacatagtcaacacaacatgaatacgactatgatgaggctgctcggttatggggccgaaaactgaggtaatagttaagctggcccgcgcctgtccccacatttctgtaaaaaatccaactttaaaatcatccaaaaaatgtgttttaatattttaatttttcaatttaaccaaattcactttattgcccaaatttatctaaatgcacgaaatgaaagagaagcaaagattacaactcaattgctaccagccttcaacagttaacctgacaaaacaaccccactctaacggcagcagcgtccgacggacacaaaaggcgttcaaaaacgcagccgcaatagacaaagggcagcagattttgaattcgagaggcgaacaagactaatgaatggccatttcgtgcatttggatcaattttgggccataaatgtgatttttggttaaaaaaaaatttttgttgagtttttttgttcaagttcgagtcagggattcgaaatgggggcgtcttattcgtggtcagcgacccagaaaaccccactataaatatgtttttggtgattttaacttttgtaatttttacaaaatggaggcagggaccagcttagctattatcagctttgatacttttatttttgagaaaatcactgcccttgaattcccttaaaacggaatcaaaaaatccattagaatttttcttatggataagtcattttcatatacatatactccgttgtaaaattatgtataaggcacctcaatttttcgtgagtttgagtacgtttcataaaataattgagctgaaattttaccaatatcattccccttaaatattattaattacagaaaaaaaaattaggtggtttcacataaaagttgtagatagtgccttacaattttgcaacgccaatttgttgccattttcgaaaatagtaaaaaaaacaaacattttttttacatattctacttgctttttatggttacgaaaaattattggaaaggtatgcgtagttaaaatttaagctcgatcagtttactgaaaatcgtcaaactaacgaaaaattgaggtgccttataattttgcaacggagcatatgtttttacttctataagattggaaaagaaaaataaatcgaaatttgttcaaatttgaatgattaggaatcaaaaatatcgtcggttccgttatttccaatggaaatgtaaatttggttccactgtttttaaccaccgcttgaccatccgtcgcattggcattgtcatcaggcggaaattcggggaaaatgtcgctaataatattgaaaaaacggagagatggacactcgttgagaatacggggccaattgacgcattcggcgaaaatgaaggtattcaaagacatgtgccgaatggaatcgccgaacattggccaaatggtggacacgaagaactccgaaatgcgaacattttcattcttaatgcgcaaatatgtatatgttgtaattgaagtgaaaaagcggtgaaaatggctgagaaaagtgatgacattgcggtcgaagtaactaaaataggaaaaagtgatcaaaaaaaaatttcaatgtgtctccattcttacgtgatcaaaatttctttgaatccgatgactttgttgggcacacggattttgtgggattggcaaacgcttccaattgacattgacaatttccatttcattggtgccattccatcgttgcgattccaaggccaagctgagaaggcggaagtaaggcgaacacttcgagccaacaataggcggagatgaagctgaaaaggaatttccgattttattaattttattatttatttattttttacatttcttttttgtttaggcgtcgtcgttttttgacgtggtcccaaaagaaccaaagaatggtgccacagccgaccaacagaagagacacaacgtaccaactgaaaatgaatttggggaaatgaatgaataataaaaaggcaaagaaaaggccaaagtcaggaaagtccaaatgagaaaattttttaaatttcattttgaggttttagtggggctgacctatggggtaatttttctcaaatgattttttgaacttttttaaaagattttatagagtagtgatacgatgtaaaaaggaaaacgtacggaattctcgaagacattacggcaacaaaatgaacggagggaaaattataagcgaataaatgaaaggggaggaggaggaaaaagaccttttataggcaaaatgagattcattcaatcagtaattgctcctcctgacagtaggggtcagttccgtctcgccagttccgtcttagtactcaaagggccggttccgtctcaaatatttttggactcaaattttttaaaatcaataactagggctgcgatttataagaaaaatcgtaaaatatgtaaataaatatgtattaaaatatgccgaaatatgtacgaaatatttacaaaaaccttaaaatatgtactaaaatatgtaaaaaaaaattttttaatggttattttttggaaaaaaattcttcgtaaaaagtgaaataggcacaaaatgctataaaaatgaccaaaatgaatcactttttagtattttaaattaatttttgatagttaattttttgaaaaacattcgattttttagggatacattttcaaaaaattttttttaatttttcacaaaaaacttctataaaaattctcaaaaatcctcaaaatatgtaaaaaaaatgaaaatatgcacgaaaaattgcgaaatatgtacgaaaaagtccaaaatatgtataaaaatatgtacatatgtaatatgtagaaaaatcccaaaatatgtaaaaatatgtaaataaaagtcccaacttttgttcgcaaacacaaaaaagaaagtgtttttcctactaattagagcatggagaatccaggaaaaaaatatgtatttacatataaatcgcagccctatcaataactaatttagaaaaaaaagtaaaaattcttttacttcgcagcctaccgcaccaaatataaagattaatttacataaatttcgtctaattttcaaaaatacacccctgagaaatgaaaaatttcctcaaaaattttgttattttatacccctaaattgaaactttaacacctattttgaggtttttagaaccgaaaacctaaatattttggcagtttttagtttttaacacccaaaaatattaggcatattaaatatcagggctgccaaaaacatgcaaatgtatttttttcctgccttttccatgctataaataataggaaaaacacgttctttttttgtgtttgcgtagaaaaatcggtatttttatttgcatatttcgagacttttgtgcatatgcatattttggctacttgtcgtgcatatttttggcagcactgttaattatatctcaactttctgttcacattctgaaatttaaaaaaatttgggtccaaaaatatttgagacggaaccggctcttttactactaagacggaactggcgagacggaactggccagacggaaccggccagacggaactggcccgagacggaactggccccagacggaactggcgagacggaactggccagacggaactgacccgcttcgtgctgagaaccactaattttttgctttcatttttaaccaaacaaattacaaatttttgaataaaaaacaatttttttttggattcctgagagggttttttagcacctaaaaatcgcatccctagtaataatactatcgatggtgccccccacctttttggaagaaaatttttttgttctaaaaagtcgaaaacatgtttatggggagttttagggtcgctgatcatgaatctgtcattaatttaaccaatttcgaatcccggacccgaattcgaacaaaaagtcgaaattttcaaaattcacttttatcttcgtttgtaccatcggttgtattaccggggttcgaaatgtgtcgagatggatgtcagaatcggactcttatattccagaaaacccccaaaaagtattgaattagaaaaaatagaaaattttttaaatttttttcaaaaaatgggaactaccatctgggtcaatacaaagtcaactcgtacaataggcaactcgtacagaaaaaattctaagaatttttaactaaaacttagaatttttagttaaaaaaaactctaaatagattttctagctagaaaaactttttaaaacacttaaattttcaaaaatttaagaaataaaaaaaatcagctgaaaaatttgtaaaaaactaatgaattttttatgtttttctaggctagaaaatccatttagagttttttttatctaaaaattctaagttttagttgaaaattcttagaattttttttgtgtgcgaggtgccatgactagggatacgatgtttaggttttgacgtatgtttttcctgaactccccgtgacctgaaacgcacgaaaaacatgtttttttgggctgttgttaagctactttgcgagatagttagaccgattttgtaggttgttatttttagtaccgaaaaaaactacaattggcgttttgccgaaaatttgttaacaaaaatgcaataaaaataaaaatgttttaatagctaaattgcaaccatctaatttaaaagcatagttaattttaaattttatgagtttataccgaattagacgggactcttaatatttcgggcccaactaagccgggtattcaggactaagtccaaacagaaacaagtactcgtttaactctatgtttaaacagctgtaaaaattgaccaaataataagattaccaggcttttaattttcaagaaaaataaatttttaagaccgagagttgttaaatttattaaattttaatgatttatataatatttgcatatttattttatttttttgaaatccctccctctggtgcccaaacttcatgtcgcctaaactataaccggataatgaatgactcattattaatgaggctttgaccacaacaattggtagttttcatctgcatgttatattctagacataaaattgtcaattaatttgatta

SEQ ID NO: 3109 - DNA, 2354 bp, Heterodera glycines
ggcgccaaaacgtgggcgccaaaacgtgggcgccaaaacgtcggcgccaaaacgaccttggcgccaaaacgtgggcgccaaaacgtcggcgccaaaacgtgggcgccaaaacgaccccgactccccccgaagcgggtcaactccgtcccgccaactccgtcccgccaactccgtcccgccaactccgtcccaggccaactccgtcccgagccaactccgtcccagccaactccgtcccgccaactccgtcccaagcaaaaattcaagaatttttttaaaaataaatttgagtttaacaaaattttatgaatgggaaacaaaaaatgataaattttggctttattagtaattaagtttttctatttgaatctgacgcttgtacaagaactcgtacgaaaatgttttgtcgtttttaggtggaggcgggattttgtcgtttttggctgaggcgggattttgtcggggcgggattttgtccgcgcgcaaattttgcattttttattttcaaatcccaaaataagcacgtaatgctgaaataagcacaaatcttagaaataagcatattttaggtttctaagatccggcccctcaaaataagcacaaatcttagaaataagcacacttgggagccctgaaaataaaagttgtcattgtttaaaagtttttctttcacaaattaggaacttgcataaatcaaaaactaaatcggtcattgaaatcaagacttatgaattgttcataaactcaaatttattttaaaaaaattcttgaatttttgcttgggacggagttggcgggacggagttggctgggacggagttggctcgggacggagttggcctgggacggagttggcgggacggagttggctgggacggagttggcgggacggagttgacccctaccgcagtcaacgggcgatatgttttaatatgtcaaaacgccaaaatatgtgtttttatgtttaagtcgctctaaatcaaagattgtttgttcgggtaaaatgctattttggggcttctctcgccataactaaggcacaaaaatattttattatataacataaaaacacgatctctatttatgaattatttggatacttaatggtacaatttcgatatttaatcacgaaatttcatcgagcatttgcattaaaaaaactttattaatattttcgcacttacagaggcaacaaataaaagttatttaatgaagaaagagagaattttaacaaaatacaaagttataggaatatgtaatgaatgttgagcagataaattttaataaaaaacaaattatttttctttacaatttaaaaatgaaaaaagaagaaaaaagcttacaacaccttcgattcccaggacgtctccgttccaagtactaagaaggcccaacgttgcttaacttgccagatcggacgggatggcgtgctttcaacgtggtatggtcgtaagcgaaggggacccatttgaaaacaattaaatagtcaattttataatgcattttttttctctttggttaacttaatcaaaacaaggattgttaaaaatttagaattcatttaaataaagtaaaaataaaaaggaaaattcgatagtttttttcaaaatcaaagagcaaaaaattcgggatttttgaaatcttttttaataaatttcccaacagcaaatcggcagagaaattgaaaaatgaaatggtaattttgttattcatcacaaattctctttaaatcatatatgaagccttttcctaggcccaattcaatttttttaattagaaaaaactgcaaaaatcaaaatttcataagaaaattaggtttggtgattttaagaaagttatccaacaaccatttttagtggttaaagtcattcttttgaggtgccaattttattgtattccgctaagaaatccaaaaaccattccggcacaaaatgccaaaaggcaaaatggggatataaaagtcaaactaatggttcaaaaccaaactaaaaacgcattttaaaccttatcgaatgacattcttttaatctgaagatattcggagaaaaaataatggacataaaatggaaaattcaatgattttttaagaaaactgaatttaaaatttagcatgacttttatagctgctctttggaattcaaaaagattttcctgaccctttggataaaacaaattttattttaagaaaaaattttgttcacttttcatcatacattttaacaatttaattatttatttattttttctcactttctgagacaacaaataaatgttattaaatgaagaaaaatagattttatacagaataaaaacatataatgttgagcagataaattcaacaaaaaaattaattc

SEQ ID NO: 3110 - DNA, 4060 bp, Heterodera glycines
tctagagtcggaaatggcgacgttgtctggtgcccatcttcgaaatgaaaaagcaaaaaaataaaaactaacaaataaaattgaaaatgtattcggctaaacgatgcaataacattaaaatcaacaaatatcaacgaattttgatggttatgttaagcacattatatgattatatccattctgtcgatagagatcattttccacccctcccaaattcaaaaattcgtttgttcgtcttccgattccgacaacgaaagtccgtactcgtacaaatcgtcgtgttgagaggtggcctcatcctaaacaccaatttgattttttaacaaaggctaatgtctgtgcccaccatcgcttcggcgttcgtcagctcggcctgtttcgcttccgcttcttcgttctccgctgctgagacgacttcccaccgcacggaaacggactccaaatcggacctaaccaaaaaaaagggacaaaatacaatttattgactatttaaaacaaaaaaaagtccaaaaaaccctctctgtatgacctgagcaaacgcttcaactcccgctccacgtccgcaacatccatgtactttttcttcttgatcttccgaaaccttttcctccgcacatttttcaacggcggacaaatcccatccggccattggaagcgatcggactttgattctgcgccttcttcgacgccttcctttttcgactcatattttggcgcattggcaacaatcatttgacagagatcggcaattttgtagacagttttgttgtccaatgtcttcattatctgaaaataataaaaaacaagattaattagaaatgaacaaatttttatgattttgtccacctcaattacgcagggcaaatcgtacagtgtaaaacgcattgtgtcgtgctcaaactgaatcgttcccgtcctcaaattgttgtcaaagtttatgccgagtcggtcattgctggtctgatggccgtctctctccacaaattggcgtacttttgtagcaatttcgggtggaaatcgcataatgaaatgattttcccattcgtttccatcgtttgagttggacggatttgaaaaaattttcattttcggtttatttttctgcaaatgattttaattttagcaaagaaaaattttatttcatatatttatttttgtctgtttctgttgatgtacataaattaattcatttaatttgtatgtgaggcgaatgggcaacaacaattgctgtgtaaggcatacgccgagcatttccaaaaagaaatcgcaggaaaatcacacggcaagtgaacaaacactccaaaaatcaaatcaattcaaattcgattattgtatcgttaattttgatgatttaaagcccttattcaggaaaacttcctttttccggtttagtccaatcactttttcaatggccgcgattcttccgtcaattttttgccgcacattagtgaacgcgaaatccccgacggttggccttttctctcttttcatatatttgttttcttcagacactgagcaggatccgtccacccatccgtcggtgcgtccgacttttgttgagcgaagcagaagcgaattgaaatgtgcgttttatactttctttcgattctgttgagtgagctttggttgtcactttttttgaaatgcatttcattttgctaagaaatttagaagcatttctaaaaataatgggtttttggtctaaaaattttgttatttgattttaatttgtttcattcagtgcgcgacaatcgccgttcattttacgttttggaccttaacaatttgcatgcgccggtgacgttgaagaaatcgaacagttgttcgaccatttatttggacgattcgaccatttcacagccccatctgaagaacacaatcatttgtgtgtcgttggcagtgttttatcacataatcaacagaaagaatcgcgggaaagaacggctcatggaaatttttgaggaacggttgcatccgataacggtgggcatttgcaacaaaattaactgacaatgagaagtgattatcttaaaattacatctcagaaaatttttcttttaataaaattaaaattttgactctttgggtttctatcattaactgatagaaattgagtcgaaagttgttgaatttgatcctaaaagttatatttgcttccgtttctcataatcattgtgggtaataaacattttaataaggagggcatttttcagaatgaacccgtggcggctgaaaatttcacacgggatcgtaagttattttaacataatcaagcgcatcattgttctgctgattatcttcaacttagctgaacaccgacaaatttaccgcttcatccgcacacttttccacgccgcccaactgaccgcggagtgtgccatcattactctcgtgtacatcgaacggttgctcaattgtaagtgccaacccattggtccctgatgaatgcatttctgaattggagatgccgaaattgacttgtgcccgtccaattggcgtcgcattgtgctcggtgccattatgttagcctcgaaagtgtgggacgaccaggcggtgtggaacgtggactactgccaaattctgcaagacacaaatgtggacgacatgtgattcttcttgcagtttcattgtaatttttcccaccattacttttcaggaacgaactcgaacggcagtttttggagtcgttggagttcaacataaacgtgccaagttccatctacgccaaatattactacgaccttcggaccctcgccatcgccaatgacattcagttgcctttacagcctttgtacaaagaaagagccgcgcggttggaggcactaagccgaaactacgaggacaaagtggcggtgaactcgcagaaaatgaccaaaagtgtttctgcggaacgattgagagaacatcggtcaccggcgataatcccatgaaaaggggacaaagcttttgtaaatgaatgaatggaacgacttaagaaaggggaagcgaacctcacttcggaagtgctctctctctctgctgatcttgcgacaattcccaaaatgtcttatttgtattaatttgccacttaatttgcaattccttttaattaccatagtaatagcgaagtcatcaaacgctttttccaagagattttcataccaatttggacagtcatttcgccttaaatttctaaaataacatttgatttgatttctttgttattattgcacctcctttcttttatattgctttcataaccattaaattttgctttactttgaatcactcttcagtcctatccgatgttttttctcggtttttcttttttagttcggttttcattttctttgctttaacagccattcttttcgcgcaaaatgtgttcgcatgggcacggcggagcagggggagggccctgttcagcagcggtcgaatcatttgagcagcaccaggagggcatgcagtacaccatggagagggtgagcacaaaatgagggcatggaagggaaaacccaagcaaaatcggcattttgagtttatcaacaaagaacgcattgttgtgctgaacgaatcgatcgacggatcgggcaaaaaagtgttcaaaagatgggacgagcgaatggaaaagtgcgtttggccaacagacaaaaataataattcattttccagagaaaattttgtcgagtcggacgttgacgaggaactgctcttttctgtgccattcacaggtgggaaggtgcgttttcacggtcccacaattccctcccctttaggcaatgtcaaattgagcggcctttgcttcagcggtcgaatggatggtccgtcatccctacgattttttccgttttatttcccaccccaggaagttttccggcccgagtacgaattttcaaggatcgcgttaacgtatcattttcaaaccccccctcgctcgcagagggccagcgaggggggggggggtcgcaaattttgaaaattttaactaattcattaaaaaatccaaaaaatttccccggcggcgcctggcggcaccgccggaacccaaaaatcccaatttctcttaaaaagtggcttaaaa

SEQ ID NO: 3111 - DNA, 5517 bp, Heterodera glycines
  misc_feature (16)..(16): n is a, c, g, or t
tgcaggtccaacaaantctgctaagaaaaatattgctatagagaaacgcctcccatggtatttttgttgctttatccgaaataaattaataataaacatttgttgtcacacctgaattcacacaaaaattacaaaaatgataaggtaaggctgataacaaaattaggaaagtcggggttaattaaatgcaaaacatcctccgtgtgcacgttcaaattgccttcgaaagcccaaccaaaactgcccctataattaagttttatgcgcccaatcaaataaaaattcaatgaaaaactattggaaactagcatgtttacacattcaagtattgaaaaccattatgttcccagaagagaaaaatttaaaaaataaaaaaaaatttatgtttgaatttcgacttaaaggaattttcaatatttactgttttcattcgtgttcagtaaatgttttaccgaatacagtgatgagcatagctgatgccagcagtttcaagtccctcttgtccacttccttgaagtaaagaacactccaaacggacgcgatcactccgggcgccatcgaattgatgggaaaagtctcaaaaagggtagacaaatcagtcccagttaagccaaaaactcacaatggcttgagagagttggtcattcgcaacgaacctaaaaacagtaaaacttctgcgttcccttgaccatttgcacttgtcctccgactcaccaagccaacatggcaatggcccagaaaacaccggccaaaagtgccgggaaaataagtctattgtccatgtacggtctgttctttgtgaaacaaatgtaaatgagcaagacggtggtggaagtgaggtaaacgccggagaaatgggagaacacgtagagaatggcatcctttggtgggttatcaaacagttctgaacttgaaacgagaaattgtcgcatttggaaacaaaataattatccaaaaatgttttatgcgaatattcacttgtcctgcatgtaaatgacgggagtgaaccttaaattgtaaaaagaataaaatttacaatttaccgttacaaaaaaatcacattgctccataacaaatgccggcaaagacagcagagcaaatagcactgaaaaatagcaaaagttaaatggcaatcaaaaaaattacaaaattttgcatttattactgacaattaatctcccatggccaattggggcctaattcaaacgcacaaaattcgcttttgaagattgctgtccatacattttgccccattttccgttgcaactttttctgccgattttcgttgtccattgccttcgtccgtcccatccgccgccattctctgtgttccgtccccgtctttgtccgtctccaccaacccaatccgttcttcggtcattgccccgctctccgtcgtcgtttgctgccccattaattcgttgggcatttcgtcgtcatttttggcattatttttgttgtcttttgggcgaacgagcgcaaaaagaatgccccttaaatgttgaaaatacaaacaattttttaagtaatttgtcgtgtcgacgcacccgataatgacgaaaaccagtccggcatagttaagaatcggcgaattcggcacattcggattcacctgttggaaagatggaccgtacatttgttgtgcatggtaagtgacttgaaacagtgaccccgaatagtccgaagcgaccaatggcccacccgaccacacagccgcacaccccccaaatcagaatgcccattccgagtccaatggcatttataatggggacggcagtcaaattgccttacaatgaggtaaaaataagacttgatcccaataaacaaattaaagaaaaacgacaaaaatcaccgagtgcccaaagcgcaccgccaaacatcgcaaagtgctgaaaaggcggacatccggtgaaaaggaaagtcactgaaggaaaagaagcaaaatgaaaaagacaaaacggaaacgtacgaagtccaaccaaaaagatggcggaacaaacctaacagaaaagggaaaacaaaacggaatgccaaatcaagtggcgccccgtgtttcgaattttacattttaaattgaaactgaccacccattggacgaacattccatcccgtggatcgccgcttttgcgtacagcctaaaagccgtgaaaatgaaagtgccgtcgatgataaacagacaaaacgtaccacgtacattgagccaaaacaaaaggacgaaacgacacacgaagaaagaccgagggcaacacccatcacataagcaaaagagaaggatgtttaaaaatggaagagggaacgaaaaagtgataaaatggaaaaaaaattacaaaaaaggcaaaataaataaatggaaaactaataaaaaaaagtataccaatgcaaaaaagcaatcagtgaacaaagaaaaacaaataaaaaaccactatgtttagcaaaacaaaaaagaaaagagtttgaataagacattgaaagaaatacaaaaactaaaacattggtcagagtccctcgggaatgtcgtccccctccatgctaatcgacaattgttcattttcactccgcaccgtaccaatgtcgtcgtaccgtagcacatattccgcaattgcttttcggtagtcgcccacctcagtgaacaatttgtcacctccgtcgaccaattcacgcagtaacctacggagaaaagcaacaaacattgaagaaataaaacattgtttgacctattcctcagcagaaatttgctgtaaaactcgcgtccccctcgcgtgtgcaattgcgacattttcgccgcctccatatccgcttgtctttcattggcataactgaaaatataacaaaaaatggatgcgtttattgggggacggacaaacgtcgcaaggtcattccattgtttggcggtgagcacggaaagcgcggcgaggagcggataaacgagcacaaatgagaggaaagagcctttgaagacggtggcgtgcagaacgtaaaagcaactcatgtaacagagagtctgagggaggaaaataagcgaaggaaaagcaaagggaaaaagggcgtagccagggggggctgagggggctaaagcccttccctcccttgaaaattcaaaaaattaaaaatttcaagaattttcttaacaaattgcattaaattctcaataaattttccggcaacgtctaacggcaccccggacccatatttctgaaaaatggagaccaaacggcaaaaaatagtaatgaaaaacggctaaattttttgtaaaatacaccctcctaattcgggatttcccaaacaaaaaaaacacactcctaaaaatcgaatgaaaaaggaaaaatacactcctaaaaaatcgaatttttgacttcagcccccccccaaagccaagggtcttgtggctacgcccttgaaagggaaggaaggaatcacatagcaaaaccaagtgagcgcgtcccgggtcagcatataagtctctttgacactgaaaaggtcgcgggccaccaaaaaggcgagggcctaaaggaaaaaatgccaaaaatgaaaaggaataaaagcatttggaatgccaaccacacacttcgtcagacagcacaaaggtggacaaaagctgacgaccgacacgcgactcccaaacgacgcatgcgactttgcccaacactttgaagggctaaatgggctaattgcaagccattaatgcaacggacggttaaaagggactcaatattatttaaaaacaaattgaagacagcttcggcttttgtattcttttgggggagtggacactttttgccaatttttgagtgtggcggcgatacctcaaagtgttcctttgcgtaagcctttgcttcgtctgccgttctgaattttacgtaaaatggaagagcgatttgtgcgccggtcgaaaagctcgaagtgccaaggcttatggagtcaagcgaagcttagggaagggaggggaaaacgaaattgagaacattttaaaatagatataaattaaagggaccatgaaaagtattgtgttgttccaaataaaaaaaacacggtttttagttttctgagggataaaatgtaaaaaaaggggaggcgaagggatagaaataaagaacggagaaagaaacgttcattatttaattaaaatccttccgttttccgctatttccaaaaaagtttcacggaaataacggaaaaatgaacaaagtaaaaaataatcacccgaagcatcttttagacaagagaatgtgcagtgagtgtcgctctgaatctttccaactttttccagccaaaggaacgtttgctgaaaaacgaaaaattaaattttttggcgtttatttgaaaattcactcacttcgtttatcgttttctccaaatgttcaggcaatctaaagacattcataacgtcgacaatttgttaagaataatccaacgcaaaaattggaaaaaaattcactccgtgtcaattttaacccgccatttgaacgacgtgctgagcaacgggcccgagctgcacactttaatgacgggataagctgaaaaagtaagagaccgatgaaagacagagaaattaaaaaactaattaattttaaaattgaaattttttcaaattggaatggcaatattttgagattaaattgtaatgcgttcaccacaaacagttgcagcaagaagtcctaaacgcacatatcttccagttttagtaaacataaatttgtctgcattttctttgaaagaactaaaattagttttttaaatcataacaaaaaacaaaaatgaattaaacaaaccaacttgaacttcatataaaagtgctgattattgcctgattttgctttcattctttggaaatgacaaaaagggacaaatggactacaaatgctaaattaaaaatggcaatgaaatgtttagtttattattatgttaaataattcggagaactacggattttaaaaatggacacagaaaattaaaattatcactcaaaaacaaaataatgacaaacaaaaagagtgaataaaatttgggaaaacggaacgaataatacctaaagatgctcaaaaggtactgttgtattgcattttcttaggcttcccttctttggccatctttttctcaatgctttcgatcgctttcattcggtcggtgtatttcattttgtgtcttttgcaatttccattcgcatcaaaaggcgcttttccgtcggttaaccgataaagcaatttgccgagttcaatgctggactggagatattctcttaagggagtgtttttgttgccactcaaaaatagcaaaaataattaaacttactttgcgccagaaaggcatgctgcatcccttaaatgttaaagttaaacaattcatgcaatgagaatgtgcatctttttaaaatcttcaataaatccctaaattttagtaaaatttcaaatgatttccaattgagaatttttatatttgtagtatatattagcaaaaaaatgataaattctaggttttgaataaaaacatattacgaattgcatttgtgcaacttactct

SEQ ID NO: 3112 - DNA, 1156 bp, Heterodera glycines
tacatggtgcttttcaaatgggataaagccgatcattagatttggctaacatttcagcttcaaccaaatcgagcagattttcatcaggcatattgggaaggtcagcggacatcattttgcgaagtttgaagtcatggttcaatttatctttaaaaaattcatttttgattagcctttttatattattttgcgtttttagtgtttattagcaaggctactataatcaataaaagttattaataattgccggacccacttctctgtaaattgacaattattggcgcacacaaaataccgccttgcatgagtagtgatgtccaatgaaagaaagatctgtgcatcttactgttcattttcttatgatggaaaataaaagggaaaatatgtaaatctaaaaaaatcaataataattaacaggaaaattttaaaaatattgaaaattatttaaaatttaatttttttttctttattttagagccaaaaagcctaaaaagttttgaaaaaagttatttttgcctattttggcgttatgcctgaaatttaacaaaaattttataaaggaaaaatactctaagaattcgaccctaaaatttcagaaatacacgcttaagaaatgaaatgaaaagttttctcgcacatctccatgattttgcaaaacaaatgtatattcgtgatcagcgtcataaataaccctagaaactttttttccgaaattaaacaacaggcgagacctcccgtgaataaaaaataaaattctttttgcttgttttaggaggataatgctaaaggtgattcttcgtaattttaccgtgttggtacaaaaaagcgactcggccactttggcttttggattcatcgccggggcgggccttgagctgttcaaaatcaacttctcatgttttggcatttcattctacaaagtgttcaatgagaagcagttgtcccaagaactgacgaaattcgaagagaaattggccaatcggaactcgatgttgcgcagccgaattgatcagtttcaggacccaaaatgatttttgtttataatttaaaaaggataaaattggaagaattaatttccttttggatctgtctgcttcgcacatatttttacacaccgtaaaaacttaaaaaatgacgatattcaagaatcattttt

SEQ ID NO: 3113 - DNA, 1321 bp, Heterodera glycines
aaatttaaaaaataaaacccctaagaaatgaaaaattttctcaacaattcatctccaaaattgattttcatattttttttgccaggaattttagattttaaaaaatgttgtaattccttaatactgatttggcataatttgttgcttccttgaataaaaaaaaatcattttacacttctaaattaatttgaagttttttagtgaatgtttaccatttttagttcctgttttggcgtttagagcctaaataaagcctacccattttggcagtttttaaagcctaaaaatattatctctaactatcattggaaataattttgaataattgaattcatcctttttgaaattattcagttcccggagttcctccggtccgtttattaaatgttgtttttgttcatgttcatttattaaaacaaatcaggtcatctaaatttttaaaatttagcaattcaattttatttatctaatatggccaaaagaaccaatagaaaaaatcaaaagaaaaaatctattgacaagggacgaaaatcgagaaatcgccgccaaaaagtgagttttgattttattgtagaaatgaactgtttaaaaattttaaaactcagcaggaaacggagagcagtgactctgatgactccggaaacgaaagggatttttgcgacggagttgcagcggaactcttgcaaaaaatatgcagagccgtacgggtcaagggaatgaagcggcgaaatgatcgaacaccaacccctatcagagattacaggaaaaaaccggatagtgtgagtttgctttttcaatttttaaaattttaaaagatgctgacaaacttttaacatcccccgagggacggtcccaggaatttagcaaatttctcagtgtttgagacaggccaatagccgaaaaaatttctgaggcggcgaacttttttttttgcatttcggtcagaaaaaatttctgccaattccgaatcccggacccgaactcgaacaaaaattcaaattttcgaatttcatatttttggtttaaactttgtttaaacacatgaaaacgaagtgaaagtcattagtgcttcaataaaagatcatttaaaccatttttgactaaaaatggaaaatcgaatattttgaatttttcaacttttggttcgaattcgggtctggaattcggaattggtagaaattgatgcgtgattcgtaatcagcaactccgacaacccttgaaaacatgttttcatgacttttgaaaacaaaaaaaattttttcgaaaaaaagggaagtggggccaacccttgctattacccggattttgtggacctgccagg

SEQ ID NO: 3114 - DNA, 5691 bp, Heterodera glycines
  misc_feature (13)..(13): n is a, c, g, or t
  misc_feature (124)..(124): n is a, c, g, or t
gccattttgagancaattttcaaaaaagaaaagattgtccagctgtgaggataagcgacgccgagaaaattttagaaattttattaaatatagccagaaaattgcaaaatttgtaaaatttgcncatttcttgaaattttttcatttaggaggtaattcctaacctctcaccccctccccttctggctaccggcctgcttggagggagtaccaataaagaaaatgggagtttttgatcaaaaattaatgtaattggtgatccatcaggaaaatttttcggaaaaaacgagagaaaaaggcacgaaaatctcaaaaggcataataaaactcagtctagaagcttcaaatcaagtagaaaatgtgtttttaaataaaaaaatgaacatccaaatgagatatcgttctttacaaaaatagttcaatttttttttcttgttagatttacaaaaatgatgtgaagggacctgcgttattaatcaataacattcgctttggtggcaatgaataccggcacggggcaaatgtggacactactggaatgctcgaattactggaacaattgggttacaatccggttcacatgtttgaggatttgagttcccaagtaaatttaaaaaataaataaataaaattaaaaaatccaaaataaaaaattaagcaaatggttgccaaatttgagtggttctcgcgtttgacggcattgaattttgcggacaggtgtatttttataaatttttaataataataaattattaattctgacgataatttttggggtgaaaatatctttttttaaaatttaaaggtatcaatgttatggctaaccttttaggagttttttaaaagttttagaaaggtaaaattaaaactcaaatgaaaaatcgagattttacaaaaacctttttgttatttaggaaattttttttcaaatttgaaatgtgccaacaaagaatggttttatttaaataggacaaaaactttaaaagcaaatttgaattttttaaatttaaaatgtggttttggctgattgtggcttatttttgtgattttaccggtgcaacaacatgtctaaacgctcctaaatttttttagtactgtcacggtggtaatgtcccacggtcatttgcgatcagtgcaagggatcgatggcaattctgtaccaatcgctacgttgaagagcaaaatgaacgggaaaaattgtccacaaatggttgacaaaccaattgttgtaagaaaatgatttggcttattatggatataatacttgggattcagatgcttttcaattcctgtcaaggagccctgcgagattatggggttgaaagcagtgaaagcccatcattgccaactacaaaacggcacgcaaaacggtgaccgtaatttctatttttaaaagaacaatgaaattgattagtaaaaatagtttatgaatacgtataaattatttggggcatttttaaaggcattattatcttttaaaatattttctctataagtaaaaccacacttagttgaaatttaataaaactcttgatgaggaatagtttcaaaatttacaataattttaaatttttatcgattttaattaagtgcataaaaattaatcgttttaccgaaaaatttacatttttttaataattttctaaaaaagcaacaataaaaattctattacaaatttcgataaaattttcatgacaatcccaattgcattaattgatttatttattaaatatcaggcgagaaactgacagtcaaagcagcaacgaatcgccaagccggccttcgtcgagtagaaaaatgtttgtttttgagatgcccaattattatacgctattttttttttaaatgcacaggtccaaattgccgcaccgttcttcgacacgccaaaaaaagtatgttttgttggaaaataaaaatagagtaaagaaagtatcataatgaaaaaacaaataattaatgaagtcctttgaaaggcattttaaaaattcttaatgatattaaataattgaaaaacaaatgagtaacaaaataacgtaaattcatatgaattaaaatcgaaattttaagcatgcttaatttttaaaatatttattataattaatacatattattataagtgaaaataaaaattattaagactttttgagaaataaaaagtcaacatattatgctgaaatgactaaataataatgggtaataaaatatatttttactattaatcgaaaataaataaataaatatttatatttaaatataaataattatattaatataatgcatgatatatgaatattttattactacgtgtaaaataatttggcatattttaaaagacattaaataagaattttattttaattatttacctgtaagaaaaaaaacaaatttgtggatgtctttgaggaatagaaaaaattttaaacaatttttaaattaccgttaccgatatagacatttattaatttattgaaaaaaacctattattataaattctataaaattttcatcacagtcgtaatttcattaattttttaaattaaatatcaggcgagaaactgacagtcaaagcagcaacgaatcgccaagccggccttcgtcgagtagaaaaatgtttgtttttgagatgcccaattattatacgctattttttttaaatgcacaggtccaaattgccgtaccgttcttcgacacgccaaaaaaagtatgtttgttgtttccccagcaaaatattaataaggctgtgcaccgggtcttagtttggctaaaacaatatggaaaaattcaatctaatattttttccttcattcacctaaattaaatattcttggcatctttgacagctataaaaatgctttattagtcacaaagtttaacaaaattcacttattcccaaaaaggtttgaaaaagcgaatttaattttggttaataatttgcatgtggttttttttaattcgtgggttttgaataagaatccatcgctagagatgtggcctaaaattttcggattttatttattttttcattttatgtttcttttgttccattccactttctaaatttttgaagaacagcttaaaattttaattaaaaacaaaaatttccattgaaacattagcaaagtgccgagcaatgccaacatgattgttggctattcgacgactcctaacttcgtgtcatttcgaaacaaagaattcggatgttggtatatacaagccatcttacgtgtctttggccagttcgcgaaaagcgaggaaatcacacagctcttcgagagagtgcacaatattgttgccaagcaagaaacgaagggacagaaacaaatgccttttttcgaaagcaaattaactaaacgtttttactttttcccaaacgagtgaaaaaatttcagtccaaacattcaatttttaaaatatttatttctttattacatttattggtattgttgaacaaaataaatgttgaatccatcttaatacttttattaaaaaaatattatagtgtttcgtattttcctatacattttggcgatgattatggaggcactttaatatttgatttattatggtttgaaaacttattgggtgagttttcaattgtttctacttttgactgcaaaataaactacagttaaatgcttttttttgaaaattttgattttaatttaaattttattggatttggcttacatgcatggaaaattttaagtaaaaaatgtccattttatgaacaatattcgaaaattaaagtgattcaaatttcgaaacatatttctattcactgtaacaatatgagcatttttgctgataattggaatctctagaggaaattaaaaatctacagaaaattcatctgagaaaataaaacaatgatcaaaactcacctttttaaattatgtgtttgtaaagttttttgtgtatttggatttcacaatttcaccattatatacttggtaattggcaggcatgcctctatttttaaatgactcggtagaaaaaagccatatttaaatttgttaataatttaaatataatttttttgatttccttctttcctttatcgcttatttggtttgttctttccaaccatctaattccaaccatgtaaaagtgtccgtacgtccccatttcttaatcatagggaccgagccatatcggcaacgaaaatctgtccggcaatttttgaaaaaccaaattgaccggttttagagagaagtacccggaaatgttgtttttaaaaatgccagcagcgttctcagtcccctaaaccaatatttgtacatattcattaatatttctttaaagaatcattaatagggaacggatttttagatgctaaaaatcctgaaataggtactaaaacaggtgccaaaaaagtgcaaaataagtggtaaaaacaccaaaaataccaaaagtgctaaaaatgcccaaaatagctgcgaaaatgggtgttaaaaattggaaaaacccagtgtctttatgcatcgaaattccaaaagtgtctaatttttatcaatttcgcccgcacaattgcaactggccaagaaagtaaacaaatacattttggagacgaatttttgtgaaaatttttcatttcttggaatatttactgaaatcttggtcaatttttaggggtattttttaaaattttctgtgatcgattcttaggggtgtattttccgtttttattgcattttactatgaaattccgttcaggacgatttcaaaatcgctttctcagtacctaaaccaataattttacataacaatatttttcttttcttgctttattgctataaattttcagtagattataattcttattataccaatcgcgtgatttatatgacgctcacaaacgcaaatgtttcacctttatttgttttattttttaaatttattctgcattattttctcggtttcagtctttattttttgcttataggtaggaatgagatttttaggcataacaatcgcagagaaggtactcaatcagcaaatggccgaagtttttgaaattttggtaattggtcgaaaagtgttagtatgttaaaaaaaaattttgattggtcgatgccacgataaatttggtgaatgaataaagaaagtccaaccgaatgaaaatccgctacattagtcaacaaggtaacaaccaatcctggagacggcgcatcatacatgccacggctcccggacttttcgacagcaaaggacttttcgacagtaaaaaaaataatggactgttcaatagtaaacataaaaacaaataatttttattaaaataaattatattgcttgtcagttttagtaaatttatttaaattaacataaaaaatgtattgctaaatcttattactagagatacgatttttacattttttacctagaaaaatttccgaaaaacataccttaaaaatcggtccctaaaattttcaaaaatatacccctaagaagaatgaaaaattttcccaaaaattcatctccaatttttatttatttatttttccaatgtcgaaaagtcccctcctcaaattttaaatatttctgtcgaaattaattatagccgacaaatataacatcactggcttggtaaaggaatgtttcgactttctcattgaaaaattgcccaatatttttgtggcttttgaacaggctttgttgttgaacatggaggtgaggaaagaattttaatta

SEQ ID NO: 3115 - DNA, 2025 bp, Heterodera glycines
gtatttaaatattcaatttttttccctgcggcgcctttcggcatcgccggcctccctcttccaccctgctcaccaccaaaaagtttttttcaaaaaataagccgcaaaaattgttaaaattaataaagggagtcaacaaataaattatttaaaaattttatttgaagcaatttgaaaaaatttctgattttcgaccaaaaatatgattttttaatttcaaatttctgcttactaaatttttctgtctatttttttctcaaataaaaggattgtccttcaaatttgtgcattaaaaatatttttgttagtttttaattaaattttcgaattactcccgctcccgcccgggactcccgtaaaatttctgcgggattttaacgggagcgggattttcacgggattcccgatcccgctcccgctcccggaaaattttgaactcccgatcccgctcccgctcccggaaatttttttttaccggactctaaaataaattaatattattttaatcatttaaaatattttagttatataaatgataaatcgaaatttattaatgctctgataaaaaaatcatttgataatggattcaacagaaacggaaaaattagcattttgtggaaaatattttacttactatttgaaggtttcagacgcggtgtagaatcttaaaaaattaatattatttaaatcttttataagatttacgcgatacaaattaaggaaatagtatgaccttcaagtacccaattctctcattttggcgtactattttaacatctctaacacacgaaaatatcaaattcgctaatacttataattttggttataagggtaaaaaatcactttggacatttagaatcaatagtaaaaatgattaattttcgtattttggacaaaaactgctgcctatgactcgagttataacgtaatgaaactttaaaactctcacaacttttttctgagatgtaaaattgaattagcattcgcttagaaaaagattctccttttcaaaaactttttttagatatcaaatttgatcagtttaattgggtatgaagcgagttatggcagatcaaaataaaaaatacaaaaaaggcattttccagggtaaatttcgaaatagcgcgcaaaaatttacgccaaatgtgctatttggcgttattagtagggctataaattatatgcttttgcatattttttctgcgcatatgctatgaaggggctcaaaaatagcatttctacgttaaaattttttgatttggagaaggttttggtgcatataaaagcatattttgggggttttcgacaaaaatgcatatttcgccatttttgcgtttttatagcatattttggcaattttttgtaaattttcataagaaaaatgcaaaaaaaaagcgaaaaatacacctctaaggatcgacttttttggaaataaaaaaatacacccttgaaaaccgaaaaatttgaactttttgtaagaacttttgaaaaaaatttgatgcaaaagacaaaaaaaaagtaattttgttttagcataaaataaaaattcagcaaaaaaattcaaaaatgcatatataaagtttgaaattcaaaattttacaattgcctaaaaaagttcattagccattgttttggagtttttaaacacggcgagtcaattttgggctccaagcgcaaataagtttattttttatttactaatcataacgccaaaacttttcaaaacttaaaatttttggggattttcccttgtaaaaatagaagagccgatctcgagttaaaaacttaagtttcacaaaataaacttggaatcgctagaggaggtcaaaatatgggcctatgcaaaattttaagaaaattggtcaataggaaaaaatttttttcaagggcaaacatttcaataattttaattcttttttagccaagtccacaatttaagcccaaaccaaataaaatttacaatattctccagaattttccccttcaaaaatgagcataaaatggttttatttgctctactattca

SEQ ID NO: 3116 - DNA, 4310 bp, Heterodera glycines
ggtactgaaaacaatgtaaaactgagaatatcgaagtcccggtttgaccgggaccgggaaaaatcctggttttttccctgttttcccagccaaaaagtcccgggttttcaacccaaaaagtacagaagtcccggttttgcccaaaattcccggtcccgcacaactctactgaataatatatttccattggtatgtacagtatgtctttcaaccggttctgtacaatatattggttgacgcatttccataattctcgaaataacccaccaccacaacaactggcaaatgcttggcatcattggcaccgcaattgttgccgacagtgctggtttcctcctgtttttcatgagcagcagtgccatttgggcagcacgacaaattgttttgggtctgattggtgctgagctaaaaaagccataaaagggcgctataaaaaaaagctagagtgtagcgggaccgggacctggacagtagttacccccccagattttgggggtgacaattcagtcccgtcgtttcagtcccaggcaattcagtcccgtagttttagtcccaggcaagtcagtgccagaccaattaagtccgacccatgcctattagagttttttttctgttttgcatgactgagctagtagtacatcaaaatgttacgcttgactgatttcataacaattagctcctgcctattattaaatttacacatgtgtatttgtagtaattatctctcgtacattatgcatgaccaattttatgaaaattattcaaaatgttatgcttcggtgatttcatagtaattatttatgttacaattgctctcaaattccattttttacagtgacctattttgctctggttaccgtcatcaaaataattattgctgccctctattgagagtataaatagacgacattcccaaccaaaagtccatttctcccattcattcaaaaaaaaaaattttcaatcccactccactttacattattctctgaaaacaaaaataaatttgagtatttaaatacaaaataattccattacttttacaattctatcattaaaaataaataaatataaataaaaatgaaacgaacttctgacgaccaagttccttcattccctaaaaagacccaatcaaataaatgcattagaaaaattgacaattttacatcaaagagccgaaaacaccaacttttccgctccaaatctaaatttgtcgtcgaggaaattgagacatgtgctgaccctacggcggaactccgttcttgtatacaccattcaattgaagaagcagtcttagatgcccacaactcacttggatcagcaaataaggtgggggtaatcatttcttctgaacttttagaccaaggcgacattattgttccaattacaccaatttcctccaatgtcgtagatgcagtttttaatcaattttgtaaagtggagcagagtaaatccaaatacgtcaacctctacggtgcgccgtttatgatcacggtcacagtacttaacactgacggacttccccgacaacgaacaatcaaaggcaaagggcaccctccttcttcatcatatgcccatatttttaaaatcaacaacaatgacaacttttgcctattttatgccattgaattaatgcgctattattcattgtataaacgtaatattatttctagagacaaatggcgttggattagtgacagacaaactacagttttgaggcaaaaagtccatcttcttctccgagaagcagggattcccacaacagaaactgaatatgacgcggaaatttacatccatcaagtgcaaggattatggaatattaaacacccgggcgaatataagatttttatcttcaacgactatcaaaaccgccctattgctaaatctgatgtcaccgactaccagtttcccatactcctctaccataataattatcattttgatggcattaaaactctttctaaattcttcaagaagcgttactattgtctctcttgtgaatgtatctacgaccgcaaaacaacacattctatgaactgtacttcactctgtcacggctgccgggaggtgggcgtcgactatccgtgtgagcctcagcaaatgtacttcaaaaaatgtgagcactgtaacaataaattttacaacatcaactgctatgaacgacatcttaaaaatgatatctgcacaaaattcccacgatgcaatgactgtggtgtaatatataacattaaatatcattcaactatgagtcatcaatgtggagaaaagttttgtcgcctatgtaaacaatttcacgtaaaagaggaagacgacgagaatccatgcagtagttgttttatccaacctcttaaacaacaaaaaatcaaaccgtaccggatcatagcttacgatttcgaggcaatacaggacaaaaaagttggaaatagtttcgaacacgaagtcaactttgcagcggctaccgtcatctgcaccaattgtattaataatgaagaatggaaaaactcactagagggaaaacaatgtgctatatgtggccccaaccgtacaattacattctcaccatttgattacaaagagacaacagtagaccaaaaaattgtcacccagcaaactctacgggaatttgtccaatggctactatttgaacaaaataaaaaatacccaactgtagcctttgcacactttgggggtcgctacgacatgacaatgatcatcaaggaagttattgcacacggtacaatttttaatattcatagattatatattttttaaggtgttcacgatccacaaattatcaaacaaggaaatcgtctttatgaactcaaaattaaggataatgagcatgccccactaacaattttccatgacagttacaatttgatgcctatcaaattatcgggtctcatcaaatcatttggactcaaaattcaagtgattcattttcataaaaattatcaattttttttttaaggataaacaacactttccacacatgtttaacaaatcatctaattatgaaaatgttcttactaatttaccgccgtgcgaaaaatactgtcccaatcaaaagaaaaaaactgatctgcaaaagttcaacgaatggtacaacaccaattatgaccaacattttgatttaaaagaaaaattacccgaatactgctgcaccgacgtcaaaattctcacccacgccctcgtcgagttgcgccgggaattcaaacaattaacacaaagagaaggaaatcatagaggaattgacattctttggcaagcaatgaccaaagccagcgcctgcgtcaaaaacgttgcccttaatcatttgagatccaactctctagctatagtcccggagaaaggctacaccccacaacaaaaccaaagtgcactggccaacaaatttcttgactggtactctcacataaacaacgttcatgtacaaacggccagttcccgctacggagaatatatgtttaaacgtgaagggcaggtttatcaagtggacggctacattaaaggcacaaatgggcagcgggacaaaataattgaagtgaatggttgtttatggcatgggtgtgaggagtgttttgatgatatggatgaagagacgaggatgccaaacgggaagacactgggggagattaggctaaggaaacagaggaaatatgaaatacttaggcggtacgtcgacttggaggtggtatgggagcacgagatcaataaacaaatgaagagagacaaagagatgagggagtatttcgaaaactggaaggattgctcacctatcaaaataagagaagcatttcacggaggacggacaggaccaatgaaactaatccacacagcaaaaccggggcagaaaatcagctacaaggacttcaccagcctctacccgtttaccaacttctctacaaaatatcccctagggcatccaaaaattatttctttcacgaccaatgagcaaacggtcaattggctttctccaactgacaacccctacaaaggattacttaaaattcttctacaaccaccagacaacaacgtcaaagttactgtaatgccaataaagtttgatgagcgcctgctattccctctctgtgaaaaatgtgccaaagttattagcaacaaatacccaaatggcctcaaagacaacgaatactcctgcccccacttcaaccccaacgaccgcgcctttgtatcaacctgcacccatcttgaaataatgcagcactggaggccggctacaccgcccgcaactttctcatgtcctacaatacgaccaatggagtgacaatgtcttcaagtcctacgtgagcgaa

SEQ ID NO: 3117 - DNA, 2119 bp, Heterodera glycines
taaatacgatattaaatttaatattttattttaaattcttttagctctatgaaaaattgttttattttaattttttacaactgtaataatttcttgactgaatttcgctgtttaacctgtttcgttttttcttgttttagtaatttttattaaattctttgatctattttattattttgaatttttattgattttaataaaacaaatatattattcgatgtccttgtttggtgttatttattttcgtatatttatataattaaaaaaaataaataatattgcaacttctctccaaaatatgttaacaatttcattgatttaaaatcgaatatcccaaaaaaattatattttctataaatgttaaattgaccaattaaattatacggaaataagggaatgtcgaatttcaaaaaaatttaaaaaaattaatgaaacattgccaattgggtcgggaatgcctggggaaggctggtacaagcatggcgttttttttcatgaaatttaaatatatgattttaatcaaatttaaaataaaaatttctttattaaaatagcttttttctatagggctccacacagctgtggcatcatcatcatcacaaacaccagcgctagtggcaacaatttcctcatcaacaacaacaaaaatttatttttatgaacggtaaaaatgtaattttaagtaaatgtttattattttgcgtttttttaattcattaatcatttaatcataataataacaaatcattttaataattatagctaatattttcagcacccaaccaccaccatttcaaccatcatcatcatcatcatcatcatcattattattattattatcaatttttatcacaattattctgatggtaatgttaatatttataactgtaacaaataaaaaaatttttgcaagatttgcactttcaccatcattggtgccgtatctttacttatggttaatttttacttattaaaagtttattatggttaaaagctactattatattcagaagagaatccaccgacgccaacacagtcaaacaatgcccgccatgcaaagagcccgaccaatcattagtgccccaataattgccttcaatgtatgtacaaatgaaatatatttaataggcccttcaataaaaagcacttttttaagcaaaactatcggagccccctgcaaaggccgccgctaaggcctgaaactttgtactttgattgtgtttaatttttttttttgcaaaattcaaaataatataatcatcaaagctgtcaaaatatgcaaatgcattttttctccagggttctccgtagggtatttaataggaaaaatatctttttggtatttgcgcataaaaatcgggacttttatttgcctatttttgggtttatgcatgttttttttctgaatatttcatgcatattttaccaatattttcaggttttttgcatattttgccctttttcgtcaaaattttccgatttgaaaatccctttggaaaaaatttgattatgtctaagaataaatacaaatctttttgtcctcttctttttcctcctcttcttttacatccaatttttcctcctcttccttttcgtcgtccccttcttcttcctccaagccagcccacacgtcgtcttccttctcttcttctatctcctcgtcatcaaacatcaagggccagggcaaattttcgcttatgacaaaagtttcttaataaacgtaaaaaaaattttttttaaataaattcagtttaaaaacaatttagactttttttatgaaatgtctaaaataacataataacaaatacgctttttaaaaacttttaatttcttttcaaaattctaattttttgggtaaaaggctttaataaatttaaaattcaaaaacaatttagcctttttgaaaatatttaatgcccaaaactgtaactaaatcggtttttttttaaattaacacctttttaaaccccaaataaacgcaccctggtcgtcggtgctaaaagcatcatctttctattccttctccatgccttccgacatgtctcctcgtctacttcttgagcctccgcatcaaacatcgagcgccatttgtcgtttatgacaaaaaattcttaaaaaa

SEQ ID NO: 3118 - DNA, 1974 bp, Heterodera glycines
  misc_feature (459)..(459): n is a, c, g, or t
  misc_feature (577)..(577): n is a, c, g, or t
tttttgtcctcttctttttcctcctcttcttttacatccaatttttcctcctcttccttttcatcgtccccttcttcttcctccaagccagcccacacgtcgtcctccttctcttcttcttctatctcctcgtcatcaagcatcaagggccagggcagattttcgcttatgacaaaagtttcttaataaaggtaaaaaaaaattttttttttttaataaattcagtttgaaaacaatttagacttttttaatgaaatgtctaaaataacataataacaaatacgctttttaaaacttttaatttcttttcaaaattctaattttttgggtaaaaggctttaacaaatttaaaattcagaaacaatttagcctttttgaaaatatttaatgcccaaaactgtaactaaatcgggttttttaaattaacacctttttaaaaacccaataaactcccctggntcgtcggtgctaaaagcatcatctttctcttcccttctcatcccttccgacatgtcttcctcgtctacttcttgaagcctccgcatcaaacatcgagcgccatttggtcgcttatgancaaatattcttaaaaaaaaagtttttaaaaagtttaatttttaaaattttaactataaacataataataatttgaatattgaaaataaattagaccttttggcttacatatttaatttttataaaacgacatttcttcttcaaaaaaacatttaaatattctcaaaaattgttatttttttcactaaatggtttataaattaaaaaacggaaaaaattttttcttacaataaaaactgcaacgaaatctaattaaattgctttttaattgacgcataaacgcaccttgatcatcagcgcctgcatcctcggcctcctgtaggtgtttatgcgatgcgtgaatgtctgcgtgtgcaggtgcagatacaggttaagtgtaaatgcgtgttatgtgtgtgtgtttgttttggtaccggccagaggtgcagatacaagttaggtgaaatgcagaggtgtgcacgtgtgttttgggtgcaggcaggtgtatgtgggtttgtgtcaggtgtagatgcagggggtgtgtttgtttacatgcgcaggtgcagattgggccaaatgcgtgtgtttttatgtatttgtagatattcatgccaacaagacatgtccaaaaaaagcaaatacacagaaaatagcgattttcatcgaatattgcaaaaaaagatgaaaatatagtaatatctagaaatcaaaatataaaacaaaaattatcgataatgaaaaacaaaatgaacaaatataatattctatcaaaaatttattataatttaaaatcttcggcaagttttgctgggattcaaaaaattttaaatgaagcgaaaaaattaacccggaatgcttaccgaattgaagatttaaatggggataacattaaaggaatattttatgatgccgaattagtaaaggtgtcgagaaatcaaataaataaataaaatataaaagaacttgaaaaatattcaaataaaagtgaataaaataatgttcttagtattttttggtttggtatttggccaaacaaatagcaattattgctgcctttctaatgaagagaaactgcaaaagaattcatcgagaaaagtaagtgatgaaaagcagaaaattggatttatcagaaaagaaatggataagtacataatttctgggaatgtattgaagagacaaaagatggagtaatatcagtcagacgtttcttacgatcttgttttttaatcaattatttttccaaaacaaaagtgaacatacaatattcactttgttctaaatctgatgtcaccgactaccagtttcccatactcctctaccataataattatcattttgatggcagtaaaactctttctaaattcttcaagaagcgttactatatggctcttggaatgtatctacgaccgcaaaacaaca

SEQ ID NO: 3119 - DNA, 5487 bp, Heterodera glycines
tgcactgcatttggctcttttacgaggacatgtcgaaattgcgctgctgttgctgaacagggggtaatcattggcttaattatagcacataagaaggaatggtttaattaataacaataaatggcggagtgaaatttctaatgattttctcgttaaattgaaaaatgcccgagaccacacacaaaatattttatcaacaatgacctgctgataaccattcaaatgttttagctgcaacccaaacgtgcaagaccaagccggggacacaccgctgcacatcgcggccgaacgtggactgggcccggctgcacaatcgttgtgccaacttggcattccggtcgatgtgcaaaatgcggtcggtgtataaaaaagaaacaagcagcgttattgctcgagactcaagaatctcgaccaaatgattgccactaatagaccatgggatagtgacttttgctgtttcagaaaggcctttccgccctccatttggccgctcgccatggccacattgacattgtgcgctgtctttgcttgtccggcgcaagtgtccatttgaaatcgaatgtaaatgatgttggtcttttccgaatttgtgattttatgccgcctttaaggatggcatgaccgctgagattatggcactagcccaagagcagaagcaaattgccacacttttggccaaagtgaggccggagaaagcgcgcacaaaattcgtcaagcaactgtccacagtggaaggcccgctgaagaggatcaagctgaaggtgttcggacatccaggtagccgagctaaccaatgaaattgatcaattactgattggtgtttgccgatcgcattatatatactgattaatcggcttggtaataaaagccctgaaaatttcccctttttcccaacattgagtcaaatggattacttatttatccctcatccgtcccccaggggctggcaaaactcggctggtcaatgccctgcagcgctcctccgcctcctcgttgaactcgctgatggagtcggtcacgcgtcgcttctccgacaatcttttcccggctaacagcagcagtgtggtcgtctcttcttccacctcttcaggtatgtccaaatatttaaatttcgtagcattttaacattttttgcccccgctttcctccgacctttttaatttcaaattaggaccgaaaagaaaagcccggcttggccatgtcatgcaaagtttatccgatttttcttattctgcagaccaaatttcgccgactttgtgtacaatcaatggcagttcctcctcaatgattatggcatcgccttcaaaaagcggtatgttttttgtagggaaaaatgccttccccagggataaagggcagagtttttaaaaaatctaacaagaatattcatttgttaatctcatcatgggcaggtgaagcggaatcgtcggccgatgagggcatccattcgggagtgccgtcctcctcctcgaccacctcctcttcgtcaaccaacggcgtcgtcggcattggccatcggcacaaaacgtggccatgtgcggagcgcaactcatcagggcgggcgccgacgcagggcattgacattcaaaacgtggcatttccaggcaagaaagaaaagcatttggagtttccaacgtgcatccacctaacaaccggttgtgtgatgctcgagagttgactttcggtctcgcatctaaattcaaagtctcgcgcggaccttgggcaaacaatagaattattttcattaaagttgtttttgatctcgacagattgcggcgagttttccgtgtgggacttctccgggcacgagcccttccacatttgctacgaccattttgtgggcaacacggactgtgtgcatttggttgtcacccgatggtatgtcggcggcacaaaaaggaatcttttcgctaaaccgttgttttcaatatattcttaaaagaaacggattgccattttctgtatctttcggtatttttgttaatctcttttagtatataaaatccaaaacaaattttttgaaattaatgagttgggttcaacaaattagtctcgtccaatacttcgttttaatggggcagacatttttaattaaactccattaattcagttcggacgatcccatggatgagtataaggtgaggaacgggcaattagccaaacattgatacgattattcaccttcccccttgcccatttaaggagttgctgtactggctgaacttcctcaaaggccgcgtcacgcccagcgagccgatcggacattgtggacaaatttcgcgtcgatcggtggtggccatcgcaggcacatttatgggcggcgaatgtccgatcaccaagaacgaggcagaggcgatgatgaggacgttgaagatgaggtgatcaaagagaaggagagaagagaagagagagagaagagatcatcagaaatagttaaggaagaaagtgataaaaagaaagagagagtgccttgagacatgcaaaactgtagagggagattgaaatagggagaaaatgggaagagattgatcaaaaagatagttgagaaggaaatagatagagcgagagagagagagaaaacgttatcaaaataatggtaaagagaagagagtaaccacggaaaacggaaaagtgagtaatgagagattaaaagaatggctaaatggaagagaccagtgagagaaggggaagaatgagagggaaaaagaggacagagaaaagattaatatgttgaaggacaaattcaaaaactaacttttaaaatagttttaaacattctcaaactcccccccccccgcactttgcaggttcgaaacccatttcgacatccatggccaactgtttctggtcgacctttccgcgcagtccgattgtgtcggctctcgcgaattgcgtgcctttttagcgcgtcaacgggacagcattttgatggtattagcatttaaatgtgtgctaattaaactcattaccattttgttttgattttcagaggcttcaacaccccctccgaatgttggactctgcgctggcctttttggagcaactccgtgaacaatacgctcaattcccatgcatcacgtggccttagtagggggaattttataaatattttttttgaaaattgaaggatgaatttatgtgtttgaattaaatgcaaattaagtatataaatattgtattttcaaaaaagaatattgaaaatatatgaaaatttttaaaaaatctccaaatttttaccaagaattgtaaatatattttaatctttttttggacaatatgttcttaaaaaggcgttaaacaggcacaacgtgccataaaagaattaattatcatagaataatatttttgtggttttaaaaattgatttggtttctctttaaaaaacaattttaggggtacatttcaaaaaaataaatttttcacgaaaaaatttctattaaaatcttaaaacttctaatgaaaaattaaaaaatataccaaaaaatttttaaaaaatgtataaatatatgcatatataatgaaatttccagcttaataatcttttgttgatatgctaatattcagcttcacctcacttgttcgatctgaggtcaatccgctggcaaatgacagccattgtaagtaaaaagcatttttggattggttggcccatttaaacatatttgtttttgccgcatctcaaaattcgaattcttttgcctctgagaaaattcattaaaaaataattatttgtacaattttttaattattatttttcttaaaaataaaaatttaaaaaattgtaagccatcgaaaaattacaggaagaaaagaatttttaattttgccgcctaatacggaaatgattcttttcacaggtcggcagctcattcagcagttgcaactgatcggggaagttgtttatctgcgtgacgagggatccgcacttgattttattgtgtaatattatttatatatttttaaattatttttgccaatttgttaatttaccccccccctttttttgcgtctttagtctgtcccccgattggcttggcacgcatttgcttggcactttgttctcccctcgttttgcgcattcgccccgcgccagtggccgttattcactgaacgactttggcgcagtgtttccggaagtgactgacccggcggacattctccaaattttggaaacgctgcaggcaaatttgattgttaaaattgcaatttttaaatcagttttattcgaattgtaaatcaatttcggcgaaggattgagttagggtatttttgtatcccatttttcggatttaaaagtacgttagtctcgcttcctggcttcagactatggaatttttcgtttttgaggggcctcgctcttgttttatccgggcatttcgattccagcccgattcctgtgaaaaatcacttctctcacgccccttaaaaacaacttcaaactgaacaaataatcttcctttttcagttgtgctgtgtcgctgacttcgacttcgaattccccgtgttcatttcggctcccccgccgcacgacgtttggctgcccaacagaccgcactttgtgtacggcgggctcaggataaagccgacccggggcatggagcagacgatgcagtccatcttcccgcgcattcaagtggcactgcgccggtccatgcagaccttccaagtgcggcatggggcttaccaaatcgggattaccgctttatccgtttatatcgatcactcatcacgggaaaaatacagagactgaccacgaatctcacaataatccattgttattatccggcacaggactccattgaagctgagttggcacagtggaggtactgctcgaagatgcaatcgagcaaaatggaggcattgatcagattggtcggcgaatcggttgaagttcaggtcggataatttggcattaaaatttttgaaaaaaatctttgggagccataaaaccgaaaaaggctctcaagtgttaaatcgtcaaatgacctatttatttgttttagtcgttaactgtgttaataattgtgcccaatttgtccacagattcgcggccctccggaaaaggccactgcgtgcatttacttcctggaggatctgtccacattggtggagctgacgagtgccgaagtggcgcccggtatcagcacagaacggcacttcctttccccggcacatttgagggaacacagaacgagtgggtgggagggaaaggcacacaaaaaacaattcaaaactaaatttaaatttaatattttacctttaagcacctgccatttttacgccagaaacaataatggaaatgcaacagaacgagtcgctggtcattgtgaacagtgacggggaggaggaggaggagttcaccgatgtggtaagttttgccaactaattttttttgagttatttcaaaaggtattaggtcacttcacaaaaaacatacttagctttttcacgaattttgtctcgaatttaacaaaataaagaaatttt

SEQ ID NO: 3120 - DNA, 801 bp, Heterodera glycines
agtcatccgcctgtggcgctcgtcagacttcttcctccgccctccgtctcgccccactacttgctccgtcttcgcatgctcccttttgcgagagttagcttgtcaaattctttttgttcatcccttatttctttggtactaaagtgtcacttttcactgggactcagtagtccaattgctctgatggcatcggctcgacttcattccctgaattttagactaatctcgtcaagagctttcgaatgataccaaacttgtcaggatacgatcgtttaaaaaaagttatggtgccaaatctctcaattttcgagctatgaatcggttcaaaaactggtttaaacttgtcggatcaacttcccccacccctagatcgatctgtctcatcgagagctatcgattgttaccatcgagattggtccacgagaaaaaacatcgtataagtctagagaaccatatttcttttaacggattgccatcctttcatcggcgtgaaaagttttataaagttattttgttataaacaatattattataaatctaatatttttggcaccctcccgagagaaggtgcagttccaaaaattagtacacaacgttccttacaggaacgagtaagtgttgaaaaataggcaaatatatgttaatttaaaaactaatttatgatgggtttaaaatagaggaaggggagagagaactgatcctttatatttctctttttgtacgccttcttttccccctcgcccgtctcttgctcttagttcactttctctcattttcctcctcttgtcagaatggaggaag

SEQ ID NO: 3121 - DNA, 2674 bp, Heterodera glycines
  misc_feature (63)..(63): n is a, c, g, or t
tgccaaatctctcaattttcgagctatgaatcggtctctctaggggtttaaacttgtcggagnaacttcccccacccccctatcgatctgtctcatcgagagctatcgattgttaccatcgagattggtccacgagaaaaaatatcgtataagtctagagaaccatatttcttttaacggattgccatcctttcatcggcgtgaaaagttttaataaagttatcttgttataaaaaatattattataaatctaatatttttggcaccctcccgagagaaggtgcagttccaaaaattagtccacaacgttccttacaggaacgaaaaagtgttgaaaaataggcaaatatatgttaatttaaaaactaatttatgatgggtttaaaatagaggaaggggagagagaactgatcctttatatttctctttttgtacgccttcttttccccctcgcccgtctcttgctcttagttcactttctctcattttcctcctcttgtcagaatggaggaagagagtgagacgcaagggaagagagagaaatgggtcgcggtcgttttcgtacgagcacaaatttttgtctataacttttttctttgccaaccaaatccgataatcctggtatcattcgatagccctaagtgtcctctattagcctgcaaaatctcgaacaattttcttaaggttttatggccagaagaattcaaaaaatggttatttgaacattttttgccataactttttgaaccttaacaaaattgttcgaaatttcgggttaatagagaacaacaaatttttttaaaaggctgaaattattattttctaaattttttggaggcttttttgtagtgaaagacgaaaaaaaaattttagtttattcaagtttgatttaatttttctttaaataaaaataaatttaaagaaatcaaatcaacaaattttatttacttaaaaaacctctaagaattagaaaactattaatttcagttttttattttatttttttcaacttccatttttgttaggtttgtttcggctccaaagaagctgccggtctgctcacgctcggcgtcgacatttccgtctcccaattgcaattgtccgcccgctcggaactcgccgctttgctggacgcaccgaacactttgggcatggactggagcatcctggcggtgaagctgaacttgactgaacaaataccggaggtgggttaattagctatgataattgattggttattattagggctgccaaaaatatgtacaaaaagtggtccaaatatgtacataaatatgtaagaaaaatcccaaaatatgtacaaaaaaccccaaatatgtaaataaaatttttttaatggtattttttgggaaagaaaatccccgtaaaatatgaaatagccacaaaatgacataaaaattactttttttggtatttttaggcaacattttcaaacttattttttctttataaatcttcaaaatatgtaaaaaaaatgaaaatatgtacaaaaatatttgccgaaattttggatttttttttgaggattttcaaaaatttccgtaaaaaatactcaaaatatggtaaaaaaatgaaaatatatatgaaaaaaatccaaaatatgtacaaatatgtaagaaaatcccgaaatatgtaaataaaagtcccggtttttgttcgcaaacacaaaaaagaaagtgtttttcctgctatttagagcaaggagaagccaggaaaaaaatatgtatttacataaaattggcagccctgattattatcccatccattagggagtggcacaaatgccatttgctctttttcaatggcatttatcacttcataaattttaaaattataaattttaaacattaataagttgcagctgattttaatattctaattacttgcaaagtattaaaaaacttttgggttttttgattatttttatggcaattgaattgcatgccaatctattaaatttattttgattttattaatccaatcgaaatgctcttttgttatgtcaggtcgactcgtcaggccaatcgttgtcccgcactgatcagctgctcaccgaatgggcacttcactcgcccgacagcgcttcggtgggcaaattggcctccattctgcaggagatgggccgcaacgacgtcaaagaggtggcagagcaataatttcattgacttaaatgaaataggttggggggatttcgcattggttggaagaaaaatgtgaagcgattagtgaagctcgagagtctcggtctcaattcttgacttgagaaaagtctcgtttttgggtctcgggttttcggtctcggagtcactctcggtctcgaatctcgggaaattttctgtctcgagcatcattagaacgaggcggggaaaggtcagagatgaaagggataagagagaaaagcgatcgtaaaggcgaaaaggacaagattttcaaaatgaaaatattgagtagatgatttttggtctcattcctttaaaaatttcatcaatttcatccaacaaaatgggacttttcaaattttttctcggcgatgcccacaaaaatcctaatcattaaaaaataggcgcaaaatcgcaaatttggttttttggtgaaaatctaataaaaaaccagaagaaattttcaaaaagtttttggaaaaagcgtgccgcaaaaa

SEQ ID NO: 3122 - DNA, 1556 bp, Heterodera glycines
catgactttctgaaaaaatatttatgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtaaggggtactgaaccaagtttgtggagaaacagttcgaccccccccccccccttactatttcatatacatatcggggcttcaaaaattgcttattagcagcagcatttaagagatttcttgcttttctggcgccaataagatcataaataagcccggccttatcatccttatcattcattatcagtcctatttttcataactttcattacgattttcagttgttgttccgcagggtgcctctgtaccttttaacggttgatcagcccaacggtgattgaccatcgcccgaaatgatcgattgatctgtcatttgtccgttcattctccgctttttctgttcattcggcgcacacaaatgagctaacacaaacaaaaaagaaaagcttctcccccttttttgttcttccctctcccaaaattgttcagcttttgtacaatttcatcgtttgatcactcatttctccccccccccaaaaaaaaattatttatttaaaaatactttctaacggaggaataatttcgagagatttattccattagcctttaaagccaattgattttgttggcggcttctttttttgaccttttaaaaataaaattgaatatttgaagattaaattgtaataaaaattccttttttgcccaatgcattaaataattgtgagtgatctgagcttttccaattagtcattcattcattcgttttcccattttattttctctttttgtcacccttcgcttcgttcactttttctccgtccccatttttcgcattcattttttagctgcaccaacattttttgtgatataattattattatttttattatattataat

SEQ ID NO: 3123 - DNA, 1783 bp, Heterodera glycines
caatttaaaacaaaaatcaaaaattctttagagtaattaaaagccaaatgactgaaaaataaaatatttttttttaataaatagttcataagcgttcgataattttgataaattttagccgctttgacttatatttacttttaattgtgtaacttgtgatctctcttttaaatattttattcatttttttaattttatccgtattactttttgacaattaatttatacttatgttgtccacaaagtcagcggattttcccttttgtggaccttttctttattgaataaataaataatgcgatttccctcttacattttaatgaccaatttgtcatgggttcgagtccgcttgaagcatgatgatttattttgatttttttttcgtaagattattccatcaagcacatttttttattcagagttgagtgctttgagaaattcattttttgttttattttatattttttccaggaagttccgcttgtgcgcgacgctcacaactcgctgggactgtccatcgttggcggcattgaccactgctcgcacccgttcggcacgcccgccaacccgggcgtgttcatctcgcgcattgcgtccaactcgccggccgacctcacgcgacggttgcgtatcggtgaccgaatactgaaggtagtaggtctagtgagggagaaaacaatactttgtactgattacaaatttttttctataagtttgaaattttcccagcaaatttaggcgcaaacgagctgctcttcctccctaactcacctttgcaattttccgaaaatttccattaaaataccaaaacttaaacattggcatacatctttaaattttatggaatttaacttaataaaaattattttgtaaaacaagattggtgtgatggcaatggaaatatttatatcaattttttaactaaaaatttttttcttaaaaactgcactctaatttgtaagcgaagtatttactagaaaaaaaaaattatcgtgtctcctaaaatatagccaccctcctccacctaaattgttctgaaattaggacatgttttcaaaaaaaaaacaaattttaaaatttaattttctagcggtgttcaaccacctgctgctgagctctccacctttttctatttgcctaatttttaccgaaaattaattaaggtctgctcgcgcgacatttccggcgcccggcacaccgacgcggtggaggcgttgaaggccactggccgcgcgctgaccatcaccgtacgccatgagcgtcaaccggacggtctccgtgtggttgttgtgccgcgccgggacacgcacccgctcggcctaagcatttgcggtggaatcggcagcacctcaatgaacccgcaagtcggaggtgccatttttaatgatcacccatctaccccacacctgtgcaattttctaaaaaacgctaaaattcccattcaaaatttagaatgtttgacaacaacatcctaaaaaatgagagatgaaccaataaataaagagtgcagagaaaaaaacatctctcattttggcgtactatttctgtatcgccgttaatagagacaaactgaatttatatttttctaaaaatattaatgttgtcgagcggactcgaaccctcacccttgttctcttcgtgtggtgtattgactaaattgtaagactaaaaactgggacacattgaaaattattaaaaatttaaaaaaaacattggctttgactaattttcctggatttttttttgaatggggcattatttctaattcctaattcgtccctaa

SEQ ID NO: 3124 - DNA, 1864 bp, Heterodera glycines
  misc_feature (1842)..(1842): n is a, c, g, or t
gcctgctcttgctgcaccatcatcatcaagtgctattggcatcgattccggtgtcaaaaatgggtgccaatcaaaacatcactcgtcggggaagcgtcagattattaatggcagtggtgccactaccggtgccaaaaacaacaacaacgccatgtaccagaacattgctgttggcactgttggaggcgatcaaaatgccgttgaagcatcatcctcatcaacgatgatggcaccgaagaatgaatcaatcggaaaaacggtggtggagcgacagatgtcagcctcagtctcattgttggacgttggcaaacagtcggtggaagaacagaaaaaggtgtgtgtgatgtgtgtgtgtaacaagggttgcgttttccgaggcccaaaaattttttggaatttgaaattccggggtgtaaaaattttttgtatgtgatatgtgtatttttgtttgcacacaggttcgagcccgctctgtgcgatgcgagaattattttattcttttctaatgacagagaaaatgaactgtggtagaaaaaaatgcatttaaactccctaaattaaaaaattatgcaaaattaaatactctacaattcgtttttaaattaaattatattaaaattagttttaaactttaaatttatatttcttttgtagcaatttgaagtgacgaccttctccagcgtgtcgtcatcgcacaaccagcacaatcaattgccaaacggcaccatcggcaacaaccacaacaacaacggtgccaatggcaggaaagatgacgacgattttggcacagagcataaaaaagtggcatcgtttggcggttctcctccgcctgttgcgccaaagccgaaaacgaacgtgggtgcctatacttttctctttggatttttactacgggtgtttgttttttgtaaatgtttttttcattttttcaaaaattttgcgcatttcctgccggtttcagtttacatcgtttgccgtcaacgccgctccccataatcataaacaaaatggcaatagtggcggttgtactgacacgacgacaacaacggcaatgatgaatggcggcgtcgccaccatcgccgacggcactgcgccggaaacaacaattggcgacttttcgagccgtcttcgcctcttccaacaacaaacgcagcaacatcagcagcagcaaccgataatgccgaaccggacaacgagttcaacaagtctccagcagatggcgggggcggcacagccaacagcagcagcggcggcagtactgcccaagctgaaacggccattgctcagcagcgacgacttggccaagctggccgaggacgaccaaatgaggaccaaagcggcggaagctgccgctggtgatggacgccgtagggcagcggcatcgctgggggcggcggcgggcagttcgggcgacgcgtcctccggcggagagcaaccgttcccgtcgccgccaccgccaattgctgctgctgccggaggcggcgcgaagacgacgacgttgatgctttcgcccatgtcaccggttgtcgacggcggcacatttgagcatcttctcaatgactggtaggccagcaggaggcgtggtcaaagtgccaaatttctatggtatttgccatatttttgtgccttcataattaaaaaaataaataaaaagctacgtgcaggcgaaactgaacccgccagagaataagtccatgtggtgcgctttaccattacgctattatttgcacagcaactgattctttgaatatttttatttccctttccaatttttcttttatttatgtttaattgtcacttattgctttgaaattgacaaagtggtctttttttgaacaattnttgttaaatacaccccctaatt

SEQ ID NO: 3125 - DNA, 4703 bp, Heterodera glycines
tccaaaaaatttttggaaaaaatgggcgcggcaatttcatattttacccacatttcagtccggtgccgcttggtccgtcctcaattggttcaattcgaacgaaaaagaccgaaaatcggttcctccagcagcagcagaacagtgccaataatgccacggttgtgccaacatcgacttcttcaccggcaccggctgccatcagccaattggtgttggagcaacagcggcgccaggagtggcgccaggcgcgcatggcatcgctggaggccgagtctcggcgggtcaaccaactgttcagcgatgtgcacgaaacagcaacaatgggcagcggtgccggtggcggggcagtacaacagcgccactcgcctgcaggtgtgtgacaaatcagatgaggagttggagacgaacgggtgctgtgcggttgtacccgccggatatgaccgcagcggcgtcggtctcctgaattgaggactttttaccccctccccctccccgatttataaattccaaatttaagaatcgaaaaagtgataaaaaattttctacgttttcttaatttctgaattttttccagcgagcaaaattaaaataacaaatatttaaataaaaaaaataacaacaacaataatttgtggttttttcagaaaatttcaacgtcaaatgatgaaaagaaagatggaaagtgtgatcacatatttttggctgttgctgcccagtttgcatttgcgccgaaggcccgcccccctttttttatttttcgataaatgtgcaaaaaattgtcccaatgaatggctgatcaaaaccaaaaagaaatgtcctttatttccctcttctgtctctttctctttctattcaatcacttattttttctgtagccaaaaaattctcaaccaaaaataacgcgccttttccatttgctttttttttctcattattcactcatatattcatgtatttatagggcctatcacagaaaattttaaaaaaaatgtatttttagggagggccttgagccaaaaattgaaaaaaaaatggaaaattttctgtgacaggccctgtttttcattcaattttttgtccaccattaatgtgcaaagaaaggttcaaattttgattgatttgtatatgtacacaaaatgtttgttgtttctcatcacacaatttaatgtgcccattttttgttttttccatcattttttgcgccaaaaattctcacaattacatatttaacctaattattgtccgcaaaaccaaaaaggaaagcattcctcccatccaattatcatcatcattatcatttacctataattaagtgtttgtttctttcttttagcctctttttttgataatttttgtttttgcctggtgctccatttcacgttacacatacatttgattgggaccaaataaaaaaattttgtaaaaatgttttaagacaatttatttataaattacattgcgcactaaactatttaatttttgtttttaaagaaactaaattggggggtggagaccgacacactaagacgaagcaacacaatatttattcaaaagtccgatgagatcaatgcgaagcaaaatgaggaacaaaatttgagattaattgaaagaaattaatgagaatttaaagtgaaaatacataaattaaggaggtcaaaaacataaaataaatagacaaaacgccacacttaattaaaattaaaacaaatgtcaattaaatctcccacagccatcgtagtgcactcctccgtattaggggtcgccgccaaaaatggaggaaaataagtcgcacgacgatctcatcgaattgaaagagctgagcagaaaagtgccttgaaaagaaagagggaaaataaattagtaattaaaacaatggtaattagtagagaccgaaaatttcaaaatttttagaggctggcgggaagcattaaaaggggcgactaagatttttcgaatggatccgacggtaaagagatcgggaatcaaatctgttaatgtctagtgcccggatttttatgtgctaaaaatgccaaaatatgtgctaaaaaatgtgttaaaaattggaaaaacttcaaaatccaataatgaattcgatttgattactagggtttgtaattatatggatataaaatcgcaaaatatggccataaaatatggataacaaatcgcgaaatatggacataaaattgcaaaaatctcaaaatatggacataaaatggaaaaaatatggacattatttttcaaaattaagggtatgctttctctaaatttcctcaaattcataaatgtaaaataaagcgttcaaaaatggctaaatacggtataaaaaatcattttagaagaaaaaacacgataaagctaaaatgacttattttaagcaaaaaatcaatccgaaaagcgaaattttcgcttttttgcttatttgaaaaattgctttaatttgattgaatttgttaaaaatttatttaaaaatatttggcattttgtccttaaaaattttcaaaaaatcaatgaaatcccgcagaatcccgcacaaaaagtcaaatttgcggatcccgctgcgggattggaacttaaaattatttgcgggaccggatccggcgggattaatcacgcaaatcccgcattggatcattcagcgacaaaaggaaattagaggaagacgggacaaaatcacgccacccgaaaatctatttaaagaaatttcaagcttagaaatttcgatcaaaattttttataaaaaatttaaagaagaaatatttaaaaaattttctaaccatttttagaaactttttgaaaaaattagtaattcatcacaaaaattttgaaaaaattttttcttagaattttcttatttttaataggcgaagagagattggcattaggcaaacaaaattttgcttgcgtctaaatttttggagcacatttaatccattttcgttccacccaccgctccgttttatcgctgtcgcggtcccgaaatgggccaattggtgggcgaccaacgcgcgggcgacggacaatcggcaggcgaacagttcgtgaatttggccgtcaaaattgggcgagtccacatcgaccaggtcgggccgtttgtcgagccgttcagtgaccaccatcaaatattgctgctgttcgtccttgaaaaaagtttcaatataatttccaattttattggaattagaattttttttatttcaagaaataatacatgtatgttgtcgccaatctttttatttccgggcgggctttggccaaatgcggcttggcccagctgaggcgggattggttcccgctcctcttcaccgctctcgtccctttttcctctgctcactccgctcgctgtgccgtaaagggaatggcgccctttttgccgttcgttttgatgggtctgatgctgctgaccgatccgatcagcgccaaagggggacgagaatgggaggggggaggggtgacaaagttgactggtgctttatggaatgtgcagcgatttgctggttgcttaacggcaccaccgacaagattttggtgaagggcttgtcggacccctttgagcagctccgaacgggcgggagttgctcgacaagattggttgtgaagggggcttgtccgaccctttgagctgctccgaacgggcgggagttgctcttcgctattgactcgatgaaacgggttttgactcccgtttcctgcggcggatgctccggctggcgggagactgagaccgaaccgcgagactccggctgcgggaatctgaactgctcaaacttcgtgacgttcgctctcgacttgatgagcacgggtttcgactcccgtctcctcctgtggatgctccggctggcgggagactgactccggcgatgcgcgcttctccggctggtgggattagcggcgacgaacgggcctgcccttcgatggacggtttggcaccgctcggctcttccttccttctctgccctgcttggtttcgtcgacgacgggaattcgccccgtccctacggctgctccggctggcgggagactgacaccgatccgcgagactccggctgcgggagtctgaactgcttgaaattcgctgacgctccgggccaactcccggattctccaatgccaaagggaaaggaactgggatcgggaggattgggggagaacgacgagggctgccaggaaaggaaggggtcaagacgtgaatgggcgcctccgtttggccccgcacgagaatttgccgaatgtgatggagtgtggagggtgcttttccctcctttccgagtcctccaagccgtttcagcacgaatttattaaagcaaaacgaataatgaataaaagcgacgaattgatcgaattgggcgatgggacgggggaattggaggaattggtcacaggcagaccgaaaatgaagcggaggggagtggaaggaagagaagagagagaacgcgaaaaaaaaacacgaccccttggtcggggccgcttaaatagacaattttcgaagggggcgggcaaaagggaatgcacgtggacaaattgtgagagggacagaaaaatgggcagaaaattctagaagcgaagtgcgaacaaaggaaatgggcgcacaaaaattgaatgtgaattggcagatgtaaaaagtgagaaattgtgaaaggaaatctgagcacaaagttgtcgtggagatgagccaaccgatgagaaaagattgaattgtgaag

SEQ ID NO: 3126 - DNA, 2270 bp, Heterodera glycines
ttgtcgccaatcttttatttgcgccacgcgcttggggttggggtgggccaagctgaggcgggattggttcccgctcctcttcaccgctctcgtccctttttcctctgctcactccgctcgctgtgccgtaaagggaatggtcccctctttcgccgttcgtcctgatgggtctgatgctgctgaccgatccgatcagcgccaaagggggacgagaatgggaggggggaggggtgacaaaattgaactggtactgttggatgttatacagcgatttgctgcttgcttaacggcaccaccgacaagattttggtgaagggcttgtcggacccctttgagcagctccgaacgggcgggagttgctcgacaagattggttgtgaagggggcttgtccgaccctttgagctgctccgaacgggcggagttgctcttcgctcttgactcgatgaaacgggttttgactcccgtttcctgcggcggatgctccggctggcgggagactgagaccgaaccgcgagactccggctgcgggaatctgaactgctcgaacttcgtgacgttcgctctcgacttgatgagcacgggtttcgactcccgtctcctcctgtggatgctccggctggcgggagactgactccggcgatgcgcgcttctccggctggtgggattagcggcgacgaacgggcctgcccttcggtggacggtttggcaccgctcggctcttccttccttctctgccctacttggtttcgtcgacgacgggaattcgccccgtccctacggctgctccggctggcgggagactgacaccgatccgcgagactccggctgcgggagtctgaactgcttgaaattcgctgacgctccgggccaactcccggattctccaatgccaaagggaaaggaactgggatcgggaggattgggggagaacgacgagggctgccaggaaaggaaggggtcaagacgtgaatgggcgcctccgtttggccccgcacgagaatttgccgaatgtgatggagtgtggagggtgcttttccctcctttccgagtcctccaagccgtttcagcacgaatttattaaagcaaaacgaataatgaataaaagcgacgaattgatcgaattgggcgatgggacgggggaattggaggaattggtcacaggcagaccgaatatgaagcgaaggggagtggaagcaagagaagagaagagaagagaagagagcgaccccttggccgggggcgcttaaatagacaattttcgaagggggaagggcaaaaggccatgcacttagacaaattgtgagagagacaaaaaatggacagaaaattctagaagcgaattgcgaacaaaggaaatgggcgcacaaaaattgaatgtgaattggcagatgtaaaaagtgagaaattgtgaaaggaaatctgagcacaaagttggccgaagatgagccaaccgatgagaaaagatttgaattgtgaagggatgcgatggggcaaaaatgggacaaaggaacgggcaaaatgtgaatggtacgaaatggagaaatgcatatgagaaattggatggaaaaggggcaaaaattaggaatgatcaattttgaatgaattgatgaatcgggactcgccccgatcttctccaagaacatccctcattctttttgcttcgattgagtcccgtcccgttcatttgtgtaataggcggggattgacccgccttctcgtcgccaatgaaaaaattggcgacattgcccgcggcgccccttgacagttgaagctccgaagcgtgtgtccatgagttgtagcaacgggttttcgaacccgttttccgattggcattgcgcctcgttgtgttgaaaggggcattgctcccccaccagcatttgtcatggcaaggatagccatgcatcagctttttcgctggcagtccgtagttcacatccttcgactttggcattgttgcccagcatccgtcatcgcaacgaatctcgattttgttaaattcccgcccactcacatttgtgactcctcgttctgcacactccgtggtgcatgggactcttgggccctctcgaaatggaaggttcgggtccattcccgatgctcgaatggatggttggcagccgaacgttccgacaatgctgatgagcatgatcagcagtgccatcccagttctttggttgaattgcgcctccgttttcgtggtacatgacgttccggggaccaaattgcccggtttctcgagtccttgccgatttccttgggtcaacttcag

SEQ ID NO: 3127 - DNA, 3853 bp, Heterodera glycines
  misc_feature (31)..(31): n is a, c, g, or t
ggtttttacatttcccaccaaaaaacttacnggcgggccgttggttgtggagacaagaggagggatggatgcgcacatgcactttgcggtcccggtccaaaacgtaacactgggcagaggtgtcgaaatggcacaggttcatgaacagtccccggcaaattgcccttctaaagtatacaatggcattagataacccaaaaaattgaaatttgcacctcaacatctccaagttgttcatggaggtgctgaagtgcaatttctgcttgacacattcggcgtgcaactgtttcctgatgttgcacacctgttccatgcggcgcagattcaaattgttggaatcgcaaaattcctatagaagacaaagagtgagtttttatctacgattacgttacatttggcatttatgccaaaaatcggtttcaaaattttcgatccattttaaattattgaaagtcaattttttggaataaatgtcgtttttatccatttttcaaaattacccccccccccctcccgacaccgtctcgaaattttcttcccattccattataattgcctttattttttcctggattcgtttcaccgatgcgtaagcgcggtaaatttgcaccattcgcacgtggtcaccttcgttggtgcggaatttcatgtcggaataatctgaaggtaaaactttttcgcgtacaaaaattgaaatttgccaactcgaagaaaggccggtgctctcctggccgtacttttgcttctcattcagacagaaaaggtcgtggcccgaaaattggaacacgggatcagcagaaagaaaggagacgacggtgcacgcctcctcaagacagcccaactcggaggcggacagcaaaatcctgagaaaagcaaaaaaatgaaaatagtaattttattccaaaatgatggcactttgcatgcgcaggttcgacagggaatgccgtgagtttagtgccctcatcagtgatttcgagctgtccctttggactcaatgtgatggctcggagtgcgagcagttcttccaccgcggcgtgcacttggccaatgtcgggcggagagagaaggtgcgcgaaggaagtcaccttttggaccccaagttggagcagttcgagcacaacctgagcatggttttttgtaaaattgtagctgggaattgatttgcaattgcttttctcacggtggtaagtcggcagcgttgcaactcgggcacttgttcgtcagcaagagtgccgtagtcctccaatgagtacaatcggtagcatttgccggggccctcgcgccccgcacggccggcgcgttggatggcctgggccttggaaatgttctccacccgcagcaaatccatgcgattggaagcggcgaaagaactgaaaatctaattcgtcaaaaaatccaaggagagcgaaacccaatttcgcatccctttggaatttaaagtgtttccctctcactgaccgtcttttcactttgcccgagtcgatgaccacgtcaatgccagggatggtcacagatgtttctgcaatgttcgtggcgaaaatcacctttcgatgaccctgaattcgcacattcatttttttgctaatgttccgagtgaatgccaacttttggcggtggctcaaatgcccgttgagtgaccgcagtgggcaccgccgcgtacaatgccaccgcgtgaatgcaatccgcggcatggtccgatttgctttgttttagcttcctcagtatgttcattgccgtgtcgatttcctcttggcccgttaaaaatactaaaaatccgctctccaccggctccgagtcgtttaggtccaaaacagttgaaatggcgttgaacaaatagtcgttgtcgtccaaattcaggtcgggtgagttaaaaacctgaaggaaaccccatttaaactcttttttcaatcaaaaaaatcctccaattcaatgttcatcaccttaacggtgtgcatgcgcccctttatataataaatgggcgcgccgccaaaatatccggaaaagggacgcgcgtccaaagtggcggacattaaaatgatgcgcaggggcgcatcgccacgtttgacgcggtcgagttgcgcttgccgcaaaatgaacaaaagcacatcggtgttgagctgacaaaaaggagagaggtcaaaaatggggtaatttgacataaaataaaataggtgccatttgtatggtaaattcaatgaatgaatgccttacggaacgctcgtgtacttcgtccacaatgacggcggagtaggcgttgagccgacaattgtgcagcaattcgcgcaagagaatgccctcggtcatgtaaacgagtcgagtccgttcgctggtctgatcttcaaagcggaatttgtagccgacctaaaacaaatgaagtctcaatttctgccggataggttcaaaatgcggtactcattgcgtttgtatccacatttttggtcaaattttttcaaaattttttttttcttttttattgtcagaattgcttttagattaatggaaacacttaaaaaacttcaaggatcctgtcactggtcagcatacaaacacaattgaatcgacgtggcagaagttcaagcagcaacacaaagcgagatttggcagtcacagatcacttttttccacatacatttctgattttttgtggcgtaagcaatttggaggaccggacattttttataatttgtggacccaaatcgcggaattgtacccaataagcacgtaaatctccttttatttgttatttaaagcaattgcgacaataaaaaagaaaaaaaaaattgaaaaatttgaaaaaaaaaaagggggatacaaactgaattagtacccctgattgtgcctttctatatatttttttgtcttttaggcatctgaaattttttgcgcctaaaccttagctgttaaactattttaaaatgccatcagaaaaattggtaaaacacaagaaaaggtcacttgagatccgaattgagaaagacaaggtaagcttttattttattaccgaataatttttttaatcaaatgtaaataattctaggccaaaaaggagagacgtgaagaaaggaatcggacacgaaaagacaaaggagaggacgcagtgccaaagcaagtcccaagaacaattgagaacacgcaagaagctgacgacacctttgtcggatcagacgatgaagaggtaatttgacaatgaggaattaaggcaagtgaaatattcaatgcatttaaaggtattggaagacatggacaatgatgcgatggcacatttttttgaagggtctgcgaatccgaaggttcttatcaccacttcgccgagagcaaaactcgtaagaatgatattatttaaaaaaataaaaaattttctcagaaaaccttcaaactctgtttcgagttaaaaaaggtcattccgaatgcagaaattgtgtctaggaaaaacgttgccataaaacgtgttgtgcggcaggcaattgagcgtggtttttctgacctaatggtggtgcacgaagatcgcaaaaaaccaagtttttattcctttttaccattatttccaattattaattcagatggaatcgttttttgccatcttccgaatggtcccactgcgttttttaagataaattcacttcaatactccaaacagatcaaagtgtattttgttttgtttttctcattttcgatattgaatttgcaggacgtcggtgaggcaacggaacattaccctgaacttattctgaccaacttcaacacaaggctggccaaaacggtgagccgaatgttcgcctgtctcttcccgcaaaaagctgattatggcggcagacgagtagtgaccttccacatcagcgcgactacgtctttt

SEQ ID NO: 3128 - DNA, 942 bp, Heterodera glycines
cactctatagttagcactaatttaaattaaaacaaaacaccatatttaaattttgtattttttcaaatttccttttcccttacattaatttttcacgaaaaaattcattttctttattaagttttgggacttttatcatggttggaaagcaaaaagttgcaaattcgccaaagcaaaacgacggcaaagagaaggaaaagcaattgagagacaaaaacgcaccaaagtaatttcctaatttctactaaaatataatatatatttttttagaattccaataaatgcctaccaacgttacgtcacgcatcgcctgaaggtgtccccgtcaaagaaattcggcacttcgcgagaagcgatggcaaattttgcagctgaatggggggccatggagcctcaaaacaaaaaggtgaaaggacataaaaatggagaagaaacaatcgtttttgcttttagcctttttttgacgaatatatcgcggagagaagcgaatacagcaaaaagatggaggattataaagtcagttcgggggaacaattcaaattagataattacttttaatgttattaatttgcagaaaacagaggactacaaatcatttcaaagttaacaatttcgctcaaaatttattgaatttgtaacatttaagtgcagaagtcggcaaaaaggcggaaattgacgaaggttttgcatttttcgtttttaagcattttttctttggcatagggtcactcgacgatcgctgggcaccatcgtccgttgcatttgccaccgaatgtcaagcaaatttttagtcgcgaatttttggagtacaataaaagtaggggtatttttttgtgtattttttaccattccatttaaggccaagaaaaaagcatgagagacacacgggcgcagataagcgaagttgaggtaggaaagggcatttattttcggttgaattca

SEQ ID NO: 3129 - DNA, 2093 bp, Heterodera glycines
  misc_feature (1906)..(1906): n is a, c, g, or t
  misc_feature (1923)..(1923): n is a, c, g, or t
  misc_feature (1933)..(1933): n is a, c, g, or t
  misc_feature (2052)..(2052): n is a, c, g, or t
tttgaatagcaaaaaaaagggcgtcgccggagaaaaatttgaccttcgtatgaaaaatcgggcccgagacacccccctgtcccaatcgtccgtcgtatggcccttgtgctgagacaccccttgtgcatgtgtgatgggccgtatggccattttccttccctacgatgtaaaaggggtaaacaaatggcagctaaaattgcattatctgccaaatgcccttcccccgttcatttctccatcgttttccctttgcgttcagttcactgcgttcggggcgactttgacgacgacacggcatttccggacgtgaaggtcatcccggtcggccactttcgcatcggaattacacatggccaccaattcattccctggggcagtctcaaggcaaacacacaaaaagggggggggggtaattagcgagagagcattttaaaattcgtgccttaggccatggaactcgcggctcggcaaatgaacgtggacgtgctcatctcgggccacacgcacgagtgtaaggtgtacgagaaggagggcgtgttctacgccaacccgggctcggccaccggcgctttttccatcgtcaaagagtgggcggggccaattaattaattaccgtccaaaattttttatttgttttttaagcgatgtcatcccttccttcattgtgatggatgtgcaacaggatttaattgtttcgtacatttatcggctgctgaacgacgaagtcaaagtggaacgggtgcaattcagaaaaaacagagtcgacgagtgattaaattggggggggggggggggtaaagagagactaattacagtggggacaaatgcctaattaataaactaattggcggcactttaatttaatttgacacttatttaatcaccctttgtatcagtcagccaattaaggtcattgtttaaaaaggagatattatatttgatgtcaacagttgctaccatttttgtctgactgaaattttgtaatttattttctttaatttaaaataaattctaatcaaaactaattattttaatcaattaagcaaaatggtaaattaattttttatttaaattgcgtaagttcaaaaaaaagtgattgaggattttcttatgcgataatccatcccccgtctccaaactttgtcatgcaaacctaaaaaatttatttaaatgtcatatattttttctgttttttacgttgtatccgcacggggtcaaacagcaccggcgcgggtacgccttggaataggtggggcactcgcgggccgaatggcaccacgaggcgggacggggcacgacgcatttgatgcgaatttggaagggactcggacagtccggggacatcagccgggttcgggcttctttaaatgtgggaaggaatattatgggggcattttttggtgctcacccatttggccaattcgtctgagcatgggctgttgcacgttggacacgcacacgttgtagccacagccggtggggcagcaaatgcgcgaatggagcgcatttgcggcacagtcggtattcacattacaccaaaaagggggacaaacaaatgcattggcatttccaaaaaaaaagatttcggcacaccaattcactgggtttgcctgccgacagttgtagccgagttcgtccgcgctcggacactgcgcgtccgcgtgccgtcggcagcagtgggcgtcgcttgcccgactgtgacagagtgtgcccgaggcacaaacgcccgccgccgagggccgacagcggacaaaatacccttggcacgatggaaagttgccgacacctgccgagggcaaaataacttatccggaagaggggggggaatgggcccgtgccttcgaagatgtactgcttgtcctcctccacttcctctgctgctgctggtgggttcagtttccgtcgncattcctccgccattcncatcagcagntggcctttggtcccctcccctcctttctctcctccctctttttccttttttgcccctcccccttttcctcctctctctcttttttcctcctcctccctctcctggtgctgctccatcgntctccccaacaggtcgaccacaatgcgctccttcttccccc

SEQ ID NO: 3130 - DNA, 6806 bp, Heterodera glycines
  misc_feature (55)..(55): n is a, c, g, or t
ggggagagattggatggacaatgaatgaaaatgaacagcaaaagcagtgaatacnaacagagagagggagggacggatgaatgaatgtgcgcatcgttggaggagcttaaaaaggaaatctacggaacatgggcagcccctaaccaacaaaaatcggaggtgggagcagttcgacgaccacattttttggttttttaaaggtccacaatgccaattgtctctaaaaaaatttcctgctcctcccctcggtttggggcttggaaagagatcgaaaatgagagaaaagctaattgagcaatgtcacagattgaacttaaagcaaaattaaacaccgcgggagggaatcggagggaatcaccataaaaatatggtaaaaaaaacaaaacaattattgtcgcaaaacgtctgcccgtttggttaaaattcgcaggtacgccctcaaattggtcaatttgccgacacttccgccctcgtaaaggtcttcaaagtgctaaagaatggtcatttatgtgtgttaattgctttattatatactaattaatcggacattttacactgtgtgattgaataattgtataaatataaatttcaataataatacctttatcgtgtcattgcaaagcaacagcaaattttgcagcgtttctcgctgttccactgggtcaaaatttggcagcaaacgcaaataaatggcagctgattttgagtgaaaaaaagttcagttcggtttggtgccaattaaaaaccaaataccgaaaagctcgtcgggattgtcgcgcaccttaatcatttttttggcatgaaattgaaatttattattccaaaatgtaaaaagtgaaaaaggaagaataaatgtaattgtaaagctgtaccatctccagcactttctgtgcaaattccgagtgaacggtgcccaagtgtcggtcaacggcacgttcggccaacatcgaaagtgcagtgaattgctgcacactgatcgccattttcacagtgtcgatttgacgtgcctcttcttgcagtgccaaactcattgtctagaaaaagttacattaattaaaacaaaaaaaaaaaattgtttaatttatttctattgggaatttcccgggttttggttcaatgtctcgactctcgaacaattccatgtgaaaacgtaacaattaaatgatcggattgccacctgaagcagtgaaaatgcggacatgaaggcccggaacagcaactgctggtgtcggcgattgaccgccacgaagcagggcaaaaagcgggaaaggcacacgtgcgcctccggcgctctgtcacggctctccgtgttaaacatcaccagcaaaagatgggccaacgccttcacactttccgcacttccaatgcgcagaccaccgcacaacagccaaccgcaaatgtgctcggtggcacggaaggccacttgaggttcctgcaaaagagaaaaagggagggtcaacaagttcgagcagtccatccaattggccacaaccatttgggcttggcgtgcgcagtgaatgtatttgtccaacatttccattttgcgttcatccgctgcgagtccgtcgccctcctccatgtccgcatcggtgtcctcctccgacgtgttgctccgcgtcatttgcgttacgctgcgaccttcggccaccgcccgttcctgttcctcctccaccatgaaagtgtcatccacctcgcgcacttcgtccagcgatttgacgtaccaattggccattttggcgtagccgtagaagcggaccaagtcgccgatcatgtccaggtaggagagcagtccacggccctggtgcagctgcagcgcgtgccaaatgattggcatgaacgtgaccgcttcggtctcggagaacaaacagcgccaggtgagacactgacaatgggaaaagcattcccttagaaaaaacaattaatttgccccacttggtaggccatagcacgctcctcagccgaagtggcggcgagagactcttttgtgatctgaaagtgatgaattgaaaaacccgtatttttttacattatacgaccgaccaatgcctcgtagagaccgtccaattcgacactactgcgcataaaacggcccgaacggagcattgcggtgaaaatggacatacaacggattcgaattgggtcgtccaactggaattagcactcgtttacccatgaaagaacgaacgaacacattaatcaccttggccattgggttcagatggagggaatcgcgcgaagaattggatgagtaggacggagatcgatcgatgttcgattgatccgtctgcaaattgcgcgtcacaatgttattgatcgcatcgcaaaagcatcggagggcttgctgaaagaggcgcaaattgggggaacagagagagagcaacattcagcaacaacaacttctgtttgttcctccttgggatagtggtggtacatcagcgagacgaccaattcctgcagaaaatgttcgcgcagagtcaccgtcggattggccaacacgctgaaagccaattcgtgccaatgggacctaaaaagggggagagagagagagacatttgagcctatgatttgcattggcacattttggtattaaaagacagttcgattttgaatgcattgcggcgcgctttttccaaaaaattttcgggaacaggggggccagcggtgccgataggtgccgccgggcaaaaattttttttagaatttttaatggatttgttaagaaaatttccaaaatttgcgaacctccaggcccatgaagatttaaaactcacaatcgaaaaccatacccaaatccagggctttcttttgagctcaaaccacaatgtaatactaactttccaatgtcgtccatctccaagagggggaaaatgttgaagagttttcgcattgcgtaatgaattagctgctgctcgtactgctctttgtccgcgggacgtttccgcgcggaatgcatggccaacggcgtgtcgtgttgtgcgcgttggaataccggccgggcaggcgtggccagcacatcgcggcccacttcgtatgtgccgcccaaaccgccgtgcaggaaactgtcagaataatcggccttttttcaaaaattgattgttggcacaatgctcactcactcgcccacaaattgtgcataatcggtcattgtgggcaccaatttgaagcgacagtccaccaatttggcctccgtctcgggccttccgtaacggcaggcgcaaagttggagaagacaccgccaccaggaacaaaaggttggccttgtcagcgccatcacttaaaatggaactgggatagggaaattgaacagcacttaaaacccacccgcgaataaacaatttctgacggaaattggcccggtggaggaagcactgctcgtcctccgtctgttcgagtccgcccggctcgtcacagctgacaagcgcacccacaaattcgaccagctccgttttgcgtctctccaccgccagtcccatgacggcaaccacaaacacttcctcgcacaactgaaaatttaaaaaagccatttcagctgattgtgagagaattcggaccaagagaaaagagagatgactgactcaaagtgaaaatatggcagtaaatctgtcacataaaaacattttggtgaggcaattcggcgacccttttttgcagtaagttcaaattttttgttaaaccagtttttccgtacttttcttttattaattttttgtcgtgatagtgtaaaaatgaaggggttggacctgttcattccgaattgggtccaactcgctgataagcatggccaacgcgttgaagaacagcttgtgcttgaacacggtcttcttcttgcggctgtttttgttcgtcgtcatcgtttcattttgttggctctgtttctttatgtaatcgctgatccaaagggacaccaactcatcagtcacttctttgaactgagcttaacaaaagaaaagcatttccctttttcgtgtgtgaccatttaactgtaattgcttccatggacgagattcttgagcagtgtgacccggtcgcgggtcttcaggcgatggaagtcgcgattttcggccacaattttctcaagcgcagcccgacggaccatcgggtgttcgtcgttgacagcggtgttgagcacaagttgaatatgggcaggggaacagacggtcagctgaaaacgatggagtacggaacaaagacattgatgttctagggatgggagaaccggggaaattatgaaatttaaaaaaaattacaatttgtatttaaaatctaaatttctttcggtgccatagagcaggaataacagactttgcccagtgcttccattcggcattctctgtccgggtcgttgaacgccttcatcagcactgaaaatgaatgccattgaatgagcaaatgtttttgttttttgcactcgctcactctctttcggagtttctttgatcgcttcggtgtgctccacgtcaatttcggcatcttggacggcggccaacgcgcgaattgccgggattcgaacatcatgactctgtgaaacaaaggcaacccaataaatgttggacatggtcggaacaggttcaaatacgagttttccaagtttcttcaacacttaccacgtcccttcggcgatgcgtgagcaaatcgaacagtgtccggtagtgttctgctggcaaagtgcacctggtgagatggatggacgcgttgaattggtccgagttggagcgggacggcaaaagcaccggagaaaggcgctcacagcggcgacgaattgtggacacaatttcgtcacattttcgagaggtggtggcctcaaaaatcagcgcgatgagcagacacaccgcggcacgcatcaaatcggcattggcctcggcgaactgagcaaaggaaaatttaaaggaacaaaaaatcatttatttctcaaacctttttgcaatagtccaccaaaaagtccaacacggctccgttctgcgctttgtcataaaccgccaccccaaagttgacaatcgctttcatacaacggtgacgcgaagcccgcacattccccgcactgacaatgagcaagtcgagccgaaatttgagctcatcgagcagtgcttgcttctccaaatcggaatggaccttaattgaacacagaaaaatgagaaaaaaagaaatgaaatggaccacaaaagcgaaaaaaatccatcgttaggaaattgcccatccaaaaaacctcttttataccgtcgacctccacccgaaaaaagattaaaacaaagaattccaatgacaagacctggccaaacaattcgaccatcggctcaatggcgtgacggttcactgcgccgtcattccgcgcgtcatatgcccgtttgagataagtgctaagtttggcacgcaatttagcacaattgtccgcttcttcgtccaaattgttggaaaccatcgaaaaacaacgcaaaacaaacaattgtttaatttatgcttttgactcttaatttgagacatgtttgacgttaattgtagcaaaaggtaagtaaatatggcacatttaccaaaaattttttgtatttccaaataaaataaatcctatttattgttaaacatacggtcaaataattacatgactaacacaacagagaaaacccgcacaaactgaagaacgactgacatttgccatcacatttcttccaatgccctcagcttagccaatttccgattcactcgctctttcaattccctctccattcgctgcgcctcctccaactcccttttctgttcctccgcctctttgactgcttggagtttcaactggcgaagttcttctttcgccttggccaactcggcctcggatttgcgttcactgtccgccatttgggggaattccaatttggcattcatctaaaatttaaaacggaatttttgaaaatttgactaaattgtgcaccagtcgttcaaagcgtgtgccgaggtatttcttcatcgcgcgcggtgccatctgaaggacttcatttcgcaattggtgttcctctgcgatttgttggtcaactttgtcgttggcttgttgaagcttctcaatgagttccagcacggccggtccttaatgtatgatgaattttaaaaaagtaaacattaaaataagtataatttggaagcaccttccttcctcgtccgactacgcaaaaaataaggcggcgacgtcgttccctccattattattatgtcaaatccttaagaaaattatttaaataaagttcaactttaaaactttttagatgaccataggaacaatgagataaaaacaacaattaagaaaaccaaagttattggatttttccaccttcttaattagggcaaaaaatttaaagatttgaatttaaaaaagcccaaacagtatgacaattataaataaataaagaaaacattttttatttaaatcaaaaacaaaaatacaaaatgactaaaacaagagaacaaggacgcaaaaggaagcaaccaaaaagcgaagacgcagatggagacgagaaaaaagtcaaaaatgatgagcagcaaaataacgaacagcaggaggagggacgggaaaaggaagaagccatcgttgatccagagcgaatgaaaattttggttggtttttggatttcgaattgttttgctttagtggccaaaatgcaaaatttgtaaaaaaaaaaattaaaaaaggaggcgcggaaagaacgcaaacgaaaaaagaaggagcagaagaaggcaaacaaattgacgcggaaggaaaagcgcggggaacagaggcgagcggaagcaatcgaaagagcggcggaagcgaaggaggaaaagtgaaa

SEQ ID NO: 3131 - DNA, 5364 bp, Heterodera glycines
caaaacagaaaatttaattgaaggtgaagaaaatttcttaaatttatatgaaatatgatactagtcgtcgaaaactacaaaaaaaaaagttgcacaaagcacatacctatgtacctacctatgtaggtatctgttgtcaaaaaataggacttacctactcctctcaaaaaattagcctggtcgaaaatttttaaatttggcattatgttttaaaaatctctaccttgttttttttatgttcactaagtttaggatgtttgttcttagtattctcaaacacacggttaaaattgagcctactgcccttggtagagattttactgaggcgttggtggagcgtttaaatcgtcaatttgctaattacgtatgtactttgaatttaaatgtatcatgttacaggtcaaagagtattcaggttataccaaatgtcgggctgtgcattactttttacgactttaaaaaatacggcgcttcttacatattggtttttgtttcttgctttattaagttaaacaattttattttatagcccggtgacgcatcaacgcatacgcctgtcctattccgttatgttgtttttcaaccaatgataaatgaaattcttgagggcaacatactgcgctcgaaccaggaagggatcacaatcagtatgcagtttttcagcgacataacagttgcgccagacaaattgcctgcaatttctaaattgtatttattttattttaaacattattgtctaatgttctaacttcttttttattttagtgatgagtctgttcaagtttggagatgggagtatcaaaatgaaaatggtgatatcacgccattctatatggatccgggaaaacgcgtaaggtttgttattgttttttggtatagcaatgatttgaatttttctatattttcccgcgtgtgctaggcattcattttttccctgcccgtctattagctccgccgggaccctcccccaccccttctcccggtctcaaattttaagaaattatccaatgctttaaaaaattttggtgtaaaatcaacaacaacaaaaaatatgcgcggcacattcaacataaagaaatagtccggcggtgcagataagctattgacaagaataattctgtaagatggctggctatgtatggccttaccttttttgctttttgggtcttatttttcttacagatttaaggtgataagcgttaagtatcaaaatgtcgaaccgggcgctcctccagaagccaccaaagctatgacgattgaggttaataccttctgctttttgtattatccaaatttttcaggcatcgatgttcgatatgggcttgggttgtgtggcatggtgggaaccgcagtgcgcaagtgaattgaaacaggaagcaaatgatccaagcgaagatgaatagtaacaaacgaattgaagattttgttattgttttatttgttctaacggattcttttttaaaaatttaccatggtgaatgaatggatgcatttatgttaattaactcatttcatatttcaatttttttttcatttacttaatgtctttgatttagtcaagaaactattaaaagtatggctgcaattgagaagcctcagattgttcaacaacccgtgcaagtttttggtaggaaaaagacagcgactgccgttgcattcgcgaagaagggcaaaggcctgataaaggttattctttgccgaagttgggtattgtactttttcggctagttttagaattgtttaatggggtagtaaagactcatttattgagacaattcttttacaagctagaaactagtcaagactttttaaccagtgtattaccgaatttgttaccgcttttctacatttatacattctcccatgcagttttctcaattaaacattcaggtcaatggacgtcctttggagtttattcagccagaaattctgcgcatcaaacttcaagagccaattctaattgtgggcaaagacaaatttgcaggcattgacatacgaattcgcgtcaaaggcggtggacacgttgcacaaatttatgctgttcgtcaagcacttgccaaatcggtggtggctttctaccagaagaatgtcgatgaacaaagcaaaaaggagctgaaagagcaatttgtcgcctacgaccgcaatttgttggtggccgaccctcggcgccacgagccgaagaagtttggaggacctggagctcgtgctcgctaccagaagtcttaccgttaagatgtatgggataccattttttgacgatcctttttgttgttgatgtaatgcgttatcattaaaattttgttggaaccaattagaaaatccacaaaagtcatttccttaagaaatcatgaaaaacgccaaaaacatggatccgtaaaatggtaatgtaaaaccaggctaaagagggcaaaaaaaaaattgtttgaattaatttggctttatgtttatttgaaaataattaaggtaaacaaatttaatttcgtaattaggggtacctaattgaaatctcgatttggataaacatatggggaaacgaaagccacgtttaaattttaaacgtaatggtattctcacgcaaaaataaagccttgtgattcctttcttgttcgaacgttttattgctgatagaacttcgctttcaattgatgaaaaaattgattattcatcattttttataagcaacggtttgtgtttgtgtcatccatttattgccccatccatttgttatcaattcgtgggtattattccccatttaatttttgttgtttgcaatatttgaattttatctaaacaagattggttttttaaatttaattatggtatatgaatgattatttacagaaaaaaaaattaacttatgcgatatgccctaccttaaattgacttttcttttgctgtcgcttccgttcggttgcccattaagctttgtcaatcatcgtcttgaccaaccgcagtcagcagtcacttcgggtagtccccctgttgtcccaattgcctcacttctcttgtgccgctttaagctgatcgcacatgtcccttaaatatgttcctttgtcgtgcaacgcagcgttgcatccctcgttcgtgggtgtgcgaccaggagaacgattgttcggatgggcaggacgagaagaactgcggtgcattttatacctaatggtttcgttggacttttctttttatttgtgcagagactcctcaaaaacgatgctctgaaagtgaatacgaatgcaaaaacacacaatcaatgcaacagaatgcaaatgacaactcttggctcaaccacttggcccgcaccggtttcacacacacgtgcattccaaagaaatgggtttgcgacggggaggccgactgtgtggagaaggatgacgagttgaactgcgaaggaagtgagtaactgacgaaaattcgtcgatcacaattcttttttggttattcttttctctgatcggcctttctgcacatgactttttcaaatttgtcaggtttctgtttttgatatttcagagcttaaatgtgacgagaaacactttgagtgcaaaggctttgacttgcattctgcgacttcgtgcattccaatcgaatgggtatgcgatgggcaggtaattctcgactaatattagaggaatagggtcaattgttctgctttcatttaggctgattgtttggacatgaaggacgaagcaaactgtacagctaaagaaacgaagcctgaatgtgaaaaggactctgagtttcggtgaatcactcattaatcaattcttttactccaattgattctcaaggtgcgattctggtcaatgcatttacaaaagttggcgctgtgatggggacagtgactgtatggatggaagtgacgaaaacaactgcaaggtggacacgtgcggttctgttgacaagttcaaggtcatcacgcgaagagtccacctgaaaatgcaaactgacagttttagtgcaaatcatcgactttctgcattcccaacaaatggaaatgcgatggcgaaccggtaatttaatgttggaatttagaaatttgtttatcaaacctaatttcaattcttatatgtgttttgatagctaagtaatgcaaaaaattctttgacaggtaaaagtcgaaataaaatcaggcgatcggtgaatgacataaggacaaaaaatgtttttggttttgttaaggactgtcctgaccactcggatgaaacggactgcgaaggggttactgctcaacaggaagtgcactgcaaggaccatgtttgtttcaacgtctttgcccttttcccaattcaattgtctttttctgcactttgtccaggagtttgcgtgtgcctctcgttcccaatgcatcagcagtttttggcaatgcgacggcgacgaggactgtttcgatgggagtgacgagcacaactgcacacgcattcagtgcaaaccgaaagagaaggcgtgcgctgacggaaagagttgcattgacgaggaattgtggtgcgaccgatcggaggactgcgcggatgggtcggacgaggcaaattgtcccaacaatgacaaggggacggaggaaaagtgcaaattggacgagttcacctgccccggagagaagtcacgctgcataaaataccttgatctgtgcaatggccattcgtccaacgaatgtgccaagaagggtctttgcaaccaggaaataagtcagtcaaaggcattaactttgctgactttatatgattttttggaacctatccatttaatattattttgtagactctgccctaaaatggtttctttaatctcgaatattgcggattaggtttctcaatgaaattttaaaattgtagggtccggcggaaaaatgagaagaaaattaggatgttttcaaaaattcccatttttaattttaaaaatatttggttacgcgaggtaagatatagcctcctcattgtcagtcctctggctatgcacacccttccgtccactctatcaaacgcttttggtgaatttttcccttaatctgtgcagaatcatgcaagttgactggggatcagaatgacccgtgcatttcccggaagatggccacacatggaatgctgtactactgcgccaagggttacaatgccagcgtaatcgcggacaatcagcccggcttttgtgaaggtgcacaattgaaaaaataatgcttgtgtctgacggcatgcatctacttatcagacatcaacgagtgcgaacagcctggggcgtgtgaccaaatttgcacaaaccttcctggcagttaccattgcagttgctacccaggctaccaattggtcaactctgactctgacaaacccgtaatgcataaatgtcgtgcgattggaccggacccgttgctgctgttgg

SEQ ID NO: 3132 - DNA, 4714 bp, Heterodera glycines
tgatcaacaagttggagtcggcagtggcacttgactatcggcacaaccagagcactttggtgtggtcggatgttagcaaggaacaggtcggcactaatttcaagatgcaatgtatccgtttaatttctaattagcttaatggcaaagcttgaccgttcatttcccagataatgatttgtgcgggtatcaacagtacccctgggaaccacgcgatgctggaaagcatcaacagcatttgtggcgagaagagccccaatctgaccgtcataaaggacaatgtcactacgccggatggacttgccgtagattgggtgcatgggctgctgttttggacggacaccggactggacactgtcataaaccagaaacatttcatttgatgacagtctttttcagataaatgtctatgatttgcgcagaaacaaacggaaagtgcttttcgacaagggtttggacgagccgagggcaattgccgtggacccatccgctggtctgatcttttggaccgattggggttcggacgcgcgaattgagcgcgctggaatgaatggcgatgacagacaggtgacctttttatacacttattaatagtggccttgattgcttttttgtcacagattattgtacaaggcaacgcgataaaatggccaaacggtttggcattggacattttggacaaacgcgtgtattgggcggacgcgaaaacgaaacaaatcaacacttgcgattattggggcgagtcttttccaaaacaattaaagattaaaatttacgttgcccttttacgtgttttgtttctcgcttctgcaggtgaacatgttcgcgtcatcctccattcccatcagcacgttcgccatcccttttctttggccgtatttgaggaacgcctttattggaccgactgggaccacgagggtgtgttgtccgtcaacaagttccacgggaaggacttccgacaggtggtcatttacttctcgatcattcttttgctctttgttgtcgccactttcattttttatggttgaggtgttgcgcggcgtgagcggtccaatgactgtccgagtgtaccacaaacaagcgcagcccgttctgcaaaataaatgcgaggggcgcgactgcgaccacctttgcttgcctagggcattatatcgtttgtttttcccgatctaaatgatatttttaacttactattgtaattgacttatcgaacggcatttttaagagaaacctaccaaaaatgccgaaatccgactcaagggactgccttactcttgcgcctgtgacattggtttccgtgtcgatttgaacaacagttcaatgtgcgtgtcaacaactgcggtcctttccgagtcgactgtcttctgtcagtaaatgtctcattgtctggtgcacaaagtttctcccccgtttaccccgccgtttttcaaataatttttttaaaaagtattttttagtttttcggggtaaacgcgcggggtgaggtccccttcattatcagcttttgtctgtttctcatccaattttgtgcccaatttagtccaacaaagtaaacactatggccaaagctccttctcctacatgttcgccttcatttttctgggtgtcttatttgtgctggtaacaaatttgctcaatttgcgccttattttcttccccattaaaggcctacactttctaccgtcgccaaccgcgtcagttttctgcgcttcattttgagaatccaatttaccgccgaacggtggaggctgacatggacgcggaactcgaaaataccggcgacaattccctgggcccaatctccattttgcccgtaggtggcactcacaatcagagtggtcacctttcgagcggactgttgcatcagccgggcgagcttctgactacgccacagtcaaaattggtgttgaacaacggggcgagcaacggcgtacccgcacagcatcagagcaccccatacccaccggtggcattaggcagcaatgtgcgtccggatgaatatgggtacgagcagccacgacactgaggaattatggcaatgacattgctgtgttattacaatgacaagctcactttctcttccctcccatttcaccaattgttctttaaatatgcagggacaaaaatgaaaatgtaatttttaaaggataagaaaaggatttttggttaaacgttaagcttcagttagtttttgccttgcatattttctcaaaagtgccgatctttgtttttcacttttcaattctaagaatcatggtcagaatgtactcctttcatcttgtgcaattttaagcacataaagccaaaagctttgtaaacaattgaatcattgcttttcattgtttcaccgggtctgttttaattagataatcgtagccgactgattccctcattctgtgatttgcttaccctggttttcattgaattcatataaacatgtgtcaggcccgttgccggaaaattatgaggttagagttctttctactcgccatgggaatattttaacgtttaattttttatttgactactagattagtgtccattaaaaactattttgaaaggtgtgggagcaacttctcccccggacacgggtatgacatacgacgccaagttttcgctggtcaagttggctttgttctcgaatgcaccaagattggtttccccataaactccgattttcaaaactgtattgtgaccccaattttttaagtaattaaaaatgtctaattgtaaatgaaatttcctatccttctgtcatcaattcggatagcttggtttttatcaagttgggcggctttgccgcatacatttatgatgagcttgtcgaacaaaacattgggttaaagtgataaatgcaatttgaagatcaaatccgttttttgtacccataaaacatcgagtccgttctgtcctttttaacgctcgcaactttcatccgcttagttaacagccgccatcggcgtctgttcctgttgtgacatattcatttgttgactgttgccgttcgatgttaattcaatggccgccactccgtaggaaacctcattcccggcgtttggctcttcatcgtcatctgacaatcaaaggaaatggttgttgtaggcttttgttccctgcataatgctcagcaaaatgttttatgcaggggttcattggttccgacagaaaaaggagaaaaaggggctttcggcccgtccctctctctgcgacaaacccatcggctgttccgcctcctcgtcccatttgatcgggtaactcgtcacgcgcacatcctcgccgacaatcgttcgcttgagcttaaatgccgacgagtaaatgaaaaataaattgtaaaagaagtcaataagctggtgaccttttcgatgacgggctgagaaggagggttttcgacgagttccgggtcagtgtaagtgtgcgtgacgaaccaacctaaaacataaatggcatcataaccaaacaaaagtttatttaaaccgattttcatgaaaagctgttcacgatatttgcacttgagcagcaaaagagtgacatccataaaatcttcgggtcgaaggttgtgaatttgtggaggtggcgcctgaaaagaatttttggtttttatttatcagaaagttattggggaatgggccttctttctgtttcttgaagttatgataaaggtattttaatggcatggactaccgatttatttctttccaaattttttgactgctttttttatttattggaataaaaatatttcaaaggcacaaaacctcaaacaaaaatttgtgtcgtccctcctgaatcggtccgatgagaactgagtcgagcacttggtcgtgttcttctcggccatcagtgcccacgaaaaccaattcccattcgacgtcttaatttatgaattttgaacacggggaggaattgctgaagaaacaacacaaccttccttaatgttttcgaatatttcgaaaacaatttcgagtttgatgtggtcactcggagtggccgggttctccaacaactgcacactgacgacgttaatccttgaactcattttgaaggttttgactaaaaacaacaacaaaacttcaaattcaaaacaaattttaaccgatgtgaatttttgaaagaaaaaaataaataaagcaaaaatttggcattatgttattttagattcaattaacggaattccgttgcgtccattcggtgagtcgggggcgtttgggcccccgtttttgggccctcgtttttgggctccagggtcgtttgggccccaagtacagaaaaatgaaaaaacacacagtaaaaacaactttttaaatttcagcataaaatgtaaaataaacattttaaaaataaattcaacaataattttaacaataaaaaatgtaaaaattaacagaaattcacgggttcatgaggtaatttggacaataaaacaaaaaatcacgggttcattcgatagttgcgagaaattccccggagaaactccaaaataatgtgaaattgattttttgaactcgcatctccaaaattttgtcatcccatcagaactcattttagcgaaggtgtaaaggtggcgttcgtaagacaattttactttttgttttttggttgcaattgggttagccatttctgaaaaatgtccaaatcagaatgtacatcaaattggttaactattaaaaaataataggatttggaataagtaaaatttaaaaaatgagcgaatgttaat

SEQ ID NO: 3133 - DNA, 6455 bp, Heterodera glycines
tattataattctatacaatttaataaatgtatgcacattatagttgtataattcaaacatatagaaagagaaaatgagaaaaattagcctttgaaaaatcgatgcactaaatgaaaaagcaaaaaatcatattatattcatgcattgtaattttataataaatatatgacgcattatagtttgtataattcatgcatatcgaaggagaaagtttgccgcgaaaaatcgatgcaaaaatgggaaatggaaaatcataaaattttatatattatacatattatcattgtataatttaggcatattgaaaagaaatttcgaggtaagacatggccaatccaaaaataattgtttattaattgctttcataacatatatagggaccggtttttgaagcatatatttaaatctaatattaggcatgctattcggcattttgaaaaaattttggtctgtttgcttgggttcatgggtggatctgggcctgaattttcttgaaaaacccaggaaaacccaagctttgggatttcttcaaaaagtgataaattccatttgctgaatttgagtagtgaatctgctgatgtccagccgagatataactgaagggagggagagaaaaccggggatcggatttgagggaacggagggattagccaaaatgtgggccatggataatggccttctcaaaactggaaatgccatagatgcacgctagaaaatagaatataaaattcaaaattcaatttttaattattaaaaaaaattcttgaaaataaaactttgttttgtcaatttagcccaggcaatatctcaataaagtgcgtattttaatgatatgtaaaatatttattataaataaaatttagcatttgttaagcaatttgtaacggtttttggtggaaagaagtgatcaatggttgatacatggagatagatattgattgatcagaatgatgagaaaaaaattggcactttgcaacaaaaggccttttcaaaagagtgggatcaaattgtgggagagattcaaaaagagtggatgataaacacatgggaacatcgagaaaacaaagatcattatggattagatcaatgaatgataatttgatacggaaaggtatctgctcggactgatatgcattgatcaaagctaatcgatcaattttgatgtttaagcttaaggattgcactgatcagctgagaaaatttgaatgtgcttctaaacaacagcgtttcacgattagttagataaatgggagcagaaaaagggccaaaatatgtggctaatcgtctgatcagcttttcgaaagctcaaagaaaagtgatcgaaaattaataataaaattcgatcgatcaagcactgaccagcaagaaaatgctaagcaatcaaaactgatcagtcattatgtttattattgatgattgagtccgatcagttgagataaatcgtttcccgcttccgactgccgccacccactgcagtgcccgcactcatcgaagacgcgttgcgtgccaacatttgcgcaccgccggacaccgcaagtgaattggcgttgtccctgccgccacccgtcggcactctttgaatggcactgttggcacccgtcgcattggcatgccgtaacgatgctctgaaaaggggggtcatttaccttagttcccctttcagatcaaaacagattttgaatttgaggatttctgtttttgttttatttttttggccatttttaaaaatttctcggcggagcacggcacaaaaatttataattatgtatttgattgttgcagataaaaatataacttttcaaataatttaatatatttttttgcataactaaaacgccaataaaaacagaatttttctcccattttctcgaaagtttttaggatggtaaatagcctaggcctccgaacaacgcacttttccgagtgctcaagagtcttgaattaacaaatttgtccattccgttctcatgcctggtcgatttgctgcgtgccaaactgtgcccgtcgtgccgcgatgagccgcgtcgccgtcgtgctgcgcttccgcttcggctacgcgtcccgcgtgcggtggcggcacccagcgatgcgccgtcctccgaccgctcatcgtcgtccggctccgagttggacatctcaagcggctcgaactgacgcaactcggggctcgtcatgtacctgaaatattatttatgactgactataattttccatcgtccttggactaacaaagaaggacgtccttgaaaattcagattttgagtttgaaaattaaaaatgtcctttaaatttctttcatttttatttaattcatttataaatatcaaaaaatgctagttttcttcacacattgtatcaaaaaataaatttaaaaaaacaaaaatcctcaaatttcctgacaaattttaacgacctaatgcaaacaatttttttgtttgctttacaaaactgtttttttttgcggcgcgctttttccataaaaattttggggacagggtggcacgcgatgccgataggcgctgccgggcgaaatttttaaaaatttgagtgtgatttattaatagattttcaccaaaaaagatacaatttttgattatgagtagggaatagaattacatggaaatccatatttttttcctggactgtgggaggcctgaaacgcacgaaaaacatgtttttagcttggtttgaagcttctaggaaggatttctatatccatattttccatatttttccatatttcgcgatttatgtccatatttccatatttttccatattttggcattttggtccatattttatgtccatattttggcatttttcaaaaaaacctctattagaacggcccccagcagctatattagcctttttgagcccaaaacccgaaaaatttttcaaaaaatcattttttcgccaaaatttctcgagaatattgaataaatttaaattttcttaaaaattaataaattatgtcaaaaataagcaaaaaaacgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttttgcaattttgcatgttaatagagaatacttagggctatcgaataaataccatgatttttggattaggttggcaaagaaaaaagttatagccacaacttgggcacgacctgcgccgaaacgatacagactcgagttaagcagctgattgtcagaaagtctcttgtaaatagatgcttttcttaatccattgttcaattaaagataattcaaatgtaatgctcaaaggtttatagcaactttgaaaaagggaagaaacaattacataaaataccggaaaaaaagaataattaagaacaaataattatgctaaaaggaacagagaatggaaaggttcagaaattaaaaacataacacaatgacaatacgtcgtagcaatttcaatgcttcgcctgctgatgagttctgccgagatgaattcctatttctcaatgctttttctctttacgaactttgcttgctatttgagaattccaatcagtaaagcttccactatacacaatgctaccactctccattttcgactccttaattgtcattgatccattgcactcaaatttaccattttttatttccgaacgcattatagtgaaagagccgccagatgttgtcattacggcattgttttctatttccgaattcgttatagtgaaatgtccaccagaatgcatttctgcatcgtttactatttccgaattcgttatagtgaaagacccgccagaattcattttcgcatagctttctattttcgaattgtcaatgcttatagctccaccactttttaaccaaacacttcccattggtaacttgtcaatgttgtcaatttgaagagctccacgactttcaataatcactcttttcattcccgagtttttgatatttaaatttccaccgctcttcacccaaacattgtgcattggtgactcttcaatttgtaactgtccaccactttcaaaatgaactctttccattcccgagtttttgatttttagatttccaccgcttttcatcgcaacattgcccattggcgactcggtaatttgtaaaactccatcactttcaataacattttcatctccaccaccaatggaaacacattcgattgttgtatttttaatttgtaaatttcctctggtttttggtccatttgtatacgcacgctttttgatgtcaacgcataatatgcgaagacagccccctgtcgattgaccaatgtataaattaccatcgcattcagcgtttatttgcccaacggttatgttttcgcgagaaaataacgctaatggcacactgacaattacatttcttatgtttttgtcttgtataatttccagatactgctctgtggccctgttttgataaactctcccattcacactcaaatcatgcccttcaacaccaacattaacattaggtccgtcaaccgcgtaattttgtccatttatcgaaatcttatttttcctgagttgatttcgcagagaagcaactaaatctaaaataaaaattgaaaatcttttcaagtcttagcttttagttggtatcaaaaagatagacatcccctcccattttgcatacctccaatctcatgagcactatcaaggttatgattatcttcagtagtagtgcctgctggcatatcttctatttgtatgcctccaacattctgagtatcaccaacattgcgattgcctccagtatgaaaatgaaaagatccttctgctggcatccctcctatttttatacctccaatgttctgagtaccaccaacgttgcgattgcctccaatatttaaaccaaatgtccctcctgttggcatccttcctatttgtatgcctccaatcttttgagtaccaccaacgttgcgatttccaccagtattaaaatgaagagctcctcctggtggcattcctccaatttgtatgcgtccgatgtcttgagtaccaccaatgttttcattgttttgattatttatatgtataatatttccacccattggctttcctctcttttgctgtttctgtttattcttctgtttttcttcccgtttggtgtctccaaaagtgctttttccatcatgcttgttatgcccagcgtttatataatcagtgtttcccccaatcggaatttttggaaaggaaacactccctaaaatttgctgaccaacaacattcgtatgtaaacgtgcagtatttctctgaacatctcccgcagcaattagtggaatgtctaaaaagataaaacgggataagctgcttgcaagcaaatttcataaatgataagaattttagacggatagtgagtcagagaattgattggcaatattcatcaggaaataagagagatttaaaactaacgtaacactaacctttgctcggtgagccgagaacgggaattcgttcctcaattcgattgatttcattgatatgacccgtggggaccgcatttttataaaactttccatcaactaaaagacccgtcccacagacatcaatatcataactgagcccttgagttgggtatttcctgccgtcaatctcagcgtaatagcggacatgttgctgttgcgcattgtttgctagaataaaaaataagcaattaaataattattttgtttgtaatgtacatttaaaaaaattatttttaaatataatgaaaaaagcatgttttgtgttagccatcaactctttacacagcaggcgcttgaaaattttattggtaactttttttttgattttatacaaaatactttgtgccaaaacttcaattagtattaaattggcaagcctaaaccacaaaaagaaaaaacaactgctaatgagcaaattgctagttacaataaatttgagcccgtaaagcgagggaaaataaactcaaaaatatcaatatttatataaaatatttccgatacgtttgatagacaattgtggtcgccagctgttttcaccagttttagtgatgcttaaacgatttctaagaccaacatttccatagataacgcatcccggtgcctcttaaatgttaattattttcatgaatcaaactttttataacctatacaaagagcatcatttcctggtggcagcacaccacgatcttcgtcattgataaggagatgttcctccttttccgaatcaataataagcggatgttttttaaccatctgaatttcaatttcgatgtccggtgtgtcaatttcgtaaaattggccgttgactttggcaatgtat

SEQ ID NO: 3134 - DNA, 1000 bp, Heterodera glycines
  misc_feature (985)..(985): n is a, c, g, or t
aaaatcgatgcactaaatgaaaaagcaaaaaatcatattatattcatgcattgtaattttataataaatatatgacgcattatagtgtataattcaggcatatcgaaggagaaagtttgccgcgaaaaatcgatgcaaaaatgggaaatggaaaatcataaaattttatatattatacatattatcattgtataatttaggcatattgaaaagaaatttcgaggtaagacatggccaatccaaaaataattgtttattaattgctttcataacatatagggaccggtttttgaagcatatatttaaatctaatattaggcatgctattcggcattttgaaaaaattttggtctgtttgcttgggttcatgggtggatctgggcctgaattttcttgaaaaacccaggaaaacccaagctttgggatttcttcaaaaagtgataaattccatttgctgagagtagtgaagctgctgatgtccagctgagatatagctgaagggagggagagaaaaccggggatcggatttgagggaacggagggattagccaaaatgtgggccatggataaatgaatggccttggaaatgccatagatgcacgctagaaaatagaatataaaattcaaaattcaatttttaattattaaaaaaaattcttgaaaataaaactttgttttgtcaatttagcccaggcaatatatttttatgaaaaacatgctaaaaattgggcggtgagatatgtaggatatcaattatattttccacaggactttaaataaaatcttttttaaattttactattgttcatttaattaatttattattattattattttgtattgaggaattattttgaaattgcatcaaaataataatgctcaataaagtgcgtattttaatgatatgtaaaatatttattataaataaaatttagcatttgttaagcaatttgtaacagatggttggtggaaagaagtgatcaantggttgatacatgga

SEQ ID NO: 3135 - DNA, 1717 bp, Heterodera glycines
ttacatttatcgacaaaaaatgaaacaaaaaaaaacaaaggctaaacgctctaaactcctttttccttctcccctttcatcctgcggtgctgcttctctttttggactgcttaacttggttcccggatgagattttgagcggttctttgggcagtttctccatttcctcttcgtcgatcagtccttgccggtgcggcgattgtttgggcttcagccaattagggtaaatgcggcactaaaaatggaaaaggttcgatatttctagtgatttaaatctgaaatttttgaaaaaataaataataaaccagccaaatccatttccagataaaatttgaactttattaggaattattcacttattggcattgaatagaatgtaagtcgttgaaaaaataataattcagaatgctaagaatacaaatttaaatatttttacgtgtaaacgccacattccatcgacgctggccacgtgattctcaaagacgacgtattccaaacattgccttggctcctcctcagagcccaataacaaatggccgtccttgtcgtaaagtgccaaaatctgaaattgttaaaatttgaccggatatgattaaaagtggtggtgatagtgttggttgtcacctgtgtgctgtgcattcgtacaataatctgcgcaatgtcgttgcccgatttggtcgggttgtccaagcagcgcaccgttagcactttggacggttcgctgaactgcaccaatttccaatggagtgtgcctttctcaacatcgggccacattttcttcaaattttaaataatttctgataatgaacactcaacttggaaaagggaaaagaaaaagcatacagagaacgcggcctcagtgatcagttcgtgcagcttcgttttgtctcgcagtgccaacgcattgtacgcatttgcgtagatttgctcggcaagttttgtgaaatcctggtgccaaaaaaggaaccatggaaatgggaatgtactcgatcgaaccttcaaattgaagttctgaaatccgtccttcttccgaatcctcctcaacccgtagaatatcccttggtatttgcgggtagcaaatgccttcaaatcggggaaaatgtctttggcccctcgtgaaaacagcgaagtttcgggaggaatatacgggtcaattgcttgacctgaaagctcaattaaaaataagaaagcataagtaaacagctctacatcaattccttaaggggtttttgaatttgtagatatcgaaaaaattaaaaattaacgattttttgtgcccctgcattttttaaattatccgaaaatggttattggccgtttttcgttggtgccccatttgatagagtgcccctttactcgccgaatgtgttcagagttatctggtgctcattccaatcccttggcgccacatccttgaaaatgttcggcttccccttccgcaataagtacattcggacttcatccggtcgcatctgatccaattgtcgtcgctcggcataatcctcttccaggtcaattatcagccgtttggcgcccctcaactgaacgaaagattatttttgaaaatgaacaataaattaattggccgaaaaattcacgaatagtgacccaaaaagatgaataaacaatattagtagaaataaattgaatatcaaaaggatcccacgtttggttttcataaagtaaaaacattatttaaaagtgactgttttcaaaa

SEQ ID NO: 3136 - DNA, 1747 bp, Heterodera glycines
  misc_feature (8)..(8): n is a, c, g, or t
cccacgtnttggttttcatcgcctcccccattatttaaaagtgactgttttcaaatggtggggtaaaatttccgaatacggtatcaactcaaaatcgcataaaaacacttttgtgggatttcttaggcgctgagaacgaaggaacagcttaaaattcggcgcccatttaaagctcacccttctcatgtatcgttcgttgatgtgggtgtttcggttcgcttttgcggggttcgagcgtcgccagcccatgaaacgctcaaacccaccgggttcctccaattccttgtgatggtgcacaaaacgaagttgcatgatgccggtggaaaaaagtgatggtggaagacggcacaacgaacgcatggcattcaaagtcaaaaatggcataattaaaaatcttttttttctgaaaatgcaattcttcggtatcaaattttgagtcgatccgcaaatttttttttttgaattattgttaaaatttattattggcgaattgtcttttctagcggttgtgcttggcggcgcagacacacagaattgcatgcgattgcaattttcaatgcactctcttcaacttttttgcgaaatataaacttgagaacgcccgccttttttcattttttggatttttcttttcgactgtcgcattcctctcgcagataattgataggtaattcgaaatcaattaaggaattaactttcacaaattaaaatctcagactattaacactctaaaagagttttccgttatatttgtgcgttgcgtgccgaacgggcttcattataaagatccaacaaacccatctaaacacaaaatttcaaatgtttgcaattcttttctaccttaagctgacttctgtgctttcaccgttaatcttttgattgtttctgaaaccaaaatgacttcaacaaaaaataatagcaaactgaacgaattgttacaagctggtggttatgatgcttctgatggaattgacagtctcatccccagtcatcttaaacaagtaattcttcttaaaaatgaaaagttaaatttaaattttttcagctttctcgcccggtcattcgtcgtgttcgaatgctgaagaaaattcaggcacaatctttggaaattgaaagccagttttacaaggagttgcacgagcttgagatggtaagattgggagtttcatgtccgcaacattttctaatcgtagagctgacgacgctagggagagaatgtgatgcttgcctttattggaccccgaaataggctaatgcgaaatttcacaaaatcaccttttaggggttagtaaaggcgagtattagcttatcaccctttcattttttcaatttacagaagtaccaaccgttgtacgatgctgtgaatgccaaggtaactcattaaaaaggaagagacttgttcaattttctcttttcaatatatattttattcagaggactgccattgttcgtggcgagatggaacttacggacgcggacggtgaacttccgccgcttgttagtgaactcgagccacagactttggaggtaagattcaaaacgcttatattctttgaactcggatctcagataatgtcgaatattgagtttgtaaatataaaaaaattaagaaattggaagaaagtgcgcctgtggagggaggtgaaccgtcgaagggcattccgggcttttggttcaacactttgaacatgtacgcatcgatcagtgacattatcaaagtttgtgattttggtcggcgtatggttca

SEQ ID NO: 3137 - DNA, 3439 bp, Heterodera glycines
ggccgttttatgtagtaaattgccagaatctgtggtacggaaatggtaatcaaaaatgatgattgcgtgttgagagcgaaaatggggcgtcaacgataacgaacatggtgaacggaaaaatcccacataaaattctgatttggagtttttcaaaatgaaattaattaggatttttgatgccaaaagagacagagcggagatcatttgttcattcaccatataaaataacacaataatcaatctcaaattgttggccaatttcgacgcgttccgtggcattttcccttttgaattgggcaaagtggggactcatttgtccccacccccccctcctggattgtgctgctgctttggcttttgctcatttggttgggctttaaattatttgcaccctccgcctaattttgcgtgagaggagagagcgccgccgccgaacggtggaaagccatttttgagaaagtgtcggcaaattggtgccatccgccgatgggaacgaaggaaggaaggcgacggactcattgtcagtatctgtgccaacaaattggagaagtgtttggaaggggaagcaaatggaaattcagttttatgaaggatcaccaaatgccattcttctctatgtataaattggaccaaaaagtcacaaattcgggatttaacgccttcggcggatggtccgtctctgactgaattgaccgaccttcgccgtctcccataaacactcgcgcggcgcggtcatctgagtactttcccagtgtccaaagtgccctgctcctccgttcgctttttcctctccgtttttccccttttgctttccattcattcgccgccatttcaaattcggttccatccgggaattttgcccaaattggcagccgtgtttcgtcgtcatatgaaaagaatgttcggtccgttccgttggacacccttttcaagagtccgtcccgggtgaattgcaatctgatcggatcggccgatgaagtgacactgatctggaagaagggagaaatacggaaacttgatggggacgggaaaagatggccaagcccaaaaccaagccgtgaacaaaactccgcggacagcccaaacgaagattgatcattttagaactcgactcgttggaaaaaatgatactcccgagaatttgagtttgctcttgatcttgagactcgaagccaagaaaaggctccaatttgagctggaaaaacattaaagatctgcgctcacattctgccgaacaatgttgtcccccgctcgtcctgccccaacttccgcttcagtcgttgctccacccttttcctcctccccctcctcttcctccacaaccgtttgtcccccttccgtttcgattgtccacaatcgttgtttgtccgtcccctctgctcctcctcttcctccgccttgccctttgatcactttcacttccgtgcttttttgcccttctttctcctccaaaatgcttagcattgtctgcccattttccgcttcttctccgtaactgatgcttctcctcaacaaaatccttctctctgttcctcctccgcttctgtccgtggctaatgtgctcaaatgccttccccactcgtcaaactcgagcagttcacccgtttccgtgctgttcacccggtacaccttggcaaccgcgtcgaattgaattcgaggcgaatgctcaatttgtcgaatagccgcgattgcctgcgtatttggctaattactgatcagattgatcattaggtgagcgtctttcagtttttagtaaccggcacagttatactcttcgtgtcagagattggctgattacctgatcagaaaatgccaaaacgccggaagaaagaacggccaatgccttcgggaaaaatgccgatttgtcaccaccagaatctgttggattttgccctgctgtgaccatgctcacttcgcccggagggtaattgcgtgccgccagcaaacatttgatctgtgagtgaatatctttttccgatcaaaaacatctttctgatcagtgattttattggcatttgttcgttagatcactcaccgaattgattcctttttggtcggtctctgtccaaaagagttttccgtcttctgcgctgaaactgatggcttcgatcactggtattgattcggcgcttccatctgccgctgggcagcccgtctgagcgccggcaacaacagtcacaatgctcagttggaagtcaatgcgaaaaatgacggaggacgaatcaagcacaaagagttgaccactgattggatcccaagtgagcgctgttggccattccttcggggggggggtgatcagattatccgatcatattggatcaggaaatacaccaaaaaaatggccaatgggttgactgtaattaccaggatcagttgcccaagcggtaccattcgcgaacattccctcagcggttgccagcctctccgttcgccgttgaccagcacttcctccgccgcaacaacgggcggcactgtgccgcccgtctcttcactcgccaacaaaactttcttcaaactccgtccgtccaacaggaacaaatttgcgctattgtcaaatgcaatgccttgcaggaaaaaaaattaattaattaattaggcaaaataattaattgtatttattacccttcggaaatgtaagagaattcgaagccaaaacaatttcttggagcccaacgtcgaccacacgtacaatttgtcgcttcaaaggcagcgaaatgtgcaagtgattagtgaagggatggacagcgagggaatagggatgagaagcatcagagggactgaaatgggaggggggaaatgggaaaacgaaaagatgggacacagcagcacggggtggcaaagtacgcataaaaagtggacaaagggagggcaaaaatttatctggacaatgcaagtgctaagccccccccccccctcgccttatctacagtagggaccgaaatttttcgaatgtacggttaagggaaagggttacgggctgccgggcatttatacaggtgcggacttaacggctaaataatccgaaaaacttttagtccgtaaaacccgcatcgatcgaaaaaatgtggtttattggcgctacggatcagtaaaaatccgtattcggattcggcccgtatttgatctctagtccacagacatttggggtgggtatgaatagaatgccaaacccactccatttggagcaaagtgtccacaaattcggccccgggcgtcactcgacggatcagttccgcgtcccaaacaaacagcgacccgtccgcggcgctggcgagtgccgcaggcgcgtgcaatgtcgcctcgcgcgcgtgctctctgcgcccaacgcaagttgctgttgccgcctcagtcccaccgcattcgcccaaaatgcgccgtcgtcgtttttcgccattttccgccgatgcttcggcgccggcaatagttcgaacggttgcta

SEQ ID NO: 3138 - DNA, 3887 bp, Heterodera glycines
ggatgaagccgatggacggaagagagagaccaaaacgacggcatcggagaagcggggagagagtgagcggacaaatggagggaaacgaagtgacggacggacgacgcacaagtggacagatgaaaactgatggtcactgaagcgaacggaggggacaaaatgtaaactcaaagggacaatatgtcgacttaaagggacaaaatgtaaactcaaagggacaatatgtcgacttaaagggacaaaatgtaaactcaaagggacaatatgtcgacttaaagggaaaagaaatgttgactcagagggcaaaatgtcgtctaattcatttaaaacccaaaaaggaacatttctcggctcgaggctcaatgtccgtgatcagagaggcgggaaattgttcgagaattgtcaaaaaataatttaaactcacattgcgccaggcgaagtccgtactcgtgttgtccaaacgcattttgtcggtcccacacgaattcatgcgaaagcgactcgcgcggtgcgaatgtccgctggtgccgcactccgtcaatttgtagtgccaattcgacgcgcaaaagcccggcgggcaaacggtcgcccaaaagttggacgcgcagcacactccgagcaccgtcggcacagtttgaggaataaaagaggaactgatcagtgccgggaatgagcacagagagcgaaatggcgcgagaatcgatggacaattgtggagaaagcgtaggggaagaagaagaagagtgatcagatggaagagggacagtgggagaggaggagagcgggcggagaagcgagacggacggacgaaagtgccaatcggagagagacgcaacgcaatgcgacgcggacgcagaaggggcggcggggaaaaagccgcttctcgtcgatgtcgagaaaggacggtccatccaaacggtgccaatgctgacgattcgatttggtggcaagtaaaaagtgagcggaacacggccaaacggttgccgaacgaactaaacgaaaatcaaaagaagaagccgattgatttggacagaatgtccaattcatggcatttttccccgaagggctgggcttagtcatgccaatggaacatgggagacaatcataaattttgccgcctcacactttcagggcttagtctctcccctacctgaactgataccattccgccgccgttcagtgccaattcaaaagtgccagccgttgtcgttgtttcaccactttcgtccattgcggcagcgcgggacaacgaaaagccgtggtgaggattttctgagtcagaaatgcgcacgcctgtcaacggaccgccccgggaggaaaagacgcggccgcggaggacggaaatgcgcctgaaaatgagtggaaaattgatcgaagattagggaaaatgagtgatcagtgattgatatatagttgtatttatttatcgatatctgcccactttctgtccaaaaggcgaatgtccgcgtatcgctgcaccgaatgttcgcccccatcgaagagaaatttgacccgatcgaaaaagggagaagccaaacgatcgctgatggaaagtgagcggcgatcgacggcttcgcttgggaaaggcatggccaaacacagcgaatcggaggcgcaaaacgggtgggcacaacactcgacggaatcctcacaatcggtaaggccatctgaaggggcaaaattggcaattttttatggaaatgccaatttgaagggagggagggggggaaagtcggggctaaaagtttgatttacatcctattattgtgcctctgttaatggtccgccgtcctttcaatgcttctctctcacccccgtcgttgtcgtgtccgtcgtcgcaactccgttcgccctttgcgaattggcaatggtccccaaaatgtgccgtgtcgcattggcaccgccacccatccgaaaacagttcacattggccaccattcgaacagtttcgcgcgcacgtttctgaaaagagttgctgtttgttgagcttatgactcactcacaatgccaacgaaacggaaacgggggatcaattggcattttgaataaaaatccgtcaatcagtcaaattcccaaactattgcctctctaccgaccaatttgacaattctcgccgttccatcccgcttggcactggcactgtccgtcggctgtgcatgtgccgtgttccgtacatccgtgtgggcattggctcggtccgttggatggcatttccgtttttttccgattggtcggtccaattttgtcatttccattcggcttttgctcgcccttttcttcatgcttttcctcctccgttgccttcctctcacagccttcgcctgtccatcccaacgcgcaaaagcattttcccccgtggcaaatgcccctcccggcacaatcgtttcggcccggacattgcctttccgcacaatttggcccagtccatccctcccggcaatggcactttccgtctgaagaatcgcatttgccatgccctgcacagctcggatcctcacaccttcgaaggatttgttggatttaagaaccctttccaatgagatgacttttattgttcccgggtgtatttttggagtccctgatcatgaatctgatacctatgtttaccagtctaagccccaaactgagctcgaacaaaagtcaaaaattcaaatttttcgatccaggatttttttgaaattaggaagtcggaattgatcaaaagtgatgtaagattcgtgatgagcaaaccccaaaatttcggggatcattttgcaaatcaaattggcccgccctttggttttaagaaaattcaaaatcagtctattttaaaatgcgccgcagttcatcactttgaataagaaagctttttcgttaaagttctaaatttgaatttaaaagtgcatttttaattaaaaattccaattttatcggccgtcccccgcccaattgtttttgggcccaatttacaatcgcttggtctcgataatcactaatactttgtcccctttccctgctgttccctcccattgtctcaccaattgtcgagcatttggcactcgacccctttgaagccggcatagcactggcactttccgttgctgaacatcccattgccggagcacagtaccggacaagcggtctcctcgcaaaagacgcctccgtagccggggtaacacacacagcgcccggcacggcacaatcccttgccgaaacagtcgaattggcacggcgcatcatcggacgacgaagaggaggaggaggacaatgccaaatgatggggatcactttcggcaccgttttctgtgactgtagccaacaaagtgaccgcttcattctgaaggaatggggcaaattgtgagaggaatcaccgccaaaaaacacctgttcccggtcattcaaaaagccaaaatgccatcggccagctgtcagaaagtgactgatcattgtgtgccgaagaaacgtctgaaaaagtcaacacactttagtcatttggatcatttggttataatgattcaatcagtcttcattaaattaatttactgtaaactatagactcccgatctcgatcatttttctgaattcatttcttatccccaaaaacccaaatctcatgtcttattctttgtctgatcaggttgacttggccatagctcaacttgacttaatcagggtctcttttctaatcactactttatgctttcattccattctgatctctgctctcctaccgtgtcgcgtccattccgatcggttgtcaatgggtgcattcggtcaccggaaacaattttctgccaatcatgcgccccgggggtcggcctaacggaatgccgtgccaacagcacaatgcgcgcttttggcgacacagtgaggttgatcagaagccgagagttttgcgagagcggtgg

SEQ ID NO: 3139 - DNA, 1342 bp, Heterodera glycines
gagcgaaaaggggtaattaaataattaattaattgccttgtcgcattaatatcgcggaacccctggcgatcaaaagtcgaaccaataaatgggcaacgggaaaagtgatgaactcacaaattaaaaatatggccaaagccaaaagggtggtgaaggcgacaatgacgagagtgaccagcaccaggcgagaacagcagcgggacgatgttcggcccggtgccgtcgttatcgcccctgctgatgttctgctgcgcttcattagcattccgccatggatcggctgcggcccgcaggtgccgttttgctgttggaggtgaagccgacgctttcgtcgcatcggtggacaactcaacgggggctgaggtggcggcggtggtctaaccaaagagctggacgcataagcggaagcggaagaagacgagatgagcagagacatggagtcgggcaggggctgccgagtgggcgccatcattggagagcgatcagacgaatccgactgatcagtggagggacgagtcgacgagaagcaatgggagggataaagcacatccactgattgaatgagatattgttgaggaagacggtaatagggggagagagcacagaggagaaaagtgggggccgaacatcgcctgaaagaggcggaaatagcgcaattagcaaagaaaagtgatcgaagagaggaaaattagtgaaatggattgggatgggcgagaatcattgtcgagattttatggggacagttaaacgaagggaattaccccaggtggggctcgagactctcgagcaacaacgaaagaaaatttaaagaaattgaaggcgggggcattgattcgaaggagtggtcaaacgaagcaaatgaacatcggtgcacctgctgtgtcacttcgttttcgcatggcattggtcggtaatattatattaagtacggtttggacgggttgtgccgccgtggggggggcggagggtgccgttggcgttggcaaaggattggtcgtagtcgccaacggcagacatttccgttcgcagttcgttgggcggttaatggttgaacaatcacaagcccaacacaccgcatcaccataatcatcttcatcatcaccagcagcacctttttctcttttcaaggtgagcgagttaattgggccgcgaaaattggacggacggaagagaaagggcaaagaaaggagcagagaattggggggggggggagggaagtgatgaattaatattgagtgatgaataatgtggcggaggagaaggggtgggcggtccgaaattcgaaagtcgcatcggcaaatttcggtctcgaaaagatacgactcggcaccaatctcgggaa

SEQ ID NO: 3140 - DNA, 1743 bp, Heterodera glycines
  misc_feature (1684)..(1684): n is a, c, g, or t
  misc_feature (1723)..(1723): n is a, c, g, or t
aattttatttttttcggaatttccccgattttcagtgcaattaaacggccccctctattaaagcggccatttgggctctaatgactcaaaattgttcaaaaatatcagatttttgggtatatttctttctgtcataagcattgatttttccaatttttacatttatttaaaaagtgcattgcgccaattcacatgttaagaaattaaatttttggcattaaacaaagggccaaattcacgtgaaaatgaacaaaattgtcattctcgtgtttaacagtgggccaaattcgcgctgtaaattttaaacattgccgtttttgcgtgaaagtgaaggcatgtcatcaatttcacatgtatacatttattaatattgttggcattttttttccactctctgtgtttggcacactattctcgcaacaattgtggataattgccctcaattttgccaaatctggccaaaattatagcgcgctaattgactttgcttatctaccggcctgtaaagcacgccttatatttctatatttctatttctctcactgtcattatgtataaatattttatcatgtgcatattaattttttttttgcagcgaatatctgcataaaagaagcagtgattaccaatttttaacaaattcatttattattttttttaataaatgcgcaactttgccttcattttcatttggtttctgatccagttggggaatcatttgctgagtgagttaaaatattaataaaaatataataagaaataggcaaaatggataggaatcgaatcctcgctatgccaccatttcgaaaatgacaaattcatttagttgatacgggagttttattaagtacttaatatttataatgtttagaaaatgttcgtgcttttccaactgcagaaaatggaagcggaatggtaagtggagtgtttgtggaggaagaactagcagttgaaatagaaaagcccaacgaagcgaaccagaatgtcaatcctgaacacgatcaaactaaacgcgaaggagctgtaagcgaggggaacatgaattccaatcatggacatgcagagaccgtatacgagggaaacatgaatgccaatcatgaacatgctgagaccgtacacgaggggaacatgaatgccaatcatgaacatgctgagaccgttcacgaggggaacatgaatgccaatcatgaacatgctgagaccttacacgaggggaacatgaatgccaatcatgaacatgctgagaccgtacacgaggggaacatgaattccaatcatcaacatgttgagagtgcacacgaggggaacatgaatgccaatcatgaacatgctgagaccgtacacgaggggaacatgaatgccaatcatgaacatgctgagaccttacacgaggggaacatgaatgccaatcatgaacatgctgagactgttcacgagggaaacatgaattccaatcatgaacatgctgagaccttacacgaggggaacatgaatgccaatcatgaacatgctgagaccttacacgaggggaacatgaatgccaatcatgaacatgctgagattgttcacgagggaaacatgaattccaatcatcaacatgctgagaccgtacacgaggggaacatgaatgccaatcatgaacatgctgagaccttacacgaggggaacatgaatgccaatcatngacatgctgagactggtcacgagggaaacatgaattccnatcatgaacatgctgagacc

SEQ ID NO: 3141 - DNA, 3144 bp, Heterodera glycines
cgaggggaacatgaatgccaatcatgaacatgctgagaccgtacacgaggggaacatgaatgccaatcatgaacatgctgagaccttacacgaggggaacatgaatgccaatcatgaacatgctgagactgttcacgagggaaacatgaattccaatcatgaacatgctgagaccttacacgaggggaacatgaatgccaatcatgaacatgctgagaccttacacgaggggaacatgaatgccaatcatgaacatgctgagattgttcacgagggaaacatgaattccaatcatcaacatgctgagaccgtacacgaggggaacatgaatgccaatcatgaacatgctgagaccttacacgaggggaacatgaatgccaatcatgaacatgctgagactgttcacgagggaaacatgaattccaatcatgaacatgctgagaccttacacgaggagaacatgaattccaatcatgaacatgctgagaccgtacacgaggggaacatgaatgccaatcatgaacatgctgagattgttcacgagggaaacatgaattccaatcatcaacatgctgagaccgtacacgaggggaacatgaatgccaatcatgaacatgctgagatagttcacgagggaaacatgaattccaatcatcaacatgttgagactgcacacgaggggaacatgaatgccaatcatgaacatgctgagaccgtacacgaggggaacatgaatgccaatcatgaacatgctgagaccgtacacgaggggaacatgaatgccaatcatgaatgaaaatgagtgacgttgcgcgacaagaaaaagatcatgtaaatggtcggcacaatcacaaggatatttcgctgattgtatatttcttgttttatattagtgatcagtttttagtcatcgggatagattgcatttatcgacgattatctcttttttcctattttatctaatttatgttacttttgttcgtgttttatacctctttatttgtaaattatggacatttaaccgttactttttaacattggatgaggaaaacaattttacttaaattgtttttcgtgtattttttacaaggaactaactttaaaggagttttccctaattagaaaactaattacttatttgacgcaaaccatctgcttgggtggtgttatttatcattaaaatatttgttttgcttgtcaccgacaggtgttattcttacaaattgcttgcttctaatgaatatggttgattaacttttgcagaagtaagtaataaaaaatcctttttggatatccaatatttgaacaatctaagaaaggctccaattaattaattgagaactaaatgtcatcataaactttttctaattaccattatttttgttatcttcgacagcagttatattttttgatttaatgaaaatttttcatttacgccaaaaactaataaataacctaaataactcagaagagttggtcgaaaaattaaaaaaaaatacaacccattgaaatggaaattttttcaaaaatttagccataaaatttatttttatctttaatattttgtttttcaactatccatatttattagaatcaaatctaacgcgttgtcaaagacagatgttattcttttttacacttttcttgcctctaatgattctggttgattgacttttcatatttaaaaaagcctttttcttaataagcaattagtacagccttccgcatcattttttgacattttcattacgccaaaaattatttataaccgcgcttttgaaaacaggaaatctccatacattttgttttgttttgcaattaaataggaaagaagaaaaaatttaattacatttttaattataaaaagatattgaaaattatttggcgaacgtttttttgtctaaatttgtataaaaaaaacagtagttaataatgtttttatgttttgtttcataaatttggaattattatttatgtgaaattattttaattaaattttgaactgacattaaattatttcaaacttttgaataaattttttaaaaatcacttgaataattggttgaacaattaatgaaaaaaattgaaaaaattaaaattaatttgcacatttttttcaataattttatttttattttattttttgcttgagctaatcgtttttctgaaattgaaaaacaaaatttacaatattttcacttgaaaaaaatatattaaaattttttggaattttaattaatgtgatacaacctaaatacatacaaaaatttaatttttttgtctttcaataaaatctatctcttaatttgaatctccgtttataatcatgccattttgcgtgtgaaaagtgtgttcttgtccgttcatgtttcattttattcacacaaaaatcaaatttgaaaactattgaaaatgaaaactttcaactaatgcaatttcaatacaattttattgtaatgaaaatttaaatttttataaataatcccccaagggtcggtctaaatttcttcgtaaaaaatacatcccatgaaaaaatggaaattttcaataatttatccataaaatatattttttctttaacatttgatttttaaattttttacattttattaaatttaaaaaattttttattgagtttctaaaaagttagggacttataagttatgatttattatttataaaataaaattaaaaaataataattaaatttaaatatttctatcattgatacttttcaaaattcgcctcactactggaaaatcaaaagaatctctgtttaatcatgtcattttgcgtttcaaaaatgtgttcttgcccggtcatgtttcatttaattcacacaaatactgaaaatcaaatttgaaaataattaaactttcaagtaatgcacttttgaattaattttattctaagtaaaaaataaatttttatttaatattcttcaattaataaaaatattttattagaattaaggtgacttgttctacttttgggatttttcttggtcaataagatttttataaacccaaatttgtggattttcctatttttttttttgattaaatgcgccaaaaatatacgccaaaattgcataattataattatcattatacctttattagaatggaactgttctttttcatc

SEQ ID NO: 3142 - DNA, 2090 bp, Heterodera glycines
tatataaatgaaataaaaaaaaactaaaagttataaaataattatttttaatttttaacatataaatgtctgaacagatatataaatgacaaaaattaactgtttatttcaattatcaaagagatatattttaatttataaatcaaatttatttataaatagaaaaaaaataaaattttaatattgtaaattatatttattcaatattcattataaaggatgaattaagcgactaaattctcaaattattttttaatattaataatatttaaatttaggtgctgtatgtgccctgtatgtactccatttggaagcatttgcgcgaaaattcctgctacagactgctgttcttcatcggaatcactgacctgagcatactgtggattcttggattcctccgggcatggtttaatctgcacggatatgtgttctgctcctttccgacactgatttattttgttggcattgcgacaacatgtgaacaatatatataattaaagagttatcgaagcgctttattcaaaatcccggtgtttgaatttttttttctgtccaaaaaatgccaaattccgatgaatggtttgcggcatttttagtgatatgatttattattctgaaattttttcacctctattttttcatgatctagcttggctcaatttaaaattttggggctttttaacatttaaaaaattgagagacttgttttatgatcgattttctggaatattaaatgtcttcacaaaaaatattaatatccatacaataaataaatatttggtataattcgtgaatttcgatgaataattaattccattcatttttctattttagcgctttggatggctgaaagcactgctgatttggtaggaataattaacatacaattattaaacaatgaacaaattctcaaaaaggaattattaatatttagtctgacacattgtaattttatcatttaaataatttatatttttaattttattttatttaaaaatgattttttggcatttcacccccaaaaggttttggcattcaatcgctgtgttgacttcttctcaccccattattcgcgacttttgttcagtggccatcgaacattgttttggaatggcgcctgcgccgcctacgcattatattgggcaattttcctcaaaccgggcatctacagtagcgtttattttggctcctttttcaacccattcatgggctaccgtaacgatgaacaaattgaggttgacaccagaaaaaataggaaattttaggagaatttttgcaaaataaaaagttataaaacacattttgcgggaaactttcttgaaaaaataaaaaatttttttattttttttattttaatttatttccctatggcattgaccgaatggaatcccgagaataatttaattaaaaacatcctcccattctccaatattcttttttgttcgataacagcatatttcttaaaacaaaaaaaaatgcaaaaaaaaggaaatattatttaaaaaatttatttttcacatggaaaaataaattttttttaaatgtgaattttcttctagggaaaatcccggtttaattacgcgatttttttttatttttacaataaatagggtaaagcgaaatgcgtaattgaaaatgcgatataaaaaaagagcgaagtaattcggcaaatccctttgtccatacaatacttctatttttttgtaccgattacagtaccaaccggtgttgcacattttccacaacactacggtggcagtgctaagcccgagcatttatctggtctttatcataaaactgttgtacgacatacaaataaatcgcagacagctgagtgctgttgtcaccgaattgagcgctgtgcagagaaaggtggtatatgattggatttttttagattttccaattttttaagttttggaataatttaatgatttttaggtatgaaataaaaattttctgtaattcttttaatctaagtcttcgattaatttattgttggttgcttttaaattttatatttataaagatttttatgatcaagggaaatttttatttttaattaaaatattgattggtttcccaactaa

SEQ ID NO: 3143 - DNA, 1615 bp, Heterodera glycines
  misc_feature (1475)..(1475): n is a, c, g, or t
  misc_feature (1477)..(1477): n is a, c, g, or t
  misc_feature (1486)..(1486): n is a, c, g, or t
  misc_feature (1518)..(1518): n is a, c, g, or t
ttttttctcgatcctttttgagttatgaaaatcacgcccatattcaaatgatgtgcttttttaataaataattccgataaacttttttcatctattattgtaagcaggtcatctagtattaaaagcagcggtttcttaatggagtggagtaattcatcactgggtggccctttattaactcgaaagcccattttttgtagaattggaatactgtcattaaattgaccataacaatagagcaccgatttagggattgggttgatcaattcatctctttctctcaaaaattttagtaaaaacgttgttttaccgctactagacggtccactaattaccatgccaaacggcatttttaattttaattcgtttaaatcgaaggctgtatcctcagtcattttattttattattattaggttaactgacattacaaattctttaaatacgagattaatgaggattctttgtgtgtttgttatagatatctgtttgcatcatattgtactttacgcatcctgggcacatcacttgggtaaagtggaattcgctatctcccatcagtttgaattggtccttgtgcttgtaattgagtcgacgacatccagggcagagaaagttgatcacggcaaactttgggcgggccaatttccagaagaagcgctgctgatccagtaaggttggctttgatgattttttatcagcttttccagctttctcaatgggtttttcgctgctttgaagttccgccgtagacatttcgctaattgattttttggatgggacggaggaagacatttcgaaatttttgaataccaaacataagtattgactccttaaatacacattgggcccctatcatttctactgaccacatcaaatttgtagacggccaatatgactgctggaaatttgactcttgactatgaatatgactcggaaaagagatttgaacatttgcaaggaatggtgatgctgatagttctttactcagttttcttattgtttttatgtttttcatatctacgacactttttgtatgaataatcaccatttattgataaaataaatcacgaaaaaattggactacaatttaaatccaaaatcacgtacaataaaattttctgatacaattcctttggtcacaacgggacggtatcgcttcgaaatgcttacagattgcactgctccttcacgaatattggggcgaagctggtttggatagtcaattattatttcttcaaaagcatcttcttcttcttctgcagtggcataccgtaaaacggcttgtttgaatgtgttgaagtgtagtaggcggcacgcgtcggcggacaatgtaattcctctaactttcaaaacagtgtcttcggctcccgttcttttgctccgcattctcagcgcgtactgcttacatcctccactcacaaattccaaaagttcatgcccgggatattcggtctgagaggtcgcccaggtgcgngnccagttgtncatggacatccgtcttaataaacccttataantttatttttttattagttttttaccggtctcctatacgcaaaacacgtgtccccgtgtcgggtagataaataaggaatttgggcacggactacgcgt

SEQ ID NO: 3144 - DNA, 3625 bp, Heterodera glycines
ccagcctcgctctttgtcgttgttgtggggacattggtagcccggaaaaacgcctccctctgggtgttgctgggcacacgtacggcaaagcggaaacagtagtcgttggtcgaatttggcggggagaacagggacgtcaacccttcgtggcggaaccacgaagactttgagaatgccgaggatggggacgtctgtagggcggcgccagtcgacaattgagtcatctccctgcatgatgtggacggctgtagggtgtccaattgggtaggacgtgacggcagtcgtataggggtagagggagcgcacgtcgtaatactttattttccaactgaaaatattattttttttttattatattacatttacaaaaaatcaacgcacccctctggcactttgtagcgaagacgaagaggggccacgcgcccaccgtgataacagtccttcagattgataggccctttgtccacatagctgttgaacgactccctcattcgctgatcccgcttcagcatttcactaatttcgcactcccagaagactttaacttcccggcatcttccgctaataaactgtaggcgctgcgcgtcgtcttctcggattttctgggccgtctttccgtttggcatgactgcttgtggatcaaatcggtgatgaggagcagaacacgcatgccaaacgcatccattcacttcaatgaccgtgtccgtctcagcaatataactaagaacaaataaataatttaagggcaaattattgtaaaaaaatatattacccgtccaccgtgtatcgcccaaactgcttttcgccacaacgtgaataagccgtttggatttggacgccatgctcttccgcgtaccattccatgaatttcagcgccagaagactttggttgtttgctgagtcatagccgcgctccggaacaatggcgagttgctccttcttcaaatgattcatttgaaaatgctgcatggatgcgctggcgatagtcattggaccgttgacgatgtcgattccgttgttcccagccaaatcaattgcgtcttcctcatcctcctcctctgcgtcttcttcggcgttgtggttttcaattggatccgtaacagccaaaaactctgcccgaaaggcaatcagtgcctcgatcaaaatccgtgtgtcgttagtgcagtaagaagcaagttgttcacaaaggttgaagggggcattgcagtgctcgttgtaccatccatcaaaacggcgctgcttctcggaagtcattccattgtatatgtagtcctcttttggggggcagatggggcagagtgttgttgtagttttgcacggtgttgaaaagatgcggaaagaactccttgtcttgtacttgtagtccgaatgccccgggtaaactgccgagcgccactggcatgaggttgaagctatcgcggatggaaatttccgggctgtttgtcgtgcgcccaatcttcatttcgtacattttgttgccttttctgaccatttctggacatattccgaagttgaagaattcgcggaaaaggatgacgttatcgaatctgccaccaaagtgcgagaaaatagacgatggatacctgatttaattagcaaattattaaaaattagttaggaaaatcttaatcactttttatcaaatcccgagagaagccactgcgcaaattctgtcatctgtgattcgcacacacgcattgagtccacttgagtgttgttgaaggcacggtgtgagaacgtgatggtgcggaattcaccgcaaattttgcatgccgtacggccggacagtgattgacgccaagtgtttcctttgatgcaaattgaacaggccacgtgggctgagacaaagttgacgatgtgtgcacgtttgtttgggccaataatggtgtttgcgttgtttcgcagtcgaaggcgatgagacggaatgccttgggatgcttcggcttgagtttcttgatgaaacaaccccgccccttgtcatggtaattgcggcaagtccaacagaatttctcctcgcatacgtgtccctttcttccgtcacgggtattccgttcaaagtcccacaagacaccgcacttcttgcactttttcgatttggtacagtaattagatgtgaggtggtgttgatagcattcacaaaggaaggtcctagggtgtccgtgggatttcagaatgaaatttggtcagtggatagagcacccatgggttcttaagaaaagtgattttattttttgcggaatgagcccgagtgccgagttattccgtgccaaagtttttggtttttttctaattaaggaaaagaaataattgtttgtttactttccaagtgtctaatggtgtagaggtagtgtgttagtcaatcttttttttgggtcccaggttcgaatcctgtgcatgctaatacattttacaatttttattttttctttttatgcataattaattattaaaaatattttttatgaaacaaaatcttttatgcattttaattttattcaattaaaatttaaaaaataaattaaatataaagatgaactaaatatcatgtcgatttgagaaaaaagttttctaattttttatataaattatgcaattaatgaaatgtaaatattttattcactaaacaaaattacgaaataagtcattatcattttttgaataatttaaatatttatagaatagcaaaaaaaaaaaattaataacttaaaaccatatttttattgtttgaattggattgaaactgattgttaaaaatagcataaaaagcttcaccacgtcatgtgactctaggaaagagcccaagattgaaatatttacaaaataaatgcataaaaataaagcaaagaaattaccgaaaaaagaatgtgataatcctttcaaattgtcattcctttcaaattgtcatctcctctcctaatcgatggcaaagagaacggcggcaaatttttcccctcccatggacaacaccgccccaaaaaaattcttgacttcccttgaccaacttcaaattccccccgaaattgacaacgacagcgccattcccgactatgcaaaactgcttattaagcagttgcactcgctgctggccaccgcgtcgtctctggttcaatctcaagtagcggcaactgacgcgattgaggaggaccgccgacaacgaaccgttgtcatcaccaatgtgccggagttccaatctgggaaagcgtcggagcgtggggaggcggacagtgcactggtcaatttgattttggacactgtggacctcgaccaaaccccaatggtgttccgggtcggcatgcgaacgcccaacagagcgagaccgctcaaaatggaatttcccacaaagcatgcggcgcggcaggtgctcagaatgaagggcaaggctttgtcgttgaatgctctacatggtgcgcgcatcagagaaagcatgaccaaggagcaattggccgaacgccggaaactaattgaggagtgcgcaaagaaaagaaaagaagatgcgggagattggattgtctacgcaaatcaggtcatcctgcgcagcgaaattgacacaattcgtaaaaagaatttttaaattttcatgccaaatcacaaaaaactaaaataaattttttacaaaaatttttcc

SEQ ID NO: 3145 - DNA, 2824 bp, Heterodera glycines
  misc_feature (19)..(19): n is a, c, g, or t
  misc_feature (62)..(62): n is a, c, g, or t
  misc_feature (69)..(69): n is a, c, g, or t
  misc_feature (80)..(80): n is a, c, g, or t
  misc_feature (93)..(93): n is a, c, g, or t
  misc_feature (108)..(108): n is a, c, g, or t
ttttcaaaagagtttttcntctcaataattcacattaatcagagtaagctctataatattanaagggtntaataatactntaaaatattcatntattttaggtatttnttaaataaaaaaatttattatttatataagaaatttttgtattaaatatatgtttcttttatataagtaacttacgtaggagattgcaaaatcaatattatctaattaaaattaatatattcatattttctctcaatggctaaaatttgtttcattttctgaagaaatattattaatgatttttcaaagtatcaattttatttaattgttttttattaaaatattcagtttcttagtcgacctcgtaaaataaaaatgttgtagaaatatttaggttttagttttttaaataattatattttaaaatatgaagcactgttttaatttttgttcttatttttattattttgcccacattttattaataaaaatatatttattttatttgttgcattaattatataatttgacttaattggattaaatatgtgctctattattcaagtactcacgtctcatccgacacaagggtgaacttaatcggcttcgtatgaataaaaatatttttaatttatttcctctaatggtaatttattaatttatttatgaatcaattttaataaattatttatttgtttgaaaaggattaatcattggaatatttattgtttcgaattatttgccacattttctacttttatattaaattattttagttttcattttcatttaaacagttcgcaatcagtttttttaatttttattgttcgatttagatttataattttaatcgaatgcatcttttttaattcatattcttattttattattttgttcatattttgtaataaaataattattttatttattatgtattaattatataatatttaaatttcttgttgttttgatgaatgatattaatgataaatttaaagtaaatgaatttcttttctttttttttgctgataaaatggctttaaattaagttaattataaaattagatttaattggattaaatatttgtttctttatccaagtaactcgcagtgtcctcgctcacaaggggaacaacttcgtcggccttatatgaataaaatatttttaatttatttcctctaattaaaagttctttttttataaatttattttaataaaatatttatagtttgaaaatgattaataatctcattagaatatttattgtttttataaagttaattattttattttttcaacattcatttaatcgagtttgcaatcaatattttattattaatatttattgtgcgttggctaattatatatttttagcttaataacttaataatatgtcctacattaaaagattgttagtcaattttattttagtcgtattcattattttatcatttaatctctttggatttgttaatttattgcctattaaatttttgaataatttttcttattttttctacacgttgtttttccttcatttaattatttgcttattcaaattaagaaatcctttctcgagatattttctaattatttgtaataaatccgaataaatggacgaattttgggagggaatttttaaatgaaaatgaatggggtgaggagacgatggagcaattggagaaggggggggggggggggaattaacggacaaacagtgaaaaagtcaattaaaatgaatgcaaaatgaccgcccaaatgtattttttgaaatttaatttgcagatggtgcaaagaaatgacgacttaaaaaggcagtgaaaagagatcaaagattttatgaattttcccctcaaattttgccaaattttgttttttcaaaattataaggcacccttaagaaaatacaagaactttttattcaaggacaacataaaaatctgttaagctaatatatcgatgttaataaaaaaaagtaaattcaccacaatgattagattaactttttaaccttttcattttatgaaccgtctatttctattcgtttttaatgtgctttttgaccgttttttgcctattttagtcaatgtccattctctggtgatagaatgattatcctatatatttttcttggaaattgccaggacttgcccatggaaaccaaaaggattcttagaaaaatgcggaaattggtgattaagggccgaaataggtttttagatgccatacatatacgcaaaaaaaacaattttatgacgtttaaaactcgctaaaataattaaaaatttgggtgcacaaaattttgggcaatcctaaagaatgggggtccctaagtttaactctttttttaaattttgtgctcaaaaccagtttaaaagggctttcgagggtgctgattacgaacctaaactcggatttgcccaattccgaactcggacccgaattcgaacaaaaacgtaaccattgtttaatctttctaaggagtcttaaccacacaactcaagttgtggataacgtaaatttattttgcaatttaaattgtaaaataaataaatgaattttttctaggctaatttacatgcagaaatagaacatgacttttatttttgtctgtgatgtaaattctaacatattagttttatttcattaaagaaatatgcacacgcccaaccgttaaaaatagttcactgatttaaaataatttgaaaaattcataagtatttatgaatccgtttttaaatataaaatttttaacctatttttaacaaaaaaactgagaaatggttagaacatttttggagaagaaataagcaatcgaatagaattaaaatcgtt

SEQ ID NO: 3146 - DNA, 3359 bp, Heterodera glycines
tcagtttttatgataaataaaaataaattaggtgttctaaaagatttagattattttattatttttgaagtttataaaaataaagttaataaaaaatttaaattaaaaaaagttattttcactgaaaagaaatatatattaaggctaaataaagctttataacaccgaaaatgctatttttaaatattttaataaaaagccttaaaaagaaaattatataaaaaaatattgttttatatatagtataggaaaattcaattctatttataatttttttaaatcaataaacattttttcaatagcagtcataaaagacgatttttttactacttttcatttttatcaaatgttttttatatcattaaatatgttaaaaaataaataattagaatcattttgtttcatatataatattgctactttaaaataattattttttatctcgtcgccaaactctttactgtaaaatattaaacgagtttttgttatatttcgctacttattttcatttatgttcaacaggtaataaataataaatgaatattctctcatttactgatgctcttgaattgcaacggcagcttttgtggctggcttcaaaaatcttttttttcttcttaattaagaatttttatttatatattacggataatattttttgaatattttatatgatatttcaaaaaatataattttttaaaatatgcctcgctcagagataattattaaaataatatttactgtgtttccatgttatttctttaaatttaactcttagtgtgcttcttttcttaattgccttagcgaaaaaattttgatatcaacgattttttattcatatgattgatatatttttatgtttatttgttattgatatgtttttatgtttatttgttaatctttgatttttttttattaaattaacataatattttgagtacaaagcttgccatttaattttttgcctttaataaattgcttttaatcagctgatttaaataaaaaaaattttcgtaagggatttatttattaattacttcataagatgaggggttttattttatataaaaaaagagtccattaattatttaaaattcgacctttgaagaatttaaccgtgtgaaagaaaaataaattaatagacaattattagttttattatcaaaagaataatttaataagcttaaattatcctgtataatgcgaaatcacaccaatttttaatattttaaaaaagtaaaaaataaataatgaggaaaaatggttttaaaaaaataaaattaatattccataaaaatagagatgttaattaatgaattgtataatatcgaattttgtttaaaaaaataatgatttttcaaatgtaaaccttcctttgaaattttcatcggcggcgcgcgaaaaatgaaagcatataatttattgaaaatttaactttttaaaatcttgttcgccaatttcgatgtttactttttctcgtaacgacgccaatattcgttttttggcttttttactattttaaaaatcaatttttttcaatttcatcagaaagaaaagtttggttttaaatttatttgcacacttttttcggggttaaatagtatttttaatttttttttacattttcattgtttcatataatttttttatttacagccagtttttataattttaattttaattaatgtttgtcagctaaaagttttaaaaattcaaatagcttaaatctttttattttttatgctattttttaaacatttttatattatgcattttattttttgttatggatctgcattaaagcttgcatttttataaattaatattattttattgtttttctactttattattagcttttctttatattcttgatcaaactcaaatttattcatttttaaatcacgggcaactccagtattttttcatacatattattgcagcattcggttacattattttttatcgattttaaattttaaatataattaaaagtttggtaatatagtttaatttgttttttcgcttatgaattattaaattttatttactaaatttttcattagttttatttaattattagtctttttatttgatttattttctgttatgatttattaatttaattaaatatttaatatttagtgaatttttatattgtcttacgtcaaaaaaactactttttataaaataataaaatttacattttaaaatattttgtaaaaattttctttcttgcattttgttttattttttaatttgaattttagaaatgtaataagaattttgaataaataataatattgaaatttcaataccattaagttgtgcatttttgtgtagtttcattattttttaggtaatattaatcgattttaatggatccaatttagtcaatcgaaatttctgtttcatactataaattataatgtttgtaaacattatcaacaaaattaaattaaattatttattttagaggttattttaaactatttgttaaaattttacagatatatttgtataaagcttttttcaaattacttctctttctgctagaattgctgatagtgctgctgtggtttagctataaaattttgtttttatttttttgttattttactttggcccactgttctcagatttataagcgataaataattcaataaattaaagttcatttatcaataatagtctattttacgaataataaaatattattaattaaaaaattattattttatataggtaaaaaataattttttttaatttttataattcaaaacctattctttaacgatttaatttaatgaatattaatttcaagcatttctttcaataaattatcatttttttcgaaatataaatatttatatttttaataatatccgggtattcttaataaagttgaaatatttcctaaataaattattaattttatttagaatatttttacgataataattttcataaacatgtgctcatattgaactttgtgcaaagcatttgttcggctacttttcaaattataatttttaaatatgcattatttgaattttatgttatttttttgttgcttttgaagaattaaattctattaataattttttataaatatattttgttctttgtttattgtttaatttttgtaaattttagctgttttattaatgaggaagagtttaaacaaattacctaattaacatcatgaagctatagaactcgtcaaatatttgttctttttaaatttatcttgaaatataatgttataaaataaatttaattataattaattcagtgacacgttctatataattaaaattaattatttaagtattcactgagtttttttgtggatcgac

SEQ ID NO: 3147 - DNA, 4544 bp, Heterodera glycines
atccttatataaaagagccctaagagaaccttccaccgtttcggtcaacatttcctagtttgatgcattattcttgcattatcccccccccccccccaaaaaattatagtcattttataaagaaaagttgatattatttttcgtttgttttcttctacttattttcgggatgataaatgtctcaatcgattttcttggggaatgttttgcaccattgactgaggatttataggcagaaaaggttaatggaatttaaaaacaataatatttcattggtaagaaagcataattttaaacaggtcgaattatatcttattacatcggcctgcacttagacggagttgtatgccttttttctgctttctgataataagagagctctaaaaacacatattaaataaagaaccataaataattcgttgactaaaaccaatccttatataaaagagccctaagagcaaccttccagagttccgatcaacatttcctagtttgatgcattattcttgcattatcccccccccaaaaaattatagtcattttataaagaaaagttgatattatttttcgtttgttttcttctacttattttcgggatgataaatgtctcaatcgattttcttggggaatgttttgcaccattgactgaggatttataggcagaaaaggttaatcgaatttaaaaacaataatatttcattggtaagaaagcataattttaaacaggtcgaattatatttcaattttccatacggagttattttgattacgacttttttagaggtaaatttaatatattttttttactaatttttgaaatttagcctttcaatgccacattatttatatctgcttaatgtataaaagagaaaaaaagataataataaatttttttaaaatggttcaaaaaacagaaaaaggaacagcaattttgctggagacatctaaaaaagaggcagaaagggcatggaaggaagtcatgctactggcagacgaagcggctgattacgctaaatctgcccgtggagcccttaatcgggcaattaaatcccgagaaaaggccccctatgcccccggtgttcgagaattgttgtgtctgaccaacacttataccaaaactagagcaaattaggatggggttttttggacaaggtttatttagacaaaaataagttaaattggttaaatgatcgtttcagtcaaaaaggtgaatgaaaattgagaagagaaaaagaagtcccaatggtgtccaatgagttgcttatatacgggtcgggagcagatcgggaaaagggttttggggaaggaaaacacaagagacaaaaaggattagagcgaagaatagtcggcacatcaaaatagacaaagagaatgttttgggggaaatgccagagggaatggacgaagggattagtttggaataacggattcaacatcaaagggaagagagagagaaagcagatcattgtaaagggaataaattggggaaaaggccaaaagcaaaaatgccgatcaaaacaaggcaaaacagattcaacacttcctccccccttccgtgaattccaaccgatcagcgaccatacggacgaaagcgactgtgatgtccagagcaatcagcacaacgacaactgccggatgaattggacggaccaccgctgcagctcccacggcgacgcatgttgaagaagcggcgggcttgcgctttggtctccgcatttgcatagccatagccaccgtgacgatgcccatcataattttgattccaatgaggcattctatgattccctcggtggcctccgcgattgaagcgaccgcgggcatgtgagccgcgacaatgagctgccggattgttgtgagggttctgagcgccctggggttggtccgattcattttcctcatttggttctcccctattcacctcctccgggggttgaggaccccccttttcctcctccatttcattcttttccggcccatccttgagggacaaattttcgaaaactcctcgggcctccatctcttcgagtgcatccgcaatgctcacgacgcttttggcaatgtctccaatgcttgggagtagctcagctttcaactctttgattgcctcacggacaatctctctcacggcatccctggtcacggcatgttcggtctgcacctccggcaatgtgaccgggctttttttgacagtgcgcggcttggaattctctttctctgcctgattctctccaaaaagtgtgtccagcggaacggcagacattttgatttagggcggaaatggacagtgcttagtggaatttgggaaataaaggaacaaatgtgaacaaaaaaaaagaagaaaaatacaaatttacaaacaggaaaaaggggtattagcggaaaagaaaattttagcaatgaaaataaaaaaaaataaaaaagagatgaaaaaaaaaggaaataagtccgatgaaatttgcacttgtcatatgtggcgagaaaccaactttcgcctttttataaggtcgctatgcgcgactctttctccgcccccttccatttccgctttccataagcgctcccccattggctgcaaaaggatggacggtatccatttcttcgtcgcctggtctcggacccacaccgcatctcctggataaaactcatttctggattgtacctcttttgtcggcacatgtgccattggctcaagtgccttaggattttctgacaatgatccttttctgttctttcccattggcggcataatttttatcttatccatttctgtcctcatttctctttttaagaacttttgcgccggggtttcgcctcccaacatttggcatggggtggagcggtattcctgtagaaggataaattgggcgagttgcagtgttttacccgaatccaacagttttttgatcccctctttgaatgtcctaacaaaacgttcggcctccccgtttgatggtgggtggtatgggggtgatgtgagatggttaattccttcttcggacaaaaatatattaaactcagccgacacaaattgtggcccattatccgataccaaagtccgaggtgaaccaaaaacggcaaatatttcacgatatgcagtaattagtgccgatgaatttgtcgaattcatttgatggacgaaaggaaatttagaataggcatcgactgttatcaaaaagttggttccccaaatcggaccggccaagtcaacatggaccctctcgaagggatactttgcctcaggccatttatactcgggacatgaacgtggcggggcgggggcatttctttgacagatttcacattctcccgtaaattcctcaatatcttcggaaatttttggccaccatacgaatcgccgagctttagcttttcctttcaccatcccaaaatgtgctttatgaactaattttaaaattggcacttttaacacgtccggtataacgatttgtccttggggatgtttccttatcaaattcccttccaaataaaggctatctctgtttttgaaaaagggttccaattcattttctattggttccacccaattgtcctttattttggccattatttttgacaatgttttgtcattttttgtttccttttccaccttttctcggtccaaattaaattcctccagcgtcaagaaatatgggatttcttctttaaattttatctcgatactttcccattttatcggcacccttgatagtgcatcagccactttgttagccctgccctccaaatagaccacttttggttcgaactcctgtaatgccattagccatcgatttattttggggttaatgctggccttttggaaaagaaatgtgagtggcctatgatcagttaagattattaattctgccccatacaaaattggcctaaaattttgaattgcattcacaatggctgccaattctccgtgtgttgctggtaatttgctttcggttgccgaaagtgtacgggaccaatatgcaattgcatatagttctttcccatcaactgattgcatgagggccgctccgtaggcaactgccgaggcatccgtgaaaaggtaaaaggccaaattgtaatttggtgcccttaggcacggcgacttcaataagtgctttttcagctcactcatagcactctcttcagcctgtccccactcaatttttaattggtttcctctagtgaggctatttaatgggtgggcgattgtcgcaaagtttggaataaattttctgaaaaaagataccatccccaaaaatcttttcacttctttaacatttttcggctgaggaaatttctcgataacttctcggttattgagcgatggctgataacctatttctgataggatatgtcccaaataaacacatttcctttggaatagcttacacttctcagcttttagcttgaggccatttttctgtaggcgaacaaagacactactcaaactctccaaatgctcctccaaagtctctgtatgaatcaaaatgtcgtctatataaactggtacattagcaatgcccctcagaattttatccatggtcctctgg

SEQ ID NO: 3148 - DNA, 3713 bp, Heterodera glycines
tgtaaagcttttccctaattactccgacttccaacattttgtctatgtgggaccttaattcctgcttgtacttttccgggaccgggtacggttttacttgggctggaatttcagtggttgttaagagcatgggcgcgcttattttgcatgttcccaaatcatattcatgactcgaaaaaactttttcattttcatttaggcattttctgatttcggcaatttctttttgctcttttatgtcaacgtttttcaaaattttcttagaaatttcgcctttatcctcattcgaattttcctcgcaatttaggacattttgttccatttttctcactaaatcacccgtttgaaggtccaaaagaaatggcaattttcggaaggtatttcgcccaataatgaagtcgtatgtccctcttccaatttctctttcaatcactgaaagcaccgttgtcaccgtatacccagcgatgcacagccttatttcactttgcccaattatcggtactgtactctctccaattcccacaattccggccacttccggggaattaagcttatttattccgaattttaatgccacttttgcacaacctaacgtgacatgtgcacctgaatccattagtgattttgacggtttgccatttactgttcctccaattctaaaatttgagtcgcatttgtcatcgtttactatggccatcaaaacggctggttgcatctccgcatctgcttcaattacttggtccgtaaattttacccttcttccatcactctttagcttaatttgcggcgtgtcctccgggcttggccaccgctgcatcaatggaacggccattggaattccttcaatcatttcgtctctcactttcacactccctttttctccccttatttttccattttcccttatcttccttttctgccaaattcctgagaagatgctgagaaatagccatccaaaattcaaatactttagaccttcagcaatttttaatggcagaaagaattgcatcaaaaatgtgatgctaatataacaacaacagagaaacacccataattggtttaagctaaaaatgcctccccttaaaaatgcaaataatccattggccactattccactagtcattctgtgggtgtgttcagacatcccctcccaggagcttggttttgatattcgagtaatttcacgcattattttggctccttccagtgtttcattaaattgctctggggaaaataattcagaaaaatttgaaagtactctgtttctgaacaagggaaagttcatttcaggaatgtctattttcccgtgtctcgacattttctgaattgcgtccgctggtatttgcctcatttcaccagttttctggtcatatcggatgagtgtgccacgggtatcaatgtaaatgtagcgcatttcgtcacaattcgcctcctttgatttatggtgaattataagagtatttgggtcaagaaatccgtgtttttgtttcccgtacaaatcaaattttattggcaaaaactcaaaacaatggccctcctgccaatgaaaatgaattccgacttcatagacagggtaacaaggcttaacctccaaaattttttcggtcaccaaacgcgcggacacaaatgggtttccgagaaaataacgcgccaaaagtgaaggattagcaattgacaacgtcaaggcctgctcagccattatttgtaaactggtacagattttccgaattgtctcagtgaaaaggcgttgtgtattttgcgcaatttttgtgcttaaagccgtaagctgagcggctaactgcgttgagtaaaccggaccaatttgtgcctcccttttaccccttttccaatttatttcttgtgatttttgtatcattttgtcaaattcaatgaccgtaatggcaaatgcttgatcagatagggttaatcctccaccgctctccggatagcagccgggatggttgtgaaaagttttgttttcaaatgtgagcgcaaaatcaccgctttgagttgtccaaattaatgttgaatattcgcctgcccattttgaaagccaaacataaggacattggtgggtacggtcggggttccaaattaagctgtttttggtacaacaacaagctcccgatttgtaagagcagccagggcactctccgattggggtgtttaagccatccatcccataatgagtgaaaaccacagtgtcatagacaaaacaatttataatttcttcagtacgccaaaataaatttacgggccaaaatccccatccgatttccagtgaattagttgtggactttaaagttccatttatcaactgcaattcgccagctttcgattgtctttcgttactcattctcctacactcaggcgtcgaaacggggtcattgattggaacgatttcctcatattttgcaccaaaaattccgacttttcttgaaattttcgttttaatgcagctgcacgccgtcgcctccgttttgtattgcactgtattttgacggtaaatatttaattcgaacgggatcgggatttgcgtgggagcccaattagggcatattgtttcggtcggcagtgaccaaatactgattggggcatccagtaggcagatcataggcttagtgatgggtaccgcagcaaatgcattaccaaaaatggcaaaaattgccattaaggcaagcagtattggacttgccattctaaccggagccatacctcccctgcgaaattggaccctgggggatcgggatctgttctgattttcctcactaccattataccgagtctcatagccaaagttttgtctccccctgtttctgtccattggagttggggggcgatttcgctgccaatcatttcggtaccggaaatttcctctaccctcctcacggtaacccctctcaaaattacggttatctctccgatcattggcataaaaattccggtttcctctcgcctgtttgccttcatcatttttcttttttcggcattcacgcactaaatgcccttggcggtgacagtaataacaaatcctcctttctgtaccttttgaatgatgtgcactttgctgttgaaatgccagagcctcaactttattggtgagttcggcaaccgagacttgagttgctcttttactggccaacagcagctcaaaatgttgggccaactcataagcccgagaataatcagctggtctccctgatttcacctcaaattgcaggtcaggggttaggcggtctaaaaactcttccaataaccgcttttgtacaaccgtctcattttctcccgcgagtactgtccttacagcttcgcttagcctattggcaaattcataaactcgttctccgggtgcttgtttgcaaattgacattgcctgcctggctattgaccttgtgttttcgttttcaaatttgccttttaaaaaggtcagtgccgcctccaaattttccggggctggggtcatcgcttctaactctcccctagcttgtcctgctaagctcacccttaaacggcttaatttttgaggctccgttaattatggacataataaaagtaagtcctgaaactttgcggaccatcgcgagaaagacatggttgggtttccgtcgtatacaccggggtgcgcaacagtcatgagaaatgggtctgccatcattacctcacaactcatttctccttccccattttggcccatttcttcgttcccattttcc

SEQ ID NO: 3149 - DNA, 3627 bp, Heterodera glycines
  misc_feature (13)..(13): n is a, c, g, or t
aatgaacgtaaanattcaattggaggtagagtatatccgtacatatttctcctgttttataatttcattggttacagcaaaatcaaaaattcccgtgacgaatacatccgccgtctgaattccatgtatcagaccaacttggaaaatgtctgtatttaaaagatttgtttcaaaaacattttcccaataaattgtgctttagtccaaggtggaaatagtccgtggacgggccaaattcaacaaagacggctctgtcgaagtctccagaagtgatggctcaaaagagacatgtcagggtacgcacacactgatcgcagtcggcggtgcgccgcggattccgaaggacgtgccgggcgccaagtatggcacgagcagtgatggattttttggctttgagcaaatgcccaagtgagtgaaagagtggaaaatcgaagatcagacatactgattcatcattggggtgatgtaacacattttgcaattttctcggttagtaaaaccgtcgtggttggtgccggatacattgcagtcgaattggcatcaattttggctgaccttggctctgaaacccatctgctgatccgttatgatcgtgttctgcgcaattttgacgacacaatgtcccaggcattgaccgatgcgctcatcgctggaccagttaatctcaaacagaaaacgctggtatgtgttggaaatgaaggcccgcccatcagggaattgtgatccccaggattctattacctgggattaatttttcaattaaatcttgctgaacaactttttccaggtgtccaaagttgagcgttcagaaacgaccggcaaactgactgtccatatgacggacgaaagcaaattggaggatgtagacaaactgatttgggcaattggacgtgaccctttgacagctgagctgaacttggccgatgttggggtcaagctaatagctggcgactacatcaaagtggacgattaccaaaacacgaccaaggagggcatttacgcggttggcgacgtctgcacaccgaaattcgaactgacgccaggtacaacaataaggggaaaatttgaggagatgcaggccaaaaatccagggaaaccgaatcaccgaatctgaaaaaaccgaatggcagaagtgaacatggatactgtcctttcggatattgaatttgagtcattaaaattgtcggatattctatgccagacatggcattgttctcaattccctctattcattgtcagttgcaattgccgctggtcgccgtttggcccatcgtttgttcaacaaggaagcggagaaccgtctcacctacgaaaacattcccactgttgtgtttagtcatccgccgcttgccacaacgggcctcagtgaaagtgacgaatttgaaaatttataaaagggttaatgaaagcagtctctttaccacagggcctcactttactagcatagatattagttgtttgtgttttctgattttttccaaaattttagaggaggcagtggagcgcttcgggcgtgaccaggtgaagacgtacaatgccggcttcacgaacatgtactttgccatgactcaacacaaagagaaaacccacatggttgtttccacaatcgaattcattcgaataataattttggcgttttttcccttcagaaaatcgtgtgccacggaaaggatgagaaggtttgtgcaaatggcccaaattttttcgtgacatagtcaagaattttccctttaaggtgattggattgcacattttgggcatgggtgcggacgaaatgttgcaaggcttcgctgtctgtgtgaaggcgggtcttaccaagaaagactttgacaattgtgtcgccattcacccaaccgcctcggaggaacttgtgacaatgcgctgacaatcggttgacttatttttgtttgtttttggtggtgaactgctctaatgaatttctcttatcacatggacacatagttaggttaatgaatttgcatatttattgtttaattctttgtgacaaaatgaaacactgaaatgatttaaattaaaattattttttttgaatttttgtgatgttgcgttccttaattaatcaagagattgtttcagaaacgtttattgaattacaaaaataaataaataaaaatgagaaggaaggaaaatcaattcagcgtttctcctctggtcaccgtcgactcgagaaattccacctttcgctccatcgatgtgatggtgtcattcagcgtggccaattttgccttgcaggtctcgtcgaaatgactcaaaaactcggaaatttggcggatgttgtcggatatctgaagaacggcaaatttcatgaaattcgggccgaaattccattccgatgaatctcacaatgctgttcagttcgcgattgtcccagtcctccttcatttgacgttgaatggacatggattataaacggaaatggattttgaataattattatcctaaaatgaattattaaacacagcggcccaattttgtgctctcagtgcatataggtttattatttatttagtaatcagaacgccaaaactttgcaaaacttaaaattttttggggattttcccttgtaaaaatagaagagccgatctcgagttaaaaactagacagctaaaaaataaactgtgattcgctagagggggccaaaatatgggcctatacaaaatttcaaaaaaaagttacccacaggaaaaaattttttcccagggcaaaaatttcaataattttaattcttttttagccaagtccacaatttaaggccaaaccaaataaaatttacaatattctccagaattttcccttcaaaatgagcataaaatggttttatttgctctagtattcaccaagttataagctaaaaaaatttcataaaattgtcgatgttgtacgtaaccaacgctttttgaatatgattttttattgccacgaaaacttttattaatgaaaaaataattctgccttcttctttaaaagaagaaattgactttaaaagaagaaattgaaattaacacacaacatagggaggacttgaacctgggaccccccttttggtgactaactcacagaccactaagacgaaaaatccagcataattgtacttggagcccaaaattgggccgctgtgtaaataaaatagaaagaaaaacaaaattcaagctgaaagtacgaaaaaaaatggaaaataacaattttgatttaaaattagtaatttaagttcggcatttctcttaatgtttttgcaacgccccgcccccttcccccctcagttttgatcaataaatgttgagcacatagatagataaagccaaatgattgcttttccgcatcagacggatgcatcggatggaaaagtgtgtggtgggagggtgggggcggcgtatacacaaaaatgcatcggattttggctcaaaatcccaccgattgcttttgcttggtttggggggagggaggctaacaatgagcagaagcaacagttgttgtttccgtcgattgatgagtgtgctgtgttgccctatccgtccttcaaatgaatgcattcattcacccatccaaatgatgcagtcaatcggcggttgggagataatttgggggcggacggggcgctttccctct

SEQ ID NO: 3150 - DNA, 4689 bp, Heterodera glycines
  misc_feature (58)..(58): n is a, c, g, or t
cagcagcccaatggaaacaggaaggagctggtcagtcatcagttagaccacgaattanaatttatttcttgtaaaagttgtttcacattaaaatgatgccccattataatttcaacaattttattttttcatttttcagctgacgatggtgaaattctcatgtccgagccgggcttcccgtgccattccctgtcccaggagaattacacatgttccggctgcattcagttgcacgactcgtgcgcatggtgcatggactttgtgagttatttatttctttcgactcatacaattttatcaaacaattttatttaattttgtttttcaattttcccccttttccgcagagtttcaacaatttggcccaatattcgcgctgcgattccgcccaaattctgctcgagcacggctgtgcccctgaccaaattgtgaacccgcaaagttcgctgcgcaatttgctcaacgaaccgttcactgacgggacggaggagggcgaacacacagtccaactgaggccacaggaggtggagattcggataagaccaagtgagtcccgctgttttgggttattttttcttatctttgagcatttttattttttgccctccgtttcagagtctaaggcccgtttcaatgtccgatttcgccaaccacacgattatccggtggatctgtactatctgatggatttgtcatactcaatgaaggacgacaaggagaagctgtctcaactgggcgacctgctcggtatgcattttcacgtttttcataatatacgacaaaaaattgttttctttgcatttcctattacagctgaacggatgcgttcaatcaccaaaaactttcggctaggctttggctctttcattgacaaaaaagtgatgccatttgtcgacccgcgccgggagaaacaggtttcaacccccggggcaatcggtgccttttttggggacgaattgtgtcaaaacattgtctttttggcgggttttcaatccatttttgtattttgattggtactggatttacggcttttatgaaaataggagcagccgtgcgccgagggctgtgcgcccacctacggcttccggcaccaaatgagtttgacatcgaacacggccaaatttgccaaagaggtggacaaggcgcagatttcgggcaatttggacgcgcccgagggcggattcgacgcggttatgcaggtggatacttgattagccaacattatttggattaaagccaaggagagggtccagggattgaggaatggggctgaaaatgaccatgactaatggtcaaaccgtgaaagtcatgaatttttcgatcacgaaatgaacgaacacgggttttgattttttaaattttcaaaagtttggggcatttttacaaaaaatcatttaaatattgaaaaacctcttccaattcaccttttcacttctaggccatctcttgcaacagttccattggatggcgagagaggtcacgaaaaatgatcgttttctccaccgatgccgggttccattttgccggcgacggacgcgtaaaaaagggggagggcgtggcaatttacggggacactgataatgcccgtttaactgttaaagttggccggaatcacaacgccaaacgatggacagtgccatttggactcggatggttattatacggtgagcaaaaagaaaaaggcggagccgacccgggattttgtgtttggctagggaatgccatccataggaaatggttttttgtatgctctccatgcaaaactcactctcgagaaatttattcaacaaaaaggtagtatttaaaatttgaggaaaaatgcacaatttgttgtttttgtctgaatttgtggcgagaaaatgaacaaaaaagtgccttttgcgtttgccttacaattagcccaattcccttaaaacttctgcccgtcctccctccattctcgtgccatttgatggatatgccgtggcaaccctccgttgttttgtttattgtcattctttgcagaagtcgatagaacaagactatccgtccattgcactgctccatcagaaaatcaaagagaaaaaggcaataaaaataaagagattaaaggtttcccaatcccccgaatttgtcaggtgaatgttatttttgccgtcactcggagcaaccagcgactctaccaacaggtgagggagagagagagagagagcgtgccctcgcacaaatcaatcagacaaaagccttccattgtttttcccgatcgcttacttattgattggttcattgatttttcggcgtctcttttccccattcatttctcttccgtttcagttgaccgacgcgttgcctgacgtcagcacagcggtcggtgtgttggccaacgactcgtccaacattgtgacattgattgaggaggaatacgggaaaatcgcagaaaaaatcattatggtgagtcatctcgcatgagaccgaaacttctaccaaaaaacattgttttttcgagtccatggcgaaaataaaaaaaagcgtttcctttgctactttacatggatttcgggtgtacgatcagcgatggaataataaaatattccaaaatcctcctcccccccccccccaggtggacaatgccaacgcgtcgatgggccttcgcttgtcctaccggtccacgtgcgtggacggtcgaacgctgcaggacacgaacacgtgtgacggggtcaaagtgggcgacacggttgcgtttgaagtgacgctggaggcgctgcactgtgtgccgcaaagggacttcgtcctgcacattgggccctccgggctggaggaggtgctcacgctgtacgtgcacgtcatctgtgactgcgactgtgaggacgaggtggaagcacgcactttaataacaccacatcatcccatggcatttcaaaaagttgctcattgacagattgtttacaatgcgcccgaatgcaacggacatggcaatttggtgtgcggcatttgccaatgtgccgaaggctatgtgggcacccattgcgagtgcgaaagtggcggcgagtcggcggtggcgttggaagcgaagtgcaaaaaggacaacgacaggtgggtgtgctggtttggtttaccgcctgtggttgaatcgaactgctcgaacttgattggattatcattttagatgggccctggatttaaggtttaaggcattctatgcctaatttgaaataacgcatgcgaaataaaaacatttaaacatgagttaacagtggattagtatcgtaacaattccattcatttccctccgcccctctctttcagtttggtgtgctcaggccgtggcatatgcaaatgcggtgtctgcgaatgcttcccacgagcggtttgtttattgtcgactcgtcatggggggggggggggacggcgtgtgccgaaagttcggcaaatttcgggccattgttcacctcacctgtaattcataattgggtggtcgtcagtattgtacattatatcccatttttgttactattgtcctctgttttgtcagaatgcggatgaacttgtgtccggccaattctgtgagtgcgacaatttcaactgccctcgtcacgatcggctcctctgcggcggacatggcgactgcgtgtgcggcacgtgccaatgcgaaccgggcaagtccaaagcaaacgaatgggaaatgcgaagaagggggaaatataaaaaaaattataaaaaatggaattttaattttgaattttctcattgggtagggagggaatggaggtaatgcatttttgggttttatattaaatactggcagctgctttttgttttttcgggtgcagttcatttccctttctttgaatttttaaaaattttaaaaacaatttttctttatatttttcaaaaattattcatgaaaaatgatttaattcttcgaaggggagggcgacatgaaaaatcgctccggttttaaataatttagtctaattttttactaattttttgaattttgcctttcattggaatgtttgtccgatggatcttccaaaatattcccaatcttttcttctaggatatacgggcccggcctgcgaatgtccgatcagccaggagacgtgcatcgcgccgaatggcaaagtgtgcggtgggcacggcgagtgcatttgtggcaaatgccactgcttcaccgacgaggacggggcacgctattcggggccgtactgtgacatttgcccggtgcagttttcaaaattatttcatttgaataaataaaggtttacattgttttagacttgtccaacaaaatgcgtggagtacaaaccgtgtgtgatgtgccaacaatggggtcagttaaacggcaaaagaaatattcgacagatttcattggttggccaaacctgtcgagaagatgggattaaaaattgcgtataaattggatttttggggtcccaaactgatcggcggatgggttgattgatcacaatatttcatgaacatgggataaatagtgccgtcccattgtcggaatgcatttgctctgcttttcaggcaccggcccttacaatgagacgcgctgttcggagtgtccgttcacagtcattccggtggatgagctgcccgtgctgaacatcagcgagtcggacagttggaatgagtgccaatttgtggacccggccgacgaagaagccttctacttcctctactactacgacggctggacaa

SEQ ID NO: 3151 - DNA, 2454 bp, Heterodera glycines
cgtataaatagcaaaaacaattattactgtataaaaacagaaattacagagaacattattgtattttttcttaaataaggacataagatgcaggaaaaaaagggtaaaggacaaaaaataagtactttatttcattttttagccttgaatcatataaaaatgccaaaaacaaacaatgaacgggtccatccatccgtgacctttcttgaaggatttatgggcattaatttaaatattcaagaatgaatggatggcatggcttattttaggtagaagaagagagcatattttcatgatgaatagaaaaaaagaatgatattaaggacaaaagaaatcagagacataaaagaatttatgtacaaaagtggcttaatttttctcgtagagaaatttaaaatacggtatatatataatgtgttagattacggtataaaaaatatttacgcttactaatattccgattctagtctcataaaaataaccatttttatcttcataattcttaagagcgattctatcctcggcgggagggcataatgccaaacataaataaaaaaaattcgaattttgagtattttgttgcatttctgtctcccttcaattgctatggatccccggtaattgccccctaatttataattaattcgtccccatcatctcattataatttcctcccattgcccatttgaagggcgacccatcggcggcgggggatggacaacaaatatttaaatgcaaattaagcttggcgcttggaattggcgttgcgtcctattcatttttattggaaatgaaaattcaatgggccgattatatttgaaaattgtttcattgaaggaaatagaaacctcaccacatctcattgtgtaataattgttaaaatgattaaaatttaaacttagcatttaaattattattttttattattatttaaataaatttatttaccaaaattatttattgttggtaattccttaaattgataattaatggggaccgtatttttaatcagaaaaatgataattaagcataaaaaaatccctaaattaaacactgaaaagcataaaaatatggcaaatcgatgattaggcataaaattgccatgattttggtttattaaaaaaaaaaaattagaattacagaaaaaaatatgaaaaaaatgtcaatgttttcgaaatgaagttctttaacctgcgagaacattgaagcaattctcttcaaaaccacaaaattctttttataatttaaaattttaatgaaattttgaaaaaaccaaaataaaagtgaaaatctaaaaattaaaaaaaaattaatcgaaaaattcctaaatgaatttttttttcagctcttccccattcaccatgggcatttttggtccatcttttgctgtgccgaaatgcgctgccaaaccttcttcgaccacttcacaattggattggctttaggggggtcaccctccccccgggggccaagccgaggcttcttccttcctcagggcgggggaggacaaattgtggtggcgcggcaccaccacaaatttggcaattgaaaatggacttaccaaagtagaaattgttgctaaacaattgaaaaaaaagaaaaatgaatttttgattttgaataaatttgaatgatttaagttttttaataaaattcaaaattaaaaatgatggaatcacaaattttgacaaataaaaatgaaattgttaaattaaaaatttgcaaaatatgacagcctgtgaaagtagaaaacttgtcaaattcatttggttaatttgatctagtgaattctcattaaaataaatacaaaaaaagtttttctaaaaatttggaaacctctgtaaatttggtaaaatttttatttaagaatgctaaagcttaaaaaatctttttcaattaacaggttttcgttattataaagatacaaaaattaaaactcgaattttaaattaattttcatattttaaagaaatttttaaatttttccattttgatagaattaaaattactttcgcttaaatttaaaaaaaaattaagttcatggtacgaaattagtcataactacttaaaaaatgtataaaattcccgaatttcccatctgttggcaggggagtagtgaattctaagaatggcatgaatcgcaaatattggctttttgccccccaaatatgtcgcccaaaacatggggccagatgagcgcctaattaggtttttcctttccatggcactctctgaggaggggggacaaagatttggttcggttgtgccaatgttttggctgtggttggtccaattgaaataatgaggatcgaatgaccatagaaggacagcacaaataaatgctggaattatttatatattaatattttgcttaagagttcataaaagaaaatttatataactttacatttgataaaataatatttcttaagagataaagaacatatatatata

SEQ ID NO: 3152 - DNA, 3853 bp, Heterodera glycines
  misc_feature (119)..(119): n is a, c, g, or t
ttttataatttaaaatttttaatgaaatttttgaaaaaaccaaaattaaaagtgaaaatctaaaaattaaaaaaaaattaatcgaaaattcctaaatgaattttttttcagctcttccncattcaccatgggcatttttggtccatcttttgctgtgccgaaatgcgctgccaaaccttcttcgaccacttcacaattggattggctttaggggggtcaccctccccccgggggccaagccgaagcttcttccttcctcagggcgggggaggacaaattgtggtggcgcggcaccaccacaaatttggcaattgaaaatggacttaccaaagtagaaattgttgctaaacaattgaaaaaaaagaaaaatgaatttttgattttgaataaatttgaatgatttaagttttttaataaaattcaaaattaaaaatgatggaatcacaaattttgacaaataaaaatgaaattgttaaattaaaaatttgcaaaatatgacagcctgtgaaagttagaaaacttgtcaaattcattttgttaatttgatctagtgaattctcattaaaataaatacaaaaaaactttttctaaaaatttggaaatttctgtaaatttggtaaaatttttatttaagaatgctaaagcttaaaaaatctttttcaattaacaggttttcgttattataaagatacaaaaattaaaactcgaattttaaattaattttcatattttaaagaaatttttaaatttttccattttgatagaattaaaattactttcgcataaatttaaaaaaaattaagttcatggtaagaaattagtcataactacttaaaaatgtataaaattcccgaatttcccatctgttggcaggggagtagtgaattctaagaatggcatgaatcgcaaatattggctttttgccccccaaatatgtcgcccaaaacatggggccagatgagcgcctaattaggtttttcctttcaatggcactctctgaggaggggggacaaagatttggttcggttgttgtgccaatgttttggctgtggttggtccaattgaaataatgaggatcgaatgaccatagaaggacagcacaaataaatgctggaattatttatatattattattttgcttaagagttcataaaagaaaatttatataactttaaatttgataaaataatatttttaaagagattatatatatatatatatatataaaaaaataataatttcttcttttaatgataaaaatttatatgttctttatttatgtacgatttcataaacaacatgaatgtatgtggtaaaaattttagttttaattttaataaaaattttaaaaagataaaaaaattaaataaaaaagaatttaattttcttttttaatggtgaattatttatattatttatttcatttataaatttcataaagaaaatataagtgatagaaaatttaaatttaattaaaattaatatttataaaaatatattaatttcttattttgatgatgaaattatttatatcttattatttcattttaatttcaatataaatacacattgtaggaaatatgaaaagatatattgaatttttaaaacaataaattaaaattatttatttaatttcttttaactagttaaattcgagttaaaaagtaaaatttttatttccaaaaaattcttaatacaaaaaactaagcttttcataatataggccattttcattcttttaaaactttatttttttccaatgaaatttcaaaaaaaaaattttaatttcaaaaaatttaccaaaaaattgtacgaagtacaggggaatgaatgcactaaacatatatgcatgaaaagaggaggatgagtccatattcccgtccagcattcactaatccgtccccttccatccatccctccgggggcgccattctttggccaccccataaatccaattacgacggcacccaccccttggcccccaccaccgtcttcggtgggatttggccaaaaccaatttcctgggcttggccattcccccgtccgaaatggcattgttatagtgttttgttgttacaccgctttgctactatatgtgtgtgtttggtttgtgttagttatgtggcatgttcattcaattggtgccggccagacaaactttgaggacgaaagattttgtcggtatggaaaagttagcgcagcgccattagtgggacagggacattagcgattgccattagcggaccgccgttagtgggatatagaaagcggaccaccattagcggccggaggattttaacagaccgccgttaaaattttgttgacaattatttgtcattggaacggggtttttatcataaatacttgtcaaactgattgatggttaactggataaaagcatcgatcaaaaataagggtgttgtcgcatctaaaatctgatcggataattctcaatgattgattttcttttctcattcaatctcgacttttctgatcactgatcagcggtcctgcgggcgctgcttcaaatacttctgaagttggggcagcgcatggacacggtcaacgtatttgatcagctccgggtacgcattgatggtgtccggctccaactttgtaaacatgtacagaaagttggccacctgttgaaaaccagcgattgttacggtatttatggtacggtactgtaacaaaaattttttaagcaattcaccgtaaatagcatattattttcgtatcagcaaaagaattaaatctaatttataaatcaatttttaaggactcataaaacggcttaaaatttaaaaaattacctaaaaattcaaaaaatttgaaaatttcaactccgacggtttcgatgactgccgtcgagaaaattttccaattttttcaaaaaaaattttacttgaaagtccaccattgagaggccagacttaagcatgtaccctgacccggactccttcaaaagtttctcaaaaagtggaaaaatgcgcttgactcccggctcgaacacttcgccgtgcaatttgtccttggaaaatggaaaaatttaaaagaaaaaaagtttctattaaataatatataaaaagaattttaattcattaaaaagaatgaaattttttcttttaaaatggtttaaatatacatatttatttattaaaattacaaattaaaatattttttatatgaaattaattgccaaaaatttttaaaaaatttggcaaatttgggtgatttttgaattgatttttataaaaatattaaattaaaattaaattaataatttaatttaatgaatgaataaattaatgaattgcttaattattaattaataaaattagaaataattaaattttgcttcattttcttcaccaaatcgccttcttggcgtcccattttgaccatcaaatacgggagcaaatcagtggtagcatccttcagaaagtcaatgatttcgttagccttcgccttttcccattcatctttgccggccaagtcttaaattataaaattaaataaattaaaataaatattattaccaaatttttcggcaaggtagcgcaaaattgccgaactttgtgccaatggctttccgtcaacctccaaaactggggcctttccgtagaaaaattctgaataacttagttttttttttaatttggcatttatttctatggcattatgccacacgttttaattactcactgggtttgtacgttttctcccattcttccatgtctttaaagcggatgtcctcaaacggttggccaacatagtgaagcaaaaggcggatgggttcacccaaaccacgcaggtcaaaataataaaatttgtattgtgggacattttttta

SEQ ID NO: 3153 - DNA, 4458 bp, Heterodera glycines
tgtagagtaagagagagcgagtaaaaacaaaaacaaagattgcacgagagagagagagagtgaaaatatagaaaaagagttaaacaagaataggataagaaagagaaagagaaaagagagtgtgaggcaagttgagaggaatgtaagagaaggatgataaataattttttttttttaattttggctagttgtaatgaaatggtatatttttgttttttgggatcttaaaccaaaaatttaaaattcaacgaaatacccgcaaattcacaaagcgcgttcagcatttaatttaaaattcccgtaaaaatttgtgtacatgaatgaagagaaatgatgaagaaggaatagtttgtcagtcatcagcagtcggctggcagcagtaattctgtcgcttcgtcggctgtcaccattttatattcccgcaaaatttgtggtgcacacaatgtacaaatctttcgtcatggtcgtcataattgtttttgttgtgttattgttgtacattgtatgtgaatgtagttttgtacaaatctttgtttatttgtgatcaattactgcaattaaaagcaattagtattaattagtaagcgcataaataaacatttggcgaataattttactctgtatttgagcaatttaaaaaaatattgaattttgtttttaaatttaaaattcgaccagttaaaaattaattgggacaatgatgacatttttaaaagaaaataaagcaataagtaattagtaagcacatcaataaacgggaccagagcgtttgggcccccgtttttgggcccccgcgtttgggcccccgtttttgtgccccggggtcgtttgggccccaacccaaaaatagaaaaatgtgcttttttaaaaaaatgaaaaatttttgattataattttcaaaatttttaattcatggtatcttttcagtagcctttagtttactctattggcctgcaaaatttgaaactaattggttaagtctcgaaaaagttatgatcaaaaatgctcgaaaatggttgtttcttgagtaaaggtatgaataatttttttacaaaaaaaatgcaaataaaaatataaatttttcatttcaaatatttatgttattcaattgggatttttgagtgcctgtttctccattttgtgcctattatggcgcttttatgggtgcctaaaactgaagcctttttgcatatagtcatggaaacgaaatataaattaattgtcatttaatcaaaaagccgatccattcggtgggcctatagtagtaacaagcattttttgtatattgaagtacagagggacaaaatgtgtacatggtttttatgtggtacatcagcagggaacggacagaatttagggttttccaacatttttggggacaaaattacgattccaattccagaaaaaattaattgaacctcagaattccgatttttaattcccgtaaaatttttagggtctgatttttcggctcgaaattccccggtttctaatttccgtaaaacttgtcgagtcgcagaattccgattttcaattcccgtaaaaaatgggagtcgaaatatatatatttatcgaatttttgggctcggaatttcggttatcaatttccgcaacatatttgaagcctcggaatcgtttttttttgcgatttcctaaaaatttgttgatgaggcgcaaaatccatccctgctgttcggtaggggtcagttgcgtctgagccaggcataaagcaccataacttttttctttgtttgtcaaattttataaatttggcatcattcgaaagctctatatgtttagaagcttttgataagatattgctaagcgattgaacaacttataaaaaagttgcaaaatgaacactatcaaaaagtcagaatttttgcatattttaatttataacttttttatatgtcggtatgtctttgtgatttttgtatagccgatagagcttgttaagagctttcgaatgataccaacattgttggatttggtcaacaaagaaaaaagttatggtggtctaaacttggctcagacgcaactggcccgtttcgctgctgttgttgtacatgaatgaagagtgagtgagtgtagtcagtcatcagcagtcggctggcagcagtaattctgtcgcttcgtcggctgtcaccattttatattcccgcaaaatttgtggtccacaaaatacacaaatctttcgtcgaggtcgtcataattattttgttgtgttattgttgtacattgtatgtgaatgtgtagttttgtacatggcgacgataaaattttaattgccccacaaatgtgggggcaaattggtgcgacgaaattagcagcaacaacaaccgttggttgtgttggtaaaagaaaatggggggggggggggggcgagggctttcattagtcatgcatttcactaatgatgatggtaaacaaacaattatttaaaataggaatttgcgggaaattaaaaattggaattaatttgtatttttacttctatttattttattgatgttattgtatatatcgacataacgatacgattaaagaattattaaaataaatatttttattcactcataacaataagattttaaattaattttaatgttttcacttattggaaatgtatagttttgtgttttcctattaaaaggatatgaaataagtaaaattagattaaatttattcaaatctgataaaacttgccttcgtctacagattattttgtagtttttaattagctattgataattaattaagtttttaaatttacctaaaattttagccaaaaattcctaaaattacattttccctgtagcatctctttgaaatccatttattatagaaaatttactttttttagaatttgtctttaaaagattttgtagtattttgaaaaaaaaaatatttagttatcattaattgctgacaaattaattacatttttgtcttgaagtgccgactttatcagagattctatgaaaccagaaaaaagaaaaataaataaaacacatcttgcttgaacttttataaaattttcgtttataaaaaaacatttatttattttttctgtgaaaatttttttttttgatttgaatttttaaattttagtgccagtattaaatacaaatgaaaatgtaaactgagcgatcaatcatcggcggtcagaaaggggcggtacaataaacggataaatgaaatgcataatacaataaaatggaatgtcagagaataattcctagggcttcgacaggataaatagcgaattttagacaatctcttacaatagagagtcaaagacaaacgaataaaccgaaaatgtttggatgggttgcgcgcgggagagactggcaaattttgttgccaatgattttaccattgaaatttttgaacgcaaatgtttaaaaaattttctttcatgaaatttcattcaaattttttattttttttaacctaaaattcatctcacttagtaaaactcatagccattgatcaatcatttagttcaaaaactgattgaaaagcacggcacggatgatgaacagtgcgtagaatgaattgtttatgccgcagaatggtgacaatttcggccacgtaaagcagcgccgaagggatgctcagacaaatggccaaatagagaaaagagtcccgcgctgagatagaccactcgagaaagcccatgagcgagttgaaaaaagagacgcaaatgtatgctcaattggatctcgccttaaaaaagtgtcgccgttattcgtcaatgctttttaaattattttatcatggcgaatgcttgttccttcctcggtattgttattttgttgaccaattactcaatttcatattgtattgtatttttttgtcacgattgttcacttaataatgtaaattggcgaaagaactaacaaaaaggggagaactattcatttaaccaatacaattttttatttgttagcgaaatttcacaagtgagaaatgtacttagccaaagcaaaaatcggacgaaatatttttattgttggagattttaatttaattaagatatttgttttaattttaaattattatggcattttatctctatttattttatgtttgttgacctctttaatttatgttttgtacactttcacttctcattattctcattaatttgttttccaaaatttcctctctaaatttcgttctcaatttgcttcacattggtgatctcctcggacttcaaaaataaatattgtgtgtggctttgtcttcgtgtgtttggtctccaccccccaattcaattgaaggaaaacggtttttctttcctattttataccaaatcggcgtctctcggttataatggaagaatctgaaaaaaattcaaattttgttggcaaccagtccctgaatggttacagacccagggctgaaatgcccaaatacattaaaagaatttaggtcagcttaaaacaaaaa

SEQ ID NO: 3154 - DNA, 3670 bp, Heterodera glycines
aatccgtgaagaaatttctgtttggcaagcagtcctttctttttaattaaaaaaagttacaatttatttttaaaataatttcctatttaattgtaatttatttttcggcactccgctgggccgacgaaaagtgccgtgaaaatggcattgaatgttcagcagagaatcgccgtcaaatgcttggcccggcactgttcaacatacattttccgcttttgtcaaacgtggaatttgcgaaggatattggtaaaaaaaagagattaaaaccaagtttaaactctttcaacaacgactgccaactttttaaaataattaatttaaataaattaaaataaaaatttaaaatgatttttcttatatttgcagtgcattcaaaatgaaacatatttttttaaaattttattctatttttcagttccaaccaatgtgttatcaaaagatgaagtgctcgctgtttatcagttcaaatccattccaaattgtcatgggatatccgacggatttttcccaatgcaatttccgacaaatgaacggtttatgaacacgggcacacttttgctggacattgaaaaagtgtcggaatttggacaagagcctgaagatagtagtcggtgcagcaaaaaaatgtacataaatggactgtcatggaaaataagggcagaaattcgaacgaaaatggaatccgatgatagaaaggtcggcatttatcttttgtgcgatgctccaaaagaaggtgcaaattaagggctaattaatattaattaaccaattaatttgcattgagcagaaaattggagttgcaaatgttcggtaaccattcgaattatctcacaaaagtgtggagtggcggatttaagaagagaagtttatgcatattttggaaacaatgaatatgatagctggggatgccgcgattttagatggagatacagatacctcgatttcattgaatttgctgtgggtggcatttaaatgtctttctctaattaaaatattaaaattaagaaactgggttgacccgaaaaatggcttgtacgacatgcgtggggcacaaagtgacattttccattgatgtcaccgtgaaagaagcacaaacgggcaaagaatgcttatattcataatcagtgatcccgaaaacccttcgaaaacatatgtattttcatgtgtttgaataaaaaaatatgataaaaaaactgaccaaaaaaggcgatccaaactaacattagtttagctaactttctttgaacaaaattcaaacaaaatttattattttaattattttttgagtaatatattagctttaacccaccgtccaaaaattcctacgcatttgggttactttttcccacctcatttctgcaaattatccacatatttcaagttcaaatgcggaactgcttcctgcttgttgtctgctgctgttgacaacttcagttgcaattagagggggggggggggggcttttcccccgggggatgcttttcctccacagccctcgccaaccccaaaattatggcttaaatcgcgtaattcttataactcatagtaattaaggatcaatggccaatgtcactttgtcctcgcttttattgtaaaatcctttgcttggatccatcagttccttaaatattgtaataaattaaaatttaaaaaaataattatcttaatggaaattcattataattagtattaattagcatttaatttgcaccttcttgttcacgcataaggtaaaagcccaaccatttctcattgtcagtgcttccatttttcttttcaatttatgccaatattttccatggaagcccatttatgtaagtgaaagattcgcttttacgttcacttctgtcgatttctctcgcaaattccgacaatttttcaatttccatcgaaattattccattggatttgtcgggatcagaaatgcatttctcctttttatcatctttcactgtgacatcaatggccaatgtcactctgtcctcttctctgttataaaaaccattgctttggtccatcaattccttaattaataataattatgccaattaaggagttatgtacaattgacactcaacaccacgtttaaacagctgtaagaattgactaaataataaaattgtcacttttccatattttaatttttaattttgtagtaaatataaatttttaagcgcagcttaggttatttaagaatgaaatcatagcgaaattagtaatagtttttcaatttttaatttaatgagcccaaacttcccggttcccaaatttctggtcccaaaaaattctgcttaaataaaaggaaaaaatgatcagtcaattaggaatggtttcaatttaaaaaaaagtttacgtaaatcctaacaaaattaatgcaataaatccaagtccaaaaaattgtaaacattgacctaaaatggtaaaatttgaattgggtttatgactaaaatgtttatcattgaaattcggtactcaaaaatgagagtctactaaaacagctccgacaattaattaattcatatatcagcagttttgaaagtataatcaagaaaaattaataaataaaaaaacaggttcatcataggatggaggatattcaatgggcatttttccccaaatcatattgggcatttatgtttcgtcttccgttttgcttctttcactgtgacatcaatggccaatgtcactttgtcctcgctttggtcgtaaaagcctttgctggggtccatcaattccttaattgatcataaataattgggtcaattaagggaatgtttaattgtcactcacagcaaatgaaatgaaattcgggaatccccagctgttctctttattgtcaataacatggtcatcgaattccattccgaaatccgacactccgctctttagagagacaattcgaagagttgccgaacatttgcaactccaagtttctgctcaatatcaattaattaattgttgttaatatatatattaattattagtaattttgcaccttcttttggagcatcgcaccaaagataaatgctcaaccatttctcatttttgtcagtgcttccaattttcggatttatttgtgtccatattttccatggcaatcctttgatgtgcacagtttcgcttttacgttgactcccaattatttcacgcgcaaattccgacactttttcaatttccattgaaagtgtgccgttggatttgttgggatcggaaatgaatttctccatttttggctcatcaacagttatgacatcaatggccaatgccaatttgtcctctgctttgttgtaaaagctcttgttcgagtccatcaattccttgattaaccataattataccaattaagtaaatatgttaaattattactcacagcaaaagtaatgaaaaatccaaatccccggccgatgtttgatctgttgataacccggtcacacaatgtcccaatggaattctccgcttcggtcttttctgacacaattcgataggttgccgaaataacgcagttccatggtcctcctattttaataatgattatatttttaaaatagtaattaaaattggaccttcttttgcatcgcaccataagtaaaatcccaaatatttcttctcatcaatgcctttcgtaatttctgctttaattttccatggaaatccatttatatacacggca

SEQ ID NO: 3155 - DNA, 2992 bp, Heterodera glycines
  misc_feature (2975)..(2975): n is a, c, g, or t
agccaaacaacaattggcaaaattctaaaattcaaaggcatttaatctttaaaatgtagtctttctctgagagtgccaaagcgagaaaagaatcgagtttttcttgtctaggttttcgagtttagaagaccgagatttctttaagccctctaatgattgtttggcttttgacaaacttaaaaaaacattcattttttgaggaacatattttacaaaaaaaaagtctaaagtcaagggtttttcgatctcacaatcagacagcagcaattaattggtcttaaaatccttaatttattatacattctaaataaacgaaaaaattttggtaaaaattttagtgtaggaaaatatttgcaaaaaaatgcaaataatagcgaaattcaagacggaaaattcacgagattgagtttaatcattcaaaaaaaccactctaaacagtttattatgtattttagttaactggaaaatgtaaaccgacaaaatagttaaaaattagcaaatttttaattctttcgcatttttcaatttttcctacccactttcaagtcgagaagacgggcctgagcaaaagcgaagaaaacattgcgcaattcggaaattggaatttgcgaagatgagccgaccagagaggggatattgtacttattggctaattaaataatttaattatttttgtcacataaaattaaatccaccggcgtaaagcacagccattgcattttctccgttcagttcattcaactcttccgtataaatgaagctcaacatcactttgaatgctgctgcttcaacgtcggggacctccacgggacaatcagcagaggctaattgaaaattattagtgtaattagcggcggctaattgaaaatttattagagcaattagcggaggactattgaaaattaattagggtaatttgcagagactaaattgtaaatgtcattcagtaatgtttttaccgaattccgctttttcctttttggcatcaaaacggaacatcgcctcaaaaacgtcggaagcgtgtttcaaaatgagcttatgggctggcacaagcttaagaggatgaaattttaaaaacacaacaaaaattaccattcactaaatttccaatttataattaataaattaaatttttaatttgaagactcgcctcttttgcgtctccgtcgcccaccaaaaaataaacatccgcgtcctcacgcgtgctcaacaaatgcttcatccgatcaagcactgattgggacatgataagcaatatgaaaatcgtatttatctattaatgtaatgaaatgaaataatgggaattaagtgaattaagatattcaaaattggcaataaaataaataacaaaatcggctaaatccttatgattttactggactattcagctggctaatcatatgccaagcccataaacaacgaatgagtgaatggtgaaggcttcccctatttttggggggaagatttaaaaatcgcaaacattttaattaatttatttttcaatttgtatgtaaaaacaaattaaaaaaagtaaagggtggaaaatccttacccgatttgaactttcattcatggaaattggaaattgaactcccaaatcatcggaaaattatttacttttacccatcatcttccatccaaagctcattcaaaacaatatgcaattgtcagaagagtgtaatgttttgttgttcccatcctcccgtatttttttcatttattcatcgctttgcccctcggggtaaaaaattgatccaaatcaatacaaagaaacattgtagaaaatggtgtgtacataggttgaataaattatattaatattaatgaaacagataatttataattttggattagaataaagcgtaaaattaatttaattttatgggtcagccttttattcgtaaagtttttgtttaaaaataaaaactgaaaaggaaataagaggatcatgttaggtaatggaaaaaatcataaatgtatatttaattaagtaaattaattaggaaaaaattgcagagaacaaaatgaaaatatgcctaattaaaaacaaaagttgtgagaaaaagcaagggttattctgttccaatttatccattgatctgtcaaattttttacaaaatcagaacatcaaattcaaaaaatcgcattttgaggtcaaaaaatatgcaaaattgcttcaaatgattaacttacaattttttcgttcaaaaataataaattatttttatctttcgtctctcatctctagggttataaattaatatgatttttaatatatttttctttgcgcatatgctattaaaaagcggctcagaaatagcatttctacgttaacattttttggttgttttggtgtttattctcctgatgagataacacaaaaaattattaaaaaaacaaagattcatttttagagaaagggaaaacattaaaatagtgtatgccagagatattttctgcttttccaaaaaatccaaccaaaaagggggaccaaaactaatttgtaagacaacattagtaccaaaaatatatatattctaaatttagtgtaaataaaggcaaaactttttttctaattattttgttgaaattataattttaaattaaaaaaataggaatgaaataaaagacaaaattgaaccttttttatagagggaagagagcgcaaacaaattatggaaaataaagttaaacgaattaatctatcttatttcttgtaaatatgaatgggattaggtatgtactaaatgattcatgaattttataagaccaaacttataaaattaatttaaaaaattaaaataaaatgattaattttagtgcaaaactttaataaattaaatttattaatataatccctataagcttcaaataaagctaatgtaaaacttctcgcaattacactgatgcccctgtttttttttctaaaccatagcctcaaatttaggagtgtaaaatgacaaaatttattcaanaaattataaaaattagg

SEQ ID NO: 3156 - DNA, 2648 bp, Heterodera glycines
  misc_feature (19)..(19): n is a, c, g, or t
  misc_feature (44)..(44): n is a, c, g, or t
  misc_feature (49)..(49): n is a, c, g, or t
  misc_feature (2541)..(2541): n is a, c, g, or t
gaaattggaaatgaactcncaaatcatcggaaaattatttactnttacncatcatcttccatccaaagctcattcaaaacaatatgcaattgtcagaagagtgtaatgttttgttgttcccatcctcccgtatttttttcatttattcatcgctttgcccctcggggtaaaaaattgatccaaatcaatacaaagaaacattgtagaaaatggtgtgtacataggttgaataaattatattaatattaatgaaacagataatttataattttggattagaataaagcgtaaaattaatttaattttatgggtcagccttttattcgtaaagtttttgtttataaataaaaactgaaaaggaaataagaggatcatgttagccaatggaaaaaatcataaatgtatatttaattatgtaaattaattaggaaaaattgcagagaacaaaatgaaaatatgcctaattaaaaacaaaagttgtgagaaaaagcaagggttattctgttccaatttatccattgatctggtcaaattttttacaaaatcagaacatcaaattcaaaaaatcgcattttgaggtcaaaaaatatgcaaaattgcttcaaatgattaacttacaattttttcgttcaaaaataataaattatttttatctttcgtctctcatctctagcgttataaattaatatgatttttaatatatttttctttgcgcatatgctattaaaaagcggctcagaaatagcatttctacgttaaaatttttttggttgttttggtgtttattctcctgatgagataacacaaaaaattattaaaacaacaaagattcatttttagagaaagggaaaacattaaaatagtgtatgccagagatattttctgcttttccaaaaaatccaaccaaaaaggggaccaaaactaatttgtaagacaacattagtaccaaaaatatacatattctaaatttagtgtaaataaaggcacaactttttttctagttattttgttcaaattataattttaaattaaaaaaattaagaccaaacttataaaattaatttaaaaaattaaaataaaatgattaatttcagtgcaaaactttaataaattaaatttattaatataatccctataagcttcaaataaagctaatgtaaaacttctcgcaattacactgatgcccctgttttttttctaaaccatagcctcaaatttaggagtgtaaaatgacaaaatttattcaaaaattataaaaattaggcaaagtcaatattaagataaataattttaaaatccaaattcttgtcaagaaaataaataaataaattttggagatggatttttgagaaaattttcatttcttagggatgtatttttgaaaactttcgggtcgattcttaggggtgtattttttttttaattttcgggtcgattcataggggtgtatttttcgttgttgcatttttgggcaatggccaaaatagatcgaaataggttttttcaaaatttttaaaatctttttaagctctaaaaaataaaaacctaaaatagcctctagaactcgaaaagtagcttaacaccctcctccaaaaaaaacatatttttcgtgtttcaggccacggagagctcaggaaaaaataagttgattgaaaaacattatttgtttacatttgcattgatttgaatcaacttttttgccggggccaaagcgatgaaaaaatgggtaaaacggggaggaaaagaggaggagcacacgaaacattacattcattcttctggcacaaatttagaacatttgtgtattggttgtttttattgagcattggacacaccgtcccaaaaaatgagagatcaaccaataatgagagagtgcagagaaaaaaatagaatttcttcaaatttaacatattctgcattttctataatgaattcatttttgtctatggtcgaatacaaaagttttaagaaaaacaaaatttcgaacgttcatatctttttgttctgattcttcaaattgcttagcattcgttttgggaaagcttctcctaatcaagaagagctttagaataataccagtatcgtccaatttgcattaaataattgctagggctgtgaattttagtgacaaaaaatcccgaaatagttaactaaaatagtgagtaaaaatgttaaaatagtgacaaaatagtggcaaaaagtccgaaatagtgacgaatagtgacataattttcagccaaaaattgagcaaaaataatttttattcactgattgcagttgcaaatgagtaggactgggatttttaagaccaaaaaacccaaaatagttacctaaaaaaattttttaaattaaaaatttttgccaagaaagtaaatttttgagaaaattttttttcatttcataggagtatattttgaaaaattttagctcgattcttaggggtgtattttttgggtttattgcatttttgttaaggaattttccaaaaaatgtcgaaatagtgaaaaaatagtgacaaaacgccaaaatagtgatttttanatattttagtgacgaagtagccaaaatagtgatttctagtgaccgatagtgacatcagaatcgaaaatttttaatgcagaaatgcgttttttgagctcctttcttca

SEQ ID NO: 3157 - DNA, 2058 bp, Heterodera glycines
cgaagacaacaaagtgctcggcattcgatggaaaccaaaacacaatcggctcatcttcaaattgccaatcttcgaaggaaaaatcacaaaacggacaattctgtcgcaaattgccaaagtctatgacccgctcggactcatgtcacccgtactactgccagccaagctcattcttcaagaagtgcaaaacttaaacccaaaatgggacgacgaattgccagcaaacatcaacaaggactggctcaaattgatggcacagtggctcgacagaggcgaagcaatcacaatcgaatttccacggcacatccaagccatcgattcagtggaattccactgcttctgcgacgccagcaaatacggcatgggaattgccgtgtaccaaaaggccaaaacaataatcagaaaggatgaatgcaacctcatctacgcaaaaagccttgtcaaaccaatcaaagtggcagcgcacgacggtacaatcccaaagttggaactttaagcactgactctcggagtaaaagcagtcaaattcatccaagctcaaatcaaattcgccgatcatcaagtcatcatgtggacagacagtcaatgctcagtcgaacgacttcgagaaaacaagcgccaagatcgatttgtggcaaatcgattacaaaaaatccgagaagcgaattttcaagtccgacacgtcagaaccgactcaaacccggcggatatggcatccagaggcgcagatccccaatgccttcgaacatcactgctttggcgctttggcccgatttggctttcaaaagcagacaaatggccagaatccaacgtcatctaccgaccccgagatgaattcaaagaagtggaaaagccaccaatcgttgatattccagagcaaccaattcaagcagtgcacagcttcatcgcatcagtcatggacgactcagtttctcttgccggcagcaacgacgaaagccaacaaccacgcccaaagaagttcaaaattccgaaacgacgttcggcactgttacgacccatcggccagcagcaaagtccattgcaaggacaacacaaacgccgcaagcaactacaagactcaggcttacgcaagttatttcaagccatctcggaccaacaaggaagcagcaaggccaccacaaaggccatcgaggaaagccgagaaatgcagaaggcaccacgtcatgaacagatcgagcatgaacaacgaatggtgaagaaaagtcaacaagaagcaaatcgacatcttcaaccagaaaagcggcagcaaaaaattcaagaagtgccacattcaacaacagaagagcaacaacgagaaaccaaacgccaacaaatcgaaagacaacaaaacgacgaacaacatgccatcaatcaacaaacacgcagtaaggcttgacaagaattggcacgacaatttgactacgatctgatggatcagccggatccaacagagaaacaaccggaagaaacggatcaaccaacaaaatcaaagcagcaatcaacaaaggacaaagaggacaaagagctggaacgacatcgcatcggcagaaaaaagacaatcgacatgcaagaaaaacggcaacggtcaagagacgaatggccagaggaaaacgaaacgctgctcagctacgttcaacgcatttacggaccggagaattggacgtcagcatggcaaagaggacgtgttctccgagagctccatgaactggaagatcaagggcgattgatgattcatcacaaatccgatcgcctacaactcagcgtctcgcgaatgtttggaggaaaacgaccatttgccgagttccgcttcgtggaaggcagatactactcacacatggtgccagaagatgtgatcttcctccaagcagtaccaaccgaagaacagccggagatcataacaatcgacgacacaacggcaccggcaacaaatacggaacaaacgaagcacccaacaaaaccgcaacgaccacaatcgccaaaactcgaagaataccgcatggccgactccaaaccgaacacgagcagccaattcaacctgtttgagccatgcgacaacac

SEQ ID NO: 3158 - DNA, 7812 bp, Heterodera glycines
ctcacacatggtgccagaagatgtgatcttcctccaagcagtaccaaacgaagaacagccggagatcataacaatcgacgacacaacggcaccggcaacaaatacggaacaaaagaagcacccaacaaaaccacaacaaccacaaccgccaaaactcgaagaataccgcatggccgactccaaaccgaacacgcacagccaattcaacctgttcgagccatgcgacaacacgcacacaacttgcgccaaaacagcgacttacggttccaccgcgggcaaccgatttcaaatggaagaattccaaaacttccgtgccaacaatttcttcgaggcactgctcttcaactggctaacacgcaacatgaacttaccagccgaagagatctgggcggcacacgaaggctacatccagtcagacacaacagtggaagaagtggcgcaaatgttctaccaacaacaagttgcagataacggacgacaaatcgcacgagaccagcatttgaccgaggtcatcaatgtctggcgtaactcctgcgaccgatttggcgaactttacaatcaaccggcacacaagcaagtgaagtttcggccaatcacgacggaaaacgaacaacaaagcgactatggagaatggatcgaacggctcaacaatcgcacggcggaaatcttctccaaagcccggactaaggcacaatatccaacgtacctgaactacaactgcacaacaattctgatcggagacaacgttgcagaagtattcaaaccgctcttctacgacgccaaatggttcacacatttccccggcggacgaattccgactcatccccggaccgaaggtcaaacacttgatcttcgcgtaccaagcgacagccgaaaacatggcagcgcagatcgcaccaatgctccatcgattcatgcgatcagagatcgaaacaactttgatcctagccaaggacgacagcgctcaatggatcagcaacaaaaaatatctgatcgacgtcacccgtgaactaaaagccggcttcttcgttttcaaccgggaaattggagaagcacgacgaatcgccaacagaatcaaacaaacgatgccggagccaatggagttagacaagagcccgggacgtcaacgtcaacaagttcagcccggcccggaacgtcaacaagtcaacaagtgatcagctcgttaatgctgatcagcctcctttgccttctattcaccagttcggcacaaggacaaccaattcgacaaaagaaatttgcggaagtcaaaacatggcacggcggctacatttccaacttcctcaacctattcacggaacgtgacaagaggacggcaacaaaacacagtccatacgtccagcgatacattgacaaagtcctcgcacttaatcggagtctgagccaaacaacgactcctccagcaccaacaaatccgccgcaaacgactccaccggcaccaacaaatccaccgtggacaacgactacaaatccaacaacggcgaccataaccaaaacacgctcaacaatttggtcaaccaaaacaaccacacggcccaatgcctggacaaccacgacgacaccaatgtcacggatcatggactaccgaacaactacagtgtacagatcacgtccacaacaacagccacgcccaggaatcaagttgatccgctggcccaaaagcccaatcaccaccgaagaaggacgcgatgttttttggtgttccaaccacggcagcacactctgggaactgaagggcccggaaaactcaccattctgccgaccaccacccgcactcaccgcgcaatggacaccactgacaatcacgctgtacaccaagatccatcgaccggaaccaatcgcaacggcatggcactgcttcatcaaaacgacgacggaaaattattacacaaacatcgtcggcgataagttcgtcgaaatcaacaaagaatttccgttggtctccaaacgactctgccaacgaatggcacatcaacaagaatgcccactcgccaaaacggaaatgcaccacgtcggcaaccacatttgggcaacaaacgaccaacttcaagtggatttccctggaccaatcactggactcttcaaagggaagcaaaccagctcagtaacaaattgttttgcgcaaccagcaacactgttcgtcaaatggcacagtctccaactactgtcgccaatccatcgcgcagaccactgcaattacgcttccgagtattgccagctgcaagacaatagttcactcatctggacttcagcatgtccaaacgacaattgtttcatgtgcgatttccaagaagccgaagaaatccacggagaattcaccaagctcaacggtcaaacaacagcattttggatctcggatgatcgacaaaaggcactgaccttcaccgagacacatgccgtgcaagcatgcgacgggagacaaatcgtcttatcagagcagaacttcggcattccaaaagagcaattcgacatcatcatgagtgaccacacaagagcgaaacgcaacgtacaacccgaacaactcgcttcacagctttccgctgctcaacttgccacaacaatggcactctcacagctttacttaaaggaatgccagcgcaacgtgagcgtcagcaacccaacgcttcaggcacgaaaactcctcaagcgcgaaaatctgcaagcccgatggatcagcgaaacaacaatcgaagtgtttccctgcgttccaatctccctatccaacatcagctaccgaaaaacaaaggactgctacaagttcatccctgtcacaatccatctgccaaacacaacacaagacgcattcctcgacccggagatgcgcatcctctcactcatctcaaggagcgcaagttgctctcaatttcgctaccatcatctgcaagtgcaacaaaaacccaacttgtgggtgcgaatcgactcaaaaaatggaaacgtccaacgattggcacaaactgccatccatgagctctacgagacaatcctcaacaaaacggacaacgacttggatctccacccactgatcttccatcagtggcaactcgacaacgacaccgacttcgctacctttccacacatcgacgaattcgaggattcggaagagttcaaaaataagctggaacaacacacgacccaacgagccgaagcactcggagctttacccggcggaatcgaaggatggaccgtcagatggctccaagaacggctacaggaaataatccaatggtggatacgtctcgcctcggcatattccacattcctactttgccgtgacgtcatcctaccttgcctaatcgcttacttcctgaaccccattcgcatcacactcatgaccctgattggatttcgaccaaagaaacaaccaacgcctcaaatccaagcacaacacgaggacatgccattgaaggaaatgccaagcacaccaatccggcgtaaacgacgtcaattgcccgagcaatcgactccaccaatacgactggacacgacgacagcaacggcctcattccgaacaagagcaagagcacacagcgcaacggaagacacgcccttcggacgcttgcgaccgatgaaattggcggacgactgaagggaccaaaagaaccaagaagagagaagaaggaaggaagaacggacgaacctttccttgccgcctcgggagtgtcgcgattgcccttcgcgataatcaaataatttgattttgcaattgtgcacaaattgtgcaaaattgaattggccccaaaaactatttatctggttagagatcaataccaatgaaagtatttaaggatttaagaaatttgagttgataaagcaaaattgtgattttcggagtagatattttcgatggcgcatttaaaaaaatgaaaataggtaaagagacagagaaaaagtcagtaattagcgcgaaattaatagtataagaaaacactaagaaaaaatggtcgcatttcgaacggagttcttgacgatcagtgacccgctggagcggcatggatgcttggatgacgacaacgacgacgaagatgaagaggaggagcaggatgacgacaatgcatttgaagtgatcggcggtggcattgacataacgtgggagccgatgaccatcgccagtgcctcaatgagacactttcgactcaatcacctcaagcgggattcgctattgtgcctgagtgcggctacgacactacaaacacccagagccttatagcgctcaaattcatggattggtacgccaaaaagaacggggtgagcatccagacggcacactcgccaggcggagagaaaaaaattggccagtacactgtggacggatacatcgcggcgaccgacaccgtgattgaggtcaacggctgccattggcacgcgcacgacaatccacgtcaccgttttcagccccaaacaatgatggcgaatgggaaaacagcgcagcggatacgggaggacgatgcgcgacggatggccttcatcacatctcaggcgcaacaagtgctcgtattttgggagtgtgaaatcaacgcggagaagcgcgacaacgacgaaatgaagcgcgcctttgcccagtacaaggacagcggccctatccgtttgaaggactgctaccatggaggacgtgtgggtccacaacgactacactacgaggtgccggaggggtggcggatgaaatattacgacgttcgttcgctctacccccacacgaatgctgtgacagcataccccgtgggtcacccaacacgagtgaacatcattggtgaggcagagcaggcggttgactggcgacgcgccgaccagttgccggtccgaggcattctcaaagtgttcgttgtgccgccccatcacgttgatgtgcctgttctgccagtgaaatttaatcagcggcttcttttcccactgtgtcgcatgtgtgctttgcaacatccgcatggagccgtcaatgaagactacgagtgcacacatcgcgaggatgatgagcgggggtgggtgtccactgtgacgtcaatcgagttggaagaggcgcttcgcaacggttaccggtgtacggcctactatcgctccgtggaatgggacgatacgcggtggagcgaccgcgtttttcgaggctacgttgcagaattcatggccatgaaaacgcatgccagcggcttcccggacgaaattggcacaaccgaggaagatcagcagcaattcatagaggaatgtgaggaaaaattcggaatccgaatcgagcgggaaaagatggtgcacaacaaggccaagcggaccatcgcaaaactgtgcaacaactccctgtgggggcgcttctctttgcgcaatgggttgtccaaaacgattgtgaccgactcgcccgcggaactgcgcgctctgcttgacaacccagcggtggaggtcagctccgttgacccgctcaccgacgaatgcgtactggtcacctatgcggccggaaacgaatgggtggaggaacacgaatgctcaaacattgtgctctctctttggacaacatcggtggcacgcctccacttgttgcggctaatgcagaaggttgcgtgcgcaccaaactcggtgctcatctacaccgatacggacagtgtgtgtttcgcccatcgtgaggcggacgggtgccctctggagacgggacctcacctaggcgacctttcggatgaatggccggaccacgagctcgtggaatttgtttccggtggatgcaaacagtacgctctgcggatgcggcaccgtcatagcggggaggagaaaacggtgctcaaagtacggggcataacactgagcgccgatgcctgtcagcttctccactttgccacatcaagaggagtgtcctacgctacgcaatgtgtcattcaaatgaggatgatgatgatgatgatgatgatgatgatgacgaagacatttgttcaattttgattgagtaccccaatttcctaaggcccaacattaaggacgggacggttatttatgttaagctgtcaaaacgctatcgccctattgtaactaagggggttgtgggaatgaatgcaattgtacatgattttggttttataaagacgtaatttatacggactgcactttttaaaaatgcataattaacaaatggaagattaaaatttaaaataatgaagcgtgagaagttgcaaattttaggtagaaaaatgcatagtttagtaagagaagtagcagttttggaaatattaaaaaaaattaatcatcatctgagttacagagttgctgtttttaggtagaaaaatgcacaattagtcatgtttaactgcttgagatagaatatttttgatttgctctttttcaatccatatgattcctttcacaaaaccgcaagacggaggaggtggtgttgccgcaacactgttttgtgtgggcatcgagccaaaccagagaccatggtcgtcatcatcagcaccattggaagaaggtgctggcaaatttcgcagcaatgatgacgaggatgatgacgatgacgttgagccgtcacgcttttgagacaacaaattcgcgtacacaggcggaaagccgttatcgacgacttttaccagttcaagcgggtaatatttgtgcaagggtccatcatccttttgaccaaaacatttctcaattacacatggataatgcgggtactttagcataatatggtgtcgtgagtaataatgggccgcaacgcaaacattgtaggggcgcctcaggttatcataagcaagcacagagtcggcgccctcttcagtgagcccagcacagaagagcgtgtgggtgaagccattacggtcggagtatgtagtgatgagcttactgtgtgcaaattccttcaacaatttttctcgatccgcaacactacagcaaattcgcgcgcccacttcgtcagggggacagccaaaaatgcgcgagaatgagataagcaaatgcattgcgcgcaagtgagattttgtgcacattcaagcgcttttatatgtgcgtaggagcaccgtaacttcatctttcacgtagcgcgcagcactgtacattttcgctatataaaagcacgcaaatatgacgcaaaacttcattttaatcacaagaactcgctctgctgtgatgtggacggcttagcaccagccggtgaagacgaagcagcagcagcagcagaagtagtggcaccgccaccagtgcatccgcccttgctcacccgccacccattttcggtgtgctcggccaaggcgactttttgtaaaagcggccccagcctcgacattccgttctccaagtggattttatgcaagctggcgaagccatccttcacaatgtagcgaacaggggctaaagagatgcactaattagtcactctcaaagacatcacgatgtattttatttcactttaaagcagactgcaaacttacggtttcgcccaacataaatcgtccttcctgaagcatccgccccatttttctgccaataacccagcaaccactccttgctgtattttccgtagccgtcaaaccgcgcctaggatgataaaaaatagaacgttaaaatttaacttaaactaatttaattgcaaaaaactatactgaagcagcgacggtgcgtttcaacgatggtgttagcacagttcacctccagatccgtccatctgtaggtctcatctgtgggtgccattgccatccgctggatggctttgttcctccgggcgaattcgataaattcgtcgcggaggacctgtaaatgtacactgtaggtgtatttaagggtatcagctatataatacacttatagtgccttattatctcaattttcaacgct

SEQ ID NO: 3159 - DNA, 997 bp, Heterodera glycines
agctggggagctggtggccgacttccaggcatgcgaaacaagcatgtcgcttaagctcgttggcatccaccccttcaaactttgcatggcccagaaacggcacggcccaaccaacttgaaaaataaatgctgaacgcatataatcgtcaccacttactccactctctcatgacccaacattccgtgggaatgtgaccaatacccttgaggccagacaagaaacacggttctaaaggattataaaagtatttgattaatcacctacaaacatatacacaccccgccgtcttcacgctggttcagataaagtgagcattcgtgtggccaatggtttccaaccttgcagagtccgcaccactttccatccgaccaccatgcatccgccccccgtattccctttccccagttcattggtcgtcgctgctgctgctgctggtggtggtgctgctgctgcttgacatcggtggcatccgccccttttttctccgccgctcggatggcatcagtcccctgcattgtgtgtttaggtttaacacgattacattttaaaaagccatcaaaaaatgctgctcgaaacctgatgtttttgctgttgctgctggtggtggtgctgctgctgcttgacatcggtggcatccgccccttttttctccgccgcttggatggcatcagtcccctgcatttgtgtgtttaggtttaacacgattacattttaaaaagccatcaaaaaatgctgctcgaaacctgatgtttttgctgctgctgctggtggtggtgctgctgctgcttgacatctgtggcatccgcccctttctgcggctgtgcagccttcccacgacacattttttaacagtgcccgttgggttcaaaaggtagatggagtttcgacgactttccacagatacagaggttttaggcaaagaggttttaaacaaaggagaatacatttttatttaactaaaatgtaaaaaaattacgaaataaaatataaaaagaa

SEQ ID NO: 3160 - DNA, 1379 bp, Heterodera glycines
ccccccgtctccattaatcccaccgtctccaagtagccccccccttttctgaggcgtttgaaaaataatcccgccgtctccatttatccccccgtggggataaatggaatttttatttattacaccattttttttaaacacaatagtaaaaaatgctaacaaatgagcaattcatcgtcatctcccactccatccagctctacatcataatcagataggatccggcttcctcctgatcattttgttcatctttcattgttcatttcttctaaactcgcgcaaaaatttgattcctatttgtccaaatatgttaaaaataaagtgcatacaccatattatatgatcaattaaaattatttttagctgaattatcccatattaataatttttcttgattttgtattttttaaacataccgtattttctctttttatccccccgtctccattaatcccaccgtctccaattagcccccccccttttctgaggcgtttgaaaaataatcccgccgtccccatttatccactattgaagatgtcctttatccgcttgtttatccttttcatcagcgcttttaaatttttattcataatatatagtaaatatatattatttattttaaaactagaaaacaaaacatacgaaatttcttagaaattagatatgacaatgttttcaaaataaacaatattctttattttttgccattgcatttgccttatttttaaatgagcacaacctttttcatttatattctgattttatccctgaataaatatattaagaaggcataaaatagttttaaattaataaataatggtttatgaatttctttagaatttcaaattttccaaaataatgtcgcttttttaaccccattcatatcaatgaattttcgttataaagcatcattaaccgaataagtgtcaatatatttttttagtcatactttttatttttacatattttgaaattggtataatttttttgaaaattattcacaattagaatagtagcactaatattcaaggttaattttaattattacccttattatcataaatttaaccaaatttcgtttttaattgaaaaaatctttttcctctagctgaggatcattcactgctgattttcgaatttccaggaaaataaagtaacaggctcattccgcaaaaattaaaaacgggtttcttaagaaaccataactttcttgaaagttaacaaaaaatttttgaaaatttgcacgctaatagagagaacatataggtctagctatcgcgatagccaaatttttttgaagtaattttaaaaaaataaaaaaacgggctctacttggagtgtttttttgtcatattttctaaatatttttctattctatg

SEQ ID NO: 3161 - DNA, 2147 bp, Heterodera glycines
tttttgattaaatatagaggggtgctcgagacacaaaatttagcgattaactcaaaacgagacggagaaactcaaaaaaagaaaaaaaaacccgaaaaagtaaagtcccaaaaattttaaaatgaatacgaatttaaatttgaaaagatatttttattttgttcattttaatttatttttaattaaaaataatttcattttatctattagaattaattatgggactgaaaggacccggtccaaggccagtcacttcggcacggcacttttttaaactttttttttaaatccacaaaaaaagtaaaagtaaattaaaaaaaaattttttttaatgaatttttttataatgaaatagtatatgttcaatatttaaatttgtcatttttaagtttttttgttttttattttatgaagaatttattttttgggtaaatagagttttttaaaaaactttttttcttttattttttttttgttttttgctatttttaggaagggtttttaaacttttttttttagttttacaacgggtttttaaactttacctattctcggtgcctttgatcaacaaggcgggattctttgttgtctttgtgcactcgcccaacgatgaatagcccgcatcgtataggctacagtaggaaattgacagatcacggatgcctttccaaacttcaccgtaactccaatcaaacaacggacaaaccttggcaaaaatttgaaaacttttaaaccttgcattaatgtttaattttatttgcagaataataaagatgactgagatcaaagttattcaaattaaacagttttggtattgagcgatagaacgtaaaataagacaattttgtttcttaataaattagaatttggattaaatttcaaaaaaattttctaaaaaaacattgcaaaaaaagaggctatgaattttttgaaaatgaagaaatttttttgaaatttaccatgttagtaaagtaaatattatatcatttgtcaatttgtggccttattgtacgccctaaaaccaaaaattaaaatttttttttatcaatttcttaaaattttttttattaaaactgcaaaatatttcaaattttgacaccaaataagcacaaaattgtttcatcttttggcaaaaaattattaaaatatattattgtaaccagcagagctgcaataatctgcggttttcaaattaatttttttttggtttttttgtattgaaattcatttgtttttagtttgcaaaaaaaaggtatcaaaaatcattttaaattttttttaagttagaattttttttatggcattttgtgcttatttacggctttctaagaattttttgttcaaaaaaaacatgataaattattattaattttatatattttgataaatatttgggagtttttgtacatatttaataatgtatttatggattttttttttacattattgtatcatttttattatatcaaaaaattcaatttttttttaatttcaccctaagaaatttgggccaccctccgtcggtccattggatgttgcttttcatgtatttgccaatcggatctgttgaccgggtgcccatcattgtggcaacaatgtgcgactgcttctccttgtacagtgccaggccgtgcttcatctgaccggacaattccaccaaatccaaattgtacctttaattttcatatttttattaatcttatgggtaaaaataatcaaaaaaaaaagtttcattatgaaacaaatttaaattgaaccctaaattttcaattgttttttttatttgatattatcaatttgaatgcaaaaaaaaccccaaaaaattagaaaaataaaatagggcaaaaaaaatccagttatttatttattttttaatttttttttattgaaatagacattaattaagtcgaaatctatttttcacctcaaaaaaaatgaaaacttgcggttgtaaaataatttaattacaaatatggtaaagaatttaagaatagttacttgagctcgacctggacctggatacaggcttggattgtcttccaaatccagactttttttcaaaattttaatcgctacagattatcttttttaagaaaaaagattgaatgagggggggggggggaatttcggaacttcggttttagtca

SEQ ID NO: 3162 - DNA, 2194 bp, Heterodera glycines
  misc_feature (31)..(31): n is a, c, g, or t
  misc_feature (2148)..(2148): n is a, c, g, or t
tttaattattataaaaaaattgaaagtttantaatttatatgaaataattcatgcgactcttcttaaaaagcagaatgtttccatttttttttgtttgttttgttttgtttttgctttgaaataatttttattttgaattattattaaaaataaatattttttatatcttaattttacccatattcgtccaaaatgccattaattgcactaattgcttctttaatttttgctgctaattgcccggattgcgatgaatttaggtaattatccaagttgtcagcatcctcctccaatttgtttttggtgattttcattgtttgaccttaacaaaaatttgatgaaaaattattaagaaaatatattttttagtgaattttagacaataattataatgttaatttaatttttatttttatatagataatcgtaaattttaaatttcgtttttgatgagattagttagaatatcggagcactaagacaaaaaaaatttaataaactatttgaattttttgtggggaaaaaataaaattccgacgagattggtaaagcatattcatttttttgttcactttaaaattttgtagaacagtttcatgaggaattaggatcctaaattctgtaactttttatctttttaaaaagagtgcaggtgcacggaatgaaagaaattttgctcggatacaatcggataaaaccaatcgataaatccttttttttcatttaaaaatccgtttttaatcattggctttgtgtctgtcgtctctcccatttctcaatggagagaaaatgaatgtgtcggtcgccgatttgcatatgatttattttctgctgtccaatttatatcggagattaaagattggattaaaatggattccaatccaagccagggttgcacgaaattttcttgtcgttttcgtttcgtcataaattttcggcacattttgagtttcgttttcgtgtttcgttttcgtccgtcaaaaaatttttgtttcgttttcgtttttgagtttaaaattttcgtttcgttttcattttcggttttcaaaattttatttttcgtttcgtgtttcgttttcgtatacgaaatttttttttacaagttttcgtgcagccctgatccaggcccatagcaaatggaaggaaatgaaaatttaaaacttaaaaaaaaagaattttttttggaatttggaattccgatacccttccgttaccctcgcatttatccattgctcccgatataattttcgattttttcatgtaacttatttgttagtccagcatccagaatttctagtaggatttcacgcttttgacgtctctggtcccggatttatattaggatttcactattttcaccccctggaacccggatttttctgtcagaatttcccgattttctggtcccggatttctatcggaatttgtcagttttttcgtcccggattccgtatttgctacgtggattttcccattttcccgtttttggcgatttcccaatccagaaccagaattcatgttccgcattttcaaaaatgcgagttcccgacctaccctgcttttttttatttttgcaatttttttcgagaagattcgtccctcaacaattaatttatttaaaatcagacaaaaaccaattttgggacaacagaaattttaaaaattttttttgttcttctgatgtttttttcctattgtaaaggagagaggcctgggacctgggtttaccccgaaaatttaattaaaaaaaaaattcatgagaattttctaaatattagcccatcgaaaattcttctaataatgaaaattgattacagaaacaacgttacttacagtcctcctttttctcgcaaacatcaacatccataccattggctagaaaacaaaaaaaaaaaacaattttttttttacaaattttttaaaaatttttccaggctaacctcggtccaattggattaagccaagggccattgcaaaaaacaaacagaagacacttgtgaagcgcatttttattattatgaagaatttttttttcgaaataaaatatttagatttaataaaaatttatttaaattggtaataaaatcatagaattgaatgagaaaattaatttgatgctctttaatagagcttttttaaattaattnaattttttttttgccgctttttttttgtttgccaacgcgcaaaata

SEQ ID NO: 3163 - DNA, 1382 bp, Heterodera glycines
ctcttcacgaagctgaaatgtattagaatgcaattatgacaaaaataaaaaataataccgataaaaaaattaatccaaatgttgaaaaaatttcgacaaattcatttggaatatttttaaccaccgttcctattgacaaaataaatttcaaaaaataattaattgttaatttcatttttggaatttttcaggtctggtttttttttatcaagctcaaaaaattttaaaagttttgctgaatcgtaattcttttagcctccgttcatattaacaaaataaaattcaaaaagtttataaaaatatattttcggaatttttttagacctaaaattctataaaatttcactaaattaatttttggcatgttttaaattattttaagtcgagaaaattgctataaagcccaactgttcaacaccaacagatgggtaattaattactttactattgggaaataaaaaacggatttcattaatttattcccgcacttggccatcggtttttgtgccattggtctccgccgttttgtaggcccatccccgccggccaagttgacatattgtccggaagttggcggtgccggatccggcggcgcatattcatgatactgttggcacaatgtctcctcactttcactccccaaattcttgctgaagaaataaattgttaattttgttttaattcaattacaattaaattaaaattaatacattgattgacccaacaaaaatttcgagattttctttaaaaaacgagggtagaattttctgcactccccctcccccccccctactagaagaaaaatgaaaacttttagggaaaaacgagtattttttgttaaattttaaaataattgacactaaaatggcaccaaaattggcatttttggcgacaaatctactaaaatgctatttttttttcacctgtggcaccaacccgaagccaagggaccctgggcaaaatttttaaataataatttgcgttcatcagcggattataggtgatttaaaagtgaatttttataatcccttttagccagcaaatcttggtgtttatgtttttcttctgatcggaaattttcggacggatcaaatcaaattaaaataattaattacggatcattgacgacagcagatgatgatgcagcaaacacaatgcttttgcgaaaagatgcattctgcaataaataaaacaataaattcattttataataaatttttaatttttttttgagttcccatatgttcttatttctaagaattgtgtccttattttgaagaggcccaaattttagaaaaaactgtaaaaacaattttttaaggatttcaagaaaattttaatttatccactggggcgcgactatccaaatggtttcgaattta

SEQ ID NO: 3164 - DNA, 2439 bp, Heterodera glycines
  misc_feature (103)..(103): n is a, c, g, or t
  misc_feature (2138)..(2138): n is a, c, g, or t
  misc_feature (2400)..(2400): n is a, c, g, or t
tttttattattaaaaattttatttttttttaattttatttttctatttccattttgctttattaccccatttcgtctcttcacattttgcgttgtcaatgtgnagtcggaattgattgaattgtccgcggtggaattggatgaagaaatggtggaagatgaagagaagccactgcaaaaatttttttttcgattttaaggataaacggggttttccaggactggaggtaggctaaaaattggaaaaataaggatttcaagggtgattaatagggccgcaacttttagtgacgaaaaatctcgaaataatttactaaaatagtgagtaaaaatgccaaaatagtgacaaaaagtccgaaatagtgacaaatagtgacataattttcaaccaaaaattgagcaaaaataatttttattcattgattgcagttgcaaatgagtaggactgggatttttaagaccaaaaaacccaaaatatttacctaaaaaaagtttttaaaattaaaaatttttgccaagaaagtaaatttttgagaaaatttttttcatttcatacataggagtatattttgaaaaattttagctcgattcttaggggtgtatttttgaaaattttttagctcgattcttaggggtgtattttttggttttattgcatttttgttaaggaattttccaaaaaatgtcgaaaaagtgaacaaatagtgaaaaaagccaaaaaagtgaattttcactattttaagttacaaaacgccaaaatagtgatttctagtgacaaaaaatgacgtgcaaatgaaaaaattttaacgcagaaatgcgttttttgagctcctttcttcaaaacaattgagcaaaaaaaaaaaaagttttttcactagaaatcggcgccctactaattatgcgttggttttgatgatgatgatgatgatgctgtgctcaaatcggttgcaagcagagaatattctccagcagatgaaaattgtgatgaatttgctgcggaagaataatggcaacagcacgacattgctgcacatgaacagcttggacatgttgcctttggcttaattagtttaatgaaattaaaaataattgtgtgattaattaacataattaaattgtcaaacattcgaaaattggcggctattaaattaaaaaacgaattaaaattgcaaattagtgtataattattaaaaataatccacacatttgaaaagcgatgccagtaattaattaagaaatgaattaattgccacatatttgaaaattggcggtcaaaattaaataaaaaattaattacaataatttcacattcatttaaaattggtggctttatttatttaaacatttaataaataataatatataattaaacaattatttaattgcaatattagaaaattaatggacataattaattaataatcactgaattaattaattgcagtacatttgaaaattgatggccatctgcgccgccgcaactctcatagtcggttgacgatgaagaacttgttttttgcaatgatggagctaaaaacaaaaataagaatgtacaaagtttttaaaaaattgcatataaatttttttgacatttaaaatgaaattatttttatatttaaaaatataaatattttcattaaaatatattaaaaatagaaattccgaccagcagatgcatcataagtttcatgcggcaaaagattgttggggctcatcggcgaaaaggcagcaaaatttatctgaaaatttatttgaggaatttttaaaattcatggaactaagtacagacgcttgtcatcctctataagtttttttttaaatttcagctcatggagaaaaactaggatctttttagccgttttccgccaaaaaaaaagaaaaaaccaaatttttgccatttttgagtctaatttccaaaactattacaaaatggggggtccggcggtgccgattggcgccgccggtgaaaattttgggaaattttaatggaacttgttgataattgagtaaaattttcaaattcttgtatattatatttattgaattgatcagattcttctgtgattaggcactgatcaaattaattgttgggttcaagaaaatcgctaggtttgaaaaattcaaattggcactacattnttggcgtttgtcgcgcaacgaatcgcgcagaaaagttttctggcgcggaaattgttcagactttcgtcgttttcggcgccaagcacagcatgcaattgtgacaatggttgacaacaaagtgatcagacaaatgcaggcgatcagaaaatcacgtcgccacaacaacggttcacgatatggggtgggtgcctgtgtaattcaatgatacagtacataaattggcaaattacggtgggcatcacaaattaaaaaaaaaattttntttaattattttaaatcaaatgtcgataaaattcgtgtg

SEQ ID NO: 3165 - DNA, 1711 bp, Heterodera glycines
attttgttcaccaatgcttgccgtcctggaactcatccagccacactgattggacgggattgtgacggacgaaatccaaaccgggatgtcgtaggcaatctaaaaaaattaaaaataaataaaataaattttttatgcattttaaaattaaaattttgattaaacaattatctcaaattcatatttatagttttaaggaaagaaatttacatatttacataaggtttatatataaaaattacgaaaaatatttaaaagaaattcaattttttcaaaaaattctcaaataaaaaatttaatgagggatttaatcatttcttaacttaggtttaaattattgggactgtatctaaatcgtcttagttaatttaaacaaaattgatcattaaacaaaattttataaaatattttagttccccttgaaataacaatgaattctgtttctaatttgcacagaaattattttaagttttgtacaataattttttgttaggctatcggcccacgtagtatagtggttagtactccacgttgtggccgtggcgacgcaggttcgattcctgccgtgggcaactctcttttttgaattttttaaaaattccgaaaatttaaatgcatgtttttatcattttttagcttaggtttgaataattgggagcaatatttatttataaccaaggatctttatgtaaattagaaacaattcatcaagctgttgatatttaaaaattattaaaatatccaaaaaattcattttttccaaaaatttcgaaatttaagataggagattttttaacatttaatagtttaggtttgaattatttggaccgttatctaaatcatattagttaatttaaacaaataagcataaacaatttttgtaaaatatatatttattgtttcctttaaacaacaaagaattttaactcaaatttgcgataaaatcttttaggttttgtacaataattttttgttaagctatcggcccacgtagtatagtggttagtactccacgttgtggccgtggcgacgcaggttcgattcctgccgtgggcaactctcttttttgggtttttaaaatttgtgtttggaataagacaattaaaaattataattaattaaatgtctttttatattttttaaattcattttatttttactccaaatgagttatgacgctcaatttgtgtgaccaactgttgtccaaatgtatcaattcggcgtgccttaaaatttaaaaccaaataagttttactaattaaataataaacaaattttttttgaaccagtttaaaaaaataattaattttatcccaattttgccggtcttaattaatttaaataattaatttgttttactaattgaaataagtaacaatttttaaagcatacaaaaatttaaatttatatatgtcataatcatgaaaaaataagattgtgcgcaaaaagcaaaaaaaataaattaggaacttaataattattattttttaataatctataaaaattgctaattgatagttttaattaatttaattaactgaattaaaacaattatttttaatagtcgatcttaattaatttaattgattaccaattgcacacggcgttcgtcctcatttcgcagaattggcataaatgcacccaatgcctggcaaaattgaaccgcgtccaaagatgtgctttaaaatgaagcaattaatataaataaaag

SEQ ID NO: 3166 - DNA, 4724 bp, Heterodera glycines
  misc_feature (660)..(660): n is a, c, g, or t
  misc_feature (692)..(692): n is a, c, g, or t
  misc_feature (745)..(745): n is a, c, g, or t
caaatttcgtccccattttcgcgcatttctttccccccctaggtctcattttatacaatgttcaaattcaccaaatcataaagcaaaaataatccaaacagtaaactaataaaaaaacattaaatttgtacatggcccggatttcgttttcctccgcaaaactttctcatccacgtcaacaatgttaagcattattatccatactcaagtatccgtcgtgccaactgttcttttgctgctgtttttgaagtgttttttgacgctgtaacctaaaaactaaaagtttgattaatttacgtaaacaatttcatttttattttgagttttaattattattattattttttattacatttcccgtgacaataatttatcccctatttccctcctccgctttgcttcacctcagcagtgccgtcagttcgctcatttgtccgtttggttgtgccgtcgtcgtcgccgcttccgccgacccttccgcaaacggcgattggccgtgcgaaattgacttcactcgttggcgaatttcgcgcacaatgtccgtcgcttgcttaccgcgtgtttctatagagaaaaaaaagtctaattaaaccataaatataaaaaaatagaaatgtttttttaaattttttgcaatttaaaatatattaattttattanaaattataaaaataaataaatatttaaattanaataattaccaggcaacaaacaataaacgaacacagcgccaccggcactgacncaaatgaaagggacgaaactgaaggaagtgccgacaatctgcaaaaagcagtgaacacttaagcaattcttactaaataaatcagttaaaattcaaaataaaagaaaagaagaaaaatggcttttcccatgcataattaattaattaattaaatgattaatttttgcactttttaaaggacaaatgaattttaaatgtgcgcaagtgaaaagaaaacaaatgaaatgaaatgaatgaatcaatgggaaaaagaaaggacataatttatttgaatttatttatttatttgtcttcagcggaaagaaagggcaaacaaaaaaaagcgcacttttacatctttcgtccgtccgccgacgcacttttatccgacagaaaagaaatgtgcacttttcttttccagacaaatgagtgggactttttgggcgggtgcctaaaagtgcaaatgcccaaataaaagggctacgcacttttgaaggaaagtgcaaaattggggggggggggacaatgccctcgggggggggggaataaatgcccagggggggggggagatttgttacccatcccaacccaaccaattcactgatgaaaatgcacactctccgctcaacagagagagaaacgagcgaaaagtgcaaatgaactttaattaaaatttcaatcgaatcgaaaaagggcaaatcaatgggagagatttgagaaattgtgtcaattgccagataaaacttaattaatttagattaggtttttaaatagtttttagctgtctttacagagagtaaaaagacgaaatgaaaagataaatttaggtaaaaaaaagttttatttatttcgaaaatttgaaaaaatattcggggagaaagaataaatttatcaaaaaataggaaaattatttacttgttggaatggcaaatagcacgtggagacgacaaaagacaatgaccaagcgaccgtaacagcgacttaattaaattaaaaaataaaatttaaaaaaatatataatattttcaccagtcacagcagcagcgcgaaatttggtggggaaaatttcactggaaattagccacggaatggcacaaccgacgccataggcacacatataaacgatcagagcggcgatggtggcgtaactggcgaagttttgctgaaattgggaagaaaaacaatttgagttggaaataaatttaaaatatttgaaataattatgatttctaaaataaaaatagttaaaagtttaaaatgttattttattcgcctatacgtttggatattatttccttttttctttaattgaattttaatttcataaccatttcggttatatccttaaaaacattgctttacccaaacggcgtgttgaagtgcgacaaaaatgctcaaaaagaacaaagaaaccgaacacattgccaattgacccttaaaaaacatagtaataaataataaaatgaatcataaattgggcacgtacaatcagcaaaatacggcgtccaacttgttcgatcagaatgggcgcactgcacgcgaacagaaaataagcaacgccaacggccaaagtgctgaagcgcgcggttcgtctgaaaaatgccaaataatttaaaaattatttattataataataattaaaatggacttacgggtcgagcccggcgtcgatgaacatatcagtggaataggcgaacacggcggaacagccggtgaactgttgggtgaccatcaccacgatggtgatcagaaggggcaggcggaattggcgttcgaagaaaatttggcggaaagtgcagcaggagccatcctcaaaaaaagaatatttattaatatgataattaatgtcatttaaaaggcacatttgtatatatatactaattaaccatgaattaatttattattttaattattgccatatttatgtcaattaataataaattgcccacttgcatgagtgctgcttcgctttgcagcgattcgtacataaattcagcctcgtcttcgtccaccaatttcttcaagtcctccatggctttagcatgctcactaaaatttcaaaatttttcatttaaaatgataaataaattagcactaattaccctcttgcgaaaagtgtgtatttgggactctccggacagaaaggcaaaaccaaacaaagcaaaaaggcgggaaagccggggaaagcaaaagccaatggccaattgtcggcactgcccaacaccttaatgagtcaattaagtaactttaaataaaataaaattgtttgaatgttttgcccacttccggcagtccgagtaaaagcgaaaaccaatcggagaaggcaaccgcaacctaaagaataaatgaccttcgttaagtgctaatggcaattgcagaaccatgtgaaatgtgccggcagcgccgcgatattttgtcggagtgatttccattagatacatcggcacgaggcctgtctaaacgaaaagccaaacggattaagcgaatttaaattttgtttttttttattcctacagaaaggcccatatttgcgccgagaatgagccttccgaaaatcagaaactcgggggaagccattgacttggacaaatactccagcagagccgcaaaaacattgacaaatccgttgatgatcaatgcgttgcgacggccttgccattcggacaattttctgcaatttaattctttgagttattaacgaacgattaacccaaattgttccattgccttttccaaatcgagaattaaacagatttattaatttcgtttatttattgtttttcttttttattctctatcatattaattctcaattacccaattagtccgggggggggggtcatgttcattcactcactcacttatcaatgaactaattaattgtcttccgacaatttttgtccccattatcagtgatttctttctctcccccctcattcgcttcctttgccccgggcaccacccgtaatataaaaagcatccaagttttgctttcaacgaaatggacgctcttcgaccgaccacttttccaccacccgtccaaacgacccccgaggggtcgaacgacgaccccaggccaaaagtgaggatgaatggccatccgaacaacacaataaagtcacatgaaaaaatttaagaggggtggggggagagaattggcacaactccagcaaaaaaaaaaacaacgttaaatggaaaattgctgaacttttaaaagaaaatgtataaaaaaacgactgacagcaataaattaatgataattaatgaaattagtaattaatttgggggatttgaacatagtctcaaataacacctgacaagcagagcaccgacaatggcaccgatggcaatgctggagaccacaaaggaccagtacaggttcatctccgtcagattcagtcccggccctccgccgttcctccgaatgtaagtcatgttaatccattgggtgagcagttctgttatatggaaaaagcgcttaatttaatggtttttgaaattgaacttctcctaaccctgctcggggttgatgatgccaaagctgtagaattgggtgctggccccaaggcaaacggtggcgacggaaacgaaataagtgggcgtgaacattttaatataaaagtgtcaaaataaagctaaaaatataaattgaaataaaattgttagcatcaaagatcagcagacgatcagccaaaacatttggggagaaaagagaaaagtgagtggcgttacgttatgaaatggaagtggcaaaaccgcgacgggtgtggtgatagcaaagcaaagaatttgcccatttttgttgtctgtctgtccgtttcgctaatcgaccacaaaaaatgcgattaaataaccaatatttgcttttttatttttgtaaattaacacaaataaatgattcatttgtgatcattgggtccgtccgtccgttttgagcacccatcgaattgcactcgtctcaaacacaaaacggtacataagtacaccccccccccccccg

SEQ ID NO: 3167 - DNA, 1985 bp, Heterodera glycines
  misc_feature (5)..(6): n is a, c, g, or t
attannggctgggccaaaatcaccaagaacgaacaaattggttgcattatgctaattggccaaataagccataaatttaaaagatgcttgcttatgtaacacaattcgccggttttcagccagggttagaaagtgccatatttatgtatatgtatgacttttcccagtggcaccacttgactcaaagcttcttaaaaattttcaaacaaaaaatttgtacatatttggaccaaccagtaaaatgagtttaaatcttcaaaaatttcagtcgtcgcctttttatctcaagagttagcctattatttttcatgaattaaaattcgaactcacagattgaatacatcattttaatttaccaattagaaaatgaaaatgagaaaattataaaatagttaatttttggcaaaatttttatctacaaaaaattcgctgaaagccaattcatgtgttggttggcaatgatttataacggagccaaaaagggaaaattcgaaaaaagcgatgagtgatgtttgataaatgatattattattgtataatagtaatattaataaagaaagtttcaatgaattataatgagtgattagcttttatcattgaatgttcccttcgcccaaattaactcattccaattgtcaaattgatacgcttttgtgttaatttgcctgaaatgacctatgaaaacggaaaagtgagcaaagttcgttttgatagttttgtgctttttaattcacaaaaaaggtaataattaattaaaaagataattttttttgcattttaattcttagattgtcatgtgccaaatttaaaactaaatctcattctttattctttcgttttaacataaattccaactcttgtatttttggtaactcggaattcctatattcatttaaaacaattttttgtcttgtttttagtgtcgttgttttttgtattatttttatatattaaattataaaattaacaaaaaaataaaaaataaaataaattttccaattctttatcctctgatttgtgagttctgatataaattgtagcttctgagtccgagtcccaaacttccgaatccaagctcaaagcatgtttttgaaattgtcataagattatctcttaaggagggtatacaatatgttgtaaattttttgcaaaaatccaacgattcattccgttggacgcgcaacggaaaagcggaaattattttctttactatatttatttaacaattttgcatttcttcttttttaatggcccaatttatattttattgtatttgaaataatcaaaataatattagtgagcaaaaaacaaaaaaaaaattcacataaaaattagcataattatgatttaattgtataattaaccatctcatttataattctcaaataattacacaatttaagttattatttttcagtttttcatcggtttattgagtatttttttttatcagcccaataattgatcagtacacgttgagagactgttcgtaaatgctcgcgattgagtcgaagttggtttcccggggcgagattgggtttgatcggaaagagttgagcgcggcatttgccaacgagtccgtgtcacgccgatcgaagcccattttggccaacccattgggacagccaaaatcggacatgaaggcacggagttgatcagccaaagtgttagcgatcaaatcggtgcttgcagtggactaaaagacaaacaaaaacaaaagtgattagatgaaaatgccaaaaaaagtgaaagcattggctagcgaacgtgccgggagtgcagagcccaacagttggcttgcttccaagtgccgttttgggtcggcaacagtggtgaaaagaaaatcggcgggcgcagtgcaaacgacggacagaccatgtgggattagcgcgtgatccttggagtagtcggggtcaaagtacgacttgccctgggaactgatcggataggaaaggccgtggcacagatggacgacctggaaagcg

SEQ ID NO: 3168 - DNA, 1383 bp, Heterodera glycines
atgagctggccatcagcatttgggtgcgcgcctcctcttcttcggggtcgaatattgagcgacggaaatacttctcgatgacgcgcaatgcttcacgaacccacacatcgctgaccgggttggacccttggtagaggggacgagcgtcggggcggagagggcgaggcgatcgctgcacaaaatagccaaaaagtgatcaaaattaaaatgatcagctgaaaaaactaaacaattgaccatgactgtggataaaaagaaagaaattcaggttcaaagttggtttaaaaaaccccgcattgtttttaagatgatcttaaaaaacaattggaaggcggtgcctatttattataaattaaacactaagataatatatgaacgagctggagaagtttttgaatgaaatattggacggtccggctttgaaccggagtctctgtgctttctggatcaatgttctaccagctgaaccaccgactctgtcctctcgagttccccaatttgctcgatcaaatacaataggagcatcacctcaattggtccaattaatcttcctttcgaacaagtttcttctctatctcaatatttttcaattttaccaaagtttgttgatgttccccacatattcagcagcagttctctttggctacggttagggtattgtattacaatggaataactgaccattttgtacggcttcgccgtgtacgattcgagcgcgtggcataaaacgtcgaagccgctgtaaacggccacatttctaaatgataaaaaatggccaattaagcaacaaaatgcttaattaacaccgtggcatactcttcacattcaacgggtcaatgatggccaaaaacggttttatgcagcggaggcgaatgcccgccttgcactgcttctcgggaatgtcgatgatggcagcgcctggcagaataattaatccaaaatgccaataggtcatgcctatggcctccctcccatcactgatcatgaccaccgttttatcattaccgaacgtcttccccacctccctccccatggctcccctccccactttgatcgcatataagcagcccagggatatattttaaattcaattaatccttttaaaataaaatccggaatattttaaatcccccccctcggctcgctttctcccctttctctcaccggtcgtttcactgcctgtgcctgccgtagtcggaatctttaacgataatattgatttttgaatttatttctacataattaacgaacagcaataaggggcagcatcggatgcttcggaatcattcctttgccgagggggttctgcacaaaatccaaaaagtcggactcacaattgaaaaggggacagagcggcgaccttaaaatggcggaagtcgaaag

SEQ ID NO: 3169 - DNA, 1262 bp, Heterodera glycines
taataatttaataaattgaaatatgtaattaataaataaaaaatccattttttatgtttttgtttgccttcgccgtgtcaatcactgatccgccaccgaccgccacaaaacaatcgtaacttttcgctcgggcaaaatcaattgccttttgaatgcctttttaatgggttggcatcagaaaaacagttaaacacgcatgaaatcactttgttgcgatggttcgcatttgacttcatcaaacacagcgaaagacaaacggagacgggcgaacgaagcggcgacttccctaattaatggacaagcttattaattaatcattaatttgccgagagtaactacacgcaactaattaatattggatgataatttggttatataatatataaaattaaaaatatatttttatcataaaaaatatttacttaaatgccctcgttttggtgacatttttgtctgttacaattagtgcatttttggagcccaaattttgcacatcgaagccaatttcgctggtcacgccgttgccacagcgcaaagttgagctcatcatttcaaaagcgtagtcaacgtcttcacattcagctgaaaaaattattaaattaaattaatcattattaaaaattaattattaatatgcattacaaatgtcagtccatcgttttgcattcactaattacaataattacccgggggaaaagcgcagctcgcgaagcttttcctcactgtcaaattggcaattgccaaatttggagcacagaaaccaccgacaccaaatcgcgtaacaaaaggagaaatcatcagtggcacagttttaaatgagccaattgtgagctttgttgagtttgctattgatgccatgaaactttatctgagaatattggcaaaattttaaaaaatttagattcagtcaattttatatttattaattcttcattgagattttcctaataatttgtcaatagcaaatggaagtgtttatattatcagttttcattgttcgttaagagtgataattctatgaacaaatcgattgaggatttatctttataaaaagcatttatgcacacattttttatatttattgctttttaattaattatattaatcataaataaatccaattaaaaggctgacgcaaaaggataaatgtgatctcattagtgaacggtgagaaataatcgtaaagtgacaaaataaaataatgtcacattgccggcggaggggggaaatcatacagggggggggggggggggggggggggg

SEQ ID NO: 3170 - DNA, 1461 bp, Heterodera glycines
  misc_feature (5)..(5): n is a, c, g, or t
  misc_feature (16)..(16): n is a, c, g, or t
  misc_feature (35)..(35): n is a, c, g, or t
  misc_feature (53)..(53): n is a, c, g, or t
  misc_feature (57)..(57): n is a, c, g, or t
  misc_feature (88)..(88): n is a, c, g, or t
  misc_feature (95)..(95): n is a, c, g, or t
ccaantcaatttcttnccgaccatttttactatcnaaattatcctcttttttnttcnccacttaacaattaccaaataaaaaccattnaccaatnttaaaaatgaaaaatatttttttaaatcacaataatttgaaaaaataaattctccgtttcgctgcacaaattgagctaatctttttaaattataaaattaattcatccctttcttttctttctttctttttttgttcatcagcactttcaatttctttttcatttgatttatttgcactttctttctttggcgtcattttctcgtgccgacaataccctctgattaagcatatgattaagcatatggcatggattttctcaatgcgttgcgccaatttaaatgatcttatgccactaatccacaaatcttttatcataatttaattttaccatttaataaattttagaaatatttcacaatttaatattctaaaaatttattcagaagaaaaatgaattttctttgcttttatttttgtgttctttttacttttcttgtttttatggtgttttatgaggtaagaattttttaaattaaatgctagtcacttaaatttccaaaggaaaagaagaagccgaaatggtagacaaagattcattaatcccttactatatattaagcgaggcgaagctccgcccactttttgcctttttgaatttgcgcctaaagtggtgttttgtttatgtgtgtgtgtgtgtgtgtgtcacaaatgttttgaattatttattgacacgattgttttagagattaaaaagagaaggggagtgagaaagagaaaagaagagagagagaaaagagagaaaagagagggacagagagagagagaaaaagtgagggacagagagaaagaaagatagatagagggagagagaataagagagcgagagagagagaaagaaaaagagaaaagaagagagagggagagaaaagagtagagagagaaagagaaaagaagagagagagagagaaaagagagggacagagagagagagaaaaagtgagggacagagagaaagaaagatagatagagggagagagaataagagagcgagagagagagaaagaaaaagagaaaagaagagagagggagagaaaagagtagagagagaaagagaaaaaagagaagagagagggagaaaaaagagagagagatagagagagagagagaaaaagtgaaggagagagagcaagaaagaaagaggaaaagagtggaatagagagagagagagagagaaaaagtgagggagagagagcaagaaagaaagaggaaagagagagagggagagagagacaaagaaaaaaaagagaaaagaagatagagggagagaaaagggtagagagagagagagagaaaaaacagaatagagagagagagagagagaaagagaaaagagagggataaagagagagggagagagagagaga

SEQ ID NO: 3171 - DNA, 5516 bp, Heterodera glycines
ttgttttcgggtgaaagtgccaaaagcgactccatctgctgatcaacaagatgagcagtggcggtgcctccagcggcttttgagtccaattcctcatcagaggtcaaatcctcgtactgaatggccgcggccggtggttcgacagacggtggaggagcaggaggaagggcaggaccaactttgtcctttttcgcttttttgtactttttcggcatttcaaatgattgcttaatttagcttttattactaatagttagagaaaaataattaaataatgatcagagatgctaaataaggccataaaaactgaggaaaattgaatttacggattaaaaaaaattcttataataaaataaaataaagcagtagtaatggtggctatgatgggagcggactgatgggaggagcgatgaaggtggaacatcggacgaatagcaaaatgccttattggccgaggacaaacaagccgaagcgagtgacaatcgtcttactcacctttaaatgtctccaaatagccgctggtgaatgtagcaggacgttataacggcgtcgaaaatttgaataaacaatttgtggaaaatgtcaagagaaaagtggagcgaaaataatattttcaaaaaataacaaatatactgatttattaatacggtaaatattttaagtagtactgtatcacaaatcttttaatgcgatgcaatataaattaattaatttgatattaattagttctatgtatgcagtcagtattttaacaatttcttactgtagcaagttcaaacgcgtactgtgcctgcgaacaagcatttttgggtaattaaattattatatattttcttttgttgactttcattgtgaaatggcgaatgaaggtaaagtaaaaaaaaaaaatagagaaagtataaattttacaagcaaatctttgagtacttttaggccgatatcttaaaatctaaaacgacagttttgtagcaaatctttttctgatcaaaatgatatataattcattatacaaaatttaggctcctatgtgcacattcaaatttaattaggtgagccaatttgcctgtggttttgagagaaaaaaatgaagaattggcgatatgtttaattaaatgtttaaatgaatattttaaatttatttcatgtgaataaattaattgaattttaaataaggagaaaacaaaatatatttttttatgctcaattcttgttaattttaaaaaaaaaatttcaatctctctttctattttttccttttggtctcgactgttgcgcttgcagtaataccacgttttggataggggaagggctgaatatgccagttgaaaaatttgcattgctaaatgtcggagtgaaaaaggtttaagtgttgctgataagagcatgggttatcattctcgccaaatttgccgcaaaatcgctggtgttcgtctattgaccgtttcagttgtactttggattagccgtattttacgcgctaatttctattttggccgtttttgattgatttttcacattgattccctgttcctttttgtcctcctttttgtgcatttggccactgatgcctttccttgactgatcctgctaacaggattaaatttttcgtaccattttcatttttgggtcatatttacattaaaaaaaccttaattttagtatggctaaggagaaaatttccactaaaaaaaggacccttcgtcttacaacccctttggcgaaggagcgcctacagcgattgcgttttgaaccttttcctgaccaatacgacttaattggattatcgaaaaaaatttatgacgcactacgcggtgcattctttactgatttaccccatgtaaaagtcgtcacttttaaattattggacgcttccgcgcccgcgagcaaagaaatttgggctctaagctcctgggacaaaatcccgtaaattatgagtttatatctaattttttttttaataataaaataaatcaggattgtgatcgagattcacccggagcagggtgattgtgaacagcttgttgcgatgctggcacatgaaatgtgccacggagtgacaagcaaagaatcgcgcgaaaatcgtccgtattcggcgaaagaaaaggccgagcggttcgaccaatgggtgggaataaatcttacaaaaacaaaaaaaaaattcataaaattattttaaaggccaaattggtgcaccaaacactcgggatcgatccctggcgcaaatgcgacaaaccgtaaattaaattattaattaaatatgaaatgaatttttaaattctccgtaagtggtttttatgaaagtatgacaaacccaaaaaaaaaaatatttaaaattattctctaaagcgtgatggaagatttaggcgttttcggtctctcaaggcatactccggtctctttttgggcttaattgattcgtctaatgaattatttccatcttcttcttggcaatccgttttttcggccaaattttgcgaatcattttcctgttcaggatttttactaggttgtctgttagtcctgggaaaatgattgtgaccagggaaattgtccaaatttgttgcatgcattttatcaagactctcttcctcgtcgattggtaattttggcaaggtgcaattaggaccaaagttttcgaaacattttttaatttgatttaagtgaactcttttcgggttttgttgtggcgaaatgcagctaacgatagtggcatatatgccatcaatttctatcactctaaaaatgcccttccaaggcagatgaaatttcttagaagttccaactttacctgcataatttcttaataaaactcggtctcctacacaaatttgaggttgtctaactgttcggtcatattgctcttttattttctgctgagctgcttcattggcatcggctgcacttttccatgcttttcttaatgagctgactaatttttgtttgaaatcggtttcctccgcttgttggacttgactgtgaatgcgagcatccaatatttggtctacacagaaaattgggtcccgaccaaaaacaaggaaaaaacggggattcggatgtggatgaatgacaagaagtgttataacaaaaggatgcaaagtctaaaaactcgtcaaaatcagggtcctctttggtaatgtattttgataaaatattatgaaatgtacgaaatgacctttctgttaccgcattaccctgtgaccagtggggaattgcataagttttgtttatgtataacatactacaaaattccttaaaaaattctgaggtaaaagcagtggcattgtcactaatgagctcagtacaacctccaaattttaagtaacaatttgaaagaaaagcttttgcaatagtctttgctttggcatccggaattggaacagatattacatatttcgaaaaccaacaaattatattcaaaatatgtttgtttccacgcgatgtggttggaaatggacctgccaaatctaagccgactttcgcaaaaagggtattgctaggtgcgagttgcatttcagcacgatatgcaggggtgggattatgcctaagttggcatgtaatacattgacgtgtccatgagacgatatcagaatgcattttgggccaaaaatattttttgcatttccgtagtgtcttttttatgttcatgtgacctcctcccaatggagatgtatggaacgattcgaaaattaaggcccttaacgaaattggtacaaaaattcgtgtacttgatgagggtgttttaaaataaagtacctctgattcgtaaactaaatttaaacacagggctgaaaatcggtctttttcattttccgaaaagtctggtggcatattgccatttgttaaaaattcaatgaatgccaatatttctggatcatttttctgttctttactcaaatcaatttgataggaattaccatcctcgtgtctgagggtcatcgtgttgacaaattcatccaataccaaacgagggtgtgctcgtagggaaagacacaccgggaactcaattatgtcctccatttctgaaaggttctcgatttcttggatgggcgaatcttcagctgcacgagaaagtgcatcagctaaagaattctgttttccagcaacgtgtacaatttttatctgataattttgaagctcaattagccatcgagccaaatgagggtgtgtttctgattttttgagtaaaaatgccaaaggcttatggtcagtgtgcaattctatatcactcataaaaataaaagggcgaaattccctaagatcataaataattgcacacatttctatttggactgctggccatcgtctctcaggtgccgatagggtgcgactacagtaagaaattgccgaaaatgttcccaactttttgttttgttgcattaggactcctcctaatcccgttgtagatgcatccgtaaagatatgaaaaggctcgttataatttggaaaaattaaatttggagtttgtcctaataattcttttaatttgtcaaatgaattttgttgtgcttctcaccattcaaacttgactgattgcctcgagagacttaagagtggttctgcaatagtagaaaaattttcgatatgccgacggtaaaacccggctttccctaagaaacgtttaacttcttttacatttctggggattggttcattttgaacaatttcaattctgctcaatgatggtttataacccgcatttgtcagagtaaagcctaggaaattcattgattttgatgcaaaagagcactttttgggaattaatttcaggttgtacaagcgaaagcgttcaaatgtttttcttaatgattgtaaatgatcattaaatgtaccattcttggtaaaaataagaatcatcaacatatgatattgcacagtcttctaatacagataaaacaatagacatagctcttgaaaatgctgcggtggcatttttcagtccaaacggcatgtataacatttggtaaacgttatcctcggttatgacgccgcacttccatgatgtctcatctgaaagtttaatctgtaaataaccacttgacaggtctaaagatgaataataattacaattgcctatcttctccataattacatcaagcctgggaagggggtaccggtctggaattgtaatatcattcaattttctgaagtctaaacatggtctaatgcctccgtctttcttttgtacaactacaaaaggggtgacccaaggagtttccgactcgatcatgactcctgctgctagcagcttttcgatgtgttgtttcaattcatctctgtatttgtatggcatacgtcttggtgccgaagaaattggctcattagtcgttgtgacgaaatgatgagcattcgctgtaaatgatcctaaatcatattgggatttgctaaaaatatcagaaaattcttcagttaaatttttcaaagcttttaattcttcatcaataacctcagagttagaccaattaattttgaaggttggatcagtttcaatggctttcgctctgatactcaaaatctga

SEQ ID NO: 3172 - DNA, 4482 bp, Heterodera glycines
  misc_feature (76)..(76): n is a, c, g, or t
  misc_feature (166)..(166): n is a, c, g, or t
tgtccgtcaatttgatgattgcttcggaattcggagcacggtgccttacgcgagtgtgccactacttccatgtttntagcagctatgaatgccatatgttcaaccccatcagacttgaatgctattggcacattttcaaaacatttattttcttgactggcatccncaagaggaacaaaattaaaatcgtcttttttaagttcgacacatggccaaactttgattattcctggtcctaaatttttggcatagacaagggatgtgttgaacaagattcgagcaagaattgttggttctgacaaggcggacgacaaggcccataatttcatctcatgtatgtgctcacagatagcaaagaaagcttggacaaatgaaaagcgaagagcttcagtcatttgccaactcaaataggaaagttctgtctgaagctgtgagtcggtcacaatgctttcttgggctcgtctggtgcgttttcgttttgtcgttttgttgataaaggcataaccttggtgagagagagttaaatttgtattacatgcttttataatttttggtttttcctcaaaagttaaaagaattgggtcattgtctgcaataaatatagtgccaagcatttgtcctttgaatggacctagcggcaaatactcacattttttcgaaattgaggaattccaaaggagtaatgttttgtcttctaagaaacattgacctttctcaaatgagcagtgattggagtctccaattgagttttgaattgatgggctcccgaacttattaattattctcgttttaaataggtagcaattttcactgcttgccttcatccaactgaatgatccgaagagccaaacccgaggagacatatcgattttattgtcagtgtgaaatagttcaccttcctgtttaagtgtgccaaaactgcacttttggtggttaatcatctgttggcattcttctctgtccatgcttaacatttcggagtctagtttctcaattatgggaatatttgtgagggaagtgtgtttttgaatatttttacgaacttttcggcacgcccaagcttctacctcatactgaaaggcatttggtttataaagccaaatggtttgttttcgtgagcccttcggttgattgaaaagaggagtgggacattgagtaggtgatggaagagaccaaaccgttccttcaatttgagtttggcacatcattgggttttttggaattgggacatcaaatgatgcctctactgagaccggtacacatttgatgataacaataaagaaaaggagcattaaaaatttcgtgagttttggtccaataccctcccagcttgaagcttttaattggggtgaaggtggtttgatattttttgaatcaatgactggaatttcgcagttttctgagtcattcataactcctttgggctcgatttttggtttacttttaacagttgtaattgcattcaatgcattagcatcttctcttttgactgaattgcccaagggctgttggtataattggtcagaatcgaggacagaaacatttgatgggatagcatcaactgaattgacagtgccataattagcattgcgcccatttctgcctctgtttggttgtgggtcaggtctattgttgataaattgagaccgtctgttgcgacaaaagtttgcaatatgtccaagtttgccacagaaattacaaattggtctgttactccacctccgctggctttggatttgttgagaatttggccttctgtcgttcggtctctggttacgcctgaattgtgttcggttattattattgccgttgttatttctgttgttattgtcgaaattacgcggggcaaaacggtcattgagtggtgtcgcattagcttccgaaacaaaaggtggtccccgataattggattctctgttttgttcagtctgtcggtttccgaaccgttgtccactaagtgcatgaacagtgtgtgccaaattatccgagatttgtcctttttcagttaagagcagagcctcaagctcctcggcctgtgcctttattcggtctaagtctttggtcgaattgagaccgactaaacgaagcaaaaatccaatattgggtttaattctatccaaaaattcttcacaagtcctctcttttctttgattatcattcaatgttgggtttgtcatttcaacaagcggggtaaggcgcttaaggaattctgaaacagtttcgttttctctctgtttgcaaagtgccaatgtccttttagtaagttgccgtctttggggtgagtccaatttttgcctaatcccagtgatcgctgagttaagggcagctgcctccgcttggattaattgtttaaaaagttgtcttggtgtcccaattaatgacattttaaatcgagcaactttctcatcctcattccaatttcgtcctacagctccaacataatcagtaaaccactcagcccattcatcaaaagcgatcaccgaatcttcaccaaatacctctaagtgaccaatcattccggttaaagtgttaactctgccaagttcaaaactgtcttccgcaaacggatcaagatattcctcgttgtcttggcttaaattggcattattgcaagaattaaaacgaacatgagaagtttggtttggtgttattttgggtttgacaatttcagcaagtgtatcaattttagcatttaaaactcccatattcgtgtttacttcccctgccattttatttaaggcccttgtgtttgcatatgcccttcgatttacaattctaaatgatctatttacagcttcctctaggcgtagaacttctatgtgggctctttccaaatcgggaacctttaccgacgttttaccattccaaaaatttcggtcaatgattgttatgtttatttcttcatccctctcttgactggtggccctagagccagtcttttttgagtgtgacataagccacgaaaatgtgcactgattgctgtgttgaaataagtgaggggatatttgggaatgatttgaatatatgcttggctaaacaaagaaatttatgctataaatacttgaattttggtcatcattttaatgccaaatcaaaagaattttcttagtttccgttcgcttttgatgggaaattacataatgtttccataggcaattgagcgattgaacgcagtgataagcatcattccattaagatgcaagcagctgactgtaaaagcaattagtagcatcggcggtgatggccggaaggggtcaaagtgaatgaacgtcgtgtgaaacgaaagattagtttaaagtgaacttcgaattaaagttatttgtaaatagcgttttagttgaaatttaatttttatttattctatttttgcattaaatgttaatttgcgtagtttttctttctttttcttgactgttctccccagggagtaattttgcattaatttccaattttttactcgcctcatctctgcgcactccattctcttgccaacggatagccagggtcgctggaatccggtgctaccagtaaaacggccgggtgtccaacccagagtttaagagagatgcccattaaggaccatggaggtagtgccagaggaatggaagagggaaagagaagcgggaattgatgggtgaaaatccgggccctggactcccaacctcccgggtcccaagcccaaatccgtccgcgtccggaccaataataaatcggcggagaatgatcagtgctttattggaatagcattaaaatataatggtcgacggataatgcactggttggccaactgatcccccgagtgtagaaagtcatcagtttaaatagacaaatgtgaagggaaaaggcaaaggggcggaacaacaacagaaaagaaattgattatggaaataatcgaattatgctttacacgacattcaacaatgagcttgatattttttatatacataattttttttaatttacatatgtaaatcaataatataataaagattataaatctcgaatttaaacgaagttggaattaattatgtaaacgcaagaaataaggaataaataaactctgcataataaaaaattattaatacaaaataaaatatatatatatatattgctaacaaaatagtatataaattttaaaaaataattcaaatattttttaaataagcatatttgatgtaaaaaaccatgcctgacgaaaatttatttgaacggtttcctataacagtttttcgtaaacaaagaagatgaaatatttttaatatctttttaaaaacattgaacaaatgagattgtattaattattaaaactaattgatttttctctgaatttaaaacgaaaaacaaataacaaatattaattcatcattttaattatatacattaataattaaaaaataaaattaaaaagattaatctaagtcagcaaaactaaaattagaaagtgtcattaattggtaacaataaaaattcctatcttcttgg

SEQ ID NO: 3173 - DNA, 1407 bp, Heterodera glycines
ttcggtttttcttactatccttgtccttctgtgttccttcttagctcctttttgttttctttttgaatttttcccttttttggcgttttgttgttgttgttgtttttggtcttttccatatcctttagcgcgctcattgcacggcacacttttatccatgaagggaaaaatgtgccgtactttgtctcaatttttttcgctacaatactacaaaaaatggacaaatttggccaagtttggaccaacaatgcttttaaattcttcaaattcatcggatttatcatattttgttgcaattgagtcccaatttcgtccagcagccgccatttgttcttgcttaataaatttgcaaaaaatttaggctataaaatttgttctgccggccttggtttgtttgcgaagaattattttttaaccatataaaattataaaaatttcgaagcaaatgattcgattttttcgcaaatttaaaattggtctcataattataaaaattaattatattttatttaatttaataattaatttaatttaattgctcttattttcatttaaacatactgcggtagccaatcagcgcgctctatccctataatgcttcgtatcttgtccatccttctgagaattcctagaaaatcaccgaccgcttttttatctaattccttgcactgtaaaaaattattaaatattaaatttttgtatttttttttaaatcgcactacgaaaatttcgatacccatataaaatgactttttttgaaaaattttcaattagaattttctgaaaaattgagactcgcatgcctttcgggcctgcctgccctgcttaaaaaagttgcacttcctaattagttgacgaagaaaaaagttatagcccaaaaaatttgtgctcgtacgaaaacggcctgcgaattggattagcccatcccccactgccgaacgcccaatgtttcccaccacaaatagccacatgttgtacacacaaatgtgctcccatcctgaaaattgtgctgtccgattggcacaaaaattgcaaattgctgagtaaccggaattaacaaaatggatcaatgttttgccgctatgatcatttagcacctataaataacatattgatacagggatacacattgataaaattaaataatgaattgattttaaaaaatggaacttttttgaccgaaaaatgtaaaaaacgaaatttttttttttttaattttttgtttcgccgtcttttgaaatttttatgattggaccctttccagaaaaacatctatgacgatgaatttatgtgaattttcctaaaaacccgttatttttgaagggcattcttagggttcagccaattttattttgatttaaatatgaatattattttttaatttattaaatttctcttttaattcac

SEQ ID NO: 3174 - DNA, 2228 bp, Heterodera glycines
attttgtccataaacatatgaccacctaaaatggtcgctatgcctattcactcacgtggtattttgttactaattattatttcagaaattaaaagcgatagcgattccaatgtatataaattcgatttcatcacaaccttttcctgcctcaaattcgaattgtttcacgcaaattgacatttgttcaaggagtaggaaaaaggtttctttttctaatcaattcaagttccaaatattttttaagaattcacaccctaaattgatcctcacaataccgccagaggcaaatgagaaggaaataacggttcaacgaattccattagtgattgagtatttgcaaaacaattggacgttgcatggatgggaaccgaaagtaacggaacgaattgggcataacattttatttaattattaatatgatcatttttaatagaaaaacattgggctggacagaaaaactgcaaatgataccaattattacgctgcgacttcatctcacaatcagccgagggcaaacgaaagagaaaacgcaaaaagtagcaaaacggagcagagggaaaggccgatgggacgaacggaacactcattacacacaggttgatgattttcgaaattgggcagtattcatttgtaatggctattcccccaaattgggaccttttttgtcttcaaaaatatttaaactaatgtcaagtttgaagacatttttttggacttggtagctgaacatggatctgacacccgttctgacaaataataattccgaaattggataaattttatcatatttattccgtgtttttcggaattggggcggggattctaattagttaaatggttgttagctgattcgtgataagtgagtggccacgaaaacccctgttaatggcaaataaaacctgagattggaatttttagcaacaattgctaattctcgcggttctgttgggatggaggaagtcgcagacaaattgcgtcaaagtgcgcttcagtcgtccaacgctaagcgaaggcatttgtcattggcagaacaagcgatggaaaatgaggcggagatggaaatgaatgaacaaccgtcggtaagtgcaaaagaattaaaagtcgaaattggccaacaaattgtcatgcaaaaaaaggaatgcttaaattgttccaatccgccgaattatttatcgaacatcttatttttgaattattgagaagctttttaaccaaaggctcacaagaactgggcgtttcaagagtgctctgaccacgaatttgggctcagatttgtcataagattgtttaatcggtatttttcgaatatattttctcgaaattaggattctattttctttaaaaactcatgaagaaaagttttttaccaacaatttctcggcatttctgctgacctccctcccttttttcatgtatgattgaattttcaaatgtttgagttgtaattaattacgagtcatttttttttttattagtttccacaaatctctataagattggttggagaaaactgcttttgtgataaattaaaaacttgcataagttctctatcatttcaaaaaaaaaaaattcatcagaaaccgactggtttgggtctaaatggtttaaatcggttttccggtgatttttttttttgccaacaaaatcccggtttatttttatgatttaaaaagatatcaccaaaaaattattttttgagcatttcgaactaaatttgctgttttaagattttggggagaattttttaaatcataaaaaaaaaattaatgagctaacattgtaagaagttcataagttttaattatcaccaaagctatggaaactaataaaaaaacggctcataattatgttatcaatataataaattttgtatattttcaagtctgatgacagcctttcgcagtcggttgtctttgaatgccaaagttgcgacaatggcaaaggccgtgacgaggacgaaatgggcataccgcccccatcaaaacatggaaggacggagtgacatggcggagagttggacagacggacaaatgaacgacggaatggagtttgggaatgaaaaaaaaattcaatttgacatcaattttattgaaaatggatggaaatgaatagaaaatttattataaaacacctggatggatataattttgtttaaatgaattaagggaatgttgaaaaaacgaaatgggtaaaaaacggaggcagtgaaaagcaatcgaatgatcgat

SEQ ID NO: 3175 - DNA, 3924 bp, Heterodera glycines
atgggtaaaaaacggaggcagtgaaaagcaatcgaatgatcgatcatctctttaccataaatttcctcttttgttcgatgtatgtgcagtggagcaattgaagctgtgattgggctttggtggattacgcctcggggattgggtcactttcccacggacatcggtctgagtggacaacttcacgttaggattagaggggagaacatcagcagtgggaacggaggcaaaaaggatcaattccccggggaattttaaggatggacaaccaaatccgacaaaagtcggctgttgcctcgggagacagaccgatgttgttgaagtcgttccaaagtgctaaaatcagttccgaagtcatcagttctccggcatgcgttgagatcatccgaagctgtaaaattcatgattaaacttacaattagtctaatgaatgctttctcgccataaacactccgtctttgcgcagaaaattgttggtgaatttgcgcagcgaaacgtcgtcggccattggtttttgcggatgttcgctgagcactcgcaaatatttgcggatgaaaatgacactctgagcaaacaaatgccgaacctgtgatgagagaaaccccaaaggagcacctttttcgggtagagcatcacgtagacccaatagagacaattggtgacctgcaaaaaggcggacaaaaggaactgattacggtacaaaagggatggattacggtaacggagccgacggtgagaaaccaaaaccacagaaacagaaagatcttttcgttgaacatgctgtataaatgtaaattgcaaaagagggagatgagtgagcagaatgaccgtacttgatcatgagcacacattgtacagtatgcctgtggatgttgccgaggacgcgcacctcaaagtcgcacaaagtgacacgtgggaacatccctagaaaaacaaaggatttgctgagatgtgaacagcggggaaaggacggagggagggagcgcgccccggaggacaaaaaggaacagaacggacggatggacggacggacggctctaggaaaatccccgacacaggaaaatccgacactaacattaaattttaaaaataatttttgattctatgagttaatatttaaaatacatataaaaagttacagtactgaagttatttaaaataaatattcttattgccataatctattctatctaggtgggcatatgaatattttttgtatgcccttttttgattatctcaaaaaaataaaataatctctgtgatccttgggaaacgagaatgtaaatagtgcttaacaatttttaacatatgaatgaatgatattcttcatattcacctggacctaatactccccaggcaaccgaagttgatcagatcattcgtgaaaaaatccacgcaaaaaaacaattctcggcaaattcaattcaagaacttgctaagcctaggcagatattaactcaaacaatctaaaattttgttttaatttaaagttagtgtcggattttccagtgtcgggtctcccgctggtgtcggattttccatcggtgtcggattttccgcttgtgtcggattttccatcggtgtcggattttccgcttgtgtcggattttccagtgtcggattttccggtgtcagattttccagtgtcggattttccggctcccggacggacggacccaaagagaggcgagggatggacatacccccgggggtggggggggcgaccgaagtgacacgtttatcttcatcagcggttctgccaattccaatgccaaaaagaaacgtattcctcctcctcctctaaagtcgggagcctaaggcacaacaaaagggacgcaaaacgcaccccttaaggacaaccccaataaagttatgggccaatggttcatctgctggtgttggcccattccctcgtttaacccacccgttttctcccattcgatttcgttgacaatgtctctcagaagagtgaatccgtaagtgaaatcgcgcgagcccaaaatgtggttgagtaagctgaaattggaaaaaagcaaaaaagtgacgaaggaaaagcgtaccaaaattggaccataacatttgtggagtaaaggagctgaatggggcattttgtttgaaatgccattcactcactgactgctcacttttatgccaattgagaggagagtgacgtaacatccacagtgtttgccaagtcgcaaaatgggcaaacgattgcgactttgccgttgcacttgggtcagctgaataggcggggggaggaggtcaatggcatttgcaaaatcaaagagtcaaaaggcaatggcacttgaccaacatgcacttcctcctgcatgtgcctagccatggtgtacaccgtccgcgactttatctcggggtccatcagtcgcgcgtcacatgccatttggactaatccctgcaggttgatgcctgctcattggtggcaaatggcgtaatgagttcggcactttggaatttcttttggcactgacccgagtgccaatagagaaggcctcgccacacaatgcacggaatgtaaaagaacagcgcctggagggccaaaataaatggcaccttaattggccaaagagtttcggggtactgtcaccggacggaaggaataccgtacccattgatagtatccaatctgtcggttgcgccgggaataaacctcccggggaatgtcctcctccattgggatccaataagtgttttgcacgtagctgaacgtggtcaaccacagtcattcattcggtggaaacgaacggaggacaattcactcaccagtaattctcctgcaaaagcatttggaaatgaaagactaattaattatttaaaagacggaaaagcattgcaaattaaaaatatatttaattggcacattttccctccttttcccccattaccgtgtattgttccattgcatcttaaaatcatattgtttactctttcaaagtgagttaaattatatttcacctgtaaaagtcgccggcacccaacaccttaaaatatttacaaaattatttttatttttacttttccctttttttttgcccactgaattggaaagccgacctgaaaatgcattaaatcgttaaagcaatcggttaggatgatatgctcacatattgtttggcagatactaacaaagcgaaagaggcgactaaaattggcaatttaaataaaataaatttaaaaatattcaaaaattaattttgccaacttacgaatggtcgtcgtataataatctatgacaaattaatgtaatttaatcattttactttaaatgcacgcacagttaagcttgtctatgaagtcgtcatcttaatgatgccaaatgatcgttaatttgcgctttcgcttacccaaccgcggataaagtgcccgaaatgcggaggccaagtaatagaggatcatagctgaaagggtgcctccattcggttgattttggcattttttaatgaatattttaccaggcgaagcgccttggccgtgggcgtggccttacaaagaaaagatttgaattttaaacatcccaaaatttggcctaccgcccccgtgggcgccgaagtgatggccgccgatgtgagagccgtccagaaatttgtgagactttaaaacatttagggttttggtggtgggattagacttgcctggtaggaagggatctgttccaagtgccgggccttgtctatgtgcgatcgctaaagaaggcgcgggttattacttaattaactaattggatcattattattctgactttgttttctttttgacattaaatcgtttttcaaaattaccattttagggtcgattttttcgggaaatgaaagtgcgagtgaatgaatgaggaggagaagaagatgaaggtgctttgatgggatgaaaatgaacggaaaagcggaggggggggggaagggaaagggg

SEQ ID NO: 3176 - DNA, 1314 bp, Heterodera glycines
ataaaataagcggagggaaacgagccgagaaaggagagaagccgatatgtcaattagccaaattgactttgattggatgaaaatgagaagaggggtgggtgagtgagtgttggcctctaaagacgaaatgaaaggccattttaaggatgaaaggtgacggccgattaaagtggaaaaagtgccaaagtcggggcttcccctcggggcttttcccgggtgtgtgtttcggcatgcttttgcgttcgctacctgctccaattgaccgctctcctcgagctgcttctgcttcacttgctgcgtgtgaattttagccaatttgggcgcaaatcggggctctgaacgcaattggccactcaaaggacggaatttggcagggaccaggcgcagaatttgcccctttcgctccgctttctgttttttgaactccgtccggtccctgaccacttcccccccccctacgttcggttttttggtgccaaattggccgcgcgttttgggctcctccgctgccaaagtgcgttagtgtgccggtgcttctgctgccccggttctgccgttcggccaccgattgctcttcctcctccccaatcggtcccaacggattgtccgtcccttcggcccaattttggccctcggcactgtcctttttgtggccgtttgcccacagattttggcaatttttgcgccctttcagcaaaaatgaattgtcaaataaattcgtgaggtgaaaacggcggaggaattggaggacaaagctgcgagaatcccttttttgggagacgacgaaacgaacggagtcggacgaaggcgaatggacgacggaatggcggaagagagaatgggggagggggcggtgggaatggcactggcaatgggaaaactccgatgggaaggctgagggggcatcgatcatagaataggggaggaatggcaccaactcggtgggaaaggcatggacaggaaatgctgttgttgctgctggacaaaagggacgaaaaatgggagcaatgaaaaggaaacggatggaagaaatgggggaagtggaaggggaccgattgggagggagacaaatggggagggggcgggtcaactccgtctcagcttaagaagccaaataacttctttctttaagaacttccgaatgataccaattttgataaatttgctcaacaaagaaaaagttatatggccagacggagttggccttcaccggggaagggaaggaggagaaagggaagaccaaaaacaggggagggaaaagggggaaagggtgagagtaggggagggggcacagcctttgttaagcgtatgatt

SEQ ID NO: 3177 - DNA, 1191 bp, Heterodera glycines
ccccccccccccctcaccgctcatcgggtggcttttctccccctttttactcactaaaagcatatgaagagatgaaaaaaagtgggaaatgcaaatgaaatattgtaaataaataaaaagtagaagaagaagtactgtatgtgggaagacaatataagtacggtaataagaaaaataatgaataaataatattataattaccttatagaaacagcaaaaatggacgacgaattttgtaagttcaataaaataagaaaatactgttaatgaggctgacaaaaaataagtcacagaattgcatttgccattttaattattccattggaagtcccaaaatgcgtcaatgaataaaaatgattttgctttagcaaaaaagtgggaaagcgaagttaaaagatgaaaacgttacgtggcattttattgccgcggaaacacgcgaaaagggacgggcggaaaaagtgccatggattagcacagcgggaaagttggcacttgcggagggattggcgagggatggaccacggcaacagggacggtgaaaaataaggcaacagaacgatgctgctgatcagccaatcaaattggtcagcaaatagtaatgggtacggtatgatcacttttttacagtagccgataaaaatggcaaataaaacactcaccttaaagcgagagccgaacttgagttgacggaatgcatgcatttaaaggacggccgaggggccaaattttgggagggaaaagcgatcagaaaaaaagccgggaaagagtagaggtgaacaaaaggcaaagaacaatttggttttcgcgtttctaattggctaataattaattaatcaattagcatcggatgataaaataaggcgaatgaatggcactttctctgaaagagggcattttactttcgcacgctattagcattgaagtgggggagggggcaattaatttcaacattattaaaagcatttacggcgaataaaagggaaaatgggggggggatggcttattatggaaatgtttcatttgatatgacaataggagggattgatcagcagttacaatgataatgaagagataggcaaacagcaacaagatgcgacagggattaggaggaataagcgaagaagaagaagaagaagttgacggaaaagaggggaaaggagggagagggagaggagaggggggataagggag

SEQ ID NO: 3178 - DNA, 656 bp, Heterodera glycines
attaacaaaggatatgcaagaaacacagggaaaagaaatgtacacaaccaattaaaattggaaattgtgaaaatacgagaaaatggggggaaaatagagaatttaaagcgatgaaattaaaatgtgtaatggaattattggcaacaagcagcagattcagtaaaagcaagcaaagaatggcatcgaattaaatgaggagaatcagtgggagagagttaatcgaatttgtaaaaaaataattatgagacaataatccctaattatttggggtgccaaaacggcgattgaaatggcggaaaatgtgggggagaaggggtgagacacaaaaggcattgttgtaatggaaaggggactcacgaggaatgccgaggaaatcggcaggcgttagcggcaagggaagaagcactgatgggaggggaggagggaaggggaggggagggggggatgaattgggggatgaatgaatgcccttgggcctcttcctcttctttttttttgctctcccaaattctttcgcgacgacttttactccaacaccgcttcaattcgcttcattgctcacagtgccgaaaagagaagtgaggggaggggaagaagcagcaaaattgaatttggaacataacgaaagcaaatgtgaaggggagttggtaagaggg

SEQ ID NO: 3179 - DNA, 9333 bp, Heterodera glycines
ttgtttgtctttccatttttaatttatttccaacaggggtccgtcctacggcgtttcctaaatccaccagcagcaaggggggggcgctgaaaatgaaaaaattaataatccactttatttatcaaccaaatttaaatattaatagtattcgctaataagttgactccaaaaattgtttattgtattaaaaaaagttttattttaaatattttacaatttattttagatttcttttaagtttttattacagttttgtttgaaatttatgactttatcagctttttagagaatatacatatatatttttaatttgtttgttttcgaccaaaaacattatgataattttatgaattttgtttccataattataccaaacattttaaatttcaaatgcttttttttgtcttctttaaaatccgaatttatcagcttttgccagctctcctcccactcccaaattttggttcatcaaattatgacaaaattagagttttacaaatatttattttaaaatcggattgcgtcggcggtgaaacaaattcatctgctgctttccctcctccactttcttttctctcatttccgcaaccaacaaaaagccgcccccaccttcagatgcttcatcttctgctctgatggtcgcccgcccattttatgttcaattttaggtcgtatttatttaatttttttgctcatttttttcttaaaattccccctcatttatttgtatttgacggaatgccacaatgtttttggcgaaaataaaaaattggaagcggaaaaagcataaaagaacaaagaaagtgaggggcataacaaattatgtgtttcggctacttctaatagctttacattggaacgtcataattgtcacttttgaataaaagtaatatttttaaatgatttaaaaaataataaaatttgtcacctaataattaaatttctgttcgattaattttaccattttcatcaataaagacatattaacacaataaaacggaaacatttttaaatggcattgttataaagcaaatagccgattattatttattcaaaagcgttcctaaggaaatttagcagcatttaaattcaatgaaaaatttaatgtatataaattattttagctggcacacctgttgctgatgaatagggaccgaattttgaagcatttgcctaattttttgctagctttgggcgagctaagaagcattaaaaactcatttctaaacggttttgggcttttttaccttttagagaaaaattttaaaacttttattttatttaaaaagaaatttcggcttttttatttgattctcatcaaaaaaaagacaataaaatgcaaaattttatgcttatttcttgattttatgtacttaattcgctatttttgagcttatttcgtgcttaattcattaaggagtttttgttgcttaattaaatgtttaattatcttttttttgcttaaaagtccgatccctactaatgaatgccaaatgataattaaatgacaacctttgcacataatcactaattttttccaaatgttgtattactatttaaggctctaatttatgagatgttcccttcaaaataataatttttctacaattttcccattatattaattttttctcgtgcgattacgtaaattttaattcggttattaaatttttaataaatcatttatgattcaaactacgaaccaaaaatttgtagtttcttttcttttcgcagcgtcattttccattttaagaattgagcaaataaatgaacgcaccacagagaattttaattgaccttggaaattgtaattaatatagagagaatcatttgatttggctgtgggtgagggagggcaccaccgccactctctgcctgaaaggcggctaattaggtaattaatttgatgaccaaaaatttaaatgaccgatagactgctgattactgtaagtgataataaaatatgtgattctgaactgcaataggcttcgctgttttttcttaatgttttagaaataaatttttcctttttgaagcttttgcaaattatataattttttgtaatatatattagtctcccacttaattcaggaaaatatgaattattcatgctttatcattaaccgtaagagaataaaaatcttaggatgcaacgcaatttaagtagttaaagagaccggtctttaactacccatttttatatatattttttttaatgccaaaaattattgcgaaatatttgtcggcagccctcataatgtcgagacagcgagtgtttgctgaacaaatcctcctccactttttttgtttattctaagtgaatttttgatgatttgcccccccccccacaaaaaaaatccatttttatggccaagcatttttcggacctcccccccgtcgcttcgcatttttatttgctaaagaataaaaaagcgaaaaaattctttttgttttattttatttatgtcgaattttttttcgagagagtgaaattttgcattggctgagcaaacaaagcgaaaattcaatggacaaaggggcaaaatgagctgtgcaaatttcgtttgtttgaaaaaaaatttttgtttggaaaatgtcattttataatgacaattatttcatttccaaatgtcagttcatttgcactttttgtgtttaaaaagctaaaaatgaaaattttaccttagaaaatttttggcttcaattttatttcaaaattaaaattcctgaagtttaagaaaatactatcgaattttttaaatgctttttataatttacaaatttttgcatttaattaaaactcatattatttcctctcttttaatcattttgctacatttttgtacctatttcaaaatattacgattatcaaataatgtgcaaaatttatttcatcgagtgataaggccctccgctatttttctgctgataatttttattgcatttttgtgtcattctttggttggttctccattttttattttatttttattattttttttacattttttgcgatttttaattgtttaaaaatgtcataagatattttacaaaggcagaatggtagttacctttaaacaaacaaattaactaattaattagttaattatgtttttgttataaaaaaatcattccaaattttttaattaatattttttcttaatttcccttaacatattttcaactttcacccccaccccttacttatgcctaagctttttttcatcaacatttaatgttaattgttaataatccgtccgtttaatcaaaaaatattcatttgcataatctgatgatgatgatgatgataattctgttgttttgtatggtgtttcgaatgtcattataacattcattcattttgcttaatctttctctccgcatcatttttcgttcttctccccccggggcttttatttaatttattcaaatttccgtgcccattaaaaaagaaagtgcccatcgcgtgatttgcatagtaaataatattattcttctttttttgatatgttctccaaaacgccacaccttcacatttatagaaaaacccaaatgcttttgcaaagcatcaaaaattgataagaatggcaaaaaaaaatacaggaacatttttatcacaaatcctgtgcttttccaccaaccctaataataaaatgctaatggtctattatgcatcattaatttgatttttatattttaattattttattcctaaataccattgtttttttaattttcaaaaaaaaaatcattttaaaataatcgaattttaaatatatttttaaaccttaaaatttttggtttctatttttaaaaagataagcaattaaaatcattatttttttaatattttagttattttttcttaaatattttcttttaattttattttaatttttttaacaatcacacattttaaatccattttttaaaataaaaccgtgaaagtgtttagggggtgtttaaaaatgaataaatttaaatcatatttttaaattttttaagtatttaggtttttaaacctctaaatatttttaatatcttcttaatttcaacaaatattctaattcatttttttatttttacatatgtttattcttatttatgcaatattacaacaaacgcgtcagacattagaattattaaatatttctcacatttttaatgtcctttttagattatcgtaattataagtgtattaatccccactataaattgtttattgcgaatcagttttttttaatccccccacctcccctaaaatttaatcccttcctcaaggaaatctttccaaaaagtctgtccggcgtttttaatgactttttttaaaattcatttctctttaataacaagcaatttgttcatatcgtttctcttttcacatacctaatcccctccccataatatatgtgcaaaatgtccaaccaaaataatattaaatccccaaaaaagttgtggtaaataatccaacggtcgggaatggtgattaatcactctcgagaatttcgcgcactgggattaatggggggacggggggagcatggggattaatgccttccgggcaagacaattaacggattggtgacgctttacgcatcagtcggggcggggggggggggggacggcaccaccatagccgcttaacatgcactctctccattttcacaaaacaacaaaaatattctaagggtggcatttggcgcgactaaatccgccggtgtgcctgcttaatcatcaatttcaaaaaaatttaatccgacgaccgtacacttttgatgagtaccaaatccacacctgattgacagcattttttaaattttttgttgcgatataacttaatgaaatgatgctgtttcaagacaggatatattattctcgctataaactgctcttattttccaatttgcgaaatatttaaatccctcccatcgtcaaaattaacatcggatttttgagtaagtttttcaattgttttgttttttgcctaataagcgtcaaatttcgtaaatatatttttatttaagaattttttctttttatctttttttccaatgaaatcccgttcctttttcaggtaaaaaggaaattaattaattaatttgtccctcccaaattcgaaagtggtgtcaaaaggcattattatccaattaattggtgatgcctcagtcaatgaatgataatggcccattaacaaaaactgtctcatcacaaattcactgtttaatatgcgagtgaatgactcttcttctcctcatcttccatctctttctctctcaaatttatttgtacggccgaaaattatttttgggccctccctgccatcttctctctctcccattaatctccggcggagaccctttatttatgtgagcaatttgcgtcgagaatctcgaaaatatttaaaaaagtaaatttgatggcgcagtacgaaggggaaaaattacatccattcgccggggggcatttttgcagttttgccaaaattaattttgttgtaaggacttttttaaacttagccgcctccgcgcagatctcaagatacatttttctgtcctgctgtacaataatacattctttttgaatggactggtcaccacgggaaattcagtcccatgtcgccttaatgaggtacaaatttgttttggaattagccgcttttccaattccaatttctctccgctcaattttttttgagtccggcactcatatggacgaagtaacttcttaatactaaaatttcctattttttgtttaataaaaattattttttggttagaaaattgacactcctttggttgcatagcatccaaatcagtccagcagcaggctgttcatttattaaggttaaaatcattaaattctttaattacacttcattcacttccattgctcccccccccctcgtccatttgcacgtattattattacgcaacggacgagagagagaaaaaaagagtcaaacattgaaatttctattttctaccttaaacaatattttctaccttaaaatttcactgctgtaagactaaacgaagttgggtagagaagggggaggatttttgggcaaaatacggaggatgatgggaagagatgggaagcaaagggatgccttccgtcctcttcgtcgttagggtgtaaaattcgttcagaaatttttgaaaatccggttcatcatcaattcatggtcacgtcagcccaattccttccccccccccccgcccccgcccatcacaaaatagcccaaactatacaaaaatgatgatcacatctgaaaatttcaatctcacggaatctgcaccaccaccaccgccaccaccaccatcattatcatcatcatcagcacaattgcacgccccgggggagggacaaagtgtaatgtaatgtttaaaaattttgtagcgaaaatggccgatatttaagaggtgggagggagtaatacgacgacgacaacgggacgtacaaaggagattttgtgtgtttggtgtaacatttttgccatcatatcaattattatcatcatcttcatctttataagcataatcctcattagcagcatcattagtcgttggcatggtcatgacctattagcagcgtcatggtgggcatgctaattaggctggtcgacaacaaaaggcgccgaccgaccattgatgagctcaagcaatggcacggctattattatatgtgcacaattttttgacctttccggatgggtggacaaaaaaactatttttggtgggcacaaaaatattttttgtttacgatacacttatagttgtggtaataataataaagtactggtacaaaacggtccgtaattttactaattagccaaaaattttcttttcttttcttggaaaaatggtgggaaaattttagaggagcatattttgtcgagaattggttattagaattttttttttccagattgcgtttcatcttttttctaattttcttataattttccacttttcatttataataaaaatttaattaattgtattttattttctaattttttcttcctgcttaaaaatgtattgttttattttgtcttttttatttttgaatatatgaaattaaaaacttttttttcttttaaaaatttatgccatatttattaacacataccattaaataccacactttgaattggaaacagggacgggcgaaacttgggctttggcttcgaaaacttcgggtttttaagcctcaatttttgagcttcggtgtcgggtaaattccatgaagcttcgattccctaaagatcgaatgtgaaaaacataacctaattatgggctcaagaactaagaatgatcctttttttaatttgtgatctaaaaagcataaaattagcaactttttgtgtaaatctttcaagaaatatggcctaaatttcataggcattgaaaatagaaaaacaaatggattctcaatagacataaatattcctgggaacacactaattgtgcttcatttattttttgtaattttctttaatttatttttattttatttttttgtttttttaaattttggcacaatcttttggtctctctcctcccacaaattaattctctcccataaattacttcgctaaatttgctcactgtcagcacagcatgaccttcccaaaattgtgcgcattacaccgtaaatattcgccatataaatttatttttcttacacaacaacacccgaaaatgaaataataaaatgaatgaaatttattaatgaatgaatgtacctgaatgaacaaaaatgtaatttttaaaattaaataccaaatttaaacccttaaatgcttcttattttttggaaattaattcccataaatttttattgggaatattccaatccgttaattaaaatcattttttataattaaaaacaaagtaaatggctggaaacatctttctaatatttttccacaattaattctgtacatttactgagataatttttaaaaatataaatcacccaatactttattccttctgaccgagaacggaaaattctcagcctgacaaaaagaaattaattaactaatgataattaatgtgctccgcatagaattgacagacgcgccaaattaatcaaattgtgacagccgatcaaaacatcattaaaaataaatggggaaatatttgtttgcgttggttgatccaatgtcatcgcatttcgtgtgatgggctgaccttcagtttgaaattttttgctaaatttacgaaattctcaattacagaaaataattttataaaagcattaattttgcgggggtcaaccgatgacaatttttaaaattaaaaaaaaacattttatatttatcatttccaaattatgacgtaatagagataaaattaaattattaaatctatcatagtaatttttaaaaaaaagaaatttcgtaatgccatatttgaaaaaaaaacaattaattaatgtcactttcgcgttttaacaacctttaataatgtttttattcccttctgacgtcaagtgcacatttctttcccaccaattggccataaaatctctttttatgaaaggtaaatttaccgatttggccattctaattaaaattaaagtatatttttccatttttcatttttgggcctaaattcctctccatttcattggtcccatgactaaaattattattttttgttttctttttcggttgaacagagcacaattctttatcattcacagaacgagatatgatcattattaaaataatttttaaaaaattagttttattatcacttttttttaaattgcctttataattacgcaaaaatcagataaaagtgaattttagtttcttaactaactaataatatctaattgttttttttgaataaaataacacattaattcggtaattctcccgtagataaaatcggattaattaatcaaaaacttcactcatgatcaaaatttattgcctatttatttgtttgttttgtttttgtagaaaacatttttttaaaaagactaaattttatttaaaattttttgttatttttaaaatttcaaaaaaataaattaaattaaaaaacaaattttgccaaatgcatcagaattggtcacgtgtgcaaaaatgtgatacatctgtgccgattaactgcggcttattcagcactcaagcacagtttaacttaaatccatgccaaacactttggcttaattaccttctcccgattatctaaattgtttttcaatgttttttttatattttgccaaatcaaaatgattaaaataatttttgaggggtaaaaaatagattatgccacccgagttctatttgccaacaacaccatacacaaaact

SEQ ID NO: 3180 - DNA, 1869 bp, Heterodera glycines
ttttaggaaaatccctttaaattcccagcggaatttccagtatttttcgaatttttcttttttagttccgcaattttatttgaaagtcaaatcaccatggaaattagcaaacattgagcttttttgtcataaaattttgtatataaatttaaaagtaccatttcttatgcttctcatctgtttgtattcgtctcgtttttccgaatgggtaattccatcggcgttaaaaatatttcttttattatctttttttaatttccatttaattgaattttatttaatttataaaattatttttttttcatttagcaaaattctgtattaatcacctatcaaaggtggttgaatgagaagattcgtagcagaggaactatttaattgcttttaaattattaattatttttcgtcaccaattaattaattaattctccgccaacttttttttttgctttcgtcgacactttttgtgccatttggctgatggaaatgccctcctccattgaggcaattcaagcaattcttcaaaatgcaatgcaggccggcattccgccggaccaaatgcgccaccttattcaccaaatgcaggtacggcttaaattaaaatttttgaatcgtgggaatttttttcaatttaattaatttgcctttctgtaattttaggtttctcagaattttggctttaattgaaatttccacgcttttactcggaattaattaccacggcttttaataatgttaaccaattaatcatacaaacacctgctgctgccagtgggtgctgctgtttgtgatgtatttgttcatcgtgagattttggggcagctgaaatttggcatttgcgcagatttgattacctttataaaaaaaaattagccaaaattgtttatttaataggcctaggcttaggcttataataaaatttaaaaaataataataaagaaaattttttttatttaaggactaaaaactaaattacaaacaaaattgaaaatatttattgtagtctccagaccaaaacacacaaaactgaagttttcttaggtgctgaaaatgataggaaaacaaaccaaaaaagtctatagcaaagcgtgtaaactaattactgaaccggttcaaaatctgaagaaattggaaatggcttggttttaaaggtttaatttgcatattgcgctattaaccagcgcacactcgactacagtaggtggggcgagactccgggctccggaagaagtccgcgcgtgatccgcagagataagctcatcaagagcttttgaatgataccaaatatatctgggttcaagctttttaaaaaagttataagtgccacaaatttctccattttttaagtttagaaccggttcaaaatcaggtttgaacgctttgccgcaatttttttttttgggttttctatagtttcagcacctaagaaaactcataaaatttattactgacgaaaaattatggtaaaaaaatcatttctcatcaacaatttgttattaaatttttttaagagataaattgcacaatttttaattcatttaatctttctaaaaaaaatttgtgaaatttaattatttttttttaaatgtttggaaatgatttcttttatctttataattccaaacattcgaaataattaaataatttcatatatacattttttggcaaaattttgagttccatattccaataattcctttatcatcaaatttgcccccccccgtcttccaacttcccaacgttcccattatttttccgcatttatcaaacaaatcccttttttcagtagtttaatttcaattcccattcaatagattattatactaaaagatatacatttaattaaaaatgtaattttattataataaa

SEQ ID NO: 3181 - DNA, 2811 bp, Heterodera glycines
  misc_feature (2769)..(2769): n is a, c, g, or t
tacaaagacggggaaagcggcgccgtcccggagaactgtcaaagtgatgttcgggaatcccgagtgccgaccccagaaattctctgcctctaagctgttgacctcaagtctcggcacaattcccggtccagaatccccccggcacatttcttgagtctcgggaatcccgacaattttctaatccacaatcccggcacattttgatcaagtcgaaaattcgaaattgaattacaaaaggcggggaaagcggcgccgttccctggaaaattggccattttatttgaaaaattggcatttcgccaaaacagtttatcggcattttctataatacagcgctcccctcgaattagagttcccatcccctgaaataaagccccccccctttttgagatggattgaaaaatagagccccaggggccctattccaagaaatacggtaactttttaattgcgcaaatatttgaatcccgagcggcaatttttctatcaagaaatcccggcacattttgccaatcccgagcattaacatgctctaattagtgcccggacagtgtagagttttctagttttgcatttttaagcaagcactgccgcttccgttgacaatagcacacaatccaccgccgtggagcatatcgcttttcaaacaccaaatggtatcaattggttaattaattaattacatagcatttatattaattaacgtacactaattggcattttaattataaaaatccttttaaattaaattatttcggctccaatgcaatttacgcgcccaatcaatgaccatcctcagtttcttaagccataacttttttcttacttgataaatccatacatccttggtatcaattgaaagcttaaagtctcgggaatttattaatacaagaaaagagcaaatacttgcattaagaaaaaaattgcaatgaaaaaaaacctgaattcatcatttttcgcgtatattcaacagtaatttttgtctatgcttttatccaggcatttttctatacaaaaacttcagtgaactttaagctctcgattaataccaagaatgtaagttttgaccaagtaagaaaaaagttatggcttaagaaaccgaggttggtcattgattggacgcgcaaaagtcgattggacgcgtaaactgcattagagccaatttcataataaagttttcagaaaatttctcaaaaataaacacaacttaagaaaaacaggcacattctcctttgaacactgatttatcaatgacaataacggttttatccattgttacattgggaattgaatctgagcaaacgacgcccttttggacattcgaatcggacttttctctttaaaagtgcgtccgattttgactattccactgactccgtctgaattgttctttccttcctaattcgtttcattttataatattaaaaaaaggaatgaacaattccaggctattttgtgttcgtttttttttgctaatttccgagcgaagcgacgccctacaaaatcaccagcaatttaaataacgaacggggaaataacaaaagcacccaccgcaaaacacgttgcttttggaaattcaaaaatacaccatcaccagaaaataaaattgtttgaaaaaataaagaaaatgcaatgaaaacaatccgtacgccaaacaaatacattcgatgatttccaatggtcccccaaaacatcgtagtccacaaaattccacaattgtcatgcctcaacaccgaccaattcaggcggtagttcgttctaaaacatataacaaaaacagaaattcatttggttttgtttaccttgggatgttttgactcaaagtgctgcttgtacgtcttcgggtcgggcatcaatgactgaaaacaaaaacgtaactgaattaattcagtgtaaataactacaaacagttcagataaaagaaaaatggatttattcgttaccacggaaggccagttcaagaagccttttttggtccggacatcaaccgtacaacacccaaagccattttagtttttttaccatgcaaacggagcatttgaatgtcagtgctttggcggcagccgctctctgatcgttgccctgacccttcttctgctgctgttgtttttgctggttcttttgctgagacagcgccttttggtgaccacgggccattattattcagttgagcaacataaacgacggacaattcaaataaaaatgtcaaaaagaggaaaatgagagaaatattgaggatttgaataatcctaaggaaaaagtgtaaccaaaaaatgacgactaaaagaacaaatatagaaaataatagtccaaacaaaaacaaaaatgtcccttcgcccctcaaatgttcatcagatcacttcgcattccgccccgtgcttctccaacagcgccttcagttcgtccgcctccgttttgcccatgtcccctttgatttccaccggcgccgattcgatcagttttttggtctgtaccaaattcatgccggggatcacacttcgcacctctttgatcagtgcaatttttttagcatcgtcaaatttggccaatctgacctaaattatggagggaaaagaatagaatcaagcgtaaaactggacaccgtttttggttgtttttttcttattaatccagttgcgacagaggaattttgctttaatttagtcagtttttgtcaaaacaaagaattaccgcgtacgaagtctttgtggacgccgaatcgtcgtccgcgttggcttgtgatgctaaacggacaaaacactaacatanaatagtgagttaagcatttcttttttggttccactttcactt

SEQ ID NO: 3182 - DNA, 1762 bp, Heterodera glycines
tggatactgtaaaatgtgagaaatgtgagttactactgtaaatcgcccattttttgatgaattatgtaataatgcaataaattttgaaaaattgtgccaatgtttttttttggcatttcggactgttttgataaactggaaagtttcatctttcaaatggtactgaattgggtaaaaaaaaattaagcacacgggccgccaattcagtcccaagctggggaaaaattaagacccaattaggcaattatggaccaatttaaattgcaattaattaaaaattaatttttgtttcaaaataaatttattcaaaaaagaaaagggaagaaaaaatacgaatctttttggaaatgtgagaatataaaataataaaaagaagaacagagaaaagctaacacaaaacaaataaacaaaaaaatgttttttttgggagaacaaaaaaaagaagaagcaaaatttggggaaaaccgccattacaaaaaaaaagaaacaattaattaaaaccattaattaattatcccgaatactaattaaccacttaatgatgatgagacaaaaatgtgataaaactgatgcacaaagaggaggaggcaaaagggaggagacgaaaatcaatttgcgcgttaattaattagttaattaattaattttgtgtgacaaaatgcgggaaaaatgaattgaatttatttgacgattttgttgagtaatttgttgatgaaagtggcgtctgatcagctgaatttacaggggcaagatcatctcgtcagtcagtgacacagcgcaaaaacattcgctaatattgacaatcgatcaattaaagagaaatggggggctaattaggggttgctgtgctgtccgagagtctcgaccaattaagagagtcgagacggagacgtgaaaaaagatgaaatttcccatggggaaaagctaattaatcgaattcgtgaactttcttttttaagtgaggggggtctcgattttcaagtcttgtctcgaattttagggtctcgaattttcgaaattcggcaaattttcgaccccgaatagcacggcatttgtacaacataatgcttacaatcagagaatggtggtgaatgggtttttgtttattaatacaattgcatggtgccatttaaatacatcggcaacaaatgcacggcaaattaggatactcgtcgtacggtggatgaatggttttataccgtatcaaatttttggcattttttgtgccaaaagacgagcattttgaaattattgaaagcaattatacaccataaaagaagtagaaacatttggcattcattgtacacactttaaatgtacatatgttagtggggcatcagcacactttttgccaaattccttacattttttgccattaaatttccaattattttagccgatttaattggtttttttttaatgaggtattttttggtttgtgtgtgccaattcaaaaaaacaaaacaaaaattgtgcgggagagactacaaaaaaaagaaagaaatgtggaaaaataatttgtttttgtaagagaagaaccggtccaacatgagattgattgctcaacattggtcgacgacgttgttgttgttgtttttggtggcttaaaaagcgcacaaattaaaattttgtttttgcgagaaattcatcattttcttggccattgtcactcgaaaaaaaaacgcattctcgagaacttagcgtccagtctcgagacgaaccgaaaaataattctcagtgtgggcgaacgcacatagtcgca

SEQ ID NO: 3183 - DNA, 1839 bp, Heterodera glycines
  misc_feature (1783)..(1783): n is a, c, g, or t
cccctcactttgtgctcccgctgctccgcccgcttgtgctccaaacattccggcagctgcaaacatttccggactcattgccatcgcgggagtgtcgggaatgttcagacgctttttcagagcaaaattcaaatcggagacctgtaaattttaccatgaaaaatgaaacaattcgaaactcacttcgaccaatgaaagttcggcaatttggtcgacgagcgaacggacgcgcggcgaaatgtccttcgcgcggtccaccgaaggcggagaaacggacggaccgtcctcaagcggaagacccagcgcggaagcctaatttttaggaaataattatgcaaaagtgaaacagtagatgagccgtaaaacaattaaatgttgaaatgaagcaccaaaagacgaacgaatggaaatgaattcaaatttgacttttaaattcgctaataaactataattctccttcaaaaattaaccacaattccaagggaaaaggcttaccgatgcccgacgaacaaacggaccgagcgctgtccggcaaattttcaacgaaccattgacaatcattgttttttacttcacttaatgcaaaaaaacgatggtaaataatgaacaaattaaaaagtaattcctggagaaataccaaaaaataacaaagggaaacaaaagatcaacagtttaattcaatcatcaacaaataaaaatgtgcgttagcagcagccttcatcgccaaattaagagacgagtgcggaggcggtcgccgattcgtacttccaagtgggcgggagcatccgtttggttttgaagtaacgggcgagacggtggattcgactctccaccaaaattagacggtacctaaaaacatgcacaaacgtcaataatcattaggaattgtgggcccaatgtcggtaattccagtttaggcgtccaaccaatgatcattctcattttcgaacataaaagaatattttgtcaattgttattagctcgtaatttaattataaaaattctgtaggttttaagcttgcgcttaataccaagaatataggcaatgacgtagtaagaaaaaagttacggcctaggaaaatgatagtcattaattggacgcttaaattgagtttggactcgaattgattttcatactttgagtcaatgtccttgcggaaacgctccaaatgcttgcggatactaaccgccttcttgatcagatggtaaagatcctccggaatttctggtgccatcccctgaaatggatatgacttactttcaaccaatcgcaattaaacaatgtgcaaaccgtaacctttgatcgaagaatgcgcacaattttgttgccggttatacgacgcacttgcgcaacgccatgagaatcacgcaaaatcacgccaatttgagacggacgcaaccctttgcgggccaacttcacaatttgctcctccacctcttggttggtcagcttctgccaggtgggcacagagcgacggtaaggcaacgccgagcgcgaaatgccttttcccgggttgtgcatgcgacccatgacgacgtgaaaagattattagagctgatttctggaaaataaatgacagttttaacagacaaaataaatatgaaaatttaatattcaaaaaagaaggtaaaagctgaaaacaaacacacaaaggaacaaagtttaggtatgtatttgcatttgtacgtttacgcatagcgagacaaaaaaaaatttgttttttcttgaatttccttctcataattatggcgtaacgcatctttaaattttattttctttccngagtttaaattcaacaataagcactttttgccgctttttttcttttttaccgttaa

SEQ ID NO: 3184 - DNA, 1333 bp, Heterodera glycines
taagcattttgagcatacacaaactgtccttgtttttttgtggtcactaacaaaaaagtgagtgtcaattttcttaatattcgttaaaaccgaacgcctattggcttaaaatcgaccgaaaacccgaaaaatagaagaaatgggcaaattaaaaaaaaacataattagtattttaaaataatttaaaaatcctttatcaaatagtacgataaaataaaataaatgaaaacaagctgctagtagaatcaaaataattcatcatcggccgagcggatccgaacctatgacaaatggtcattagcgcatttaattaacgcacctctttttgctgatattttcatttcatcgatttgttctgatcattttttttgcaccaaagcccaaaaaaacccttaaatttgagtagcaaatcgacttccattttttcaattgttcagtttcaacgacgtcggacattcggccgacgcgaaaaagatggccgatgattatttggtgggcgaattgaaggaggacgaaggccaaacgaccgctggggtttcactgccggaagaggcgaaaagggacgaaccgacggagtcgtggcggcaaattctgagcagtccggtgatttctatagtttttttttggtacttcggctattgtcaaattctccgatttaaccttcgttttctgaacgaacctaaaatacaaattccaattttggatatatttataccctaacggggagggaggaattccgcagttttccgttagaccaaaaataaatttccgctcaattagcaaagtatctccagtttaaaagctccattgttttagacttggtccaactttctgattccggttgcgctgtcgttgggcgttttctgtgcgtataaattgggcacggccatctacagacaaatggcctcctaacaaatttcatatttacaccggttttttgttgtgacaaacggatttagtatttttatgtcatttaatattgtttttattgcatttaatcagtagtttgaatttgaatattattgtactagtaaaatcatgtccaaaaggaattgcaaataaaatgatatttttaactaaatgctttcgtgttaaacttttttttaagcacttgtaacatggagtctattgaacagagttcgacatctttaatcaataaaatctctctctttttctatcgcttataatttgtcacttcgcttgaacgcctcgtgaaggtgctctcctggtaatcgctattaccacggatatatcacccaaatatgcaattattgaaatgtacaaccagccaaatacgaataacgaataaacatgacaaaattgaggatgtgct

SEQ ID NO: 3185 - DNA, 2000 bp, Heterodera glycines
ccccccccccccactcccaaattacagctgcaaaagtgccggtttgtccatccctccgcccttttttgctcacgtgcataaaattggcctcaaattcgcggctgaactggcgcagatacgagttttggttctcagcaaaaagcaacagttgtcgctggtgactttcgctcatcatgtgacacttgaagccgttctgatcccggcactgtttctggcacatttggcagaaccatttgagcttttgcagccctttggcctgaaaagaggaatttaaatatgacatgactaaagacaaaacaacaaatcattgtccccactcccatttttgaaaatatgaattgtcacctttgcacggttggcaatttctttcggcgttcccttctcgtgtttcggcattctgagcagatgaaccaataaacttcctttgtttttgcaaaacaaatgaatcactggccaaattcatatttaattaattaatgcgtcttcaacttgtgggaagatagtaatatttatatattgaaaatgtttatttttaacacttttataaacataaaaaagaattcgactcaattcggttggtttgtctgtgtctctcactttctctttctcttccctctgttcttttccgtctgctgtctctttctcttctccacattctctcgcttcttctccgccctcctctccttcactgtttccaccgtttgcttccgttcctcccattttcgcttctttcgctgtttgtttttcgcctttctgaccactccctttttcagcaggtcaacattgtcctgaaatcattttcagggggttttcaagggtgttgatcacgaagctgaacttggatttttccaattccgagccacggacccgaattcgaaaaaaaaactcagttaattgttagcgcatttttacccaattaacaattaagttttttgcaacaaaataaattgttgttaaatgaattttggtacttccgggttatgtcgcccccccccctcaaaaaaattccaaaattcgtaatttggggtttccaacttcgctgatcacgaatatgatatttattttaacatctgatgacttttaatcatagatttgacaaaatatctatgattttagaaaaatatttaaaattcaattaaatcatgaaaagagtcagacaggtggcataaaggcagcgatattgcgcaaaatctcgtcaaattcatcaacatttcgtcgcttaacgtcctgccgccacaaaaaataatttatgtgtgaaaattgtaaaattaatttatgccttttctgtccccaattggccaaaactgggttaatatttcaaaattggtttgaaaatttcatatcccaactctggtaaaagtcgaacaaaatgcgaaatgtcggcaaaaagaaaaaataaacttacaaaatttttgaaggcatttgcagcaacaattttataaaaatccggaaaataagttcaccgactccgaaaaccctaaaatagacttattttacgaattgttatactttaatttttttctggacatttcgtgggtttttactagagtgcaatgggaccgggaattttaggcaaaaccgggaccgggacttgccgggacctgagaagccaggactgggacctcgatttttcttcgggaccgggaaccgggaccaacagggaaattttaaaaattcaaaaaaaattttttaattttttaaaaaatttaatttaaatttatttcaattgaaaataatataatataaattaaattttaattttgtttttaataaaatccaaaaattaaagcaaaaaataaattaatgaaaattttcaaatcaaattttcttcaattatttcaaacaattaggtaatcatttttgactcaaacgatcgaatattatttgaaattaacagattttttcacatcaccttttcggcgcgtttttcccaaaaacttttgggaaagaagggggtccggcggtgccgataggcgccgccgggggaaatttgaaaattt

SEQ ID NO: 3186 - DNA, 7706 bp, Heterodera glycines
  misc_feature (17)..(17): n is a, c, g, or t
  misc_feature (7672)..(7672): n is a, c, g, or t
caggacaggccaaatantgcgagaacaactcattgatctttaaagttttgactatttgaaagagcgcacaaaaatattggtctttgatcagaaagttgctaatacaattttaacaaaagctatttacgcttttgttacagttgagtgtgatcagccaacttgcgcattttgacgatgtcagtccccttggtcagtttctgcacaaagcggcaacccaaaccgagcgtagcaactcatttggcttcattaaaattgtgccaaaaacggtagaaatcggcactcactttttactctcatgaaacttgtctatgttttgcagacattttcattgaaattgggccacccaaaagtgcgtgacatcattctgcagcagttgcctatgaacaatgccacacattttatcatgtcggcatgctatgggtcaattgtggcagggatcgtaacttttaatgagcgcagtgccatcggcaaaaccgacatttcaaatgcgaaaagggtctgttgaaaaaggcatagtatttttaaagctgtaaatttgttcaagattgttcgtaagtttctggctgggcctggactgagtccttcggacaaatcattcatctctcatctgaataaatcaatttcgtgcagtgttttcgttgacccttctattggaaattgcttgactgatttggttcgttttaagcgaattgtgttcattttaaaacaattccaatcggatttcgttcaggattttgtcaaaggactcaactcttttgccgataagtgggcggctgctaaagacacaaaacatccgactccgatcagtttttcgttggtcccactgtcttctattggcgacaaaacccgattcaatcccgtctctactcatatgatcggtgatttgtttattcttttgattaatcttaattatccctatgatcagcagatgaacatcagtttgaatggttttgtggccatgtgaaaactgtgaatgaatatgattggttgttgcggaaagtccgtcaatcattgaacgaatgttctgccatgttaacgttagattttggcaatttacagataatttaaaaatttgtttcaggaataacgagctggacgacgctcaagaattttttgaacaattggaagagaggaaaaacattttttacgattcgttgaaagatttcatcgtggatttgcgaatgtgcaaagccgaatctcaaaaagaggccattgtgcaaagggcagtcgatgattatgtacatttctgccaacgtatagttggtcattatgaagagttggtgaaagagaagaaggaaatggtcaacgaattgaagcaaaaaggcaaattctttgggaagatttctcatccaataacctttttgttatttaaggcgtcacttacatcggtcgttccactcgccaaaaattggactcgcgttttgcttttgatgactccaattcttccgtttttcattttattttgttgagaaattcgtctgttccgccggttcaaaatcaacacacttcctttttgctttgccttggcaaactttacgagttagtgtcacgtggaaaatgtacttttgtcgatttggatgttctgcgggatggcgaagaagcgcaggcggacgaaggactgccggaggacattcgctcattgaacggatatccaagctttggaatgcgtctgataaaaatgcgtgggaacaaattgttgtcgaatgattacatggcagaggaggaacggaaattgcaatatccaattgctcgggttcgttaaaacggaggagagggcggcattggctcatggtccaaaattaaaaccaaagagaattcagataatttttaatattttcttgtatatggaggaggaaacgattcattctcgtctccataatttttggtttaaaacctgaaatctattaaggaattaaattataaaattcacgttttttaactattttttaaattgaatttcaaaacaaaaatatttaaatgtttttattgggtttcatttgcgcagattgagaacattcgacgaacagaagttggagcagtgcctgaagctgattccaaagacatccaggcctgcagtttgccgtgccctttatgtgaaggctatggtggaaattgcccgaacactgaccatatgtggatgtgcgatgattgttgcgaagcattaacttttgtgcaaatagaaaaagtaattgttgtttggtaatattagaaaaaaataattactcacaggaacaagcacaaattacgcatttcttttgcgcttgtggaaaaacgccagtggacggattttcttttcgctgttccgatgtggcaaaacatggaactgagttcaagcatttttgctcaaaagtgtcgctggaaaaggaattggatcggttgaacaacaaaggcatgctgacctttttgctgcttggtgagacgggtgttggcaaatcgactctgatcaacgcactcatcgcttacctgaaacatgcgactttgaaagaagcgcttgaggtgaccgagtttattaaatgttgtgtttgtaattggcattatctaaatccaaaataggcgaatgaaattgactgggtgatcccggcccgattttgtacgggtcgttatgacagcaaagggaatcggcaaaggattgaagtgcgactgggcgaggagagcaaggaggagcggcttgaagctggtgaatcgcaaaccaaatggccaaatgcatatgtgattccgtcaaaaggtcgaccaaatagttatttctttcatgatcattagtgacactttcagatgggcacaaagttcgaataatcgacgcgccgggcatcggtgacacaaacggcatcaatgaagacaatatcaattttgacaagacactcaacttcatcagcacactccccgaacttcatgccgtttgcattctgctgcgccccaacagtcctcgcgctacgcccgcaatcagatattgcattgaaggactgctcacgtatttgcacaaaaatgcaaccaacgtaacttcgtagtaattgggagaatgaataaatcaaacactttagaacattgtttttgtgttcaccaacgcacgcgggtccagttatgacatgggcaagttttaactgttaataagaaaatgaatttaatgtttggcaatgattttcaggaaagtccgacgaagtgttggagaaaatactgagccccattgaacgagcgcataatgtttgactttctgtttttttcctcataaaagtgctttattcgctttcccctataaaaaggtgtcaattccactccatcgggaccgaatttactgtgtggacaacgaagcgtatgaggcattgtgtctgatcaaaaagggcggcattgaatacgaccaagaagagaaggacaatttttcgaggagttgggcccatgcagagaaggaatttcggcgactgttcaaacatgtgtccaatttggaaccgcaccgcacgtgggaaaccgtgtcggtcaacgaagcgcgtcgaacgatcatcgatttgtccgaaccgttggcacttatcactgaaaaaattcaggcaaattaccatttagttgtcattttggtgttaattatgcctccttgccatttcagacaaaccttgaccggatcaaaaaatacgaagaggccatcgaactcggagtggagcaggtggaaaaagctcccactcttgaaacaattgaatttgtccatttgccttacccgcgcactgtttgcgccgcggtatgaaaaatagttaaacctaacaacactcacctttgtttttcattggaattacatttcaaaatgtgttcgtgttcatttagacctgttgcacttccatccatcgtacacttactggtgatgtcacgctgtacatgaagcactgtcacgagcattgttacctgcaaaatattactccagaactctttcccaatgagggcttgaaatattgttgggcaatgaatggaacgaacaattgcacggtaaagtaccaaaattccaaatgcttgcttattaacaatttactttaatcgttttaagtttatagaaatttgggttcttgacccgggaacacttccttgcaatgcaattagtgttaaatgtgccatttagtctttttcactcaattcaaaccaatccattttagcagtgtggatgcgagtggagcgtgcacatgcactaccattacgaacaacgccaaaaaaccctcacccttgaggaagtcgaagaaaaactcactgctgcccagcgtgaggggttgtcaacttcggagagcgttcagaagcaaatgttggaagagcgagggaccatctatctaaaggcacttttaaaactaaaaaaaacattttgtcaatgttttaaggccgcacagttttgtgccttcctgaagaaatgggcgctgaagccgtacaacgacagcatggaggcgtacatcaacctgtccattaagcaggcagaaaaagtggtcacggaatgcaaaggggcagcggatgagaagcttcatgaggacaaactggagggacttcgagtcagtccgaacggaaaccaattaaataaattatcgaactgattgactgtttaattaagctaattgaaatttaaggaatctctccgtctctaccgagagcagaaggaactcattgacaatgcaactgcggacgattccgctggaccaactgttataacggcggagaatgtgaagaagttcttcgatgagttgtgcgatttgccagtgtttggtgcagacattcggcaaatgttcgagacaaagcaaaagtcccgacatgagcatcagaaagaatactccgagaagaagaccagtgttggggtgaagttgagaccaacaaaaagtggaaaaggtgaaacggacagacccagatttaattaattctacctgtaattctatccttaattacctaagtcgtccaaccggagcagtgttggaacgaagagcagcgaaaactcttgaaggcctacgagaagaaacaaaaggaaatggaacatttggagcgggaaatggagaataagaatatgctgcaacttcgtaagtagaaagtagagaaagtgtggggaaggcaggcaaaaatggataaactctccgtgaaaatttcaattttttgttttacgaaaacggggatctcggtctatttattttattaatctcatttaagcaactggaaattacgctgcttataaccaaccgtcaacttccagcagttcattttggcgtaagcaattccaaattgtgtttttttagacttccttaatttacagagaggattcccgtgcttaattgggtcagttcgtcttccacgcagaatgggtcgtcatcatatggcacacactcaaccaacagtttcaatttgtcttcaaatttctcttctttgggtggtttggaggatgagcgtggtgtgatgccgaagaacaaacaatggcacaaccaccggggaccgaagtgatcaaagaaagcgacaaatggaggacaaattatattaatgcgaaggagaagagcgggaaaagtgcttttggactctatcattttatgagctttttaaattattaccattttacgaaaatttgacacgttttatcatttatttttattccactgacattttatttcttcattttgttttgctttttggattaaatcagacttctgactgaccctgctttaatcggtccgtttttcctcttccattccgccgtttatctcttttttgtcccttcctcttttttcttgcacttcctcccctttttcctcttgtcatccatccccccccccttctcctcttcatttccacttttttctgctcttgtcattcttatgtccgccgatcagtccaattttttaacaatggacgagacaatgctctttttcctcgtccactcgtctttctctgctcgtccatccaacacaacaattgttttgtcgtctaactgcgacgggaagacggaagagaatggggggggggggggaggcaacccgcacaaacacagagagaaagcggaaaaatggataaactttttttctgggaaattggccaacaatttggagatggatcagcagcagtggacagaaaattagttgagtaaatggccaaaacaggatttaaatgccgacacaatgggctaattaaagcttgcgatgatcattaacccattgatcagagagagagaaagtgattccgaattgatagatgtttttgaattgaactgctagcaaaagcgctgatcagctgcagcgcaaggcatgcgcgaaatgaccccccaccacacaatgctgatcactgatcagcagcattgtttttcccttagcatagatccgatcggatcgtttttattgtgtttgtttgtatttgcaattgcatttcccccccccccttttttccccgctttggtgttgggggcattcagggacaacaaaagttagtggtcgtcccccgccggtcattcgtcccttgcggggacggcccccctcgtccccgtcgttggtggcggcggcagcggacccctccgtccgcccccgtcaattggcggccggcgagtttcggcgggcggagtcgacgacgacggtttttgctgccggtgattgtcccggcgggaataattcgccggccgttggtcgagatttttgagtcccgagagtggcggcggtggcgacagcgcgagaacaatggcggcgccgcgcaaaggcaaaatgaaaggggcggcggaggcgaaggggtggccaatccaacgacgaattgttgtcatcagtgtccgtccgttgaaaaggagtggggcccatgcagcacaaccatcagtttcagcagcagaggaccaccgatcatcggccgaggacgaggcgacgacggacagcgggaaaaatttaaatattttaaaatttagcaatttcattagacgcccctctccccggaattttggcccgagaacgaaacagtattttaaattcccagaaatcatacatccccctgttaattttctaggtttttattcaaaaaatccagcttctaattaacaaattttgggcaataattttccgtattttttgtccaagaaaattctacaaaattttaaggatttttttagttattttttcaaaatcagttaaaagccatcgtatgcttaaggctttaaaggtgatgaataatggcatcgtttgaagggtttttgtacctcgggggaaaactgagaaaaatcgcgtgactatccatccttttttcacggaaaatttcaatttaatttttaattttcaaaattaagcctcaaattaggcaaaaattacgcttctttaaacatataaaaatggagctccatcgcattgacttgttcacacttctcacaacggcatttttgatggtcagcagtccatgtttcagtgatgaattggtttgtttaattaaaatttgaaaatattttttaatttaaaatggtccaccttttaggcttttcctcggcggtcccaacggtctgtcagcggtttctccagcgatgcggcaaaataccgtaacggactgtcctcagtgttttcgttccaaaactcggcccgagaaccgtctgccgggccacggcatgtgcgacagcaggtaaattgaatggcaaaatgccaatcacaacaaaaagctgacaccggcgcgaaacagttttttcgagggtttatctgatcacaggaaccctgggaatttcttnggcttccgtccgctgatgcatttaatcaaattac

SEQ ID NO: 3187 - DNA, 2672 bp, Heterodera glycines
  misc_feature (1516)..(1516): n is a, c, g, or t
tgggagggagttatccttatttttttggcattctgcagatattgataatgtcccgcatattgttaattgtttgctccaattttggggatggaagggggcataaatcattttaaatttcaattttttgaaatggcttagcccggcaaaatggacggattcggtggcaccgcttccggcgcgattggtagccccaacagcgacgcgggcagcatttattggatgtcaccggacccgaactcgccggacctgcaggcgtggacgggtgcgagcggtggcagtgcggtgggcgccggcgcgccggtgccacagcagcaacaacagcccaccggcgggtgggtactcaaagggcagtgctcggaaatctgatcactataattcggatgatcggaatgatttgaaattgcgtttgggtccgattagaacttggagacagagatattccaatgcattttaaattgagcacgaaattatgatttctagttgccgaaattctttgtgccgtcagaattccgattcccgacattttttcagctgttggaatgccgattttcgattgccaaattttttgagggcgtcggcacacatctccgataggcacacagccgtccactaattgcctaggctatctgacagagaaatttgttgcaaattgatggctatcaaaattcaaatctgtgatcaaaagatccatgtttttggttcagataaggccgtaatcactttgttttgggtctttgtgtgggatccattacagccaaattttgtattgtttaccgtttgccagcactgagtcatttgggagacggtttaagtctaatttgctaccgtaaaccgtttagatagcgtttctaagaattgttaaaattatgaaaagtcgaaatcctttagggctgcttctgtccctggccaagcggttggcggcggcgcgtcatcgccgatgatgaatgccgccgctgtcgcctatggtatccaacaacagcagcttcaacaagcgcaacaatcgctttcggcaccgcaaatgccatcgcaacaagcgcaagcatcggcacaacagcagcagcagccaattggcatggcattggcacagccccaacaacaacaagttcagcaacaacaacaacagcccatgtccatgatgccataccagccgcaggtgggtgcgagtttggcactgaaatgcttcctgaaagtgccggtttatcccttcgaaatcttacccggatttaagccaaccgaatcacgaaaaaacaaattaagtctcggataaatgccaacaatattaaccctttcaaaactttaagctaaaagactgcatttttcccaagggtggtggtgccggtgtctatggctacggtggccaacagggcggctacggtatgggcggcggttacggtagttcttctgctggtggtggccaaatgccggtgtcgccgtactcgtcctacttggagaaacagatcagcacctatccgtaatgcctgatcagcaagttctgatcaatcaaattcatttttanatattaaaatttattagtagggcatttaaataattttaaaaaaattcattagtaatttttaaaattaaattccattagcattatgatttacaccctcaacgagtgcattccgtgccaacgtgccaagcatttgcttgctgtccactacccggacgtgcgtgcccactacttggagctgtccggcaacgaagcgtggcaacagcaactgcaaatagacctacagtacctgaccggggtaaggcccacaaaaaatactgtgccgaaaatcagagaccagagcttaggcaaggataaatctatttgttagagataggtatcttgaaaaaaaagcctgggcctcggctgaacctaggttccatcttagatatgggtctgggtttccgggacaaaaacccagtaaaacttaggtccaggaaaaatttaggttaccaaaaaatggcccggacctgggtttgatcttagacatgggcctggatttccgggacaaaaacccaggaaaacccaggtccagaaaaaatccaggcctggctccgggtccaggccgacctctactatttatgcagatgtaaatttaatagcataatttttaaaataaatttaatccaataatttgaaatgatttttataaattttaatattatttcatttcaggccatcactttcccttacattttcgtttgtggccaatacattggaggtgataattaattttagaattttttttttagaaaattcccaattttttcaggtgccactgaactttttgaactgcacgagagtggccaattgcggcgaatggtcgcccaatgtctgaagacggcaccaccgaaatgaatgtggattcgaatcggcgcgcttattgttaaattatttggcattttgtccgatcgaatttttgcaaaatttgcacaaacacaaaacttttcctttttctggagaacaacaaccttattgtacattttgtgtgtttattattgcatttccattaaaattttgatcaaaatcttttcaattattttataaaattttgatagtttacagtaaaatattgcagatttaatttctggcgctactttaaacaggatgaagtaaatgttgttttttacataattaaaaaggagagatagtacgccaaagagagagaaattacaatgaa

SEQ ID NO: 3188 - DNA, 2987 bp, Heterodera glycines
  misc_feature (1651)..(1651): n is a, c, g, or t
tattgcagatttgtttatctttactcaacaatttgcggtttaataattaaagacgctaaaaaatggcacaacagcaagcgataacgaagaagcgtaaagctgtgcaagacggaattttcaaggccgaattaaacaactttctcatgaaggttttaactttttaagaaattttgtttttataataaatttgttggataattcaaatatttttaaaaaccgttatattctttcaaaaaataaccattatggcaatttaggagttggccgaggacggttattccggtgtcgaagtgcgtcgtgcaccttcccgtactgaagtgatcatcatggcgacgcgcacccaaagtgtgctcggcgagcgcggcaagcgcatccgcgaactgaccgcactcgtgcagaagcggtttggctattccgctggacaaattgaggtttctctacttcattttgtgttatttaatttttcttacaaactaaattagttttgtgacttaacaacagcaattttatttgaaagggctttaatttcgaaaattaatcccatttggattgcatctaaaaaacgtttcatctagtgctatttctttgtttttattcccgaaaatacatcagatttaacttaaacataaagtgactgcaataatctctttgtatcctttttagctctatgccgagaaagtgtccagccgtgggctttgtgcggtggcccaatgcgagtcattgcgttacaaagtgagtaaaaagttcaatttcgaatgaaacatttgtgtagatgaaccagacctatatactctatacacttttccggattccacctcgaatattataagtcctttctaaaaaatcagttggtcggtgggctcgccgtgcgtcgtgcgtgctacggtgtgctgcgcttcatcatggaaagtaatgcccgtgggtgcgaaattgtggtcagcggcaagttgcgcggtcagcgtgccaaggcgatgaagtttgtggacggagtgatgatccattcgggtaacccggtcaccgagtacatccaagaggcggttcgccacgtgcaaatgcgacagggtttgtgttttaaaatatggaaaaatattttgggatctatttgaaagatcgattaaaagggttttcgggtaccaaaaatacttttgagttagtttccaatgccatgcgatcccatttttctatttttttcgcctctttgttcaggcgttttgggcatcaaagtgaagatcatgttgccgcacgaccccaagggacagatgggaccgcgcaatccgttgcccgaccacatccaggtacaatattctacaaaaactgacacacggaaccgcataactcgggatggatacaaacccgaggatttatttttagaaaaaaaaactccatacctttagattagagaaggacggagaatttgctattaaaaatctaaaattctgggtttcctagacaaaaataaagttttgatactttttcctaaaattgttccttttccatgacaggtcaaagagccaccgattgacgtcgcgccgaccacgccgtactcggagcaccgcgaaccgatgaccactggcatgccgccccagacacaaatgccgcccgcccatcagcagcagcagccgatggttggccaagtgccgtccccggcacnagttttattgtgagaaagaaccgctgatgaatggtcatgatggaggaaggggagatgttcaattaaaattgttatttgttttttttacttttttttttttgctgttgaaacgcatcgtaaatggaattgctaatgaattttggaacaaaacctttggggttaaaaagtaattaattgtgcccgtgatttagcgtcttttgcccatgattagcaaataataaagtagatttagaaatatttacttcaaacaaaaaataaacaggcagtgaaacaaaaaggcatttttcagttaaagtggtcaaaaaaagatttaaaaatgtttttagcaacctacccatatacacgttgcatgagacatgtacacattcataagttacatatttgtacaatatgtaacccattatgtgtacatgtgccatgcaacgtgtacacaggcaaaaccaccaaaagaaatttcgatttttgaccaccctaactgaaaatttcacaactttttttcgtgctattagaaaataacaattttagtttatgttctgtttcagccactcataaacagattccattgaatatctttcgctgctcctcacgctccaaacgttatttcatcagagttgccaaatcgaacacgaattcgggtccaaagttcgcctcaatttcgtcaccagattcaagcaaagtaacgaatggaaagaggaacgcacaatcagcagatagagaaatcgaaaatgcagttgaatcttaacaaatgaagaattaaaataattgtattatttaaatttgcacaaaatttctaagtttgagaatttttagttattcccggctgtgtttcaatgtattttaaagcagtgattacaaataaccatttttttttgtttaccaacccaaacaaagtccattcctcgtgaaaaacaattccctgtttgccaggacaccacatccgaccgtgtgaccagttgcgaaggcatttgtgggatttgcgaaggtcttggtaccgtcgacataaaatttgcccttgcttccatacgcgtaagcagtcgcttcagaaaaaaatgacccagcaagatttctcgtattttttatggcaaatccaaagcaggcggtactgaaaaagagcaaaatgatggaaataaataatcaatacagtaaaaaatatccgaattgtattcgaatatataaaaatataatgaataaatacgcctgccggttcatttttatgatggaaatctcaaaataaaaaaggacagatgaagaaggaacggccgccaatatggaatgtttggcaaagacagtgcggtcaccaccttgaagaaagattgagatttaaacattattaaat

SEQ ID NO: 3189 - DNA, 866 bp, Heterodera glycines
attcatcgctttgcatttcttttttgtcagagtccgtccatttcgatctgctcccccgaataattcccaccgattttccctccgcgttgggttggtgggacgagcagcagcagcggacacttgcggaagaagtcgcgtcgacgagtggtgagagggagagaaagaaaggcaaacgaagcagcaaattgtcggcatggacttacacacttttttaggtgcgttagcgacggaagtcgccaactttctgccgccctatctgttcagccgttacaacactccgtccaaattcatgttgcgcggcgacgtggaacgatgggtgaaaaagccgacagagatcggacacgggaaaagtccgttcttcaattagtttatttattttttaataaaataatttgcaggtcttcgcattgaacggaaagcgctgaccatcacagtgaatgcaaatgatccttttccggaagcaccgagtgaaaaagcagtgcacgacgtgaatctgaggtggaccaatgggggaggggggggggggatggggaaatatagtacctcgagcataaattgcaagccgaatctctaatactgtaaatacctctgatttgacaaaagaatgatgcttcgacgggatatgatttgttgagaaaattctgccgtttcagatggaatccctaatccaaatttgtcgttgtgtttcattcgtttctccaattcaaccccccaaaatctaagctttgtccgttacgtgaacagatgcaaaaaccccgagatgcatcaaatgctggtcgaactgttcgcggaacgacccctctggtcacgcattgccatcagttaccgcacccgactcactgagaatgcgctaaagtgcggttaat

SEQ ID NO: 3190 - DNA, 4866 bp, Heterodera glycines
ctatcagtcaattatggtgtcatttaacacaaatcaggtgaaacacctgaacggacagattcattgtccaacatttcatatttataatcatccaaatgaattgtccatttgtttgggaaatgtttgcatttttgccagtacattccggagagatcgcgtctcaaggcatcgtcgacgccttccgttgggacgcaacagacgggccaattctttgattatttgtaccggtcaagtgggttaacattgggagaccctttatccgcttcacctttctctcccagaaatgcttccttcgcttcgtcaaatgtggtactgtgtgtgcgatgtgcagctgccaatcgcgcagaaaatttgtcggaaagattttttggaaacgctgaaggaatgcgacccggcaaatggatggcttcccgcggtactttcaccaaaccatgtcaatttgggccataactttcagggccgaattgatgccatccgatcggcgatcaaaaaggacgttgagaaaagttcggcaagaatgggcgatgacgaattcgatgaggatgttggcggaccaatgggcgctgggggcggtgctgcggaagacgaaagtgtcgctttgggggacgaggaccgagaggacatgatgctgctggacgagttggccatggaggaggaggaaacggaggaggacgagacggtggacaccggcgaagaggacgaactgatgttatttgaaggggccaagaaataccgataaaactgcactcattttgacttttttttattcaaaaataagtaaaaaataactcaaattattcgttgccgaatttatctcatcattttaatcactcccgattagtgtacatataagtctcaccggaataaacagcagcctttttcgtcagtttgaattacatgtaaaaaatcctaatgcgtcgtttttcagttgaatggggtcacaagccaaacaaacgatcattttctgttgtgttttggcttatttcgtcatcccttttatgcgttttaaatcgttgagcaataaatccctaaatccccccggcgcatcactctgttggtaaaatgtttcactccgtcgtctcccaaaatgtgctctgttcggcgcttcgtcttctgttccctttgcttttttgctgatgtctttttcgcttttgaattggctctgttcgctaacaatggctgttattcccacgatgttatggtctgtcttctttttggtctctctctctaattaatacaaaatcaaaattcgttacccactaattggcccgctaattaagctgcgtgaggttggcgagtcctttgaagcgatgcttcgtgccggttccatccaaaggcgcactgacttctgcgcattgtcttcccctctttgtgccgatgcttccgccgtttgtgctgtttggccctctccgtcggcctctgtccaccgtatccattgggtacagttgttcatgtacgacttcggcttcggactgcgcacgccgccccattggaacggtgtggtgatggaaagtgcacaaacggacggtcggttgagaaaatggcacaatgaagcgatgggagcggaagagtttcccattcattcagcggacagtcggccattcatggaaagaggcagccgactgttgtgggaagtgaccgtcccgttggaccatgtcagtgggaaacagccgggtggaaagtggggacaaattgggggataaatggccaaattaaggggacagaataagggatcaaacggggcaattaggggaaactgctgccatacatttgagtcccataaagaatcggccgtggaattggcgaggcgcgctctttctgtacgaaatgatacggcgaaatcagcaaaactgtgaacacttcgtgagaagtgcccagtaccgagcatttctgagcaacaaccgcgtcgatttggtggtggtcgaccattttttgcaggtccatcccaacggcactttcacatttcaattcattcaaattaattctccgtaaaataatatttaaaaataaaagataattttattcacaaatgctttttgggaatgtttcaccgtggcggcctttctactcaatgcttcggcgaccattcgcttctccaattggcccattgcggacggttacatcgcttctctgaacattccggcaccgccctcagcttatccgaagacgagcaccgccttttcagcccgaggcaattctcggggaattgcctatttttatgtaaaggcattcaaatgcccgattaatcccaattttccgtgccattgccattcccccccccccctcagaaatgcattcgttttctgtacgacttcgcaattcgcttttccatgcgctcatttcgctcgtccgtttccttcagcgtcaaatgatcgcgcgatttttcgcttccctcgaaattttttacggtcaccgcggagtacggctcgaacaggccgaggcggcacaccttttctacgcaggccgtgccgaattcatagcggagccaattcgaccgattagcaatcgcatcaaacactttggttgcgcgaaatgtcaaagcgaaacacggaagatgggccaaagcaaaggcaggggaattggcacgaagaaaagtgaacaatctgaaaaaggacaaaagttgagctggccaaatccgacaacaaaagcagcagcatggaggggagaagctgcttttggatgcaaaaacgccacaaattcagacggacaaagggccaaattagaccggaatttggtgtcagtctcccccaatatccgccaacaatttccgcggatcgattgggaagaaattgagagaagccctttcgtattggtcagcttcggaagcattgcgaaggtcccaaaaataaatcccattaaacattgagaaatgccttttaagctcgagtttatgcccgaggaattattccgctcatttctccgcgccttttcaaattttccttccatcatttttctttggcagacaaacagtgagacaaatgccattttagctgacaaaaagtgccaaaatctgcctaaaaatattcggtttgtccggtgggctccaatcaaaattttgctgggtaaaaaggaaatcgcagtttggcttcgattgtcccttatgacgttggcttaagctcatcccaatttgcattatgccattttgcacggcggcgtgaacacagtgaatgaggcgctgatttacggcggcagaccaattatgggccttccgcttcaggtgaatgacttttcttggaaaagacataaaaaaaagccaaaaatactataaaactttgctctttcagggcgaccaaccctcaaatttgcaacgattggtcgacttgggcatggccgttcaattggacattggccaagtgtgggccggacaactcaacgccaaaatggcattaattgagcacaattatgtcgcgttcagcagaagagcacaacaaataagtgccatggtcagaacatatcgcaatggcattggcgctgtacaacaggtgggtgctgtgatggcagaaatgggacaaactaatggaaagtgacagggaaacgcgttactgacaaatgagtcataaattgctatgggaacaaatttacagtaatccatttacggtatgtttgaaattgaattgaattaattctaattatcaaattctaaaagctaaattgatgaaatagcaaggtttctatacaatttagccttttaacttaaaaaagtactgtataactgacgcattttgctggaacccatgggagaacctccaagaaaacggccaggctcaatcgattagacattcggaaagggccgtgggttcgagtcccattgggtgcgtaccttttaggttccacacagatttggccacttcattaattttaatttgagaataagtcaattttatttgattaatcattcatcacattcttagaacttttggctccaatgggcagcaaataagccctttctgaagcgcagtgctcacaaattcttccatctccgttatcgttcatccgttgaacattttgcattggcggaattgggcacggcattggcatttttgttcgcaatttttatgtttttgtcatcataataaacaaaccttaaaataaatatttacaaatattacaaagcaaataaataaaaaacatctgtttttcatatccattcattccattctttcgtgagaatggtggtgattccctattttgctgctgataaattgtctctccgaccaatgaatggtaatcaaattaacaaattagtctattcggtgttatgtgtttatcgatatttaccaatctcttcattagtaatgcgcaggaaatgcctttaattacttattgttagtaattgactaatttgtgcattccgtttaacattatttttgtcaataattaattcattcattcatcttctttacaattcctcacatttcaaattgccttggtcttggattaatttaatgccttttttacacttgaaattcaaaacaaaaacaataacatttaaaactctttggtgcctaaatcaccagctctaccaaaatgaccttaacgatggatgaactgagaaacaaagtccaaaatggccaaattagcaccgttgtcgttggttggcccatttcaatttaaaataaaatatttgacactcctttttcactccgaaggctctgtcgatttgcacgggcgactgattgggaagcgattgacggcacggcattttgttgaaatggcgcaaaaaaaggacaaaatgtccatgtgctattatttccttgcgatgacaattgaaggtggcaatgttaaaaattattgtcaattgttccattcattgccaatgttaggccacgtggccgaagggttcgaagtcgcgcggtgggaaaaacg

SEQ ID NO: 3191 - DNA, 3609 bp, Heterodera glycines
aattcgtacaagcgactgcagccgaacaggtctaagcggagacggcatttagacgatttacgagatcaaaaagaaaagggaaacattttaagttgggcaccaacaaaaatttgttggactgtcgacaatcggacgagttcgttccgtttgtgcggccaaagttcgtccaacgttcacatcgaatgtcgtattggtggggccgacctcaacccgtacttggcattcgccgcactgatcgcagcgggcattgcgggcattgaagaaggtggggaaaggaaagcattttcggcatcgaacaacgaacactgtcaaaaaagggttggaattgccaaaggccgttgcctgcaatgtctacgcttcggccgatgccattcccgaattgccgaaaagtctgcgaattgcggcggaacttatggccaattcggaaatgttgaaaagagcgttgggttggtggttctttcgtttttattagcacattaaattattttaaggtgaaaatgttttacgacactacaaaaattcggcacgcattgaattggaggactttgaaaaggaagtgaccgattgggagctgagaagggcatttgacagatgttgaagacggacggacggacggacggaagaatgccccggggggaaagaattaaaataaataattgatcaaaaaaataatcatttgtaaaattacactttattattatatttgcattggcaaaggcaactaatcagctgaataaaatagcataaaccaatgacaattttgacaaaaacatccgcttataaaattagctgttaaatatttaaattaatgaattttaaaggaataaaaatacctaacaatttttcacttataatttattctactttttgaccattggctttctgctttttaaaaactctttgttcggcctatatttaacagctgttctcgcccaaagtgccatttgatgggacaaccgaaagaatgaagacgccacggagagaagaattaaatccaatcgatggacggggaaaagtgcccaaaagcgatgagaaaatccgaaattaattcaatttaatttgcttatatgtttttgttgttttttaggccaaatcacattttaaatggaaatatatttcacttttgtcccattgctttgcttttcgcttcttttaatgctttatcccttctcggccaagggcaatcgcagaagcgaagaccaactttatgaggatttattgtgggcaaaatgcgaaaaaattaaatagtttttttctcgaaggtatttttacaacaaaaacgtacggcccgtgaaaaatagcacgcaaattttggaagtgaaattcggcgcctctttgatcagaatcatcgacgtggtgaggaggaaaagtgatcagaaaaaagaaaaactaatcaatcgcaggacgaggtcaaccaagtgctcaccacgtcactgtggcttgagatggtcaaaaaggggcaattaccaattcggacattattaatgactaattaggcccataattaatgaccatttattcgcttctctctttcagcaatggttcgactacaaacttgtctggtgagagggaatcaatttttttttcttcttaattcaattgccaggaatccggccaaatttaatggcatcaaaaaattgtacattccctcggaccaaatttggaccccggacattctcctgtacaataagtacagtaattgtctcactaattgaccttacgtggaattccttcctttgaagtgccgacggagagccgcacatttccattgtgtccgatgcgatcgtttattatacgggtctcgtcgtgtggaaaccgccgagcatttacaaatcattttgcgcggtacgtttggttgacatccattggctttttgggctgccaaagggacccaaaaagttttgttcagatagaaattgaatactttccgttcgatacccaagaatgcatgatgaaattcggcggatggacttacaacggatttctgatgaacatctcccaaattccggttacattttcctaaaattcactccgggataagcttttattcccagccgcgcccagaagacgtgatcgagaatcgccattatccggatgggcgggaatacaaatacttggccttgggcatggacctgtccgcctatcacgcgtaccttttggcattcccacgaaaaatcattggacctttgaaaggagtttggagtgggatttgatgtccgtgacgagccgacggcacgagcagctttaccctggctgttgtgggcaggtgaacgaacaacagcaaaatgttgtgacacgaccaccttcgttcatttcaaggacaaatacattgacattactttcgcgttgggccttcgccgtaaaacgcttttctacgccgtcaatttggtcaccccgtgcatgctaatcggtacttaattgctgaccaaaaggccccctgattaatttgctgcccaattaatcccaccaattagccattttgactgttttcgtcttctatatccccgcttgtgagcacaaaatgacttattccagtacgttttggaaaatcaaaaggccattgtatcatttcgcccctaaccgtcgttcagtttccgtgttggtcactctcaccgttttctatttgattctgattgaactgatccctcccacttcgatggttatccctctgatcgggcgctatttgcttttcaccatgttcctcgtctcgttttcaattgcgatttctgtcgttacgctgaacttccatcgaaggtacttcagtgtgtcagtgatcactgatcagtgatcggggttgatcactgatcgtcccactcattaactgccgatctcactttctcaagggatggtactttgcacacaatgccccgatggatttaccgcgtgttcatccgcttccttcccaaacttcttttgatgacccctccggtggatgatgatgcccaatcggataatgacgaaagcaccagcatttcgggtagtttgcaaatgccgctttatttgtccaattcgttagacattcaaccgccctatggcaatgccaactccgacaacaatttcggctgctacgcccattcctaccgaagcagcggccctttcttggcacattcgtgtcgctctcgacgaagcattcccgccgcgggcatccgtctgtcgcaaacagcgcaagtgaaaggaatgagtgcggaagtgctgcgacggatggcggacaatgtttactttgtggccgaatatttccgagcaaagcagcaaagggacaaggcgagtgggacaacacaccaaatagccgtccccatgcccccgggggttctctccctccccctaatgctccatcgtctctccgggaggagcgggggtggatgacatgacgtgctgttacagctgctttctgttttgtcctatgctttctgtgctgtttaggtctctgaaaattggtcctacgtggccatggtgcttgatcgcctccttctgatcgttttctccacctctctcttcatcggcacccttctcattctttccagttcgcctcccgcaaaaagcgaatggggcgaacccctgagcacaatgccaacgacaaaaccactcagtggagacactttcgaattcgaa

SEQ ID NO: 3192 - DNA, 1112 bp, Heterodera glycines
  misc_feature (56)..(56): n is a, c, g, or t
  misc_feature (61)..(61): n is a, c, g, or t
agtacgggctgtttttctcagaggacggagatgtggtggtatttagtgacttttgnacatnttatttgaatttttatatttgtttggcataatgttttttcgaatttggccaatttgttttcgtttttctttagtgcagtcgggacacttttgttgttgtttttgttggtggtaattcggtttttcatgaatatggactgttttcgacccgagtcgcctaatctgccgaatatttgctccgatgggaatttaatactggatgaccaattgactcaacatcattcgtcgcctttcaaaaccggtcttccgtctcacaaattcgttaacttagctaatttattccgatttcagatgccgtaaatatcattcgagagtcatttgaattggcccaacaaatggacacaccgaatcccattacatttgactgcgtagaaagcgaaacacttgcggaagaaggcatacaacagagaatagctgtgaaagaaagtaagtcgtgaaatggcacttgcactgggggggggcgaccagggacgggcgaattccgaatgcttaatagacttcgagcttcgtgaaaatgtcgaaacttctaattacagacccaatgatgggcttaattttttcgaattaaaaaagctggctgaaaattaacaaatgcaagtatacttaaaaaaatttctcgacgttgcctcgggctttgtttcgagcttcatcttcgagtgctaaaacacccgggtaatcctttagaattggtgtacctacggaaaagataaattttctttacacatttctagggtaaaaaattagctgataactaatctgagtttagaaacgaaatctttgatttgtctattttttctaccaatacttgaatttttcaaaatcttaatttttcttaaaatttactggcggtaaaccccatattttatgatgtagaacttaataacttctaagaaaaaaaatttttcgagaaatttttatggtgaattactaagatttttcaaaaaaatttccaaaaaatcgctgagaatttctcgaaaaaatttttttcttgaaaattttcttatgaaaaacctttctaagattattttcttgaaagatttctaagatagcaa

SEQ ID NO: 3193 - DNA, 4663 bp, Heterodera glycines
gcagaattttattcaaagtttgtattttgtagcattcctccttgagtttttgttcggcactctaaaaaaattgtattctttagcatttaaatgatcattatgcaaaaaattattctgcatggaccataaaaaatgatcagctttaacgccgaacgcctatttcgtgttttgtagcatgtaaatgatcacttttgtttggcacttttcaaatgttatattttatagcatttaaatgatcattttttgttcggcacttttctaatcaaatatttgtattttgtttctgatcttcttatccagtttgtagttgtcaaaaagacatcaaattgcataaactacaaagaaataggcccaatatcataagaaaatggcatggattatgcatatgctatcaataaaataataaatggcaataaaaaaaaaaatgaaatatttttataatacaaatacctaataattagggactcctttttttccttttttttgcctatttcaaggtttttgtgcctaatgtgcccaattgatccagaaaatttaatattttttcttaaaaaatttttggaatttaaaatatttaataatttcatttacaactgaaaatttttatgtgttttgctacctaaaaagcgttaacaaaaaattttatttgcctatttttgcctatttgaggatttttgtgcctatttagtgcctattttgcagtttttttctgcctttttagttgcctatttcgcgattttttgtgcctaaaaatggagtccctactaataatccttaaccactatgataacggatttttcttcgaaaatagagcgagttaaacacgtaaaaacccttaaaatttaaaggaactttaggtcaagcgattctaagatttatttaatactaatttttaaaaattacaaaatttttattttttgctgccagatttgtagtagagaccggccaactgggaccggaaggatttcgagtcgggacccagactaaatcccggccccgatcaaccccgaagaatttttaaattttgttgggtttaattgatcattttttgttcggcacttttctaatcaaatattgtattttgtatgtagtatatgaataaactataaaggaattctcgtggatgtaaatccattattttttttatgtataagcaaagtgcaaagtaaaatgaatatgcttattattaaatgaatttgatcaataaaaataatcaaattgaaataaaagtgctctgttcactgcttctaatcagtcagtctttccggtcgccccacttctctttgggcatgttaataatatctgatcataaatgttgatatttctgatcgcatttcttccatcattttgtttaattgtgcaaataaatttaagcatttggtttctgatcaatcacctgtcagcaatttttccgatcactttacggccactttctaatgctcactcccattgtgctttattcatcagtattttctttatgatcaattacttaattttttgaacaaaatgtttcaattatctttatgatcgcgcatcatcaccccaatttccgatcatttacttactagtcagttgagttaattccaacaaaaaatcatctatttattgcgtttaatctaacttactcactcattaaacggcttcaccttggcctccaaaaagtaaactaattgttaattgacccccgaaaagcgggaaaatatttttttgaatgaaattcgacactgaatttccacacaaaaaataactgtccaagaaatgattttgagaatcaaatttcttcacttttactgatcagtcgaatgtatacaaaaatgggggggggggagatcccttaaaaatcaaattgaaaaagaagtgcatccttgaaagaaaagtaaagccaaaaaggaaaaaaaggagttggtgtttgatacgaccgccggaaaaacatttgttggcatttctttggggggcgattggacaatcaatcgtaaaaaattccattattcttttatgatgaaaatatatataatacaatagttagaaataatgattttctgtatctgggaatttttcggtcattcaaaccactgctttttgaagggtaattaaattttttgaaattttataccattacgcttacgaataatatcaatggaaattaggaggatggccggccgagaatcagttgacctcggttttaacttttcactttccatcatcttcatggtgacaccttcacttcctcgtacaataaaaatttacaaaatatttgtattatgtagcatttaaatgatcactgcaaaatgaatacattggattgatcaaaaaagtaatagaattgcaataaaaaaaatatttttataccattgaaaaaaccattaaacacaatcaatctagacagtccttaacaaaaatttatgaaatttatttttaaattgatatttgttatcaaaaataattttgaatatttgaaaaaattgcactttcatggccctgagctgatcattaagagtgtattttttggcctgagacccgtccaaaaatcttcgggtaggatttcgggatccgggacgagaaacacatcgcattcttaggcttaggtctgcttgggcctatgcttagactttatattgtaaaatttttattgtagagttaccattcactttgaaaaagatggcattggagaaggtggtgccaacaccgttaatgttgacggaatttgatctttgcatgcaatttaaaaaagagataagtgctggtcaccatgaagattttgcagtttttttctctgtctccatatttctctcagcataatgggaaaggaatgaatgattctctttttctcattccgcacacactctttcgcctccttccccatctcatacttcttttcctctccgtcacacacactatttcccctctttgcatcaatatctctgctcctccctatgtaccaatatgcaaacccataaattttcttttaattaatttccattttagttgcatattttgctgtctgttcatcgcttctcggccttttggctaagatcaaagtgtagttacagttctttacggcttaatctccgtaacggcccttaccgggtcaaagagattaaccaatttttgggaattggtcgttgcagggggcttgctccctctcggctgtgcgttggcccgttattgcacttgcttacgggaacggcgcgtctcccctgcgggggagaacaaaattattttgtaattcttcaatccaaatttctcttttgaatagctgtgtgatcaaaaataaaaaagcgcatgcaaatgaaatttttatactggcttaggtttctggcctttcatttggctaaatttaaatttttcctaaattttcttttgcacaatttatcggatagtcggcgtcggcgagtccgtgttatcggcgataaatcaatttttcctgttttcactttttatctaggtatagcaaaaattaaatttcgtttaaaaattttaaatttttttctaaaatgttcttcagaatttttatacgatttatcggcgagtcggccatggcgagtcagcgtcggcgagttgaattgttccggtttttaggtgctaaaaactgccccaatagttcgtttttaggttctaaaaacccccaaaaaataggtgctcgaaatgggaaaataggttgccaaaaagtttcaggtttaggggttgtaaaagcataaaattttatccaaaaagcaacaaaattaagccaaagagaaaaaattagaaaaaacaaaaaaaaaaaatttaaatcaaaaaaattatacagtaacccataactgatatttaaattttacataagcaccgagccgaaataaactcttttttttctttgctaactcacttcgaaatgagtcaaaaaatcaataaaggttccaaaaaaatcttacggcgccgcctctcggtaccgcgaacccccaaaaactactaacttttcatgaaaacgatccaaaatagtaaaaagcaaaaaaaaaaaaaacggatttggttcggggcggaaccctaattcaaagaaagttgcaaacgaaataatcaaccattacttcattaatcttatctttttttggcaattgcctacaaattttacaacgctcggggtccccgactaagtgtcgaagcgggggggggggatgttgtcgggatcgggaaattggccgaaaaatgtcggggtaggggtagaaccacatttgagagtgcattatcgatgctgtttacacggtttcggtgggcgaaacggattttgtttacaatttgaagtgccggatcgcaaatgccactggtctcatgccggaggaccaaacaattactgttcgtaattgtgttgtccttaataggggtgacgcaacaatgaaggattacggcattgaaaacaacacagaacttcacgtgacggataaccggcggcctcagtcgagcaaaaaacgtggtataaaggggaaggtgttgaacttgtttggtctccccaaaagtggatgaaaacaacagaggcagaagcagcagcagcgaaagatgatgctgatgaacacctttcacgcccgttgctaaacgagtcattaacactcattaggtggttgtttttttttgtcaatttttttttggatttcagtatgttttttcattggttcagttcactcactgtccattt

SEQ ID NO: 3194 - DNA, 1885 bp, Heterodera glycines
acggccccaggcccggacggcatccgttactcagtttggaaaaagtatgaccaaggagcacatgtcctgacgtctatctacaactgtgtcaaaagagctcaacacatcccccgaaattggaccaaatcagtcactgttctgctccataaaaaaggagaccgaaatgaagtgtcaaattggcgaccaattgcactttcaaataccatcggaaagttatactcttcagttttggcaaaccgattggcaatgtggtcggttgctttcaaccgagtcagttcgtcccaaaaaggttttatgcctgtggacggttgtgccgaacacaattttgtactccaatcgatcatccaggacgccaaacgtgccaaaaaacgatgctcaattgcgtggttggatttgaccaatgcatttggttcaattccccaccaaacgattttcacagcactaaaatggtctggactatctgaccaatcgatcagtgttgttcgacagttatatgccacgaattccactcaaattcggcattcaaacggcctcactcccgaaattccaattcgagcgggagtaaagcaaggatgcccgctcagtccaatcatttttaacctcggaatagagcccatcctccgcaccattggccaactcagaactggctataagttgcaagaaaaacgcattgatgtgttggcttatgccgacgatctcgtccttgtagctgagtcgcccgaagaactgcagaaaatgttggacgccacctcaacaatagcaacttgggctggactttccttcaatgcccgaaaatgcgcgacgctggacatcgatgggcgaagaaaaacagcattgaacacaaaattttccattcaaaatgctcacccgcccatcctaacaatttatcaattctatgaccatcttggcgttccaacgggctatggttcagcccaatcagcgaccaaaatcctagaaaaaatgaatgaccatgttcaaaaaatcgatgcgtctcttttaacaccgtggcaaaaatttgacgcaataaatactttcgtccttccgtgcattggtttccatcttaaaaatggtgtggtgcaaaagaacccattaaatgcactggacaagaaaatccgcaattacggcaaaaaatggcttaatttgccacaaagagctagtactgagcccctttatctcagccatgccatgggtgggatggggatgataccactcaatttgcttgccgacataagccaaattgtccacgcttatcgtcttatcacttcacgtgatttgtcctctttgtcaatggatttgatcaaaaccgtggtcaacaaacggattcgacaacagccgactcatcaacaaattgccgaatatctaaacggctcgatgaaaggccttttccggcagtttgagtcgacggacatctcctcaaattggacacgcgtcaggcaggcaaccgcccggctgaactccaaattaaaaattgaatggaaatggtcaacgaatgaagagcgattggcactcgaactcaacaatgacccgctcaatccaaaaaccgcggaatattgtttgagagctgccattcgcgatttcttccgccgtcgtctgctctccaagcccgatcagggcaaagttttttcaatcacaagcgcaacaaccgcttcgaatcactttatgaaggccggcaacttcacgcgattcgccgattggcgatttgttcaccgcgcccgattggactgtgttccgctgaatgcaacgcgtcgattcggccacggagacaaacactgcccgccgctgtcacgatggacaattggaaaccctcccacatgtcctttgccattgttggccacatcttggaaagggaatcacgcgtcggcacaatggcatcctcgaccgcctt

SEQ ID NO: 3195 - DNA, 1311 bp, Heterodera glycines
gcatgggggttgctccccctcggctgtgcgttggcccgttattccccctgcttgcgggaacggcgcgtttcccctgcgggggagaacaaaatttttttgtaattcttcaatcccaaatttctcttttgaattgctgtgtgatcaaaaataaaaaagcgcatgcaaatgaaatttttatactggcttaggtttctggcctttcatttggctaaatttaaatttttcctaaattttcttttgcacaatttatcggatagtcggcgtcggcgagtccgtgttatcggcgataaatcaatttttcctgttttcactttttatctaggtatagcaaaaattaaatttcgaataaaaattttaaatttttttctaaaatgttcttcagaattttttatacgatttatcggcgagtcggccatggcgagtcagcgtcggcgagttgaattgttccggtttttaggtgctaaaaaccccccaaaataggtgctcgaaatgggaaaataggttgccaaaaagtttcaggtttaggggttgtaaaagcataaaattttatccaaaaagcaacaaaattaagccaaagagaaaaaattagaaaaaacaaaaaaaaaaatttaaatcaaaaaaattagaaaaaaaaaccaattaaaaaatctcttaatttaaaagaagaaaaaattaaagatataatagaaaagcttaattgtattgagaaaaacatttgttttcgtgcatttcagaccatatggaggagctcaggaaaaagataggtaaaaactaaaaatatcatcccaattggttggatgttcaaaatgccacagagcttatgttggttgtaatgcacacaaatgtctaattatcccccatgggggattatttttcaactccctcagaaaggggggggggataattggagactggtagattaatggagattgggagataatttgagaaatacagtaacccataactgatatttaaattttacataagcaccgagcaaaataaactcttttttttctttgctaactcacttcgaaatggatcaaaaatcaataaaggttccaaaaaaaattttacggcgccgcctctcggtaccgcgaacccccaaaaactactaacttttcatgaaaacgatccaaaatagtaaaaagcaaaaaaaaaaaaacggttttgcttcggggcggaaccctaattcaaagaaagttgcaaacgaaataatcaaccattacttcattaatcttatcttttttttggcaattgcctacaaattttacacgctcggggtccccgactaagtgtcggggcggggggggg

SEQ ID NO: 3196 - DNA, 3204 bp, Heterodera glycines
tagtcgcctacctttatcactttgattatctctcctcgctcattctgataaacctattctccaatcactctgctgatcaaatttcctcagatccgatctgatcgtctctccccgctcatttgggtaaccctctactcctacctgatcactttgctcattctcccacatcagtcgaatcatcggacggaaaataataaaattattattattaatattttataaaattctacaaattttagaagaagaaaaattgtaaagcttggaaaaagacaataaaaatttatttaattgttattaatcttatgacgttaaaatattaatgaatgaaaaattggcatacacttgatccctcggattgactttatccaatttgggacgaatcttaaaaatcaggacatttaatccctcggattgctttcccaattcaggacgaatcttaaaaatcagaacatgttaataatctttaagaatgcctttatccaattcaggattaaaatcttaaaaatcagtacttttctgccccataaaaggcatgtcttggcaagtgctaattcacatttcccactttcattcattcattccatattttttcctctccaatccttcccttttttgccaccaattctcctccaatgaagaagcatgggaacctttttcctttcccagttggcattgctgctgggctgacaattctaatgctaatgatgccaccaaccattgctgaaaagattgatattaaatttagaatagcttacaacggcgaagagtacgccattaaagtggaaggaagccacgaataacgttgaaagtttgatgcgcgcgacaggaacttacaacattaagccaaatcaaagtatatgtagggtggcaaaagacgtctaaaaatttttcattgagatacagagaaggttttaacgagcctctttcgcttgacaacgaacagaactcaacattccaactgaaggtgattcgttttattggacaaagaaagaatatgtaattaacgtgcattatcggaatactgttttacacggtttcggtgggcgaaacggattttgtttgcaatttgaagtggcggatcgcaaatgccactggtctcatgctggcggaccaaacaattacagtccgtaattgtgttcttgataactgttgtgtatatcactcaatattcaaatgtacgccatttactgtacccaattcgtgtcaatacccatctctcagcatcgtccataaatagccatcattttgtcactcactttggcttgttccacattcagtcttcattcatcacatcattttattatttattttattcttcatccaccgacacatcaattttattatttattcttttgcctccgacaaataaactatttttattcatcgttgtgttcaccgttgaacataacaataacgataaagcaacaatgcattattacggcattgaaaacaacacggaacttcgcctgacggataaccggccgcagtccagcaaaaaccgtggtataaaggggaaggtgtcaaatttgtttggtctccgcaaaagtggatgaacaacagaggcagaagaagcagcagcagcgaaagaggatgatgaacacctttcacgcccgttgctaaacgagtcattaacactcattagtttttttctgtcaatttttttttggttttcagtatgttttttcattggttcagttcactcactgtccatttagctagtttgtttccttttcatttttgggttcttattttatgcatttttgtcgctgttgttgttgtagcttgaataaaaactgtctatgtaaaactattaaaatttgaattaagctcctttccgatcataaggcttcgcaaaattgaaattggtcaatctggttgaagaaggcctcattttagaccaaaaaaacccagtttaagtactgtaataggggtgaaaatctctcttcaacaaataaaatcaacaagaataaaaaaaaacaaaatttgtatcatttgacaaaatgtgaaatttttaattttttaatcgccgggcattcgtcgcttttcgtttttgcccccaattttccttctgcttctgttgctatgtgctgttggcgatcatttgtgttgtgttgttgctgttcaagcgcctcacggcaaattgagtcgaaatattcggacaaactgaaaaaacaaaaattggaacccaaataacaaataagcaaatagatgaacccttaaaacttgcttaaatccatgatcttttaaaaaaataaaatatattgaataaaaaatattggaagttttttttcaatgtaaaatttgttcccaaatttcagaatcaaatttttctacaaacttttttgtagagttacaaatttttgaattttcaaaatttcttacaattagagggggtttccagaaaaaattaaaaataaagaataatataatttgaaaatttcgagaatgaatttcgaaaaaaagttggccaagaggtggaggaaccgattgaaatgcgattgaagggtgtggggggggggatacagttcaccagcttggccctgctcctccgccatctcacccaccgtctgatcgctttgttcaacagcgcgtgcgtttggctggtggacagtgccaattcgttggccaccgtttcgaccattttgcgctgcaggccgacaccgagcagtacagcggcctgggacaggtccaacggggcccggttggtgtccacccgggcggtgaagtacaggccggcaatggtgggcaacaggtcgctgatcaaggccaagtcggccaaattgcgacagtactgggcaacccggcgcaggtctaagtcggacaggcgcagacggagttcggcacggtcaagcaggcctaaacaagggggggggggtgagcgatcattctgctcgaaaatttttaattaaaaaattgcaaatcccaaggttttctgaacatttttaattattgaagtccattcaaaaatgtaaattcaattaagtagccctaaatatttccaattttcctgcaaaatttcaatttttttttattaatttgaaaaagttacgaccaaaaatggtcggaaaagcagtttttaaattattttgtccatactttcttttgaaagtcgacaaattttttgttgtttggcatatcaatgataattaaatggatcaattcagaaaaacaatgaaaggagataatacacaaaaaatcagtgtt

SEQ ID NO: 3197 - DNA, 5815 bp, Heterodera glycines
  misc_feature (825)..(825): n is a, c, g, or t
  misc_feature (837)..(837): n is a, c, g, or t
  misc_feature (5731)..(5731): n is a, c, g, or t
  misc_feature (5751)..(5752): n is a, c, g, or t
  misc_feature (5758)..(5758): n is a, c, g, or t
ataaatttcttagattttatttaaaatgccaaaaaaatttggctttgattcatggataattaacctgacgagtcctgtctcgattatttttctgatttttttaataaattaaaataaaatggtgcaaagttttcatttataataaattctttcaaatttgattttctttaaaatttaattaatttaaaaagtttaaatttaattaagaatcgattgattgaatccatgcgaatcttcagcaccatttgcaactcgcgttggttcatcaagacttgcttcatcttattcctcaacaagcgtgatttgtttgagcaaaaaattcgacagggccaatcgatcagtgtgtgcttcaaaaattattttggtacagcttgtttggtttaacagatcctagtaggatttctttaaaaattttaatcagacagaggcattatgccattaccgaaccaaaattccggatttttaataatatttatagggataagatttttaggcacgaaaacgcaaaaaaattattattttcattaaaatttttaggtagcaaaaaaaagctaaattatgctatttcaatagtaaatgaataaattcaataataaaaatttttatgaaaatttttggcgtcaagaaaaaataaaataaatttttgtggtaaggaatttttcggaaatgggtataaaaaaaatgagaaaatttgcactaaaataagatgactaaggcattaatttgtaagcagaaaaaggccaaaataggcaaaaattggcattataaaaatcagccgaaaagtttttaaccaagattaaaactagtttttcttgcttatctcanagtattaagtgngcaataattttagacattttcctaaaaatttgatccctaattattaattatgaaaaataaataaaaattgaaaataattatagagagaaaaaaccctaaatgcccaaattgattatattggcacaaaatttcaacaactcaacaaaaacccgcggaaacaaatttacatacatttcacatgcgccactgacaccgatcaggtcaaaaaactttaaaaatttcaaatattaaaaaatcaataattatttttaaatatatataaaaaaattttcagatttctatcatttggcataacacaaccgttgtgataattcagaaaacattacaaggatacggaatgttgtgatgataacagaatttttttttatcaataattaaattgtaatttttatatgaaaaaaatattaaaaactaaggcgcaatacagtggtaaaaattcttaatattttcattttaactcataaaacatttgttttcaattttttgggtcctttttaattatcatcatttaaattattcttttcaaaaaaatgattaaaaatttttttgtcggtataatattataatttaaaatgagtaaaaaccttgtttcatacatattttattttgttgtttacaaaatttccaataaataaaaactttgtgttcattttttaatcatcgtcatttaatttgttgttttaaaaaattaaaatatttaaataacgattaaataaaaaattaataattgatataattatttattttttaatttacttacatttcgtctacctccacaattttttctttctttttttttttggttgggtcacttccagagcaggaatcataaattatttgcttaaggacctccccgaatttatttaatccaatgaaaatcaaacaccggtgaattttgtttgggagaacaagatttttgacgacaaatgcatatttatataccttatttgctaatttatcgcgaaacaagctgagcgacaaaatgttgctaattaatatttcttcaaaaaccttttttatttatttttgttatattgctgccatgtgtaaggtaattttttaaatgatggtttaataaatttgaaaatcggaataaatagaaaataataattcccgaatgttgcttgactccggcgggccttcccggacaaaagtttaataatacaaaaaataaattaattaaattagaaaataaaaaatttcaaattaatgtttttggaaagtcatttttgaaaattaattaattatcgaataaatattgtttattcaccgggttttggaaattaaataatagaaaaaaaataaattctaaaataaaaattgctaattattcatacgttaaaaagtaaaatttttttagcggtttgcaacttcatcaattttatgcgacaggtctttctataactttttaattaaaaaaaatttttaattaatatttaaaacagaaatttgggaatgacatgctgctgtcatgcaacgtcaaccaaatttcaagagcaaaattcgcatgtcgacgaatttaattcagtccatcagtaaaatttacaaaattccaaaaataataattaaataaatttgttcagtcggtttcaatcaaaattcaatcggtcgccatttatggaatcaaaaatgagcacagcacgtccattctacaaaattgaagaagaaactggaaagattgttaagggtaagataaaatttaaagaaaatgaaaaaaaatcaatagggtagaaaaatattaaaaaacctgaaaccggatccgaaccccgaaaatatggtaaaatttctattaccatatcagcattattttctgcattccgagactgtcattttttgattttctgaaaattaaaatttcatttcaatttggattatccaatttcagaaattttactataggctatgtaatctttgcaatagaaaaatttcttaaaaaatttgttttgaaacgcaattttaaaattcgaaaaacaccaaaaaagccctagttttctcaactttgtttaaaaacaataatctcaacctgcaatttttttagtttcacacccattgtttccaacttcggcacggcattttccatcattgagatccaaatttttggcacccacaaaaccgcatcaaccgcacaaacaattggcgccgcccgctctgttgcacaatgctttacctgccgacgcaacccatgcactgctaatcccactgattgtgcaagcaccgcaacaacaacaacagcaacaagttgctgcaactgctggcgctgttgagaaagcgtcttttgaaagcagtacaaccaccacaagcagcagtatcatcatgggaagagaacggaatgttgaaaagccgcagcatgaaaggtaatacgatcgtgttaaattaagtttttaaaaattgaaacaacaaaaaataaatttaaaatatttaaaatgaaaagtcttttattagagattgagaaaggaaaattgtaaagtaaaaaataattaatttaaaaccccaaaaaggaatttataatgaaactaatttaataaataaaattaaaaaaaagtttgagaaacaggaaaattttaaagtaaaataaaaaattaatgaaaaatgccaaaatctataatgcgaattttttttttaaagtttttaatcataaatatgtaggtccaaatgtgaatgtgaagaagaatttgtgccgtcgaaaatctccgatgaagaaaaatttggcaaaaattgttgtgagcgtaagcgcgatttatgcgacaaattaaccagaagcatgaatgccaagaacagcatggaggtgacttcttaaagaaaatgttttaactatggcattctcaaaccagtctttggggaggataacaaaattttacgaattttttacaaatttctaaggaccaaagttttgaaaaagttggaatcagggtcaggatttaggaatcctgctaggccatgggttgcacgagtaaaatcccgctttggcccggcttggtaaatatgggattaggattccgggaattttctatagagctactaagatcaatcccatctcggtctttgttaatttgctgaaaatcccctcaaattttcagcatttcttgagaaattttatggccaaacatggaaacccggcgggaagcgatttgatcgatgatcatttggtcaaacacccagcagaccgggacagttttgacaatttgatggatcggttggccgaaatttcggccaaattggacaattggaagcacacaatgcgggccaaattcaattttcatgatgagcctttggtggtctctaaaaatcaaccatcatcaccacaaccattaccactacaacagcagcaacaacaattcccgatggtctcattcagcagctataagaaaaatcaaaatgccaatgcgcgaaacagtggcgccaaatttgaacatgaaatcagtgccaacggcacaatgaacattaacaacagcacattagtggaccaaatcatcccggaaaataatacggcgacaacagtaacgacaacaatcggagcaataattacaacaacagttatggaagaaacaacaacaagcacgacaaagccacaaattgaaaagattatttcaattcaagaaaggttaaagaatgaatttgccactttgttgggcattgttgaagagaacgatcggaaaaatgccaatgtaatgttttaattattaatttgttttaatatttttttgctgttttggcaaaaatttggttaatcaacaaaatttcattagaaatatatatatatatattttgtaaattttaatatcaaagaaaaagttatttttttttgaaaattttgcgttggttttttaaccttgctaattatattagttttttcatttaaaaataattttcatccaaattaaaaaaaatcttggcacttacttaagttgattttaaaaaatgtatgttttagagttatgagaaaaatgccgccaagcaacgagcgctgccaaatgttcagacggaagaatttggagcgttcaaaaatatgaatgattcacaagtttcaaaattgcctgacgaaaagaatgtgttctcacgatggcttaaatgcaaagatcgtagcaaagttcttagcctttgcctgtaaaattagtgatgatctgatcaaaggctcaattttttgtaaaaattttaagcaaaatttttgatcacttttatactttaattgcgaaaaagtatgagcctaaattaaaaaaaaaacttatttttgtaaatcatttagaaataacacttacatacagaaataaaaattattttaattttattgtttcatatggtatcaaaaataaaataattttagaaatttaaaaaaattgcgcgtttattttcaaaattaattttgtttaaatgctctaaatcaaatgaatttgctataattgtgcgataattaataaaggcattaagctatagtattttttttttaaagaaaatgccgatgattcgcggaaatttatttaattaatattttttcatcacttaaaatatacatcccaaaaacaataatgcaaattattatattcatctgaacaggtttaatcaaaatgagagaatccataaagcttctgcagagatttagcttgactaatcgaaaaatcatctctcacatgccaccaaatgcggtttcttctgattatgagcatcgcttaattaatgatcgggcgttgctggacgagaatcgcgtcattaattaattattcgcttaatgactcgcgcatgatggtaattaagtttttgcaaaattgcgttgactattattggtggaacaatatttgctgatattttttacaatattacttgaaaaaacaggaaaaaggatgcaatatttgttggaatgagatgattaatgattgacacttttttactgcttgaatgngctaatatttaagctaattnnagttgngtttataaactgccaatgccccaaaataaattcattctctttttcattattttttgc

SEQ ID NO: 3198 - DNA, 1452 bp, Heterodera glycines
  misc_feature (52)..(52): n is a, c, g, or t
  misc_feature (55)..(55): n is a, c, g, or t
  misc_feature (60)..(60): n is a, c, g, or t
  misc_feature (64)..(65): n is a, c, g, or t
  misc_feature (68)..(68): n is a, c, g, or t
  misc_feature (73)..(75): n is a, c, g, or t
  misc_feature (77)..(77): n is a, c, g, or t
  misc_feature (90)..(91): n is a, c, g, or t
  misc_feature (97)..(97): n is a, c, g, or t
  misc_feature (102)..(104): n is a, c, g, or t
  misc_feature (108)..(108): n is a, c, g, or t
  misc_feature (110)..(110): n is a, c, g, or t
  misc_feature (115)..(115): n is a, c, g, or t
  misc_feature (127)..(127): n is a, c, g, or t
  misc_feature (134)..(134): n is a, c, g, or t
  misc_feature (183)..(184): n is a, c, g, or t
  misc_feature (195)..(195): n is a, c, g, or t
  misc_feature (205)..(205): n is a, c, g, or t
  misc_feature (215)..(216): n is a, c, g, or t
  misc_feature (251)..(251): n is a, c, g, or t
  misc_feature (263)..(263): n is a, c, g, or t
  misc_feature (274)..(274): n is a, c, g, or t
  misc_feature (281)..(282): n is a, c, g, or t
  misc_feature (284)..(284): n is a, c, g, or t
  misc_feature (289)..(289): n is a, c, g, or t
tggaatgagatgattaatgattgacacttttttactgcataaaagggctaanatntaagntaannagnagggnnnanacctttaaaatgnncaaaanaaatnnnattntnttttntattatttttgnaattgtnttatttattttttttggaaatatttattttatttttattaataaaatanntttttaattgnataaataganagtaaatagnnaaaaagaattattttagtgaatataaaaaataaanaaaaaaattttnaaaatggttgntaattannanattgntaaaatataatgaaataataaaattctttatattaatagttttcaatccttgatataagtcttaaatttttaattgttgaatttttccgaaattttctttttttattatcttaaataattgaaaattgattttcaaaaataggcaattgcataaaatatgaaatttatgctccttttgttgctgttggtgttctgtgcccttgcccacatgggtgatgcttttggatttggcggcatgcaaatgtgttgtcccccgccgtgcccgcctccatgcccgccaccatgctgttgtggtgtgtcggcaaatattaaaaaaaaaatataaattccgattaaaatgaatttgtttttaatccattttaaattattaaattaattcaggcggaggaggaggtggtggtggtggcggatgcggtggcgggggaggtggcggcccccctattatcattaactgtggcggcggtggacagtctggcggtggcggttgcggaggtcgtgcatgattcataatttttctggaatcccaatttaatttaaattatatttaaattatttagggggctgtggtggtggtggtggcggttgtggaggtggaggttagcacatttaatttcaaaatgggtaaatatattaaaatattattatgcattttaggtggctgtggtggtggcggtggcggatgtaagtacagtgaaaaaataataatttacaaaccattattttaaaattccgggtcagcaccgggattaggcttactgtcctccaaaaatcctgtctttaatcgggctttacttttgaaacccctggaggactcgggaaaagaattggaggatttgattaccagcaattaaattccttaattacctataatcggcttttgagcattgtatacctgataccaggatcagtaatccttgtaagttttgaacttgcaccattccgtttatccgcatcgatacaggaaccggatcatttctaaataagacttcatgatcagaattttatggaataagtccctcgtttttagacgaaaaattctgacagaaaaagattttctataaaataaattttaaacgtggaggtggaggaggctgcggcggatgtggttaaaactcatgaaacgaaagcctcttcaacatttgtaccagaagaagaatgcacat

SEQ ID NO: 3199 - DNA, 6887 bp, Heterodera glycines
  misc_feature (6835)..(6835): n is a, c, g, or t
  misc_feature (6852)..(6852): n is a, c, g, or t
  misc_feature (6879)..(6879): n is a, c, g, or t
tttttggcatttaatattttttacacttttattactaataaaattgaaacggcaaagttcaaccaaattttgacaaaatatttggcaacaattgggaccaaaatgaaagtgaaaaacggatagaaaaaaattgtcatttccaaaaagaaagaataaaaatttaagacaacaaaattggaaattttgaaagaaattagttacggaataattatgtatttgggttttttaattttattttttcagcttttttgtttttttataaaattaagtaaaaaattgatttaactgctcatgatacgtggcaaatttactgtttgtaaaaataataaaatgaatattaatattaaaaggcgaacaaaatattaaacaaattcatttattgcaataattcgatttcccaaaaagaaaagatgaatttttggcttaaaatattttttatatttttcgtatttaataaaaatgaatccagcaaaatccgaccaaattttgatgaaatattcggcgaagaatgggacaaaaatgaaaatgaagaaaacgcgatcaaaattgagcaaaaagaggaaaacagtgaagaaaatggaaccgaatcaattaagcaaacatgaaaagtgatcaaaatatgaaagaagaatcaaatgatcaacagaaaagagaaataattcgaaaatttgataaaatttaagaaaatttaagagagaacagaaaatacgtaaacaaagacagcaataaaattgagtggaaattggaaaattattaggcacaaatcgcgaaaaaatatacaaatggaaaaaataatttaatttaaataaaaatgaaaaacttcataagagtcaaagtagacaattttttgtattaatttttatattttttatttttaagcacaaaataaatattccaatgagaacaaattacaaaagatgaagcaatattttaaaattaaataagcaaatccaaaaataagcgacagaataatcgcaaagaaattgaaaattgcctatgaaacactaaaaatgtggaaaaagaaattttcgacagttccaaaaatgtgattttttttgaggtacgtcatttttaaatttgctaattgttgtaaatgaatattttgccaattataatttattcattatttgcattataaattttctgttattaaaataaactttttcacttaatagatatagaaaattttattaagatgaatttaattttgaaaattttcatgtaaaaattattccaaaattagtttcaaaatttgataatgaatttttctgaaattaatcacccaaacccaaataattcacaattccattagcaaaagataaaagcaaaaaattgagaaaaaaaaatattagaaagcaattaaaacacaagcagagcagacgaacataattaatcactaaaaaaaagttaattggaagggaaattaacggggataattatgaagagacaaatggggagcacataaatatgtaattgcataaaataacgaaagccaaaaaaggcaccgaatttaatcatggaaaatgtcattgggccatcccaaaaaaaggggggacaactcagcgaaaagagaggggaaggaaaaatttgggaaaatgatcagcaaaaagtgatcgcaacacaatgtctggacggatggatcaacagcaaatcgggcgcaacagcagcgaaacagaaccggattagcacagaaagcagcacaaagcacagaacagtgagacattgggcaaaagcaaagcgattggacagagtatttaagggctaattggatcaacgaaggcacacaacacaaccacaaattcatttacagaacctcaatcactagtctcaactttttttggcacttaataaatggcatgtcgatcccacacccttccaaccacaaattcttattgttttgactaatccccaattaacgggtctcattaacaaatcgaggacaatcagtaacccgaccccaaaattcgagtagatgtccccagtgacttccctaagccccactttattggtacttcgctgggttatggcatgccgtctcccgacattgccaacaattttcctctaaattcgagccgcttgtcacctaattatttttctttccctttagccgcttaatcttaatcaaatccgattaaaaaatgttcgtccgatcatctgccattctgctgatcgttgctgttgcgctggtgccactttccgatgccattctcttcggcggtggtggcaacaactgttgctgctgttgctcccctccgccctgccctcctccgtgccccgtccagccctgctgctgtgccccgccatgtccgcccccgtgcccttgcccacctccgtgccctcccccgtgccctcctccgtgccctcccccgtgccctcctccgtgccctcccccgtgcccaccaccgtgcccccggccatgctgttgcggtaagttgggcgaaatcgttttaaaaatttacactgaaaaatggatttaaaaatttgggtaacatatagccattcaaattttaaaattcaggaggttgcggcggtggcggctgtggtggcggcccaatcattgtgaactgtgccggcggatgcggcggtggctgtggcggattcggattcggaaaataaatcatttaattcgcttaattttcacgtcaatccacattagattttcatactgtagtgatctttttagtttttttttctttgttattgatatgcaatatttctcgcattgcattaattagaataaaatcattagttttaagacattcccagtgaaaacggctcttttaacactaaatttcatagatgacaataaataaataaattactttaactcattaaagtaaatacaaataattcgcttcccgaaccccgaaaaatcttcatgggagtgtctacacatccatgatgtgcatacttatcatataaaatgcatatattaattgcatttttttttaccaatatccacgccattgaccccaacgaaataaatgaataattaacattaattaaaattaaatgtttattgaaaattcaaaaaacccggtgctgcctatcggcatcgccgcaccacaaacttaccttttattaaaaagttgcttaaaaaagcaaaaattgatctttttggtgaaaatctgttacctaatgcattcaaattttcgaattggcgaaaaatgggacaaaaatgaaactgaagagaaaaggatagaaattgagaaaaacaatacctcactatcaccagttgatagcggtgaagaaatggggaccgacccaattgatcaaacaagcaaatattctaatcaaaatgttatcaaaagtgatcaaaatacgaaagataaacaaaaatgaaaatgaaaaatatggaagaaagaattggtgccaaaatataataaaagtaaaagaaatattcattttaatattaaattaaaattaatattaatatttttaagcacaaattcaatattccaatgagaataaaataaaaaagatgaaacataagattaatttttatgactcttttatgaaagaattgctaaatatgtttttcagtaattattagtgaccggacttttaggcaccaaaatttttaaaataggcacaaaaggtgagaaaaggcataaaaaatggacaaaaaggacaaaaaaggcacgaaaaattggaaaaaggcagcaaaaagaaactttttttagacaacattaaaaaaaaattttttattaaagatttttagagagcaaaacacgtaaaaataaatcaaaaaacttacaaaggcatatgcctcgaaatccggtctcatattttatttttattttctgtcaaaaaaacattatgttcgacaaaatgattcatagtgccaaatggggcaatttttgcgcgctaattcaaaaaatatgtagattaatctgccttttttgcattgtttattttgatgatcagccatagctctcgagttatctccaacataactgaacaatataatattgaatacgataataataatgatcaatcacatttattcaatatttaccatttattctgtaatctaaatgtcacactttatatcttatgttccaaacaattgtctctctcttagtgagtggttctttggtcaccccctccatctttgattacgcccctgggggattttctcttaatcactattattcacatcgagtctctccccggccagtctctgctcccgagaccgagtcgggaagagggcctaagcattgtatccttcccccagaataaaggcgtactgttgcttactgtattaatgcggaacaaagggatacaaatggccctacggtggctaaggacattcaatatttacaatgtgaaacatttcaacactggttttttataaattcattcaaaaataatttgcatttcaccttaggaataaattattgaaaaattgattttatgcaataattttgtcgatatgcattgaaaaatgaatttattgcttttaaatttttgtatttttcgttgctttcgaaattgaaaccggcaaaatccgaccgaattttaatgaaatatttggcgaagaatggggcaaaaatgaaaatgaagaaacgtaataaaaattgtgcaaaatgagcgatgaactcacaatcagcaactaattaattattactaattaaaaatatgttttttattatattgaaaatttgaaatttcaatccttagaatcttcacacaattccctttattattcatcattgtatcttagtgcttgggcattttttttttatcaaaaaatcatttttatttagaatttttattttgaatgccgcatcttgaacttttgcacgaccgaaaacaccgtacttaagcaaatattttttgaaaattcaaaaaattttcttacagattatattaaaatatctaaaaaaattcccgctcggcttctaactaagaataaatagagaaatatagcatttttgacaacaaattttattaaattcggttttagtgcagaaaaaatcatgaaatgtagtcacgaatattgaaaatttactttctgagctctccacttcatcaatttaaaatagttaatatctatcactaaatatcatagattacaacaaaaaaatgaattattacaatataatatataaaaaatacattctaatattaatcaaaatgccgtcgtgacaacttttgtttttgggctcaaaataggcgtgacttttacaacatttattggcaaatgattggcttggagttgattcgccgaggaagaagcattgtttggaaagcaaaagaagcggcgaattaggccaaactcatggacaaatgctttccgatattccgtacttaaaattatttaaatttaaaattattttatttttacctcgtcacatacaaaactggcccattggaggcggcactgacattaacagtcaaaatggcgacaaacattgtaattgtccaacatttgattgggtcctcatgaaacaaatttggtactatgaacatatagtaagcggaacatatgtaatatcccgaaacattgatcaaaatgatgataaacaacgaccgaaagatgcgtcggttgaacttttccgcgttcgaattgtttgaagctggaaaaaacaaaatgaaaactttcgaaattttgacattgatgaatcataaatttacaattttttgtttgaaaaatcggtaatctccaaaaataagaaattttatgatgagttgatatagagttcgactgggtcccggaaaattgggcatcagacaaatggacatcaaatattggacacaagaatattggaaatttttatccgaccttgaccaactacaaatccccaaagaaattgactccgacaactccattcccgactacgccaagctgcttattaagcagcttcactccctcttaagcaccgcctccgtcctaattcattcacaggctgcggcagtcgacgcggtcgaagaggaacgacgactgagaaccgtcgttgttacaaatgtgcccgaaagcaaatcggacaaagcaacggagagagcccgggaggaccgtgccgttgtggacgaaattttgaatgccacggacgttgatcaggcaccaattgtcttccgtgtcggcaaacgaatagatggtcgaccgcgccccctcaaaatggaattcccgagcaaacatgcagcgcggcacgtcatccgcatgcgcggaaaggtgcaagcattgaatggtctccacaatgtccgcgtccgcgaaagcatgaccaaggaccaactgtccgagaggcggaaactgatcgaagaatgcgggaagaaaaggcaggcggacaacggtgattgggtgatatatgccaatcaggtcgtgctgagacaggacattgaccatattcgaaaaaatttttaaattgtccaaccaaatcactgcaaattacctataattattacccaaaagtacaaaaatttttccggtctgtaaaaaatttctaccaaaaaattactcatccaaactttttaataaaaaataaagggaatgttaaatgctgcctaataaacattaggtcactaatgaataaaatcgatgaaatagcacttatcttagaaaccgaaaaaatagacattcttttaattaccgagacttggaccaaagacggggaagaaatcaatttttgcccttgggtaaaagagaattacaactatattttttcatcaaggaaatcaaaaacttgtgggggtggttgtggtattctaatcagaaaagaaattggattttttacaaaattttcggattcaaaatttaattctgaaattttagttattcaacttcaaaatttacaatgcatcagatttgttttggtgtatagaccacccaaaacanacactcagacgaaacangaaaatttgttcaaatttttgcaaaanatttttta

SEQ ID NO: 3200 - DNA, 6532 bp, Heterodera glycines
ctgcaaaacctattggggcaaaccgaaaacatattagattccctttgaagttgccgcccacataaattcgatttccccaaatccgtgcggttgcttttttttttgcacatccctccccgcgccgccgcgcagcgacgcggaaggtaatcaatcatccacctgtcaccagagtgacaggggaaggaaattcgattttttcttttgcaaatttaatcctaatttctaaaggctaaatccaaactacttagacattacattattcgcaatcctgagattttttttttgtgatgctttttctgatcctgaaattaaactcattttgaaaatttgccaaaaccgtgcgggttttttttgcatttcctccccgccccaacgatgaggtacaatgcaggcgtcgcgcaaattaaatcgataatgaaattgtagaagtgtagaagtgcaattttaattggtaatgcagcaaataatgccgataaataaattaatgaattggacaataaaattatccaaatccaatttaaaaacaaaatcgaaaatgaataaataaatatgatgaaaaaaacttttccaaaagtaggtcatctgtcaataaaatatgattaatgatttttagcaatatgggccaaaaattttttaaaaatctttgattgataggctttcgtttttgaaacgatttcgcaatatggacccatttttgaaatgattaatgagtttttatccttttccagcacaatgtgcaagtgacagacccaaaaccgagcgggtaccggaagggcccctccaaaatccgaaacctattgaaggggtattttcctttgaagttaccgcccgcttgcgggggcggtattttcttttgaaattgccgctacgtgatacttccccgcaaaatcccgagcctattgaaggggtatttccctttgaagttaccgccgcgggattttcccctaacccattgaaggggtgaaatccgttggatgatttatgaacaggttcacaaatcaaagatattgtattagtttaaccctttaaaggcgccgcccacgcaaatccgatttccaaaaccgtgcgggtatttttttttttgtccccatcttcctctccgccggtgcgccatgaagtcgccctgccgcgcaccgccgcggaaagttaatcaatcattcccctgccacaaatgggacatgtgaaaatactttcaaccaaaattcaagttcttatacatcatatcccaaatactttgtcgctgttttttgaatgctgttcattaaaatttactaatacgtgtttaaaattccaaatcctagaaaaagagcgaaagtgttctttaactgaacataaagataaagaaattatggtccgacgaaaaattttaaaataaaaataataaaataaaacgaaaaaattaaacgtaaagataaattaaaaaattgaaattttcaattgttggtgctgtgtaccatatttctttccaaaatcgaaaactatttcgcaaatttgaccaacaatttctgaaaaactgccaagcaaaattgattgatggatttattatttcgaatttctcatttattacacaatatgcgcgcgatttacattaaaaaacgagttcaaaatataggctgcccaaaattttgaaaatttaagcaaaattaattaattatcatcagtcagctcaatgacccaaagataattcaaatcccattttaaaaaaataataaaattgaaaattctgaatgtatgttgtttaaactcattcgtagcaatttaaaaaataatttttcttgataattttttgctcccttcaccccttccccataaattgtttttttctgttattcatcattatttttagatttcggatttagggaagttaaaaataattactcttatgtctttgccacgtaattctcgttgttattctttctatttcaaatttaattgaattcccaaattattgtttttgcatttaaaaatttgaaatatttcaataaataatttaatatgaaaaggcaatccttttgagttcccgaaccttttcttttgaatatatattttaaccgttttacatttttgaatgtttaaattataatattaattttcttcccttaaaaatgctttttttttgtgacataagatggtatacagcttttgaatatgtctagataattgaaaacacttcccaacttagaccttttaaaatctccaagcttaaggcattgaaaaagatcgggacgatattaagatattgattactcatgtaaaaaccctaaaaacaaaaagctttaaaatcgcaaattttgtccaaaaattcattttaatgtaatgattttattagattacacctaataagattatacattttcatggattaaaaggctcgagtatctcgttttcctcattaaaccttgctcactccattcatagattggcagagctatgacagaaaattaatgaacacctgtgcagattcgaaacgcctattttgccaacagccgccagcgaaatctttaacaaagattaaaattaaaaataatatcaggcaccgaatgtaattctgagcaggcttttgtgggattccaatctacaatgatatattttaggaatatttgaaaaaagaatgaaaattccattcatttcaaataacacttatagctccctaaaaaattattttcgatcaaaaagttatcaaaaaatctaggaacaaatatttttaaaggtttcaaattttccaatagaattagggatttttaatatagatgaaaaaaataaaatatatctttctttcgaccgactgtttattaaggggtaattagtatttacatgactttaattatttttcgtaattttgcaaatttgtttaccgttctcaaaaagtttcaggaattaaacaaaaattaacctttttaaggaggctttatatttaataaaatttcaccgaaaaataattttttaaaagacatccaatttgaaagggatttaaattttttctccttttgaatattattgcattgcgtttcactaaatttttatcaatttctgaaagtttattgttacaataacagacagatgaataacattttattatgttaataatgtataaataaaaattaattgcaaaactaaatatctttaaagcacaacaattttgtaaaatgaataaagaaagaaagcctagaggaagacctccgaaaaataaagaaaaatctagtgaaacatttaataaaaaagataatcctcgagtagaaaagaatttttcaaaaattttaaagcccaaagtccaaaaagaaaaatccaatgaaaattttaataaaaaagtaaatctcagagtagaaaagaatttatcaaaaattttaaaacccaaagtccaacttaatgggaaaagaatagaaataaattcagaaagggacacaaatgccgttcatactaaaataaaacttcctccgatttatgtaagattatagatgacaaggctaatatttcaaatatttatgattattgttaatcaatcacttcttcttatcaaaaagcattttcagcatttgacaaaatttgcatacgatgtaaaatacatggacaatggctgcttgaaaaggcagaggaaatagtatgaaaagcaaaagaaaaagcaattctaaatacaaggtgaagagagggaaaagtcaatgggaaactggttaaatgtttacccgaaaagggaagagagttgtgaaactataaggaaaaatctaatgctattgtttcatagtgaaaagagatgaatatgcaacgaaaaccggtgaaatgagaatgaaaaggaatgatgatacaagggggatagatgaattatgtgttagtatgtggtcaaacaggtaatgaataggtaaaactctgtgataagtcgtgaaaagcaaatgtatatggtgaaaagtgaaaaggtaaaagcaaaaatgttcactgataaatagtgaaagttggtgaaaagcagtaggcgacaagcgaaatggttagtggtaagtggtgaaaagaggtgaaaaacaatatgcgacaggtgaatgtcctgtggtaagtggtgaaaagaggtgaaaaacaatatgcgacaggtgaatgtcctgtggtaagtggtgaaaagaggtgaaaaaacaatatgcgacaggtgaaatgtcctgtggtaagtggtgaaaagaggtgaaaaaacaatatgcgacaggtgaatgtcctgtggtaagtggtgaaaagaggtgaaaaaacaatatgcgacaggtgaaatgtccagtggtaagtggtgggaggaggtgaaaaaataatatgcgacaggtgaaatgtcctgtggtaggtggtgaaaagaagtgaaaaccaatattcgacaggtgaaaatgtcctgtgttaagtggtgaaaagaggtgaaaaacaattggcgacaggtgattttcagttataagtggtgaaaagatgtgaaaagtctaagaacattgatgaaattctagagaagtgatgaaaagaggggaaactaaaaatggaaaagtcaaatatttcaaaaacagaaaatacaacgacgatgctgattttcgtgttatgtggtgaaaggcaaaacagaacagtagttgagatagaagctattttaaagtggtaaaaaggcaaagaaatgttcgaatatgtaaaaatataataaaagaatttaagagatttacatttaaaaatggcaaaattaaccgctgttaactctgcaaaaggaaagttttgtgacgggtattgttatcacaaacacaaaatgacaaaaaataaaacttggtggaagtgtgaactttaccaacaaggatgcaaaggtcggggttttgagagtaatgttgagtttttcggaattcgaatgcataatcatcctccagaccaaattctacttcaaatcgagatagaacagtagatttgaagatgtcaaacatagaaatcagatttcaccttggaatttcaaaaatatcacgtgaactttatttttcctctcagctgcgtgattttgggtaacccaaaagttgaaaaaaaaggtttgatatttcatgactctgagcttttgaatgagcttaatttttgtttaaaccggttcaattttagcgattgaataaatggtaattaatcattgcgtttaacaggtgcagacctacaatttagttcgttccccactgatggtccaccagaaagttgggcaccgggtgtttggaaatcagtaagtttgggcacccggaagtttgggcatcagaaatttaatcaattcgtacagctgattagacatagggtaggttaagcgtctacttgttttccgccttagatcctggaaatgctggaaactgcggggctttcaaatcagaatgccgtcggtcggacctattcgtctcccctgccgtcggtggcaccccaaaaagtggaggcactctcgtcaccacatgctaatcactaattttattgttaactttccttttgcagagttaacagcgattaattttgccatttttaaatgtaaatctcttaaattcttttattatatttttacatattcgaacatttctttgcctttttacccctttaaaatagcttctatctcaactactgttctgttttgcctttcatcacttaacacgaaaatcagcgtcgttcgttgtattttctgtttttaaaatatttgacttttccatttttagttttcacctcttttcatcacttccctagaatttcattaatgttcttagacttttcacctctttacaccacttataactgaaaatcacctgtcgccaattgtttttcatctctttcaccacttaccacaagacatttcacctgtcgaattttgtttttacctcttttcaccacttaccacaggacattcatgcttttaccttttcacttttcaccatatatatttgcttttcatgacttatcacagaattttacctattcctttgcctgtttgaccacatactaacacataattcatctatccccttgtatcatcattccttttcattctcatttcaccggttttcgttgcatattcatctcttttcgctatgaaacaatagtattagacgtttcttatagtttcacaactctcttcccttttcgggtaaacatttaaccagtatcccattgactttcccctctcttcaccttgtatttagaattgctttttcttttacttttcatactatttcctctgccttttcaagcagccattgtccatgtattttatatcgtatgcaaattttgtcaaaagctaaaaatccttttgataagaagtgattgatgaacaataatcataaattttggaggaagggaggaagtgggggggggggggattttacaccggattaagtggtatttttctttgttttctcgcgcatatttttttactctttttctctgtttctcttctctctcctatgtgaatgcgcatctctctgccctgggggggcaagggtttacaccggattaatgggccatataatactcatacctaatatttactgtaatcgctaccatatagcattttatgcgaacctgctggatttga

SEQ ID NO: 3201 - DNA, 3705 bp, Heterodera glycines
  misc_feature (837)..(837): n is a, c, g, or t
atagtaatagaaaaaagggttttattaaaaatttaataaaaaaaatttaattataaaagtttatagaaattacttacgacaagttttttttaaattttacattttgcgcaataagttcattaaaaaccctatgttctttacctttgatatattaatattttcaaaaatttattaattttattttaatgaaaaataataatgtttaaatataagaatttttttcgttttctttcacatttctttaatcggcacggcgccaatgaaaaacattaaaaaatttaatagaaattcagaattttgttcaaaaaaaatttttaaattttttgtaatttttggcttcgcttttttctgaattaattttcactgacgaaatcactcactgacgtaatcacttactgacgaaatcagcgggaaccgccgcgaatgaccgagcgtaaaaataaatgtttggaagcgaggccgcgaagcggccgagccctccccaccggttcaatatcgcaaagcactcaaatgtaaaaaatgctgaagaaatttgctgaggttgagtcccagtgcttggaatgccggagggttgagtcccagtgattgtaattccgcagggttgagtcccagtgattaaaatgctggagggttgagtcccagagattggaattcctgagggttgagtcccggcgattagaatgctggaggattgagtccctgtatttggaatgccggagatttgagtccatgtgactggaatgctggaggattgagtcccagtgtttggaatgccgaagatttcagtcccagtagtcgttttatcattcataattctacaacacaatcgtactaccntagcgggggatgcgccgaaggcgctaaccccgctagtaaacttaaaaatactataaagaaccaaaaaaatggatttaaaattaaaaaatgcaattttattttgtcgtgtcagttgtataaaaaacacctccaagtatgccaatttcaaaaaaaatccgcatttaaaaaaaagaaagattgcaaaaaaaaagtgaaaatatttgttaaaaatcccaaaataacgacgaaaacccaaattttcgtaaattttgggtatgtaattttttaaaatttcccaatagtctacatttacgtgtgtatttttcgctttttttttgcatttttttgtgaaaatttgtcaaaaatggccgaaatatgtactaaaaaggcaaaaatagcgaaatatggatgattcccccaaaaccccaaaatctggttttatatggactaaaaaccttcaccaaatcaaaaaattttaacgtagaaattctatttttgagcccctttcttcatagcatatgtgcagaaaaaatatgtttaatccatataatttacaaccctactcatcatactaacgatgttcagttgtcaaattatttgtccatattaataattaattcaaaatttttttacttctgaaaaggatatatatttttcaaaaaatttttttggaaagaaaattcttattaaaataaattttcctctgttctttcgtcgcattatataatagttgttatagtttaaaaaattttaaaataatttttgtgtattttaataagttatttttaaaacatatagaagaaatgattaattagtttatcaaacatttctaatttttagtaaatgttgtaggaatgaattagcgttcaatccgtaataaccactaatctttataaaaataattttgtttttccgtaaaatttacataatcataggtcattttagaagtttattggaaaattttttgaatatttttcatcagataaattcgaaatttttttgtaatcattttttattcaaaagattaaatgctttttctgagttgtcgaaacttttcaataaattctttttccggctcaaccgcattcatttttgtgctcaattcgtccattttttgtttatactccgtgtaatttgttaacatttcattgaatgcatccgcaaaatcatttttcaatgttttggagcgaatgtctgaaaaatttaaaacaagaaattaaatttcaaaattggcattttaccaatcacttttgccacccctcgcgccgccaatgcctcggcattgttaaactgatcgccaaagaatgggaacaaaatcagcggaacgccacttttgactgcctcattaatgctgttctgtccgccatgggtgatgaacagtttcagtccgccgtctttttttaaatttaaatttaaaaaatttcaaatttattttttaaaccaagaattgccgactgttccagccaactcttggcatacacattgtccgccaactttttgtactgttcgccggtgccaattggcgcccttttgccccatttgatgatcatgttcatctgcgggtactgcttgaacacttccaccacaatgttcttgagtgcaactgcgtgtgcttcgccatcattcatctccacaacagagccaaaactgagcaacacaacgccaccattttcattttcactgttggcagatttaaatatttgtttggtatcctgcaaataaaaatttttttttaattattaaaatattcatatagaacagatcttcttttaagggaccttacgaaattactataaacagaccccataacaccataaaccatatttataatatacaacagagtcttcctaaatgaccctcactaaattactgtaaataggcccgcaataccgtaaccaaatttataatatagaaccgagtattcctaaacgacctcactaaattttatcaaagtccaacctaagccctcctatttatcatgtcatttttttttgcaaataattttaaaaatccaacattaccccatccatttttggcacaacaccctttggcattgtgattgcgccaataaaattgatacaattttctaatttgccttttcatattggaattggacctggatttcttggacaaaaaatcaggaaaataaaattaaaaagagtcaaaaaatcaaacaaattctaaaatattatccaggaaatccaggtttttttgtgcctaatctaggcctggtgttttatatttgttatccaatattaccccattcaattttggcacaacaccctttggcattgtgattcctccaataaaattgacacgattttcttttttaatttgccgttctcgctcaatttcctgctcaacaacaggaaaatcgaggaatggttgcacattggtgaagtacaaatccatccgattctgaatatcccatgatgaagcaattttttcatgccgaatgaaatcgccaaattcatcctttgacaataatccgcgattaattgcatccacatatttttgtcgcttaacaatttaattaggctattaatttattttattaattattacaagcaataatgttgaactttcaactggctttatgtataaatcttcgtttcgttgacgaaaatgatttggattttctttgatggcactttttgttgctaattgatggtcgctaatccgtgccaaatccctccctaaaatttgtcttcattaattaagttaatgacgattttttattttttggaattttttaatttttttcaaggtataatttttaagcttatcataaaaatttaattcattctacgataaaatatttttttaaatttatttatttagactaaatatgttaatgatcagtcgacaaattttcaaatgacatttact

SEQ ID NO: 3202 - DNA, 4051 bp, Heterodera glycines
  misc_feature (4010)..(4010): n is a, c, g, or t
tagtatgtgatcaatgatcggaagagagtgggagcggtgcgaacaaaaaaggggggtgatgtggcgctttgtcaaattctttatttttattcaattaatttattaatgatgatttttgcccttcattaacattgttgggcggtgtccgtctggtctgatcactcattatttgatcataactctgtataatataaatgagagggtattttgatttgaaactttttgcttttcaatttcagattttatttgtttaatatatgcatgatgctttccgatcacttaatgactcattatgatcactgtgatcaattgatttccatccaaatttatactctttaatcactataaaaaaaggttccgtcatctttaaatcgtttgccctcaaattgatctgaattctctgatcacatttcgatattcatccaaatctgatcacatttctgatcactctctctctctctcacatttaactgcacagtcaagggctaatcattttaaaatctacttttggttttcatcaatcacaatctccaatcattttttctacaattccattcgcattccgataaccattttctgatcaaacaatcacagcttttcacactaatgactcctctgatcagctttcaacagcacagcacattgatcacttccccgcccgatcagatcgccccttccgatcacccacacactgaccagtggcatgtgtaaacaaagggcacacaaatcactcaccgatcagccgagcataaaaatggttgcgcaaccgtaccgaattgtgaattgaatgaatgaatgacctcaacccaaataaaagcacaaaaaataaaattcaaaccacccaatcccagcacaagtacaaaacataaactcgatgatcagaagagtggaggggaagaaaaatgtgcccaataaatcacgcgaccaaaaatgcaatgatctgaagcaattaaaatgcgcaaaaaattgggttgatcactcactcactcactcactcattcattcattcaaaataccctcctggtacaaatattgtctctgaaaagcaattatttgttcaccaattccttccggcaaaaattttttgtctccgatcacttaaaaaaatgctgatcacttttacagtgtacggcaataatttttgcatcttgttccatatggaaactgtcatttcctgctactaacttttgtctctgatcagcaatcaccccttcctcccggcaaaatttttgttgtctctgatcacttgaaaaatgttgttgacttttatctgatcacattgcaaaatgtcacttcctgttacaaacttttatctctgatcagcgatcattccttccttccggaaaaaaacaactaaaaaatttgttcttttctgatcacatgctattggaggatcttcatttccgatcactctccaattaagctttgctcgtttaatttgtttctctctctctctccgactgatttttggttttttctcgatcattttgttcgtccatggccctatgtcaatcaaatcaccaaatcgtcgtgcaataaacttttaatttctcgcgcgtttattcggcagtcaattaaaaaagttaatcttcttttcgggaaccttctttttatgttttaggtttttcaatttttttttattttttgtttatttttatggcgttttgactgtttcgcaaaatcttatttttcgaaacatttctcctaattttaaatgtctttttttttaatttaagctcaaccgacccatttttaattttttttttccggttttaagccaatttttcaaaatgaaatttttttatgtctttgggctatctgcgcccctgcgcccataaatcaattggcaaaaaaaaaaaatcctttaactctgaaaaaactctaggttttacaattttcatacaaatttaggggggttttttcttaaatttttcatactccaaattttttgtactttttttttaaactgccatttaaattaattcaaactttttcatttgtaaactccaattttttgtactttttaaactgccctcaccatttaattcattcaaaaattttttcatttccccccccccccatttaattggggacaaaaactggaaatttcaaaccacaaattttgaaacttttaatggggggggggctgtatggggaggaggacactctttttaaaaactctccgccggaggggcaaagattgggcgccaattcaatgccaaatcattcccccggcccccgcccccaaaaatttatcgtcacgcctcatttgtcaagaaaaaaaggcccccaatttgagatttaatgaggcacatcatgccgatgatcaaatttgtttattttttctgcaaattttctgtgcgttcacttttgtggcgttttgtttgtttttgttttgctctgccgccgccaaatatttgcgcgcaaaattcactttttgattttgcaattttaattaatttcttttttaatttttatttttggaattcagcatttaaacatttttttttaacttatatttctcggactaaccaattattttcaaggactgtccttgtcaaccaaaatcaaatatttttaataatatttaccgagcctaattcacattttgatttcgcaaattcaatttttaatatacgaatttaattaattgcatttattttatttttttaattttcaaggattttttaatttgcaaggacttttcttgtcattcaaggactgtccttttttatgaagatcaaaatataatggcttttttcaaagaaaaacaatttcttatgtggtttgggtgtctgaaaaataatgaataaaatatctaaataaatttttaggtctaagttttcagcttaaagcctggcttaggtttcgattttcaccttgaattggtcacattaacttttggcatttttgcgcgagagattattttttatttgttgttaatgttgtttttgttgttgtgagttgaaaagtgaatgcaaaacaattttaattattcccaatttaatttgttttattttttaatattttttcattcactttttaaatgtccattaaattaaattaaatttttttttaattcattttttgtaatacaaaattctttactatcaactatttctgatattctttatcttgtactattttaaaccaaatttgacccgtttaaagataaaaaatcaaaatttagttggacaacacggaaaatttatttaatttaaataattatttttgtttttttctgccattgatcacaaaaaaattgaaaaaacactgcgatgcctctcccagctctgatcagtgttgatcagcttaatccgacacaaataaatcagcaaaagcagcagccaagcccaccatcatcaaccgtcactgttacaacactgtcagccaccggcaagtttacggaataaaattttcaaaattagacttttcgactttttggtatggctctcgaacttggataattgcctaatttgtttggccctcctccctttgccctgtgggattttagaccgagaattgagccgggagagtcgagaattggtcccggaggacagacggagacaaaaaaaaacacgagaatttcccggttcgagaatttaagtcgggaattggcccccgggaaccgagacaatacttcaaaaaccccgagaaatttctcgagttaagaacttcggccggggtaattgaccccgtgaagcgatatatttctcaaaaaccccgagaactttctcgactcgtgaatttcggcattggctccctggaaaagaattcataagtagggctaggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttgnggtaaaattgtctttttttgataaatcatttctataaattg

SEQ ID NO: 3203 - DNA, 4823 bp, Heterodera glycines
aatgcagcatggacggtaaaaaacgaaaaaaattgccaaaaaataattggcgtaaaacaaaacgccaacacacgcaaaaacaaagtatatgcacttacactggtaaatgccttttttgtattttttattttgatcagccataacacgcttcattcccaacaaaaatgaacaaatttggtatctaaaaaaagattttgaaaaggagaatctttttctaagtgaatgctaagcaatttgacatctcagaaaaaagttgtgggagtttcaaattttcattatgttagaactcaagtcctaaactactgttttcaccaaaaatgctaaaatttattctttttttatttattctatatgtccaaagtgatcttgtagcctataaaccaaaattgttagaatttgagagtttcatgttttttatgtgttagagacatgaaaatagtacgccaaagcgagagaaaaagaaatgcaaaattttcatcacactataacttaagcaccgagcgtaaaaaattaaaaatcgagcgttaaaaaagttcgtaatttttttctctatcgatatgcaaaatttggagtggatttaacgtgcaggaaaaaagttaaacgtcacgaagtaaatgttgttctttacattattaagaatgaagagatagtacgtaaaagtgagagaaataaagataaaaagtaaatgtgacagaacgccaattttttcccataattattagggcccggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggttaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttaggggtgtatttttcaattttcttgtatttttattgcaatttttctcaaaaatgccaaaatatgtgcaaaatatgtgccaaaccccaaaatatgtgctaacatattttatgtgccaaaacgccaaaatatgtgtttttatgtttttataagtcgctctaaaccaaaaattgttcggagaaaatgctatttttgggcttctctcgccataactaagccgcaaaaaaaatatgttaaaacataaaaatcctagccctattcataagacttggcgcacatttcactactaattattttttgcgtcgtagatgatccgtccagcagcagctccaccaccggcagtctgtcgctgcgctcggtgccgtcgtcggccacggcgcataagcagccgcccccgctaatccgcttcgtccactccctgtacaccaagtgggcatgctttatcgtcaagaacgcgtgggccgtcatcctggtctgcacagtggtgaccacactgtgcaccgtcaaagtggcactcacaccgtaagcgcgcaaaagtgcacacgataaatttggcatactgtaatggctgtaaaattcggtaaatggcactcacatcgtaagcgcgcaaagtgcacatgggaatttggcgtactgtaatggctttcaaattcggtccaattaatatggcactcgcaccatattcgtacgctgacccacaaaatgtccagcccacgaaatgtccaagtctcgaatttgagttttttattattcagatgggcctaaggttaggcaaggggtaatatgaaggttatattcgtattcagcgaccccgaaaaccctaaaaatcctaaattagactcattttgtttttataaattttgaaaaattttggacatttcgtgggtttttactcttttggacatttcgtggcttggacactttgtgggggtgcctattcgtacactaaaatttggcgtactgtatcaaaatcaaagtgttaccgtaacactcatttaaaaatagtgaatgttttgtcttttgtttccgcatttttagcagggagttccggggcgaaaaaaaaagtcgggatattttcgggacaaaaaatttatcgggatcgggacctggattcacatccggaaggccaaaatttttcaaatcagacctcacactaaaagacttagtaatgtaccaaaccgtaattagtctcggtaattacaccctaattgaacacaactaattttgcagacagaaaaacgatatcaccggctatacgccgtacggggcacggtcaaggcatgaattggcaattcaggtaaacagaaatattccattcaaattttgatcagtacacaaaactcattaggaatattgctcgtctcgctttctcgcccttttttggcttctcgttctcgcttttctcgcattttatttttttgtccattctgatcaaaataatttccaaaatgaatgagtgttcatgatcaaatttgatcagaaatgttgtgatcaaatatttcatccgaacaaaaaatgaattttctttttgtataaattttgacaaaacattttttcaaaattgtttttcaaaaaacaaaaaacaattcagatactgtttttataataaacaaaattattttaagataaaaacaaattaaaaataataatttttagataaaaaataatttttctttattttataaaaatatttttaaaactattattttttttataaattttgaaaggaaattttttggcattttgcataaaaattcaataaaaaatatgccgaaaaggggacataattgggaacactgacactccgatcaacaacatttggccaattgtaaccaattttgccacttttcaaaggagcattttttcaacgcccaaggccttggccatccgttcggcgtgttcgttttgctgttgccgcgccgtgccgacgacaattttttgcgcccccaaatgctcgcggaagcggcacgcgttgacgagttggtcagcacgcggtttccgctgttcaaccaccggacaaatcggacagaaaattttgcccaattttgccgcgatttttgccaactcaatgaaccaatgcgacgatttgcggtcagagaaattaaaattataaaattaaatttaaaaattaaaatttttttcatttaaatttaaagctaattaggtaatttattttttaaattaaaatccgatgacaattcatgtaaaatttagaaaatttttaaatatatttattcgtttaaaatttaaaatgaatttattgcaattttcaactttttaattataaaataatttaaaaatctatttatagaaattaaacaataatttatagttagtttgataaattaagcatttctattttttaaaatttaattctctgtttaaatttaaaaagaatttattgcaatttatagcgtttaattaaataaaataattaaaaattgataattaatctatttttaatttttattagccaaatattcagtgaaaatttttatacaatatattttttttcattttttaggaagagaaaaaatttttttaagttcaatgatttttgccgacaattaattatttaatttaaaatcattttccacattttaggaaggctttcaattgcaatgggatatgttggttgccaatgagacattgaacgatgccattcatctcaactatccaatcagcagcattttgggccaaaaattcaacatccaagtcggtgacaggcatattggcaccagggatgtttcgggaatgtgtcaaaaatctccacatttttgagtcccgcatcccggacagaaaaatttggaacggcatcccggcctgagtccaaatctcgaatgctgaatcgcgacattttttcgggcccggtatcccggccagaaaatttgggtcatccctataagaatcttggatgccgaatcccgacattttcggataatcttaaatgccgatccgaaaatttttggatttttggaccaccgacacgaatcaccttctcgaacatctcgtattggtctccctctctacctatatacattggcattttgttgccataaaataaaatgtatgccaaatttgcagccaaatttcttcggcatccaatttcgtactgccgccactcccgcaacaacagcaacagcaaattcaacaacaagcagtaccagccacacaacaacagcactcggcagcggcggcggtttgtccatctccaacatgcgccgcgtggaaatggtggtgctcacttataaggcggaacgcatcggcgcgtggacagacgacgaaatcaaggagtgggagatgagcgtgtcacacttcttcgaacagtaattatatcaattaatttattattattgttcggggaaaggggcgggcatggtcaatggggcagggcacaagagtgcgattgataaagccgtaaatggccaactcgccgggattcgtggcgattaattgatcgggaacaaagactgtataaaggccgagaaaattgccgacattttaccctgggtctaaagcggggttgccatgtttggtcgacaaaaagccgggtcgggtttcgagatgcgaaaaagtcgagtcgggaaaaaagccgagttttgaagatggcgatttttgtttggggtgaaaaatgtggtctaatgacgtcaattttatccaggccataatttagaggccgtaatttagatgccccataatttatctcg

SEQ ID NO: 3204 - DNA, 4283 bp, Heterodera glycines
ctgtactttaacactactaatgctcatgcatgatttttaccaaattttatttttaattaataatatatggcttatggtccaatcatatctttcctttcaatgaaagtttacgcgcgacttaatgttaatatttgatttacagcaaatgtggctaaacttaatctcaattctaatgctcctttgggattatatctaattttaaaaatcttgaatctattttaactattcttaaaccaaaaaatagcgcgtggacaagattgcgccacctttattgggaaaagaggacagataatggaaaaacacaacgccatttggcttcagccagagttttctggtgtttatgctatttaaaattaaactttaaatttttggaattgttttttgataccaacccctcagattctttaattcatttttacgccaatttgtaatgtatagagtaataataaatatgttggaaacgatgtgatagtgttcattccgttggaattgcaaatgtcaaaaccgatttaatagatttttggatttcttaaaatattataattcaaaaaggtttacgacattcaatttccgaagttttaatttaacttcattcctttagattttctgtttagtcgtgttcagtttctgtttcctcccagaaagtttccttaaatcattttttattccaattaataatataatttaatattgtattctcaagcacatgcttctttttcttgactgtttaaagcctgcgcattgcattcacctgaatttatcttttacattgtatcatctaaatagctcatttaaatcccagtttttcctcaatatggagagccactaaaaatgatttctgatcaaatactctcatatcttcattcattatctgattagaaaatataccgtcttgaattagaattcaccttgtggcaattttaaaagaaattgcagcttcttatatttcttactcaatgaaattatgcgatttaatatataacctttaacttgcagcgaatgtggtcaaagttcagcttttaatttcactgatgcgtctttatatattaattttcttaaaaacactgcataccttttaccattcttagaccaaaattagcgcgtggccagtaatttcagcgcatttcaatggccaaaatgagaaacgacgcaaaaaacaacaacgcctttggcttcagccagagctcatttatgagctgctcctttttatgctgcctgacaaagtttggagtgttagacgcttgctgagaataagcgcgatattttatcggttaatcgccggctctaaaaatgttgaaaattggcgaaagccatataaggtcctaggccagtgtttaatggtaatcagtattataatattgtggtgttttttaatttttaagcaagatgatcaattattttacaaaaatccagtgaaaaataattttaactaatttaaatttaagagcatgttttattttatttttacaaggctaattgtgaattgatcgtagaatccttaaatgcctaattggtttcatttttccaagacctaaatttccgacctaaaaatcgaaactataaatattacgaaactaggatttttggcagcatattcacaaaacttaaaaaatataaaaatatttattttagtacaccaacattaattcggaattgattatttagttaaaattcgtttttttttgcctttcaggcgcgcgagtccgaatactcatacaaggttctcaagccgctggataagtttccggtacttatgcgtcgcttttcgagcgaaggccttccgtttactaccattgacccatacaccgcaaatttgtactttaaattggacgaaacttccgagggcccgggatcgccaaatcgtttgctgaaatttcaagtgttggtgctcttggctaagagcagtatccccgataaggcgcgtcacgtaattataattttattcaattcactcctgaaattcgaaaaattggttcttataaaataatatatataagatttcatttaatcaaaatcctaaaaaagattcattttgttaaaaacccactaacaatttttactaaaaaatttaaaatttaccaaaagacaaaattttttcaaaatttcgagttcaaaattcttcaaaatttctttatcaatttatcactatttatttttaatcacgttgttttccctttttagaaagtgcttctctgtcagcggcttaactccaaaggtgccaagtcggtgatgcttgaggactacggcgtcgatcatttcagagccgtttctgatccagcaaatgtgggtggggtttggccaaagcattgcttggttttcatccttttcagagatttaatttttaggttcgacgattccttttctttttgatttaaaattctttttcatatgttcttttttcaggaacatcccaatccttttctttttttttcttaattacttcaattttggatttaatttcgtcaaattggctttactgtttgtatacaatttttctgttgattttagacgaattttttttatcacacaaattcttttttgactacattttgattcaaccctcggtttaactcctgagatggggttttgtctttattttaattattaatattattaatttttgtccttttaggaatatgtgatgatcgaagttggttttgtccgcaattttgccgatccaccgttctatgaactcggagctgtgtgtgcgactatgaagaatctattgggctttttgacttcttacgtggatagcaaatttccctgccctttgaaatagggcaatgaacagacaaaatggcaaaaaaatgtcaattttttatttaattcgacaatttcatttttcaaaatttaaattaccattccagtggttttcaaatttttcattatgagtatcattgcttttgtggagagaaatcatttgttgttttgaataattgaattttgagagacataaataattcgtcgtattttagaaaataaaaaaatttgagctcaaattgctcgaatcgttattttttataactttatctttaatatttaaatatgtaaaaaatatggattaatgtgagaatgacaaaatgacgaatgagtcaaaaaaaattaacaaaaagagcaagtcacgaaaacagaaattaattttatcttatatttattgccctttatccaattatccatcctgtttgagtatatggcattacttaattccccatccattggttttatgataaaatagtaataataacgtttccatgtaggcggtccagtaggaatcaaaaaagaaaaaattaggaatttaatatgaaatggcaaattaatgaaagacgggcttgcttttacatggaaaatttagatgggaaacctacttaatcactcgtggcaagcagccaaaaaaaggaatttctcctatctttacattgccatcctaagattgcacttttttgctttcccttttagttaatatttattactttgccctttttaatatataatttttttcgattttttcgcggcaacgaatatatttctacacaattttatcaaaaaaaaatcctcaaggtgtcttaaagtctacactctctcttatacattgaccaacgggacttccccaaaaaaagatatcgcgtcaaaaaaaaatcaattttgcatacaagattttgctaaattttacaagaaaaaaagaatttcttttttatgatgcattcaaatttattgggtaattctattgagtcacatttattcctttcaatgaaaaacttctttgatttcttttttcattaaatgattagataattaatcgtttttaaaatttatacaaaaaataatctccatccgaatttgtggtgccttcttttccaatttcccacaaatagagacttaaccgttcacttagttttgcaaggctatttactcaaatcgatttctctggtgccctttagccccattctactccatttttcatatttaaattgtgtttgctatgcctttacttaattcactcctccattagcgtttttattgatataattggtagtgatgttcgagaccgaaaatttcccgagactcgagaccgagaccgagacttgaccccgagacccgaccccgagacccgagaccgagactgaaaaccccgagaccgagacccaaaaaacccgagactcgagacttttttcaaaaaattttcctattcgcttaaaaatcgtttaaaaattttttttgactctattcttaactaatttttggttttttttattttgattcaatttgataccatatttatcatt

SEQ ID NO: 3205 - DNA, 2328 bp, Heterodera glycines
  misc_feature (79)..(79): n is a, c, g, or t
  misc_feature (108)..(108): n is a, c, g, or t
  misc_feature (149)..(149): n is a, c, g, or t
aaaatgtgaaaattgcgaaagccatataaggtcctagccagtgttaatggtaatcagtattataatattgtggtgtttntaatttttaagcaagatgatcaattattntacaaaaatccagtgaaaaataattttaactaatttaaatntaacagcatgttttattttatttttacaaggctaattgtgaattgatcgtagaatccttaaatgcctaattggtttcatttttccaagacctaaatttccgacctaaaaattgaaactataaatattacgaaacttggatttttggcagcatattcacaaaacttaaaaaatataaaaatatttattttagtacaccttcaccattaattcggaattgattatttagttaaaattcgtttttttttgcctttcaggcgcgcgagtccgaatactcatacaaggttctcaagccgctggataagtttccggtacttatgcgtcgcttttcgagcgaaggccttccgtttactaccattgacccatacattgccaattcttacttcaaattggacgaaacttccgagggcccgggatcgccaaatcgtttgctgaaatttcaagtgttggtgctcttggataagagcagtatccccgataaggcgcgtcacgtaattataattttattcaattcactcctgaaattcgaaaaattggttcttataaaataatatatataagatttcatttaatcaaaatcctaaaaaagattcattttgttaaaaacccactaacaatttttactaaaaaatttaaaatttaccaaaagactcaaaattttttcaaaatttcgagttcaaaattcttcaaaatttctttatcaatttatcactatttatttttaatcacgttgttttccctttttagaaagtgcttctctgtcagcggcttaactccaaaggtgccaagtcggtgatgcttgaggactacggcgtcgatcatttcagagccgtttctgatccagcaaatgtgggtggggtttggccaaagcattgcttggttttcatccttttcagagatttaatttttaggttcgacgattccttttctttttgatttaaaattctttttcatatgttcttttttcaggaacatcccaatccttttcttttttttcttaattacttcaattttggatttaatttcgtcaaattggctttactgtttgtatacaatttttctgttgattttagacgaattttttttatcacacaaattcttttttgactacattttgattcaaccctcggtttaactcctgagatggggttttgtctttattttaattattaatattattaatttttgtccttttaggaatatgtgatgatcgaagttggttttgtccgcaattttgccgatccaccgttctatgaactcggagctgtgtgtgcgactatgaagaatctattgggctttttgacttcttatgtggatagcaaatttccctgccctttgaaatagggcaatgaacagacaaaatggcaaaaaaatgtcaattttttatttaattcgacaatttcatttttcaaaatttaaattaccattccagtggttttcaaatttttcattatgagtatcattgcttttgttgagagaaatcatttgttgttttgaataattgaattttgagagacataaataattcgtcgtattttagaaaataaaaaaatttgagctcaaattgctcgaatcgttattttttataactttatctttaatatttaaatatgtaaaaaatatggattaatgtgagaatgacaaaattgccctttatccaattatccaaatttggcttacaaattagcaagattttgttcaggtttttctgtgctctcaaatttgagattaaaatagtgaatatacatatttgaaccacccgaaaatggggtataattggttcctgccgatgccatttccgtattaaagaatattttcgtaatgagtgatatcattagaaaggctctaggaaaatcggacactggaaaatccgacaccggaaaatccgacactggaaaatccgacacaagcagaaaatccgacactagcggaaattccgacactggaatttcgaaactaatttactaattttaaaaagcatttttgattgtttgagttagaattaaaatacatataatacatataagttacaatacttaattttttaaaataaatatttttattgtcataaaatctatctaaagtatacatatgatattcatatttatttgtatgcccttttttgaccatctcaaaaaatttataaacaatcccgcaaatggaatcataggaaagggcata

SEQ ID NO: 3206 - DNA, 2465 bp, Heterodera glycines
acccacgggtgactttcggtgccaatgatttccaccaggggctgttgcatgaacagaaaatactaggtcgttgcataaaaaagggcgcttttttagaaaaaaaattttataaataaaatatcaaaaataacaatcataacaactgtaaatacaatatcactcaacaaaatagtttccctggaccctaacaacctttctccaacgagaaggaagtttcctaatgccgcgacggaaaaaatctgtgccgatctttgaggtcaggtactgccccaccgcctcctcgacctcggcgtcttcagtgaagcgcctaccccgtaaaaagtttttgagagaaagaaaaaggtggtaatccgagggggctaggtcagggctataaggcgggtggggcaacaaattccaattcaatgtctgggaaatgtactgggtattggccctgctggcgccggatgcggtaagcgatatccaccgcccgcagttggtttatgtatctattactgtccaaaatagtgccaggtgccagcagttcccagtacagtgggccatgtactgaccaaaagatacacaacatgcgctttttttggtgcaggttgagtcgggggaccaaaattgggtcttcctccttctttctccaaacaattttctgtgctgtgccatcgtaacagatgtagctttcgtcgcatgtcaccagccggttcagcacataacctctccggtgccttgcgatgttcgaaagacacaggtttagccgccgctgtttctgctgatcagtcggacggtgtgccacccatttgctcctcatcggccgacgaccagatttccgaagccagcgccatgttgttgttttatggcaatgtcccaccgacaattctgcgcaggaactttccgggtgtcgttgcgtttggtgctgtttctccccgcccggaattgttggaaccatttttgcgcttgacgaggagagatcacatccgcgccgagaaattcattcacttttcgcgccgcaggcgccgctttttcgccttttttaaattgctggtgtaatagcttatgtgcaaaggttccaattcttcttatttctatgaaatccccatattttcaagttttgaaatttttataatttcacttgaacctggaaaatgatcagaatgatcaatgacattgtcatccaaatcgagatgacaaataaattcaattcaactttttgtgcctttcaacattcccgctcgcttcatctgcacaattttgtacagggtgaagccattaatgagcgaagttgaaaagaacacaaaagtgttgaaggaggcggtgagcaaattggtgtcaatctgacaattaaaaacaatttttaaatttgattttaaattcaattttccatttgattggccccatttcttacaaaacaaagtttataggcggtaatgatcggaatggatcccttcgatgggtccgctttatcaagtggggccaattggacaacagtgatcaagcgatgcgcagaaaacgcaaaagaaacgacaaaagcaaatgcaattactggcttacaagcacgacgccaaaactaaaaaaaatgaaattaaatcacaaattaatacataccgtaatcccaataaaatagctttggtccataaaccgtactgctttttgtcggaccggcacctaaacgcttgagaatcggttgagtgcgatggcaatgtgcagcatgtaaagtgcgtagttgaacaagtagatcagaaatgtgccgacgttgtaaaatgccgacggcgaagtgccaaaccatgaggaagtggggccaaaaatgggcagccaatagtacacaacgtcgatgatgtaatggccaatttcctttattaatataaaaaatgtataatatttttaattttagttttaccaaaatgccaattacgctcaaaaagcggaagaatggcgaagaaaactccttttttgtgagcagtacaaaaatgatgcgcaaatacagcggaattgagacgatttcataaatggaatagccgacaaaggaaagagttgaaatcatttttgggaaaagtcagcttaatacattaattcgtgaaccaattaaatgtggctaatttcttattcaaaagaccttaaaatttatcgataaaatagtgacattatgccataaaatttcaaaattataagtatatttaagaaatcagaataatttctaccccaaaatcagaacattcttataaataagaacaaatggaagccctggtttaaaggccagcttggactctctattattggcgctaacgaaatcagatgattaaagtgaaaaaaggaagatttacgagcatttaaaaagaaaaaatggtttttttttgggttaaaataaaatttggtcattacccgatcggggtccccgacccccgacaattgagctcctccccgccccgaccccgacatgtcgccccctgaggtccccggcccccgactttttacccccc

SEQ ID NO: 3207 - DNA, 2363 bp, Heterodera glycines
  misc_feature (2274)..(2274): n is a, c, g, or t
  misc_feature (2301)..(2301): n is a, c, g, or t
  misc_feature (2333)..(2333): n is a, c, g, or t
tataaaagaaaaaggtaaatatgcgttggtatcctccatattatatgaatatatattttggtttttttgaaatttttaattaattttagattagttctaacaaaaataatttgaattggttctgaaagattcatgaccaaatagtaaaacgtaaattgcctaatttgcgaccaaaaaaattcagaattttggctacaaaaacctaaaaaattcgatattcagagctaccttcttgtcagcacatagctaaaaaatctttaattttaatttggattcttggatttattttatttttaggcgaaaaacttaccaaaaccaaagacgatgacaattcatggtcatcctcgtcattgtattcttcgtcctcatcaccttcagcctctaaatcaagcagttcagaggcaatggaagagacgaaaaaagaaaaatcgaaaacaaaaaggaaaaagaaaaatgggagaaaaaggaaacataaacagaagaccaaaaaagaaagtgcagtggagaaaaaggaaaaacggggaaataatgatgatgatgatgatggttctgctgccagcagtggttcgtcaagttcaagcagtagttcatctgctgactcggacgaattggatgacaaaaagaaaaacaaacaattggccaaggtgaaagaggagcagaaacaggggtcaaaaggaaaaaacaaagcaaaaaggaagcaaaagaaaggagagaaaaaagggaaaaaggattacgaagataaaggtgaagaggaagaaagccattcatcaagcagtagcagtagcagcagcagtgaagagccaaaaagagaggaaaagaaaaagcgccgaaagagaaagaggagtcattgaggcaaaaaaagaggtacaaatttaaatagattaacggtgctttatactttataacgaccaatacatatataaaattagttctttagaaccaattaaggggacgcccactcataaaatgtcattaatttgtctaatttctaactccgaccaccggattatagcaaattgaattttcttttccattaatgtgactcataaaccaaaattttctgggtcagaatattcgaaatgttgaaaaataaggtcaaacctgtgaattgtgaatgccattatttgaacaaaataactaattttacaaaaagctggaatttttatttaaaaattgcttcaaatatgttcttttaccattttatcaaaaaaattattagaaatttttgaaaaaaacattcacatattttggatgtcagttaaatgtttaattgtaacgcaatagggagacaatttttgaatttttgagcgatatttatttttaatatttttatttaaatgtaaattagtaaatttaagggatatgtctcggctttcaaattagtgaacattaaatagaatgacgacatacagcaacgattattcacaccaatagatgctttgtgcaattctgcttatcattctgctttttaatttattatttaaattggctgttggtgtgatcgatgctttctttgtttttctattttattatttatcataaatttcttaacatttatgtgaattattttgaattgaaattgtagagaaggctattttagtcagaaaacatgttgaaaagtcatataagatgcaaaaacatcaaaaaagcatttattaatttcttgggtaggggtaggaaaaaatcaaaatccgaagtttttatgtttcaattgtagaaatttttttttaaatattctaatttttttatcatgaaatgaggtaaattgaaaaacaaaattataatatattagagaatacctagagctaccttctaatagtaattaatttgattaagcttaaacgaagttaatgatttattatttagcaattaaaagtataattaaatttaattatagcgaacattgatacttttgtcacttcgcccacatgatagatacttttgtcaatgttaccttttacttactttaataatttttaaaaaatcataatgaaaatattacgcatatgttttttttaattttataataaaatagagagagagagagagcaaaagaaagagagagagagaaaggaaactggtaagaaagaaaaaaagaaagcggagaaagtgaggagagggagagagacagagcgtgttaaagagggagagagaaagagagaagagagagagagagaaatggagaaatgaaaatttatttgccaaaatatgcaacgtttattttaaaagaaatttttgatgtggtgaatatttctacattgtatttatctttcnaatgctttcatttttcttgccatgcgnaatgcaaaatttctaaatgtacaatattttanactttattttgtatttattagaaattcatt

SEQ ID NO: 3208 - DNA, 2733 bp, Heterodera glycines
attttcatgatcacttttgtgatattctcaatatttcaatttcttatatccaaatgtattctgtataagttttcagtaggaaattgtaatttgggggttattggcgatttcaaatggatcctcccggaacactgattctgtttatatttagatcgtaatgatctgaaaatgtcagaattcaaaaagtgcgattgcgaaaatagtaaatttgaggttattggcgcttatcaacatgatctgtctgcaacacttaatcagtttatatttaaatcataattagcagaatgtgaaattctctcatttgttaccaaaagaggatttttttctcttccacaaaaaattagttccttctcatataaaaatggagctgcacctttgcacattaaaattcaaagtccaacagctggagaaaaagtaaaacataaaattagaatttcaataattaggggtaattaaaattgcctaaggtattcgttggctatttcactgcggccgacggagcaattcgttgtgtcgccgtcaaattagtcaacagaacagaagcggcttcatctctttttaagaattcgatcagattgatggataaaatctacgaaaaatttgagaaagagcagaggaaacatttagtcgaaataattgacacgtaagaaaatttaattaattaaaataataatttctttcttaaaattttattttttcagtggctatacaacaccctatatggagggcattgtgataatggaattgggcgacgagtcactccgccaacgattgaaaagcggcagacacccggcactcggcgcaaatgaccgtgacttaatgagtgccgtagaaaaattggctcagccacttgtcgagtttcatgaaagtccggcattaatttgaacatttggttgcccaggactttcccaggggaaatcccggtcctagtttttcaaaattaaactatttaattataagacaggcgcagtgtgtgataatcaaaaagatttttgtccgtaattctgtccgggtccttcgggaatacgagccgggttgtctcaaaatgttgagctattaaagttattatgattcttgtgattgatttgatgcgcctcagttgcaattcacatggatgtgaacccgcgaaactatttgtacgtgtcggagaatggaaatttgttactgaaattgatcgattttgagggctctcaattgctccggaataaattggataaaaatgaatgtgttccaatcggtgagcatgctttcaccccagagtacacggggccagaatattacggcgagcatggcagagaggtgggcgcaaggatggggaacgtggtagaaaagtcgggaaaaggttgtgccaatccgagagagggcaaatgccatggccgagtgggaagggccaagggcaaaacatgcaaaaacaaagattatcgttacgactaacggcagctcagcaatactcctctttaatgctgttttaactgtcagatttcgactaaatttgacatttggtcagtgggaataattgtcttcgaaattctgcttggtcatttacgtgccgaacaagggaaggggccgatggaagaggtgaaaatggaaatgatcaagttcacaatttttaagtgaaaatggaaatgatcaagttcacaatttttaagtgaaaatggaaatgatcaagttcacaatttttaaacatatgtaggatgaacaaaaatcaatgctttttgcaattggcaatttattcctcggatttacgcgaaacaatctattcagaagtccgggggaattcaaaaatatgccaattgactattcgaaaagggaatggtttgaacagaacaccaatgcaatggagacggtgctgcaactttggcagaaatttccaaagacggcactgctggttacggtaatggcaagggaaatattgtagtggtgcttttgtgccgaggacaaaacaatgatggcattttcatgaattaaaggcagagcgattatttatagtgaaaacgaaccaatatgtattatatgaaattaattttagaatatgttaaatgtcgacagaaagacgcgtttaacagccaaagggattttaaattatattaaaggatcatgccaaattggagagttcagagaagtcaaaagttccaaagatttgcgaatttttaattcagtgaagttcggcgaatttttaaataaactgcgaattatcaaactaaagaataaagcgaaatgtttgattgaaaagtatagggaattgaatggaacatacaaaaaaataaagataatggtaaagaaagtgatcgaagagcaacaaatggaaatcgaagaaaagaaaaacccggaaaaactcgacgattgcgaaacgaattgatcggcggaaaagcgaagcacccttcaaaatttatctaaaggatttatttgaatgacgtgattacaagccattttagtgtacggaagaaaaaatgttcctttttccctttggtgatatgtcaaaattttctcactgatcccctaaactttttttaaaaaaaatcgtttttttagtaaatcttactctagaacattgtttaagtaattttcttaaaattggtaaattggtgtaaaaaaaatttagaaaaatttttgttcagttgctaggtcgaactttaaaaaatatcaatgataagaatattttaattattatattattttatttgcagaataataaatcataacttagctcaaacttagtcaaattaatgaaac

SEQ ID NO: 3209 - DNA, 2107 bp, Heterodera glycines
  misc_feature (20)..(20): n is a, c, g, or t
agggtgtcttatttgtgcanctgtttttatggtagcacaaatcttaattattccatcatttttaaatttatcttaacgtttacctctgcaactttgccccaattgctgttagtcgcaacgatttttggcaaaactgcacaaatattaggatccaaaaagccgcacatctgattaaagttggttgttgttgcccataaagctgccgaaattttttgtgaaatgccgctagacccgaagaagctaatgtagaaatgtaaggactttcttgattgcttgcatcaatccacgaattttccaatttcaccatttccacaagcactttacgcaatgtgcaagcactttgtcagacgtcaattaattttttgtccagttccgattcctttgtctgcagagtttcaatcacttttctgccaattgttctctcatttggcaaaagatcagctgagagtactgatcgcttttgcagatgccgttcaatactaaaacttttcccttatactcattcaaaaccggttacattaattcggcataagcatccatgaaatgcttgaatccttcgcccttgataattgaaaagggacgtccatcagcaacacaaaattcaaccaatgctaattccattttgtcatatttgtcatttgtgccaaattttatcccatgccaattttccaaatgtctcctcaaatccaaaaatatttaaattaaagtctttaatataccgcaaattatgaaacccggcataattaaatgtaacaggtttcgcaggtggcacgcaggatttgcatattacataattagtcaaatttccatttccatccaaaataatatcgtagtattgacggaagattcgactttcagcccactctcgccgttgtctgggactttgaagatcaatccctgcaataatttcgcattttttcgactttggacgtggctcgccgtcatcataggcaatgttatccaaccaaaattcatcaatttcgtattcatcggaatgactcgccataaattctaaattattatgttaacaaggcaaatccgtagaaaaattaagagaggaaaagcaacaagaagaagcattctcgaagaaatcgctgtaaacgatcgaaatgattgtcaacggacggagagacggctgtaggcgatcggaaaataggagattagtcaatgtttcaattgaaagacaacaaattgattgacaacataattttttgctttcatatttatttttatttccttcaattccttttatagctaatgagatatactaaataatggaattcatttttaaatttttaaaaattacgttgatatttaagttgatggcgtaatgtttgttgatttaaataaatatcaacattgaggttgattctccgcaaaaaaaatatttctaagtgaaaaatgttgatttgccattctctactcgcaaatgcctgcgtcaaaatgccaaacttagccttcaaaagtattttctttggattatgccttttagtgcttcgtctgtgccgttcccattgagtgccaaaacggatgcttttgccgtctcaaacagttctttgtcatagaatgtctctttttcgtcgtttttcggtgattgccattgaaaatatcatcgtatagctatgacccagggaaacgatgcgagaaccgagaaatgaccccgggaaacgatacgagaaccgagaaatgaccccgggaaacgatacgagaaccgagaaatgaccccgggaaacgatacgagaaccgagaaatgaccccgggaaacgatacgagaaccgagaaatgaccccgggaaacgatacgagaaccgagaaatgaccccgggaaacgatacgagaaccgagaaatgaccccgggaaacgatacgagaaccgagaaatgaccccgggaaacgatacgagaaccgagaaatgaccccgggaaatgatacgagaaccgagaaatgacccagggaaacgatacgagaaccgagaccccaaaaaacccgagaaatttctcgacttgggaatcgagaaccgagaaatcttaaagaattaatttaaatgtattttttaaagatcataaacacataaaaaaggggtagctcaaacggaatttttgcgtagga

SEQ ID NO: 3210 - DNA, 2765 bp, Heterodera glycines
tgcccaatgcagaagaggcagtcaaccgcttgactttaagtctttgacgcctcccgacactttaattgttgcctcatcagtttcttcactagtcgcttttggccattgttgcccaaaagcatttgatgccaaattggcaaaaagaatggtcagtacaagaaaggaatgcattgattaattaatttttattcaatttattaattgatattattttagtgtgaaaatgtctaaaaagttaatcgcttttaaacaaaaattttgttgcgcttaggagaaccaaagtttgttgaaatttgaacaaaaaatttgtttagctgatctttctttagccaaccattcaattgatgccaatttatatcgattaaaattatttaaaatttatgttaaaaaatttttatgcacttgacagttgactaaactaaacttttgtttcgagttgacggaaacccaaaaaatttgaacaaaatttgtttagctgaactatttatcatttggccaatttctaatgttaatttggccaagagaaattttcatcaattaaatttgtttgcttctcattattgggctcagacgccatcattagtttggtcgttttcattaaatttaattgactttttgaatgatcactcgggtaataaaagctaaacagataaaattaaaaaattctatccataattataagctaaaagaaagcgtgctgagtcaaaaaacagaaaagtgcaagcactcacaattgtataaattgaaatttaataaaggaattattttaaaataaaaataagaaaatttgaaaagttggaaaagttattgtgctttattcaattttgagcaaagtaaaaaaaattataaacaaaattaaacgaaaattgaaaacaatacattagaacggaaagtgccaaatttgaattcatattcttttttcagacttctttttctttagcattttggcaatataattttcattttttgttgatgagttttaaataaaataaataatattcaattacgctgttttcatccttaatgacccaattaaaatatttaaatataaagcccttaatcttttatttcatcaattcttacagttgtaaagaattatatagtccagcagaatagaaatagttaaaagtggaatggataattcgttaaaaatatacattccgaaatttgttaaaatttctatgctttcggtagcatttttacacttttaaaatctttttattttaaatccttatttgatgcccaagcatcccaatgcccaaatttactgctggtggcgcaagctcgccacctcataacttttaatttaatatgtagattagttattttaaaattaataaaatcaatctaaaataataatttatgaaattgaaatcattcaatataaagttggaataaatattcatataaaatggctaatatttgcaacattttgggcaatctgtacgttcatattgttcaaatttcctccccaatatggtcacattgccaattctttgtcatcaaatacacaatgccaagatacaattcatgtaaagacaaatgagtatggctgcaaataaatttctcgttttcgcacatatttaaatattttgagatttttagaattaattgaaatttttaatgaaaatgcaaaaatgacatttttgaaaaggtacctcctaaaaatctaaaatcgatttaagaaaaatagatactaaaattaactaataaaccaaaacatcatttgtccatatttacacattttggcggtcatgtttaatgtctgtatattgcgatttttcttacataaacttacgggtcggggtcgttttcgcgtgggccgctatcctatgaaaagtcgatactcaatgaaatttagcccggataaagcggtgtacaaatacagaaaatggccatgctgatgaagcagtttaaaaaaggacaaagtgccaaaaggtaattaacggagccacgaaattccctaataattataattaaagggggggggggggggcctattttaaaaaatactttgtcctaattgttacgtaaatgatacaaaaattgaaaatgattccaaatgtggcgatggttgcccataaaagtacacagccaattagagaacagctgggatttatgtctttgaatgtcaaatgaaactaaaaattgctaatttgaaaattgtttattttaattgaaatttttaccgaattgttattaatgccgtccataattttggcaaaattagaaaaaataattttgttaaaaactgaaatatttaaaaaattaattatactgtaagtggccactaaattttcatgataataaaacaatctaaaagctatcgtatgataccccaagattattttttaggttatgtttaagaaaagatatgacggatttttcacgaaaattctgtaaattggcagttttacgaaacgccaatgttggcagtttttacggaacgacccagcacgaatccatattatggagggtttaggaaattttaaaaaatacacctcaaacaatattaaaaattgagcttagaaaaaaggcaagaaaaaatgttcaaaaacgacccaaaaggttagaaaaacgtgtccggttctcattggtttttatgttaaaaaagagtatcaaaatcttatttaaatcctttaaatcgcttatttaaagctgttaatgaaataatagtttaattttttttcttgcaaaaaatatttattaatattatatatgttttaatgaattccgactttctaacttaaatttaacaacgacaa

SEQ ID NO: 3211 - DNA, 3079 bp, Heterodera glycines
tttttcagcctggttttaagaacttttgaattttgccgagttcataaatttttaaggcagggccgcgacgggatatcgtaaggaaggagttagctagacgttaaagcaattaaggcggcggttgataagaggcgtatttgcctcggaaggcaatggccatgatgccaaaagactggatttccaccccaagacttaacattttgccaattttttattaaacgaatgaaatacataaaattaaaaaatttctttgttttggggtaatttaattctgcgccacaaatgtcattttgactgggcgccgcaagtgtctgcgccgcaaaagttgttttgactgggcgccgcaaatgtaacaccgcaagtgtcagcgtcgcaaatgtcgcatcacccagatggactattaaaatgcaagcgtgtctttggtcaattaaactgaattaaataaataattgtctcgaaatttaaatccactgattggttcaaattgattttgaaatgctaaaaaatagcatttagttaggctatcacataaatataaaattatgtacacatgttgaattaaagattattcttactaaattttaaaaaattgcaacgtcgacattgaagcttttttgaagtaattcatttattgttcggatttctcttttttcatatttatttaaaagatttttaattatattgtcattgataaaagagtcaaaggaagaagcacggcttccaccagtaatgtaatcgtaaatccgatttttaaaaagaaatatgaataaaataaataatatacaatatacggcttttgatggtccatgcatttccattaatatgaataataaaaaatataaatctagcgaataatttttttttagatgacgtaacatttacataaatccaataattgattacatttaatgtccatattgtataaaaaatatttctttttaaaaatgatttattattttatataggttttattttattggcacgattgtttttttaattttattggcacgattgttttttctaaattaatacggtaacaataagatttgatggttttttatataacgccctttttgagggttttttatataacgcccaattttgatgaaatgtcttacaatttgattgatttgagggttttttatataacgccctttttgagggtttttatataacgacatagcaccttaaaatgccatttaaagaataagaagcataatatatgtatgtagttatacataaaagtgccatcaaatgtattgagagtggaaaatgggtaaatatttaagaaaggagagaattggtgtgcttttgaaaggatgttcatctactgcggtcggtcagaggcgagtgaaaattgtggtgaagtgaatgagcgaatggcaatgagtcacaatgccttttttctctccccctccctcgttaatcccttcattttctctctctaaccatccgcttcactccactctttaaccatttctggtgtctctctatttttgtctcctcttattccttcacactatttccttctctttctgctacccctttattcttttataacttgtctttctcttctctatcttttcctttgccccctgatagaccttttctctctctctctctctcgccactcccctttctctctctgttgcccattttctctctctctctctcttatcttctcatgttctccgctcttctctatcagccactctcactctctttttctctccctccctttccatctttttttaaaaatcattaatgtttaattattaacattttgaattctgcatttccacgacaaaaatctaattttaaatatttttttctttatttaagaaaaaattactttttttactaaataattttcaataatttgcaaattatttaatttgtttttattgtacaaaataaaaacaatgaaaaatagcagataaaaatacaaatgccatagtcatttttagacaacaattctgctcattgacggcgtaaaagaaaaagaatggacgaggggggggggaatttttcacccaagtaaatttgggttttgtaaaataaaatttttcaacgaatttctaatttttcaaaaaataagaaattgtgttgtctttttggtattgatgaaaaacgaatggaaaagaacagcagagagaggtagaagaagataaacagtggggaggggtcgccggtgaagaggaaaatttctaaaaaatttagctaaatcaaatcattaaaaacccaaattccttccccgttgcgcctacttttaaaaaattggctcaaaatttcaaaagtttggttcattttaggataatctgttacaaatcgtattaaaaactgtaacatttctccttttggcatatacttaaaatgagaggtttcaaactgaaaatttttacattatacaaatttttccaaaaattggaaaaagaaaggccttccgtaaaaacagcgaaaaacaacaaaatatccaattttagtgatattttttattttgtttttttttttcgtcgtcgtcataattcggccaactgttcgttcagctgctcaatgtcacgctccaactcgccccgtcgtgccaatttgtccaactgcgtctgttccggcttggccaactcgccgctatcaattttttgctgaaacaaaaaaatgaataaaatatggataaattttattgaaaggagaaagccccaaaatttaaaatgcgtttttctgtgatttttcaagtgcgtaaatccgccatcttcaggtattgctgaagcattttttgaatttatacaaaatttctcaacaaatgaaacaattaaatgactcgttaaataaaatatccgcatgcatttctctctccatattaaataattaaacgaaaatttacctaggcccaagcaagcctatgctaatgaaaaatttggagcatttttgttgaattgtattaatttttctcaacaaattactagcatttgcaggattttctccaggtaaaatcttagaggggtcagaggggtggtggttcgtcatgacagcgaatcaaactgttaaatttgcaattttctgccgttcgacccccccccccccc

SEQ ID NO: 3212 - DNA, 2940 bp, Heterodera glycines
  misc_feature (40)..(40): n is a, c, g, or t
  misc_feature (45)..(45): n is a, c, g, or t
acaaatggatttgggttggactcgttaaaagtgccttcanccgcnccttttaccctttgctgcggttgtttctgttgctgtttcgatggcatttgctcttgctttgtcggcgtgcctttgaccattgccaccgggtcccagcccaacggcactttggcgccactgtcctcggcgccgccgctgcgctggcgcagctccgcctgcgcccggcactcgaagcgcggctgctcgtcctgcggcacgtagccggccttcacccggcgcggtttgcgccaactgcctcaaatttgatggaatttaaaaaacttttttttaattccgaaaattcatcgacacgacagccccatcctggtgtggttgtggcactatgcctctccccatgcacgaaaactcggaaagtccctggaaaacactacatctataaaaaatttggcaaaattcgttagccagaggggaaagattataaaaaatgatttttcaaatttttttggatttgagttttctgtaagttgacaaattttctaaaaattaaggtgaaattatgcgtccgacggctttgacccgacgaaagaattctccatttttccccaaatgtggagggtttctcgctacttacaattctaaaattagaaaaaagcaaaacaatttggaaatttaccatcagcccgttgtgtggcggcaatgaaagtttcacctgaaaaaccaaaatacaaatttttacagccaaaaaaccactgtcctaaaatttgaaaaatttactactacccccccccccagacttagttagcctcacccaaattttccaaaaatttcgctaaatttttcaaaaaatccacaattgtcgcgtgtatgaaaatgaaattggctcaaaaaggcgtaaatgccacattaataaatccatgcatttatttttgataattttttaaaatttgggtgcccataaagaggaaacgcgcaaataatagccaaccattttttgttttcgtacatttcgatgcctacccgaaacagttttcacgcgcacatcgcccccatttggggtggtctcggtgccgtcaccaccgtgggacaacctccgctgttgttggggttgggaagttttcgacattttgttgctttttgggcgggacaatcaattgagacaaacaattaattaggcagctttaattaattagttaattaattatttggatttgatgaagttgctaaataggagaatttatgaaaaattaaataaaaataagaagatgaaaaatggtaaatcgaaaggcgacaaaccctattattgtttccatgaattatatacatgttttaatttattgagcaaatcgccagacaaaaaaaaaacttcagcaatacaaccgaatagaaaacggagcatacaaatgaatacccatccaaataatgagcatgattcagagaaaaaaaatataggtagttacggccaccggacaggcattttccatttttggcaggactcaaaagcacaaaaactcgggaagggagcgcctaaaggtctaggtttatttgttaaaacataatcatcaaaaatgagtggttttcaaccatttgtacggcctaattaagcacttttgtaattaaacacgctcaaaatcccccatttttgtaaagaatttgtcgggacattcaaaggacagccatgaaaaccctccgaaatgaaactgcgttttttgtccaacaaatttgaaaattgcaaactctatgttcattgcgcacacatggaaagggaaaattgcctttgggtgtgaaaaaggaaacaacacatacatacacaaccaaatcaatgaaaaagtgagaaaaaatcgaatcgaatcgtcgtaattatatcatttagttgagagaggggggggggggactgatcgatcaaaaaaaagtaaattgttcgtccgaggacaccagcatccatcatcgtcggtcagatcagagcctgccggtttgctgcaaatggtggtaacaacggagcaggtaatgcgtgtcgcatcgcgcatagtcaaccatttgcttgctgaggggcctgtgaaaatttgtgggaaattttttcatcgaaaatttatagaaaaaattgaattattgtagcgagaaaaatttttcctcggactaagaaattgttgccaaaattcaatgtgttttgttgaaaccaacaaaattaaacttttttttgggcgacttttaaactcacacacccccaccccctcacgtgaaaattttatacgaaaaatcagtaattcttgaaaaatagagccgcccctttcccctgaataaaagcctctcttgaagaaatttaaaaataggttttttaaattttaattggttgcatcggttggaaaatttcgttccaacaaactagcggagcaactttcgccccgacaaatttatttaaaaaaatgaaattttcaaaatctcttagaattttttaaatcttaaattttttataaaatatttttttggttcattttcaaaatttcttataggattttttttaatcttataaaattatttttttgtttgtcgtaaattaaaaaaaaaattgcttagcaccgaccgtcgcgtccaatcggcggtggacaacgatttgtccagccaaacgccgcacgcctcgtagaccaacgagcgcaggttgagccgacagccgccgctggtgtccaccaatggcacggcatgggaaatgccgagctgaccgaggaagcttctctcctgagcaccatggcacacctaaaaaggacaaaatgccaaaaaaaaaaatttgaataggctaaatccaaagaaaaaagttcgcaaaaaatgtgtccccaccttttttatgcgtttgtcggcaaaaacagtggccaaaattgggtgaaaattgtcgcgcacttctttcaccaaaacgtccaccaaaatgtcagtgtcttcggtggaaatttgactctagaggtcccc

SEQ ID NO: 3213 - DNA, 1944 bp, Heterodera glycines
ggaaaatccaacaaaaaatttgttagaaaattggccgccagaaattgcaaaacagattttccacaaaaaaattataccaaatttatggttggtctaaatttaggagaaaaatggaaaatgttccaaaaatgggggcccatttttggcaattttttaaaaatcattcgttgtcaactcactcaaaatcgaacgcaaattcgtcgacgctgcacaatttcttggcaagccaaagaaggcccacggtgctgacaatttggaacaatttggtccgcaaaagggacaaatgaatgggcagagggtcctgaaaaatggcaaaattgtaaatgagacagcgggggacaaagaaaacaaaaagttttgataagaaaaattattaaaaaaatttaaaagagtaaaaaaggattttgtagggaaaggggcggaaagacggagaaaacttttcaggatgggaagccatagttttgtagcagatttccatcaaaaaattggtatttttgtggggttgaaaaaattaagctatttttttttttgaaaatttgggtaagggtagaaatttcaaaaaaagtaatgtccagaaatactttccgagcatttggtttataatcttttaaattcagaatcattgctttccaaattggacagtctatttttttaaataacaaattatttcaagaaaaaaaattgaaaactacaaaattagggaaaattttgagaggcatgacaaagggtgtaacttttttggggggaggggactcggaataaacgaaagaaaaaatggccaaaaaacgaaccgggaccaccgtgtgcagttgctgggccctttccgtggcacgcgccttgcgccgttgggcccgctttttgaatttgctgtttggcacgccgttccatcgcaacgccgaggagggcgcgaacggagaaaaagcggccgtttttgatgccatcgacccagtcccgttggttgctgcttcctcctccaatttgtccatcagtttgtcctacaaatgcacacacattaaaaaatttggaattgccttaaatattttgctgggccttcaattttaattagaactgagcggaaccgggaattttcgagttgaaaaaccgggaattttggctgggaaaaccgggaaataacggggctagtcccggtcccggtcaaaaacgggacttcggtactcagttgtacgttttttcagtaccagtcccgctcagctctaattttaatcatgtaaaaacgggttaaattataatttcaaaaaaaaaaaaaaaattagacactccattaaacagaagtacgtatatcaggcacaaatgaattttaacaaaacgaaaaacctagaatttagaacttatttattttgtaaaaattttggtataatttttttacagatttcgccacgaacagaaaaaaaaaaatctttttttcgcaattaccaattgcatgtggtggcgctcgttgactttgaaaaaatcggtggccggccgaacagtggaatcttttgcaaaaacattgggcaatccctgggcatgggcgagtcggttcagcctgaaaaatatgccaaaataaaattgccatatgccacacatataaatagagcaattagcattgaaattgcattttgggagggtagtggaatcaattaaaaattggtcaaatatgccaagcctgtagccaggaaaaaaaaattcggagggaggaacccgaaaaaaacgaatttgggagggtataaaaaacagcgatttatttctgtttccgagaccctccattctcaatccactatcaaatcctatgttcccccatttttaaattccatgcacaattcaaaaatgaacggaaaatttattcaaaaaacggtgccagcatttgagaaaatcctgcaagaatgccgatcttggatttgatgactggacaatcgggcactcctccttcccatctcctcacaa

SEQ ID NO: 3214 - DNA, 3495 bp, Heterodera glycines
  misc_feature (101)..(101): n is a, c, g, or t
  misc_feature (103)..(103): n is a, c, g, or t
  misc_feature (109)..(109): n is a, c, g, or t
ttttgtatttgagaaaaagtgagaaacaatgtgatgacattaattgtttgtccatggttataagaaatggtgagaaacaaatattgcgaaaaaatcttatnancaattnaaaagattaaaattccaatttgaaagcggaaataaaaaacaaatcaaactgtgttgttgttctggggaaaacccctgttaattgcccaaagcatgttcaatagcataaaagataaaagcaacaatttgctccaaaatttcctcaaatgcatcgacgttaagtcagtcagttaatgtcttcgcgccagattaactcgcataaatacgagtccatcattttgcgatgatcgaccgcgctttgcttgctatttttttaaagaaataaatttttagcattcctgaaaaaaactgccatatttttgacactttctggcacttttttgtgtttttagaacttctttttgcccttattttgccatttcatgcttttttcgcccttatttcgcgatttttaaattttttcatgtaaaattcacaacttctttaacaaaaatgcattgaaaatttttttgacgtagcttttttggcgacttgtttaaatattcaaaattttttccactaaatttgtttttctttcttgaccaaatttggtttttgaaattttatttattttagaaaaatgtattcaaaaatttcgaatatatttaattatttgcaactgtaatcaatgaataaaatgtgtgccttaatttgataataaaacagtaattttaaaattatacccctaaatttggaactttttcgtgcttattttcgcacttatttcgcgattttttcgcccttatttaaggccttattttggactttttcacgcttaaaaatcccatcgctaatgatcatataatatcaaagttcactcacaaaggagtaggaaaacgaaaagcatcattcaaagcaacacaaaaaaagtcaccacctcttcagtaaaaaacctctttttctaaccaatttaaaaaggctaataccaaatgttcatgtatttttggggtaattaaaattttaattggccaaaaaaatgcgatgatacaaattgcaacagtgcgatttgagttttgtattcatcactgagaataaacatgaatatataaatgaagattaaaaagaacaccacggttaatttttgtgctaattttttcaaaattttccttattttaggctaaattacctatttctaaatggcaccgcccgtcaaaaaaaagaaaaaacattcccccgtcgctttgaggaaaatgtgagccgaattctttttttttgtcaattgctcaattaattttcccgcatttcagcttttgaccatgcccaacttggcctcaaattggcactgatttcgccacgtttcaatgcgctggtggacaaacatttcgatggcaaaagcgaattggcactttcgagtcactttacaattggcaggatgagaacgagagcaaaattgtttgttaagaagagcaatgccacaactgaaactgtgccatttcttttgcacgaccgtctccgatgcacaacaaaattcgctttaaggaccttcggattgagtaaatcaaacaatcaaagaattatcaatgggttccctttcaggcacattgatcattccgtcagcacatttcttcgttccaaccagcaaatttttgacaaaggcaccaatttggatttgcatgtgtctttatccaaagatgtccagctaatttggaatgcttttgcccgtgaaatttggcccatttttgcgccaaacattcgccatttgaattttatgtatggtcatgatcttcaaaatttgtgtcgccacactacgccgacaattctctccgagctcgacatcatttcgatccattcccatgatttgttgcccggtttgatcgctgatgatgggccaaatgcaactgcggcccaagcattgtccaaatggttgcatattccaacaaaagatggacggctcaaacaattgatttgcagtggtgctacgtcaaaactcaatgcattggtcaacaatttcaaggaggtgtgaccatattttcgtaaaatatttggattgattgccattggcttttcgtttccattgtttaggcatttccccgtgccaccacttcttcggccagctacaaaattcgacttgaaacttttgaatcaacggaaattggcccatttgaattgttgaacgaacggaccaacgaaaagctggtattggagaaagaagaaacaaattataaatattataatatcatcgatttgctgttgaagtgatgccaaattgggcggacggttcagtgggaggacaaaaagccggacaatttgaacaaaatcgctttcgatcttaatggagattgcattgggtgagtgacaaatcataaaatttttaaaaattctaggttttaaaatttttttttttaaaaattttcgggggaaacgaccttctccggagtgacccagtttttattgatatcttcacattcaaaattgcagtttatttaggcgattctctccaccaaagacggacaaaatgaaggcaaaaggtggtcgtatgaaaatgaatcccgggcctggtggacagcagaagaaaaaatgaacgaattattgggaaatgaaagataaatcgatcattatgaatggaaattgatctgaaaattgcatacctcacatttatttgttgcttttttgtttgaatatattttaattgtttggatttttgggacttttacacatcagaagtgattgggagttgggttagaaaaaatgagtaaaaaaaatgtgccggcgtgtccctttccatccccagaggataaacaatggattttgacataatttttcaaaacataacgaaaattttttgaagtcttattttatggtcgtgtaaactgcaatagagccattgccaaccagcagggttgggacgcggacagaaaatcccgcggtcgcggattcaatttgcaaatgattctttcggaaatttttccggtcaaaaaagctactttaactgctgggggccgttctaatagagtttttatggaaaaatgcaaaaatatggacataacgccaaaatatggccaaatatggaaatcatgattttcgaccccaaaattgatttgttggacttgatgttctgattatttttcgatggaagccctccctgttcttatatgcttttaatttggttagcagaaaattgtggaccgacatttaccgaccattatttctataatgaactgtctgaaaataattttttcgagaatttgatgctccaaagtagttttttatgtgatttttcggagttaagcagttaatgtaatgaaaatcgaaaaaatttatattgtttcaagtccacttagagtgctcaaattttagtcacttcattgcacccttaaggaaatgatctgatcaactatattttggtccgatatttggcctatttaagatctttttagttcatatttcgggcttttttagtcctatatt

SEQ ID NO: 3215 - DNA, 4293 bp, Heterodera glycines
taatataagaaatatcatgagaaatgtactttattatattttgagaaatgaaaaagaatatatgtaataaaatgatgaaaaccgagtaaaatagaccacctgaattccttgttcattgggtactttccatcgacagtgattgccgccaccaacggtttgtcgctttccttacggtccgcaaggccattttgttcaacttcctaaggaaaatttgtctgtgtgtacaaactcttattaataatgtaattagaaaacacctgagcgaattcctccttgtcgctgacggcaaagtgcactttgcgcttgtaatcctgcgcaactttgagcacacggtttcgccagtagttagaacccttcgggtccttcaagtagtccacggtgtagtaaacaacaaccaatggacgatgcgtaaattggaagagatttccttgggtccgaattccagccaacccattgctaaaaatatataatttgaatgcaatcacatttcgacaaaaaaacaacagtaattattttaacgtacgtttcgtagaggaggaagtttttgattttgtccgtgtcataattgccatcgtaatgaaattcgttcggttcgaatttgttgtgcaacttcttcgagacaaacaccacaatgtcgcttaagtgaaataataatttaatgataaagggaattaaagatgttaaaatcctactcggtgtatccggttttcttcagcaaatccgggttagaggaatgcgcaaagcggaaacggtcacgctcggtgtcggccactttatgaaaggagtccttcagcttgctttctccttcaaacagcccaataacgctaacgtcatcgccatccacaaatttgtcaaagtcactgatgcttttgagttctttcgagctgggtccggcttgtcctcgcatgtactgaatattttgaatttgttattattttaattcctccaagagacattgatcctatgcttaaacccgatttttcaaatcaaaacagcataggttaaaaacttatgaaatagagacaaaattatgagccataagcagtcaaaaatgcgatttacagagaaataccaaaataacgaaaaaataattgtgagtttgacagaatcttagcaattagctaaatgaagaattctttttgaaatactgttggaattttttgtcagaaattccgacttctctaatcttaggaatgcatttcttgtttttgttacaattcgacaaaaacaaaagttgtatgtaaaattaaaagtcgaaaattattattttcaccagcgacgttaaaaaaagaattgtcagccgttttttggatgcaattttttgtgacacccgaaaaatttttaaatcaattttaaacctaggtgcaaatgtcaagtaacaatccaaaaaatagactaagttttttttagtttttgttgaaagtgattttacaggacttttttttctttaattataaccccaattattagtttcaactgttaaaaaatgtaaatattaagcttggaatctttagtaaattaaatttcatgaattcgtgccgtggagcggcttctggatactttcaaaatccgatttgtttttcttatccaataaacattagtaaaaagtattgtaatcaaccagtttcgggcttaaaagtaacttgtgcattattaaattgtttcatattcactagaaaccaacgcttcgatcaatcgttgtagtaattggaatttttccagcatttcactaagcggaacaaagttatgttcttcaatccttgtgtattttatcgcaatgcgccataatttttatccaataaaattaggtattatatagtgttgaggtcctacttgcgagtcattgtttttatgttattgttattgcgcgcacagtcaaagcgaccttgcggcgcccagttagaatggattttcggtaccgatatttgtggagtcctcgcaattacggcgcagaattaaacgaccattttataacttgcatccgtggtatctataggcgccgcgagggaaaatccaatttttattgatttttgttaaacaaatttgtccaaaaattaaagatttttaagaaaataattttttcatcagaatatatatgctcaaaagcattacttttaatcttttaggcagatctttcagaaatctttttttttaatttttaaaagattgagttttacatgtttatggcagagacggtttttgtgtatgcaggagtttgctgacaaccagatgttcattcaactagatgcaattcttcaatcgaatgattaactatcacaacagataagccaacaactttatttttgagaaatttgaggaaggaaaaggacattagaattttcaccaggaatggtgaatataatttgtggagagtgatgaacttcacaaagatgcacacgaataactggtggaaaacagccgtttatgttataagcccaccattcggatgccgaattcggccaatttatgtgttcaaaaataacatgttgacttaagactagtagtcttaataatgtttttgttttatttatctttgttagtattttattttagttgaatttaatcacgaattctttcccctttggtagcaggtgtttggattaacatcctttctttattggtcacttcgttcgcaaaacattgaaacgtggcaaaaaaatgtttccaacataaccaaaaaaaagctcagctgacactcatagataaggcctagcacggagtacagaccatcccaagtccgggcctgctcgcgcgcagcctaccacgagtgttacttcctgatgcagaagtgtgtgtgcaaaagaagaaagaaagaagaatgagaaaataatgaaacggatagaccgtagaggagacgaaaaaaatagcaaacttctggtgacgaaaaaatagaacatatatatatataatccatccatccatttgatgagctgagtgaaaatggatgggagtaagttcatgtaacccattagagtttaaaacagtgagaaaatgattgataatatgttcgtatctgttgtaggtaaagatgatataatccattttacgaaattacaaaaggctcaattgcttaggtatggaccaacgagaaactatgcggttaaactttgaattttaactgcgctggcttgtccacttatgctcatatatcaggcaacgttcggattaatcgggttttcaaataactgtcgcagggattaagtcattaataaagaggaattaaaatattaacgaatttattgatttgttcatttttattattcttttggaggggggagggggggtggtaaagaaaaagcaatgtttcttgaggaataaacgcattacgatttcgtgatttaccttaacgattccttctgcatctcttggtccatcatattccgaagaaacatgccccttcctgaagattttcaatgttggaaaaccgctaactccaaatttatcgcaagtctctttttccgcagtacaatcgacctgaacttgtctaatccaattgatttataataccgttcacaaaacgaactttgatgagtggaattggtgggtcgttgttcttcagtttagtggccgctttttcgtattccggagcgagttttttgcaatgtccacacctaaaaagcattttttggggaaacagcacaggtaatattattcaaaatagaaaaatgcttcgctttcatttgaagggtaatcgataaatatgtgcaataaaaaagtgaggaatgaagtaaccaaccagggggcatagaattctgccaatgcgatgtcgtgctgctgcattcccgagtcaaagctagcatccgtgtattccaacacatcgctagaggagacagtggaaagaacctggctgagcaggaataaaatggagatcgataaaacactattcatctattcggtcctatgatggttgagaaattcttctaaaatgaataagaaaaacagtttgggtttctttttcgataaacttttaagtgaatcgattgccatttgcaataaaaaaaaattatggagacccccttctcttctcatcatctcgtgttaacggctttcctttcaacaaaaataaaatgaatgctttttggagaaagaagcgagcgtagaccgccgcgtcacagagtctgctgtcaattcccaattggctgttttgtccttctttctttttctattacagtaagaataaatgcggatttggcggaaatttaaaaaaaagaatggagaatgaacaaaaacaacagaaaaagcagagcttgagaaaattttttgaaaattcaatcaattaagaaaaacaaaatt

SEQ ID NO: 3216 - DNA, 1177 bp, Heterodera glycines
tatgattgtttgtcatttaaaaattgtagtctctaatttttgcttgaactttcagtcctgctaaaaatatgcaaataggtttcactgaatttaaaaatctgatttttgtgttctctccgtagtgtcagaattagttgaatttttgcaggaaaatagcctactataaggcctctctgcatgccaaatttcataggattttacacattcaagttaattctacgtatcaactcccacatcctagatgcatattggtttaactactctgttattcaaatattaataatttactgctttattacgcgtatttagctggttttgttctaaaaatgcaaagttcgaaaaatttgaattttcgaacttttgttcgaattcaggtccggggttcgaaattggtcgaaatagatgccggattcgtgatcagcggcccctaaacccctaggaaacatgctttcatgtcttttgaaaacaaaaaaaaactttttcaaaaaagggggggggtaccatcgacagtattacccaaaattttaaaacacggtaaatgaccgaacacatacctagttagtttttaatggattaggtggatatcgaatcttttttttcgtgactagaaaaccgagaaaaaagctcgggcattgatactgagagctcatagtccagaaattgcatgacaaatacaaataaatacagcattgaaaaattttttagctaaatattttgagaaaattttcgagcatttcacaattttacattcattttatccttttatccgtgacgcacccttagttccaacattttttcttgagaattttgtggatttttatgtgagcctttagcgctaccgaccttcaattattttaaatagccatcataggagttttgtagttaaaagttagatttttcaagtctaaggaacaggcattttttattttaatggcgacagagttatgttttaataaggattaaaaacaaatcccgagaaatgcataagaattggctacgacatgtgaggcgatcgatcccttttgcctgctggccatcttccattagaaacatcataaatttaaaaggaattaaaagaaagaaagttttcacactcctatttctctttcatttttcccttattttaatctttaatctctacgcctctcactctctctctctctctctctctctctta

SEQ ID NO: 3217 - DNA, 2186 bp, Heterodera glycines
cggcaatggtctagaattggtgtcccgacgaaaaaaaatgtttaaaatttcccaggtattttttctaggcttaaaaaatgagctggtcacgaatctgaactaagattttaaaaatcagtgacttttatctatgatttctcatccttccgtcatttccctcctagaggacagaatggtggagctgatcgaggggttcccctctctcgaagaaaagcaatggcattttactggtattaatgtggttaataagttcgaaaagattcatttgcctataaatgaatactaaaattaaggatacaaatccagaagagcaaaaaaagcattggtagaatcctgcgctttacttcaagtcccacaaaaaattaaatggaagttaaggtctggtctattgacagtttgagtgtgttgttgtcgtttgcatagcgatcgctgacctattaggatttcaacatcaattgttacgactattgttgatttgtgtcatcaaaaatatttacgcatttatttttgatcgtgcacgtaaactgggtctggggttcgaatccgcttggctgcggattattttttatgatgtttgatgaaaaatcatagataaaagtcaatgatttttaaaatctgagttcagattcctgatcagctcattttttaagcctagaaaaaatacctgggaaatttttaacattttttttcgtcgggacaccaattctagaccattgccgcaaaaccaatgctttgtctctgccgtttcagttgatgcaatccttccccggcttcaacagccccgaaattgttgaacagatccgcaacaacatgccgcagctcacttctctcgtaaatgacttaaagacaaacaagctcatttcgttgttccttcccctcagatgaccaacccgcaaatgctgcaggtgatgtccaatccccgcgtggtcgccgccctgcaacaaatccaacaggcatctcaggtccttcgacaggaggccccacaactttttaccaactttccgttcgtgttcccaacctcgtcactcttcattcattttatttttagtggggcggacatgttccaaaaccttggtggtatggccggccttttcgggggcatggctaacgctgcgagtcaggcacagcctccgacttccgccggtgcgactgaggcgggcccacagccgaggtagtctttttcaatttccaatactaacacttccatttccttctcaatccctttcatttcagtgcccctcctggtcaaaacattccgagtggttttgcggaattgcttggttctctgatgaatttaagcaccacagtgaatgtgaatgatttgtcttctaattgttttctaattgtgcttaattattttcagagcagtcagcccccggaggagagattccgtgcccaattggagcaactcactgcgatgggattcactgatcagcaggcgaatattcagggtaggatttgttgcaactttcaactgcttgtttattgaaataaaaattcggcattggttgtaaatttattgaaacaacgctagttaacagattattattgaaatttattttaaaaaacccaaaggggaatttagtttgcagaaaatgttttgtcttaaaaatcgaaaaaaaacatggaccccgtggaactttggcactacacaattctttattctttacattttcagctttgttggccagttttggcgacctttcgggtgccattgagcggctgctgggcggtggcgggcaagggaatgccgataccttttgagagtgacgaagtgctttgaatccattcctgaaagagagctcctccgacgtatttctcccgctgttttgttgtggtgtgataaatttgatcgttccttataattgccccccccccaaaataatggctaaatttcactgacaatgagtgtgtttttatctgcccacaactcgtcatatgttaatcgctttatacacaatgtatcggcttaggacgcgccgtcattaattccattgtttcggttgaaatgtcaattaaactattattaataaaggcatttattgatttcgcttaatgtgtttctatcgacttgtaaatttgttaggaatggaattaattattagcttttaaattcgatttgttgatatgattgatggatactttcctgctgtcttggggtcgcacttcaaaataaaaaaaaaatc

SEQ ID NO: 3218 - DNA, 1369 bp, Heterodera glycines
ctcccttctccgctgcttctgatgtccactttgtccccccgggcggcggctgttccctccccctttttcacttctgccaattcatccgctggaccggatgaatgaacgaacgaattgtggtggcccttttcaaagctctttttgccgtcggcaaaatgccaccgattgatcatttcccccggggggggggggggagtggacggcagtgattaattatttgatctaagccgggccttttgtttggccatagcgttcacttttggatgggtcgggtgggtgggtttaggaggggtatctgatgaaaggacaaaaagagttattatttgggttgggtcatttgtgtaaaggcgcggccaatgggcgaagggaagggacagccgacagaaaaacggacagacaaattcaaaaaacaaacaatcattataagtaggtaagtaatgatcggcagatcaattcgaattggccccattgatcggacggactttgaaatgattggccaatgatcggagggccaatagccgcgggctccgttctcgatatttattgactgattctttggatgccaaattatcctgtcgtaatgagtacagtaaaatgacgataaatttgctgcagcccttttttgtatcggtgtaattttggcggtcccctcccctttggcatttgtttgttttggcaggtgcatttattttaatattttcggttttttgtcggaaatagttgccgttttcttctctttgatttatatttctttctctttttcttcactttctttcttcccatttgcttcactgcttctctttgcgaccatttttgacggtcatttttctttttccacccttttctaccataattcactctttttcactatccactcttttttccattctattttcctcccctttcctcctcttcctcattcctcctcctttccgccttcttcctcttcctttccctctattgcccctccctcccccttttgccctcctccaattggtcccctcctctctcttctcttagtgttcgctgcttccgcgttcgtccacttccccccccccccctcccctccctcttcttcgtccgttgccaattgtcttatggccctacaccaaaacatcaaacaaatcgaatccaatttgacccctggggaaacaatttatgttgaggacatttggccttaattttcggagaaagcagcaaaaaattatgtaattgccatggacagcgatgggacaattggcgaacgaataaaacaacaaaaggccaaacaataggagcaattgacgccaaattcggcgaaagagcaaataaacagacaaaaatatttatcgtattttgtgatttatcccgttgttttaatttgcatttc

SEQ ID NO: 3219 - DNA, 1146 bp, Heterodera glycines
aaatgaatattaatcatttatttttgattaatttcgagttcatgaaatgatcatacttcgataagcttctgcttaattgtgctggcgaacaccaattggtcattcgtcccgacagtgacgcagaagaaacccggacggagcaccctcgccacggcactttccttttgcgaaagagggcgtaaaaacaaaacagtacaattaaactcaccgaatctccgtaagtggcactgagcatcagagttcgaggggggagagaaacggcactctgaaaagcaaaaatagccatgatttacagggccaaattgcatggcacaccttgtcaaattcgcgctgcattttgtgatgggtgagcatcaaatctttgattttcagcacagacttaaagaagatcgagtcaaagatcagcttgtccgcctcgtcgagcaccaaaaatcgcagtttgttgagtttgagctgtacagtaaggagaatttggcacattattggcaacggggaagtgaccacggagccaaggatgagagccatgccctaacagaaatggacgccctcccctcgaaagatttttttgaaaagtgggtatttttgaaaattttgtaatgtaatattacgcgttatttttcattagcccaattgaccaacaactattaacaaacattataattttgaaaattatttcttggaaattacactgggaaaaaattaaaaatcctcaaatgtcgccctccagtttttttctggtttacaggcctgattgtgagccaacaaatttataaaagaagacggaattcaatctcttgctggcaaaaaccgttttccagcaaaaaatcatagaacaatcgatttgcctttctttcatttgcaaattgcatcagccgcccaatggtggtgaccaacaagtcgcagccctgcgcaacatcggccaaagtgtcgggaattggaatttcgccgtaagtgatcaccactcggagagaagtgcctttgcgagaattggcaattacccggactctttaagtctctgctcattacctcgacaatacgtccgtgccgtgtcgcccaattgctgtgccaattcacgcgttggagaaatgatgaccgcctttcagaatcgacaattgtttaacacatgaaacgaatgttttacttcgg

SEQ ID NO: 3220 - DNA, 1541 bp, Heterodera glycines
ttaaaggcgataaagtggctgaaaaccattaggggcttttttcaagccgacctttgcatgagagaagcgttttcttcgggttttgctgtagaagatgagtgtgaagtggaatcttttaaaaaacgaattaatgcgcgcatttaccgtcgtaatattgaccaaaaattttaattaccattggtttgggtgtaaaataaatgctttaaacaaaaagtattaaacacaataaattaactattttgttttattattccctgacaattctctaataatcattttaacccacctttgaaaagcaattgccatttaatgcgcccaaatctgaataagtcgataatataataaatgacataacaaaaaaaatgtcacccccccccccacaattacaattcgtttttctttttttgcggaattgtgtggcattccgtatgaaatttaattccccgctgcccataaccagagggagagctattgcccccatccgaaacagaaatatagtttaaaaagaatctggcaaatcactcgcctggacccgactaaagcagcagcactgtctccaacaccgacactaattaaccctgcgaaatgccattggttaattgtcaacagagcggcactgccttttctgctcaacaatcggatgtccaacaaaatgggcaaattgagtccgatcagcaacagaatgggagttgtgatttgttggagtgattcttgacgaccgtcgatgaaaacaaagagccaatggtccaaattagaaaagggctgaacacgctgagaacggagcacctttacaaaggaaaaagaaatagttctaaattaaaatttgtttgcaatccatcagaatcgatggtcaatttatttcatcagagatcaaacccaaagttttggtatgaaaaaagaccaatttcgaaggggcctgcccatcaatagaaggagtacccggatatatcgggtcagattatttacgagtttttatgttttgttaattaaaatacctcgataataatgaaaatttggagcaccaaatgtacacaaagagccaacaatgatgggtcataaaagagcccagtggcggtgaccagtgaagcggtcaaatggaagaatttgcgatgagaagtcccaacagtggcgaaggacgaggaatgacgacgattgtgtacaataacacaaatgaacaaaagtgaggccaatgagcaaagtgaccaaaacagcaaaagacatgaccttaaaaatgagacgatattttaatgaaaattaaaaaaaaatttccataggggcaccgccgtacaattaaattttttaaccccaaattggctttatggtgcaaattgttaattaatcaggccaaaatttccctataggcttcggtggcctcttactttatgcaaaattttttaaaaagcggcaacattttcatggcaacactaccatttcttctgcttaaattttatgaaatgttaaatagaaagccgcataaaaacctaaaataagtgccatcaaaaaaacgtcgaaaaagcacagccggcaattccaggaaggca

SEQ ID NO: 3221 - DNA, 4243 bp, Heterodera glycines
  misc_feature (4196)..(4196): n is a, c, g, or t
attattattattagaggatttgttgacttttagttttgtttccctataaataagccattttaagaccaaaaatgagaaattcgaaatttgaattttcgactttttgctcgaatccggattcggggttctacataggtcgaaattaatatcagattcggattctccgacccttaaaacccctaatataatcttttctcgaaaaaactaaaaaatttgttttttgaaaaaagggggcctaccatcggtactattaccgacagcaaataaagcctatatggaaaaaataaaatgccaataaatcacattattgtcggaggtcatcttttcgatattgaaataaatggtcaccgtttgaaacgctttaccttgttactgatctaaaaatttgaaactttcatttacgtaaatcagagtataaatggggcggggattgtcaggtctttttttgttccaaggaatttttgcatatacgagtttagaaaaagtaaatttaaaaaatttcaataaatcattaaaattaaaaattttttggtttctgtgacaaaagttagacctttcaaggaatgagagttgaaccaatagggacgacacactaaaaccagaatgacgttttagacgataatcttcttcaaattttatatatcgatagcaaaaaattttcattaggtttcattttgaaaaatattaatctcgttggggacttaaacacgactccataactatgcacaattaaaaaaacaatttccgagcaatttttcccacccaattttacatagaaatcacgaaattaaagattgcggaatttttaaaaacataaattatattttcagaatcaaaatgcatctgacccaaaaattgcaaaaaatagccaaaccacttcagcctcgaaaggtgcaaaatagcaaatacctatatgatattgtattaattaacaattttcagtatccatttgtcgaacttgttcctttgatgggtaaaaatcatcttgacactgtctcagagagagttcgcggtatctctaataattcttttttacatacatataattttcaaaattcaggaatccatccatgtgttgaagaaagacataatttgtttgcatgtttgaaaaaatgggactacgacgacatgaaatgcacaaaattctccgattcattattcgtctgtttagctaattttgagagcatttaaaccattttacaagcttgattttggaatgtcataagtagggaacggatttttaagggcgaaaaattccaaaataaggccgtaaataagggcaaaaataaggtcgaaaaaattcaaaatttaggggtataatttttaaataactttttttaataaaaataatttaaaattgagacaaacaattttattcattgactaagttgcaaataatataaatttcaaaattttcgggggtaaagggtcgatttaagggcgaacacccaaaataagatttctaaggtcgaataagggcgttaaaacgcaaaattttcgaacaaaaatatgtttttcgtgcttttctcgtcgagttaaaaccgcagaaaaaataaggaaaaacttaaaaatccgtttcctagtcataaggcttagaacaattgacattaagtaccagcagaattttcggttaatactagagctggagtattgttgtaacgctggaaagttaaaaaccccaagtggcatgtagaataacaaaagtcatttctcaagctgattgtgagctttccggcatccatttccgaaccccgggcccgaattcgaataaaattcaaaaattctaattttacgaatttctcatttttgttaaaaataatttacataattagtttttattgaagtattaataagttccattttatttccgggtattagagccggttttgaaccaaaaatttgaaaaagactactaatcttttacaatttagagttgtatggaatcaaacaaaaaaattgtcgctgcacacaatgagcaaagaattaagggagagcagcccttgcacatcgtcgatgaagttagtcgaatactcgcatctgttgaactctggaattaaattaatgcgacagtaaatccgtatttatattgtatagattttaaggattgacagtttaacagttaaattgttgggacctcgatttatgaaagttggcactatcgtttatgtggtccttaatttctgtataatttcttgaactaattcattccctgaatctaagggtagcagtgtgaaagcggaggcgtccaacatactccaagcagacattgaccggcttttccgcaaatggaaacagcccgaacttggcacggcgagtcctttgcttgtcttttctcacaatttgagtcccataactcgaatagtttagatccaaaccaaagttatgaagcgccgcggacacatgccgtactacgtggactacttccaccggaagaacatgaagggatggcgcgcctaagaaaaagactcaattgttttgtaaaaccttagttggatttcagctgaagcttttcaaatggcataaaattgatacaaaatcacaaaagtaaaaaaaaaaagaatcagtcaatcttcatcttgtcagtcataatacctttcgcgcaagagacagttgccagcaaatgtgtgccctcgggcatttttcaattgcatttgaatcacccaccgacactcaatgttcaccacgcacaaacaccaataaatatttgcgtcgctaatgccaaaatataaaaatttgaaatttttcttcgaaaaaagggcggtaccatcggtggtattactttgtcgtaattgcttctaatgatacatttcaccgacaaagagaacatatccaaaatttcagttttttttttgttacccaattgaagattattttaattcatcatcttaattcaccgtcaatttcttcacacatacataaatgtgtatttctctccaaaatagcctcaagccgaaaattagtctttataatgggcggagaatgaatgaattgatgagcatgacaaattgacaaacaccgaaaagaaacattaatccacagcagcaaaaatttggtatttaagcagtgcaaatgcctctccaactgctcattctttctcccaaagtccattcatttgccattttcactgcccttttttaactacaaatttccaaagcatcgaaacatttcagaaaacaagtaaatgtctaacaacaaaaacactctgtcgcttcaaaactccgaaacttcctcgtccgcttcttcttcctccccccgtccaacgtcgccgaacggaattatgaacgaatacgtcaagtgagttgggcatgaataaaacaaacattgcccattccaacggatgaatgaatgcctttcagaagtgccactgagcggatgatccatctgagtgtgttggaggtcggccgcgtgggcaacgacggcgttggcattgtgcaactgcacaacaccttcgacttcggcgcgtcggacgcgcggcggacctgcgcttgttgtgccgttctgtgtgcttccgggtgcgggtgcggccgtttgctggcggaaggcaagtgccatggcatcggaagatgggctaatgctttaatccatcaaccccaattttaagagaccatcttcaactacgcgaagaatggcatcggtgcaaagtttgggagcggaggccgaggatttgggcggagatttggtcgcaaatggcgcaagaatggaagggacggacgcctcgaaacgattcgcgaagggacgtacggaagagacacggcaatcgaacagaacggtgagagggcgggacacgggacggtgcagagaggcggcagaagacgaggagtgaccgtcagaagaaatgagatgcagcggcaggagcaatcgatcggccagagcgacttccatcttaaagcgatcagcggacaatgcgacttccaatggcaaccgatcggatgggacgacgtctttcagcgagaaatcgccagaggcaactcttttgtgacgtcatttggaagaattgacgaagaacgtgcagaaaaaccgcagcagtcggtccgtggaaggggaggaggacgcggacggagtgcaaacggcggacgggggagacgcggaaacggcgccgggcgcggatggtctcgcggagcatcgcgaaactttgaccaaggtggacggactgatcactaattagtgctaatccccccccccctccttcagaatgncagatcgatggtccaattgtggcaggcgtctcaagttcccagtcggg

SEQ ID NO: 3222 - DNA, 3060 bp, Heterodera glycines
aattcacatgcactgttccgttgccgtttgttttggtgcgtaattgatgctcaattctgaccccgccgtgtctattcggcctcagcccacaccacgcggagacaattttggcatcctgtgaaacagcagcagaagaattgggactttatttttgcgcttatttattggtcaaataactctaaagttcggttgcaattcgatgaaacgcgtccaaattgcgcttcggtcctgctcagtcacttccaactcccaacaattgtcttgtcgaagagtgccaatcattagacgattgttggacaccctaattgaagaaagaagaaaagaaagcatttttgttggcccttcctttccttaattaatacatcggaatgcaaaagatgtctctgccccaataagtgaaatggacgtgtccgggagcctcaacctttgaaagagggacaaataacagaatgacaattagggagagggggagcaacagaagtgatgctcgagagtctcaaatcagtcggtactcgagtatcaatgagccgcaccaacttcgagtccaacgccgcggtttgggtaaacggaagtgccatcgtcaccggccaatcgtcccccttccaatccggcacaattcaccaccaaagtgaactgatctgagtcgatcaactaaaaagaaatcggggcaattcagctaaattattgcatcttttggcataacacctgctccaaagattcaattcgttggcgttggaaatgcaaaagcccttggccactttcggccaccaattggggcacggagccacggcacatacagccgaccctccgccgcgtagtggtgtaatgggcgccataacttaacaaaaggggccgatctcccggaaacaaaaggagaaagtcggatgcacagaccaatacggacggacgaaaagtgtgcgcaattcgcgctcactgagccacttccaattgtacacaatgtcggacattgaactttcctacacaattaattaattaattactcattatcaaaaataaataaataaaattcacttgcgcttcgatccattttctgtcattggattggcaatagcccgaaatgaggcgaactttgtcaaaacaaaggattagtcatgaaaattggtgcccattcaccgccagttttgtgggccaactcgtccttttcggttttcgcccaaaattcgaatgactctttggccaatcgctccgttcccggcacatcaacccgaaaaatgccttccggtccgtaactggtggtcttttcaaagtcccggtccgagaaaacagtgatctttatacgacgcatttaaatttaagagatgaagcggtagcacttgtcccattagcggggggagggcgcaaagcactctctcatcatttctctaactgtacatcctcttgttttcacacagtctttcgtcgcttcttcccccccccctcgcattaatgggataatatatctctatgaaactaattattgttatgttgtgcttattcaaaatcagtttgacccatacattggcattgggatgtgctcgacggatggccaacgcaacgctcgccccaacggcgccttcgcccacaacggcggctttcatcaaaggaaagtgagcaaaatgtcgccgaaataaataatgcacagaaattggagaattgaagcgtaaattcaacggaaagctgcagttataacgcataattatgattcacaatctcaagctggcaaaatacgctatgaaacctcgaaatatggccataaaataagaccaaaaacccaaaaaaactttggttaaattttccaaaaataggtattacaaaaaacattttgaagaaaactaatttattaattttttaaattgccaattttcgagagaaataaaataaataaaaccacggctccaacctgtcttataaacattcaagtaattaaaaaaaatgtattttatatgtgcacgcaacaaataggtgtgtaggtgcttctgttgcatgcgcgcgattcgcttgcccctccgccgctcgcttcgcccgccgtatatttggagggattgggtagacgagaaatgcattaggggggggggggggggggcggaatgtgtggtcggtcggcgtccgtctgtgccttgcgtttgcttctccctcccccttcggctgtcacttttctctgcgtttgtcgcttgctctctctctgcctttggttggtttggctgtctctgtcctcccgccactctcagcggcggttaatagccgtaagagtccctcccttcccccggcggtccgctgcttttgctgtggaaaggcaagaaagccccatccatcaattcttcactcatttgccaattctcctcccaaattccttggccatataaattcacccacaatcagcaacactttgtcaatttgagattggtggagtgatacagaaaagcatttaggaaaactgtcgataagtaagagaaaaaggagaaagagaaaacgactgcagcagcaagcagaactgctgacaaatgagggcggaaagaagaattttcgaataattaatcaaccaccaaaacaattgatcagtgatcactcacaactgaacaaatgcaacatcaccatcagttgaattcgctggtaaactcaatgaaaaacttcaaaaaaggaattcagccgggcaattgtagaataaaagtgagaaaaatggcaattctaaggatcaaaaaatcactctcaatgaacggttttaaccaaggcaaagactaagaggaaaaatacagtgaaattaagcgctaggcttcagaaagctaattcacaatttaaatagcatatcttgcggcatggatttctagcctttttcacttattttgtggttaggatttttatgtgctaaaaatcctgaaatatgtaataaaatatgtgctaaaaaatgctgaaatatgtgctaaaaacccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcga

SEQ ID NO: 3223 - DNA, 1984 bp, Heterodera glycines
tgcaggttttttaaaaaaatagaataataaaataaataaatcatttgttttttgaataaatgcccttccgctgacaaaacccacaaattgggcaaagattccattggttaacccaaaaatatttccagggctttttaaaacggctttttctttttgaacatttccaaagaatgccacacaaaaatattgtataataaatttccgtcaaaattgggcggaagaacgaatgtctggtgggaaaaaggaagtggagaaagcgaaggacggattttgctaaataattataataatccatgtaacaataaaataatttattattttgaaatggaaaaattcaattcccgaatttttttcggcttaatccctttcattttgcacttctacccttttttgtgagtccaaacaactgatcatttcccttagttgcttctttaatttttctcattcgtggattaagcacacttcttggtacatatcgatacaacaaacttcagttaatggcctcattaacggagaagaactcaatttctgtactttaatgaccttttaaatcatttttaaattgtttattaatatcttttttcgaaagttcatcgaccaacctaaaaaacctttcggaagtccatttggccaatgaacgaaatccttttgggaatcggattggcattttgtacgttttgaatgagaaggaagcgcatcggtagagaagtgggcgggggaggggaggagaagagtgatttttttcggaaatggactctccagtttcattgatgcacttattccatggaattatatctctgttttttcagatttattattatttttatttaaataatattcccaataatatttttatttgttattcattgataaagacacatatttttcaactcaaattcaaattttaaatgtgcgaatgattctttgaaagagagggcaaaaagcgttaataaaatatgaaagtgatgtgaattttttcaactgcgactttccctactgaaaaaatatttttgctctttttgagaattaatttctctttattttaaaaaattttttgatttttttcgccagacattcttcccgttgcgttttcataagtcattcataactttcgcacttttttgctttgttttgctggcattttttgcattatatttcttctttttcttcttcctaatttatgttctccccccgggggccattcattcgttcatcccccccccccctcttccattggcattggcatttcctctccccccccttggccaatccgtacggcaaacattggccattccacccatcccaatcctatcccatcccacgaccaccccataccttaagggcattcaaattgggctcatttttctgcctaattgagcagtgccgactttccggctccaaatttttttcacccgccccccggcgacgcctccattcattttgggttggcacgcaatctcttcccactgcgtaggaaaaaattcattcagttcattcgtccgtcggtggtgggaaaaaaatgttggccttttggtggggcggggaacggtgctattttgtaataagaataaaacaaaggcatttctgtggccataagccattatttcgcggagggagtgccgtcattttcgcacgaaattttaaggcacgcaaataaagcggaaaattacccctttaactttacagaaagtttattatttaaattttaattaagagaaaatgtctgttgaatttaactcgaatgatctccaattttgctaaaagcaaaatttaataaaaatttagctttagttaattgcctaattttaggcaaagccctaaaaagaaagtcgaagcgatttgccgacaaattaatttcattttttggtgatcaaaaatgaattaaagtcatttattgagaaaagagcatatttatgtagccaattgcaataaattggcgcctaatgtgcctttgtttggggacgccacgacggaagaggccaaa

SEQ ID NO: 3224 - DNA, 2659 bp, Heterodera glycines
  misc_feature (85)..(85): n is a, c, g, or t
gccattcaatgcttatgtaagtgtgtaaaacaataaaaaaagaaaactcaaattattataaattaattgaaaaaactatttgtcnccattttaagctaaatcccggctttgacaagcgatctttcgattccttcactggccccggcttcactgggctggacaagcgggccgctttcgacaccggcttcaccaattacgacaaacgcgcgttcgactcgttcactgggcctggcttcaccggacttgacaagcgatttgaaccgtttgatggtaaaaaggacaaccctttgattatatttgatttatgttttcttttttcaggctatggcttcaacggatttgagaagcgatcgttcgattcgttcatggggcccggcttcaccgggatggacaagaaaaagagggcgttcgattctttcacggggcccggctttacgggaatggacagaaaatgaacacaaaatggacggatggccaaattcaatcaaatcgttaaaatttgaaatttctatgtgaccccagctgttttctttgctgaattgcaccagttcgatattctcaatttatgcgccattaaaagtgcgatatttgtcaaattccccgaaacgatggaaaacgcaaagattgaaaagaaagttgaaaaccaattatgagaaaaatgcttgttatcactaattgtgcaattaattcgcctaattattgcacataaaaatggacgttattttcagcagattatgagaaaattcaaaatcaagctgaaaatcgcaaacaaaaaatgaaaaaatatatttctctaactatttaaatcccattaaattaaaatattaataacacaaaagcgaaattagcgcatttcgttatttcacgcttcttttgtcaatcattcgggcaaaatcggtccgcgagggcgtccgcttttcccagttgccgcaatgtttctttttttgcgcttttccgcttcatcttcttggcttatgctctgttttttgcgcttttccgcttcatcttcttggcttatgctccgttttttgcgcttttccgcttcatcttcttggcttatgctccgttttttgcgcttttccgcttcattttcttggcttatgctccgttttttgcgcttttccgcttcattttcttggcttgtgcttcgtttgttgcgcttttccgcttcatctttttgctgtcctcttttgttggaggcatcggaaaaagaaatgtgccggtattgagggggtggccaatttgggccaagattcagaacgggcggttcaaatgagttgttgccgaggattctttcatcgaagcgcttttggcggcctccgtttccattcttttcacctgctttttctgccgctctttcgtttgttttttccgcttttcccttcactttttctggcacaatgccaaacccttctcttttgcgttcactctcttccgcattatttttcgatttgtccaatgaattgccgaatatttctgtgaggaatcgcttctgtcgtttgctttttcccaaagtgccaattccgtcgttgttttttgcgtgccgtccttttccctttttttggcttttcgtcgacgttccttttttaattgttggcatcgaattgtctttgtttttgatctgttgccccggtgcctcttttgctccatggccttttccctgttgagacagtccatgtgatttctcacgctgtgaaggcgatcccgaagagtgatttggagacgaacgttggccaaggataagcgccgcaaaagcgaccagtaaaattgggccaagaaaatgggcacttcccattttttggttttctaaaataaaattttggtttttaaaataataaaatgatattttcctgtgggtgctttttcctttcatcgccttccttttataggcattttttgattcttttgactgtctaaacaaacacaatcatttcaaaagctttctctaatcaaaaagcttttcgaaatgtttgtttgcataaatttaaaatttaataactttttttaaaataaaataacactgaaaaaattcagtctcagacaatcgaaagttcttttttaaattttaataaaaatatcgctatttgaataaaattgtaattaaataaacattaattttatgtttatatttattatctctctttttattctctgaacaatcttttccttgtcatttttccaattatgtcttaattggctttgtggactcaattttcagttctcttaaggctaattaggaaaaaattatgagcaaatgaaaagacctcacagctcgcgatttgtcaactgagcaagcaaaagcaaattcaagtgaaaaattaaaatgaaaatgaaatggaaaatggaatcacaaaatatgggattagagaacgaatgtccatttgatttacattttttttcaaattctatgaagaaggggagctttatatcctttctatgttcaaatttttaattgataaacttataccaaaaaaatgtatcaatctcgacttgacagtcgagaacggaacaaaatgttctaacagaaccaaatattctaagttgcgctgtcccccattaccgtcccaaattttacccagctgcaccccatacggtaaatgcgtcagtgatacaaatatcaggaataaagttcttagctttaagtactatagtctaaaag

SEQ ID NO: 3225 - DNA, 5551 bp, Heterodera glycines
ccagattttttaaaaaaaagagcaattttggagatttgaattttttaaatttaggattttagtttcgcgatcgattatttcaataaaattcttatttcttccaatccaaataaataatttctctctgattacatcggtgctaggacaaagaggattttctaaaatttaccatagttataaaaaatttggacaatatttaatcaatgcgtagcaaatgcaaaattcatcaaaaccaccctataaatgaaagtgattcagcggcaggtgctccctcccaattgtcactgcccccagggtaagtaccaattttcttcacaatttcgatattttttcaaattaaatcattgtgcattttgtcatgtgtcatgtgtactcagctgcaaattaaaattgaaatttcttaataaatttgccaatgctttcattaaatatttaattcaacttccatttgggaaaaaattcaaggatggctcgacttctgttgcggctttttggcttggccttcgttttcgccgttttggcctttggcactgcgcagcccccgccgcccttccaagggagcggttcgttcagagaaggtgaagccatcaatttaaatatttaatttgttatttttggcattttaaggccaattcggcgcccctccgtttggtggctctccgccgtttggtggcaattcggcggacgtttcagtctcggcgagtgattcgtcggaatgcagcggaggaggaggaaatggagtgcaaggaggtgaaacaaatgcgcatttctactctataattcattaattcaggtgggcattacggtaatggcaatggttacggtaatggcaatggttatggcaatggcggctttggcggaggcggtgccgaaggtggccaagggatggacatcgatgtggatgttcagcagtcatccgaggaggggaaacgacgccgtaaaagacatagcggattcggacaattgatcgacaaaatcaaaaactttgttggcggcaaagaatcgatggagaggggtaagccaaattagcaaaggaacaattagtgaacgattaattgacccgggattattatacaatttgcaaaattgtaaggttagttaagtattttttaaaacttttattttttaaacatttttcatttttttcaaaataaagtcatttttgccccttattttttaagaaaatgataaaaatgggttccgtccaaaacgcaactataaccctttgatgatgggagcaatgggagcatcgcaatatggtcaaattgatcatcaattaattaacaaaaatacaaacatttgttcccaatttgcaggttcgatgtacggctcgccttatcagtcgaactcggcttatgggaataatcaacagtttggatatccgaacaatcagcaaaatcaatttgggtactctaatgaccagcaaaactcaaattatcaaatgcgctaccaacagcagcagggatttaacccccaattgttgcaacaaaattcgaatgatcccaacgatttttatcagcagcagcaacaatataattcgaatcagcaatatggtgcgaatttggcacaacagtacgacccgaatcagcagcagcaacaacagcggatgatgatggcaatgatgggacagcagcagcaacaacagccatttcagcaaatgatggcaccacagcaacagcagcaaaactatggaatgtattgaaacgaaagattgagaaaagaatgaatgagtcatcgaaatggaaaaaaggagaagcgattgaaattccttatttaaaagtgaatcattcactgatcggtagtacattaattaaacaagaggaatgttttatttgctgctaaaaaggcgcgatgagaagagcgaagagagaaaggaacgggggaaggcatgacatttgtgtcaccgtaattttctctgctaaaattggggaattcttgggcgggggagtctgtaagtctgtaattacgggtttagtcttttttttttaaagtagcaatttggggcgctcacacaacaaagtcaaatccgattgcgcggcacgcgccgcaatgattcctttcctcaaagagtttttgcgcttttccactcatttgtcagcccactttttgttttgaaaatgtatcatttgtaaagcaaaattaaaacccttatcagaaatttcgaaaatattaaaataaacaataaaattcgcaattaccaaaatgcattttcaatatcagcagaatttactcctcaatgagctcccatttgccagttgttcttcgaaaatctttgccaatttccgtggagggcaaaagcctttctccgaccaacgaccatcggccaatggcaaaagagagacacctgacgaagggggggggcgaaagcgacggacggcggtgattcgataaaccgatcatcattcacaaacaaacaattaggaacaaatctttcaataacaaatcttttagcccgatcaaagaaagcgaaatgatcaaaaaaagtgccgtcattccttcccttttgctatgcgccattttggtcgcccaatttattgagcaggtcaaaatcaaacgaataattaagagctaaatatccattaatcgattgcttccgtcgttgtcccctttaaggccaatgcttactgttgtaaagtgtccgattggccaattggccatccgccgaactgcaacatttttggctgcaactgcgactgtctccattgtgtgaacggttcgccaaatttggactgatcatgtccaaaatttgaatcgatgttattcagtgattgagaagggttgttgcattgcgcaaaagacggggctgaccgttggctgctcagaaacgcgcctcaaacgccacgcgctgccgcaacagccgaagcgggcggaggccaaagaggtgtttcagcaagcggacactgacggagacggggcactgagcatggacgaagcggtgggacgaaaatgaaaagcgatgattaggaaaaagaataattaagaaaaacggaaaatgattgggaaaaaggataattaagaaaaaggagatgatgggaaaaaaagaaacacagattattgactaaaagaaattaaaaaaatagatttatgtttttctaaaccacagcattttgattgttttcaggtcaactttttggtgtctaaatggaacatgacggaaggtgagctgaccaaccccgacaaacgccattggttcaccgaaattgacgtgaaccgaaacgaaaaattggagcccgaagagatagacgaagcaatgacaaagtgagagaaagaaggagaagaaaagcggacaaatgaaagaccaacggaataacaaaattagcaaacatttaaataataaaataaatatttccaattaattttttgccaattacgtaaattcatttgtgaaattgtccattgttgcattagaaacgattgggtgggcttaaaaagaaaagcaacgagaaaaataaatggaaaaacgaaaatgttttgtttaatttcgtgacaaattttaggcacgacggaaaaaaatgttagtcaattagtttaaaaaaatccttaatttgtgtgcagtgatagtataattaacaggccactcaaaaaacaaaggattgattcggcgatgccaaaaggccagccgataaaagtcgtggtcgaatttgttaagaaaaagaaattaaattaaatattctggacaggaagtataacccagactcacttcttaatgatgttcatgtgtctccgtattcccgacccaattagttcgggtcgggacttaattttttgaaaaacgggctggttcctgaacctaatccaaaatttgtgctgcatgaatttacttaattttagcgaccaaaatagctttggttcctgaaacttaattagaatttaataaaattatttttggaaacaatcagcagcttgtgtagtttggtatcattaatagaatttttttaaattagaaccattaatggcaattaaattagttttttgtttatttagatggaagaaattgaaaaaaccataagacttgaaccaaaaatgcagacattattaaataaattcagatataaaagttaaaaaattaacaaattttgtcagttcttaattcatttaatttctttaataaattcacttaattaaacattgaatattacgtggttggtcgatcgacgaaaaatgcaaatttgacgatcgacgaattttgctaaatttttgactaaatcaactcataactttacttagacgcaaccaaattgcacaatcttggtatcatacgatagcccttgaattgcgttattagcttgctagatttcaaaaaattttattaagtttttcaaaagttcaagccaaaaaatggaaacaaaatttgcacttttcgtcgatcgaaatagcaccgaaacattaactaacataaataatttaaaaaagaaaatgcaacaaattcttattttcactttgattacggtgatcatatttgaaattgttgaatcggcaaaaaacgagatcatgaagattaccgtaagactaactcaaaaaagcaaaatggactgtctcaaccgcaacaatatggaggaaatcttgatcaagaacaacatggtcaaggacgtcctgtgaatcacccacgccctcctctccctgtttgagatgtactggtgaaaccatggtctcatcctgaagttgatcatcctaacctttttccgccgccttttgagctagaaagaagcaaactgttcttgcatgcagctcacattttacgatcgggaaattttcatgttttgggttttcatctagtaatttgattcccgattaatttctggctttttgatatgtattgcttgattccaactttactttttttcactcaacattaaaattttgggaaatttattatcaatttttaaattttcaattgaatggttcgtgccaactctggtccaaaccagggatggcacggaattccgatttccggcttccgatttccgacatttttggggtcggaattccgatttccggcttccgacatttttggggtcggaattccgatttccgaaaaaattttggtcgccggaattccgatttccgaaatttttgatgaagtcggaaatttttaaaatttttttttcaaaaaattaataattttggtataatttctgttaataaattgaactgaaatttttaaaaatttcccggcgacgcctatcggcaccgccggactccaaaaatacttattttcttgaaaaaattttgtcattttttggacaaattctgttaacaaatcgcattaaaaattacaaaattttcccggcggcgcctcggcaccgccggactctcctccatgttcgcaaaaaatttttgaaaaaagcgcgccgtaaaaaacgtgtaaattagtcactccttttcccaaaaatgttctaaaataatccaaaatgacataaaaaaagattttgataaaataattgaataatttttcaagcgaatatactaaaaacatttgtgaaataccttttacttggttaagaattaaaaatttagcctattaaaatatttagaaaattttttgttatat

SEQ ID NO: 3226 - DNA, 1105 bp, Heterodera glycines
ccgaaaattttttgatccccggaattccgatttccgaaaaattttggggcctcggaatgccatccctggtccaaacagtctttattcttcgttgttattttcgcgttcagcaagtgataattcgctatcaattgtgaggcttttgtctatattccttgccgaattttcaatcgcttcagtgaccattcggtccaatcggtgaacatcgtaatccaacacgaattcgatttgctgtctccgcttgcacaactttgggtgttcgccttggcataattactttttacaaatgcatttaatctcctgttaatttatttttgaatgattaattaccgattaatccgttgtccattccgtaaagaacgcttgtccaatcgaccgcaatttgacctctgtttgggaattgtccatcattttgcctccgtttttccgctgcttacctcgtcaattccccgtgcaattccaccgacgcccttaacattttcgcctcccgaattattttcccctcggcgatggcaattcccacggcgatttcgtcgcaatacgcaaattggcgattgttcgcttccatccgcgcccttcccaaattggtcactgtggcgaagaattttgccaacggaacgtcgagggacaaatgcgcgtgaaagtcaatgccatgcttaaagtgagagggaaaagcatttacagcaggacggattgacctgtggaaattaaaaaaaaattgattaaaaaatactttcattgaaaattcatttttcattcttcccaatttaaaaattgagcttatgtctttgctaatcgaccaacttttcgatcgcttttggccataaatgtctcccaagggacaattgtgaccggacattgcatctccttgagcacaatgtgcgcagcttcggggtcacaattgaaattgcattcggccgtcgaataactttggacattgcccattcctaaaaacggaacaaatgaattttagatcatttaattgtgattagtcccaccgtaaacatttccaccgagaatgaccattcggtggggcaaactggcgaaagtcgggatcagtttcagtgcgagtgcgacatttgtcagtggaccgatgactctagag

SEQ ID NO: 3227 - DNA, 4075 bp, Heterodera glycines
  misc_feature (1566)..(1566): n is a, c, g, or t
tttttacatataacacgacaactatccttatatttttaatgtcttaaatttgttattttaaccaacgatttagcgataattactagggatggggatgtttagtgataaaaaatcccaaaataattaactaatagtgaccaaaaaatgccaaaatagttgcaaaatagtggcgaaaaagttccaaatttaggggtgtaattttttaaatagctatttttaatttgaaaataatttaaaattaaggaaaaagttttgttcactgattgcagttacaaaatattttcttagcaaatattgaacaagaaaaaaaaaatttgggggaagccccccccctcccggaccccctcccccctcctctgacgatcgctcccggctctcccacaggcacgggtttgtgcgcgaaaaacaggcggcgcgcgaaagcaggcggcaacatcaaagacccgcaccgcccccacaggctcacgcctgacgacggtgcgggtgggtaaactactcatttttccttaaaatttgctttttcattcaatggagcacgagaatgaaattgttattcccccattttgagaaatgataggtccttttttgaattcttaattgaaattgaatcagttttttgtgtgatgggcctgattgggaaggttttttttgataaatgtatcaattttaaattgaagaatctttattattgttttgatttaaattacttatctctatttttgtttaccacaataaaagttaatgcaaaatgtaacaaaaaaacaaatacaaaataattagcatgtgagattttgcataaaattgtgaactaaaatttaaaacaaaataaatatttctgtccgttcgagacataaatattcaatttctttaagaatttttaaaacataaaatcatcgccttgttatggaggccaacaacaagaaaaagattggaaagaagataaagaaactgaagagaagccaaattttcatactttcttaagccaaaaaagtgcaaaataggtgctaaaaattggaaactctaatgtctttatgcaaaaaaaaaatcccaaaagtgacaaaaaaattttatcaatttctcccgcacaaccgcaactttgtcaagaaaataaataataaattttggagacacatttttgcgaaaatttttaatttcttagagggtatattttctgaatttctggtcaatttttaaggttgtctttttctgaaatttttaggatcgattttaggggtgtatttttcgttcttattacaatttttatggaatttcttgaaaagaccaaaataggtggttaaaaaacaagcagtagcatcggcagatggcaacacgagatttttgtcgaattttcccgtatatcgtcactcaaagaaagtaacagaaaagaaggcagagagggaggagaggaaataaattaaataaataaatatgtgtcaaaatcaacgaaaatgggtaaaaaagtcagcgggcgatgaatcggaaattgccattctcagctaaaagtcgctgcagctcaactggggaaagggtgtagtgcagtgccaagtcgtccagtgaatgctcccncgtcacaaatgcgtggcaattctgacgaaagggaaaggatgaaaagaatgttttaaaacaaaagaaaaagaaaccgaaaataatgccaaatttagagggttttgcccaaaagccaccaaaattctcaaatatttaggctctctaccttaaaattttttgttgtctctcgttcagaaaaaccatgccatcccaaatattggaatttgttggcagaaattttgaaattcaaaggtaaattcaaaaaatgagttcggtggatctgttacactgtttaaactttaaaaagggcacccattttatacactttttaggtcatttcaaatgatttttgtaagtttaagactcaaatttaggaaatttaaaattcgaatttctaactttcttctgaacttagtttttttgacgaattttttttttattaagtaccttgaaacatgtttcgggggttttaagggtcgctgaccatgaatatgacatccgtttttactgaaaacaaaattttataaaaatttaaagttagaaaaatatttttccaaatttcaaaatggactaaaacacagtaaaggggtgggtaaactgtaacccaacttaaaaacattcgtaagctgcaatttttcttaaatatttaaaatttcatcgattcaacctcgaatttttgaatttctacctcaaaaaacgaatcggggtaaaaaaacgatcggggtaataaaaacgaattggggtaataaaaacgaattgggtcaaaaacgaatcggggtaaaaatgaattggccaaaaaacgattcttccctttaccagggcaaatatatatgacaaattcaaatttatttttaatgttttcttcagcaatatctatcgaaaattgtaaattttaataattcaaaatgatttcagaaattgctattgaactattcattaatcccaaaaaatgctcttgtaaattttgattaagtataattttagtgcttatatgtggaaaattttgtttaaaaaataaaaatcaataaagttaaattttatgggagattttatgaggaggcgcacgcggccaaattgtatatgcgtaggaagaggaatgggcagtgactctccagcagcgcgcaactacgcctatacatatgtaagtgcataattgtttataaaatcccacaaattaatttatttttaatagattatcaaccaacgacttaaactacccaaaattgaggtaatccctttaccaccagctgatcaaatccaccctgccgacctcaacgcaatgaatgtcctcctccaaaatctttacatcgaggtgaaaactgaattggggaaatgcagaatgctgtggaaagggatgagggtatgaaaaaacttaattaaaattgattaatccatatttttagctcaaaaatagactcataattaaaaaaacaatgtcgggaacagaagttacggcgtaagtcctttgaaaaattaaactaaaaatgattttttttctaaaatcagaaaaaatcatttaatttttagtgtaattggaaatattcgccgccctaagggatgataatttaagaacattttatgttctggaatggaagcttgttcaattgcaaaattcttaaataataaaatgtttattacttaaaggtgactattgtgcctgatggggcacgcttgggttgcactctgcataggattcggaagaaaatgagcaacgagcagttgcttgctatggtcagattaaaattcggtatgtaatattttattaacaatccactcaaaagaagggtgtgaaggggaaatgtacgacggacgattcgttttttggccaattcgtttttaccctattcgtttttgacccgattcgtttttattaccccgattcgttttttgggccgaaacgcgaaaattgaggtctaatcgttaaaattttatttggattcagaaatacactttttaggtcatttcaaatgatttttgtaagtttaagacacacatttaggaaattttaaaattcgaatttctaactttcttctgaacctagtttttttgacgaatttttttaattaagtaccttgaaacatgtttccgggggttttaagggtcgctgaccatgaatatgacatccgtttttactgaaaacaaaattttaaaaaaatttaaagttagaaaaatatttttccaaatttcaaaattgactaaaacacagtaaaggggtgggtaaactgtaaaccaacttaaaaacattcctaagctgcaatttttcttaaatatttaaaatttcatcgattcaacctcgaatttttgaatttctacctcaaaaaacgaatcggggtaaaaaaacgatcggggtaataaaaacgaattggggtaataaaaacgaattgggtcaaaaacgaatcggggtaaaaatgaattgccaaaaaacgattctttcccttacaggggaaaaatatttgacaaaatccaaattatttttattggtttcttccgcaatttctatcgaaaattggaaaatttaaaaattccaaat

SEQ ID NO: 3228 - DNA, 4831 bp, Heterodera glycines
  misc_feature (76)..(76): n is a, c, g, or t
  misc_feature (126)..(126): n is a, c, g, or t
  misc_feature (148)..(148): n is a, c, g, or t
ggcaaatatatatgacaaattcaaattttattttttatgttttcttcagcaatatctatcgaaaaattgtaaattntaataattcaaaatgatttcagaaattgctattgaactattcattaatcncaaaaaatgctcttgtaaattntgattaagtataattttagtgcttatatgtggaaaattttgtttaaaaaataaaaatcaataaagttaaattttatgggagattttatgaggaggcgcacgcggccaaattgtatatggcgtagcaagaggaatgggcagtgactctccagcagcgcgcaactacgcctatacatatgtaagtgcataattgtttataaaatcccacaaattaatttatttttaatagattatcaaccaacgacttaagctacccaaaattgaggtaatccctttaccaccagctgatcaaatccaccctgccgacctcaacgcaatgaatgtcctcctccaaaatctttacatcgaggtgaaaactgaattggggaaatgcagaatactgtggaaagggatgagggtatgaaaaaacttaattaaaattgattaatccatatttttagctcaaaaatagactcataattaaaaaaacaatgtcgggaacagaacaacgaacagttacttacaatggtcagagtaaaattcggtatgtaacatttgattatgatagaattattattttttcaatcccccaaaagaagggttatttatgtaaaaagaaattttattataaaataatcgagcatttcttttgaaaattttctttgacagcatctatcgaattgtaaattttcttaattaagaatgttttcagaaaatttgctattgaactgttcctccattccaaatatgtgtgaaattttatatttaaaatatttaagtttaaaaactttgatggaagatttatttaaacatgataagttaaaatatttatcattcgatagaaggaggcgcacgaggagaaatagtttatgtcatagtaagaggaacgggacatgagtcggccttagcacgcaactacgcttatacatacgtaagtgcatgaatttatataaatcattaaaattaaattattttttaaaattaataaaatccttattttaactcagaaaacacttgtaaaaagaacactgctgggagagaagtaaagcgtaatgttccactgtcagaagttctttctcttggcattgttcgacaagccccactcccaaatttgcggcatcctcagttgtgtttgaaatttctgaaaaatggcgcttcatccggcttttttgtagactttctagcgtattacggaacatttagtcggtcatcaataaaaaactctgaagtcaaaaaagcacatattttaagcgaattttgagcctttttcttcttcaggtgggtttaaggttgggaaatgggcaaaaggtcgtattcggattctgaggccccgaaaactctaaataaaataggaatttaggcattataaaagtcatcgtagacaccgcaaatcaagcggaaaatgcgtttttcgtgcttatctgtgcgtatcaagtgcgctgaaattttaggcatttgccaaaaaacgaatccctagtgatattaaatgaaaaatttgtgagcgaaattaagaaaattttgaaaaccaccaaaatataaatatattgtaattggattattggaagtatcaattcaaggttaaaagttcaaatctttgtattactttatcgcgtttcgtttttcaatacattctgattcattgaagcattttcaaccgacacgacacattcaattaaatgatgaaaataataaagaattaacaaaatttatttttcaacatttttttgttaaaaatttaaaaataaaattattttctgcatttattattgatagaataattgctggaaatgatgttactttgcaccgttatgatgccaagaacgcgaccattattttgatgttgttagctccagtaaattggacaccaatagaaaattggaccctaatcgatataaaataaaaataaaattttggcatagactaaaagataagcattatcttaaatgtctgttttttcattttttaaaagacgaatttggtatacaaaattcctgtggtttccattgtcaaattttctggtgtctatttattttaactttttatagaatttaattagagtgtcaataaatttttccttaaccagattatatttcttttaatttgtataaattatttttttttaaatttattttacaacatttacgaatgaaaagggaaatttaaattattttattttatttttaatcaattattaatcattaaaaatacgttgcaattggtatggcatttctcgtaataaaagattttttcatatattccatttataatataagacataaaagctgaaaatcaaaactaatttgtttaatgaatttttttgattcaaaaaatgatgaaaattaattttgtgattattgtcttcttttttttaatcatactaattgatgcagttaacgaagctttatttgatgatttgtgggataatctaaagccaccgacctcaaaaaactttaaaaaacaaaaatttggagaaaatattgctataaatgaagaaattgttgacaaaaatgaaaattatgagcaacaaaatgccaataaaaaaatgataaagtatgaaaattgcaatgagaaagaaatggaagacacaaagccaaaaatattacaaaaaacattggaggaacaaaatgataatttaatgtcaaaaataaaagtgccaaaaattgaatttgacaaattgagcgaagactcatttgaaaataaatttaacaagctgaccacttctaatgattcggattacaataatatggtaatgtataataaaaaaatgaacaaaacaggaaaatcttaaaatagaatgggttcttaaatacttcaattatttataatttttaaatatttattctggaggcagaaagaagaaacgaaatggaaaccttgaatagatttaacatgatgaagaaggaattacgaaaagaaaatttttataaaaatttgacaaattttctttttgaatgcgaaattgcaaaaaagttgggaacaaatcgtaccaaaatttgtaaattaaagcgaaaattaaagcaagaaagaaagagagctgaggaaagtgaagaaataaaaatggaattgatcagaaaatttgatcaaatgagaaaagaaaaaatttatgggtttaactacgccgagaagaaaagatcaaaaatagaaattgcaattggcaatgaattgggaattagtcgtaacaaaatttacaaatggaagagggaatttagtaagagatcaatggcctaattgaattttactcattattgtcaatttaaggtatcaaaaagaaattttcaacgaaagaaaaaattgaaaaaattaaacaatttgaaaaagtgagagaggaatttttaaaaaaatttaatttaaaaacgaattggaaatttaaagaaaaaatagcggaaaaaataggtgctagattgagcacaatttgtgattggaagagaaaattggactttagacctcgtaagattccttatacttttatttaattataactaatgaaattcaatttaaaaatttaatttttgttaaggaaaaatcagaaattacacgaatgctgagaaattggaatatgtgaaaacaagtgaagagatgagaaaaagaaactcaatgatgagtgaggcaaaaattgccgaaaaattaggcattccaattacgaacttaagacgatggacgaaagaattgggcaccaaattaaacagttaaccttcgaaaattttaaatgctattgcaattttaagaaattatatcctatgatgacagttgagtcaacttaattatgcagagaaaagcctagtgtagtatctctttgtttcttttttctttgtaatttctcggggccaggacgttttcgcgtggggacgttttcgcgtgagtgcctgtttaccagggatggcacggaattccgagttccgacttccgaaatttttgatgaaaagttggatttttcggaatttttttgagttttttgttcaaaaaaattagcaatttttgtacaatttatgttaataaattgcatagaaattttcaattttttttccgacggcacctatcggcaccgccggactcaaaaaaaaaacttaattttcttgaaaatttgctcaaaatcgctaaattttccattttttggacaaaatttgttaacaatttacattaaaaattacaaaatttttcccggcggcgcatatcggcaccgccggacccttccttccccacagtttctcaaattctctttggataaagcgcgccgcaaaaaaagggtgtaactttcccaaaaaaaaaatccaaaataatgtaaaatacttaaaatattttgatctttttaaaaaatatagaaataaactaaaaacagtttgaaattaccttttacatggttaaaaatttagcctattaaatatttaaaaaaaaatttgttatattttattttttttttgaaaaattccgacttccgagttccgacttccgaaaatttttggggcctcggaattccgacttccgaaaaatttttgctccccggaattccgacttccgaaaatttttagtgcctcggaactccatccctgctgtttacgactgaaattggtcggatatgttccaaacatccatttttcgaatcccgaacccgaattcgaaaattttctttactttttttgtttttttatttactgaggctggtactttctttaataatttgtcagcgatgaacgaaaaaaaataaaat

SEQ ID NO: 3229 - DNA, 1026 bp, Heterodera glycines
gccaaatcgcccccgcgggacgcccaataaacatatgctataagataatgtttgtgatgtgaggatgatgatgatgatcattatcatcatcatcacttgttgaaggccacaaatttcacccaatttgttgtttgttgcccggggggacggtggcggcaaaatgcaattggaaaatggcgaaaaatggaaggaaatgaatggggaaaaattttggggaaaaaattattgtaaaccgaccaaaatacggtagaaattttttgatttcaatagtcaaatgaattctcggcacggcactttctcagaactcacgcgctttgacttgtcaaataatttatattttgccaaactttctcttgcaaaaatgccaaattggtttttgttaaaaaattcgtgactttcgagagtctcgaccagagaaaagcctcgcttttttggcactttcagtgtctctcctctctctctctgattttccttttttagaccttagtctttcttgagtttctttcggtgccattctcgactttttcttgagcccccattctcgaccattactcaactcatttgtgtgtgtgtttttgtacaggaactgtacgaccacgtggtcaaatgctggacggacccgggtgttcaggcctgtttccagcgcagcaacgaataccaactcatcgactgtgccaaatagtaattaaaaaaaataaaataaatttttaaaattttaaaatttttaaatcgcataaatcgaattttgaaaaattgttttttgtcgatatatgaacaaattcagtttcctggacaaggtggacgtggtgaggaagcccgactacgacccatctgaacaggtgtgtccgaggaaaaggaatttttgaaaattaaattaacttttttaaatttttaaattttgcattttggcattttttgcaggacattctccgctgccgggggatgactacgggcattttccgaaaccaaatttgagggggacaaagtgcgctttcagggagtttttttgggtcttgttttttgccc

SEQ ID NO: 3230 - DNA, 8489 bp, Heterodera glycines
gtcggaggaaaaagaaattttgaaaattaaattaccttttttaaatttttaaattttgcatttggcatttttgcaggacattctccgctgccgtgggatggttacgggcattttcgagaccaaatttgaggtgacaaagtgcgctttcagtgagttttttggttcttgttttgccccttgccctaccgtatccgggttccctttcctacctcatacagtagtacatccgcccattttatttacatacaatactgtactattacagctctctccttcattcatcattccgccgctctttcctatcgtagtcttttttcttttgtctgtctgtcccactttcttttcctttcctatagtattcttctctaccatttccctccctacccctacagtaatcattatcccccaccctacagtatgttcgacgtcggtggtcagcgtgacgagcgtcgcaaatggatccaatgcttcaacgatgtgactgccatcatctttgtgtgcgcttcttcttcatacaatctggtcagtgcaccacactctttttgccatgatttctttggcatttttctaaaatattaaacaattattaaatttaatttttctgttagccaacgattaattcccatatgattttgcaaatccactttggcatgcgatttttttggcatttttccatttggcactcctatcttttttgaatttggcgcttccattggcattcctttttggcattcctttttcattattttggcattctattttctccccccccccttttaaggtgctttgggaggacaacacacagaatcggttgcgcgagtcgttggcactgttcaagaacatttggaacaaccgctggctgaagagcatttcggtgattcttttcctcaacaagcaggacatgctggcggagaagatcaaggagggccggcaccggctggagacgtacttccccgactttgccaactaccaattgccgcaggacgagcgcgtgccgccggacgaggacatcggcgtgtacagggccaagtgctacatccgcggcgagttcctggtcagtccttttggtgctaattgggctagttataggggagggtaattagcggtgatagaacaaagttttttttgatcaatcctagtgctaattgtttaattaggggaggatacttagcggtgacagaactaagtttttgtttgtataatggctttcaaacccctttgatgaccagattgatcaacttgggtaattaaggattaatttcttttgaaatgcgacggttttcaaactaatttaaatgacatattttgctaattagttcctaacccattcccttccccaccaatcactcatttccccccccctttttttcacattccttctcccccccccccccgggggatgcgattggaatttgcaatgaatgagagagtgagtgagtggtgccgaaaagcgccgccgccgtcgtcggaggggccgggcgatgggggaggggtgctttgtgtttggcttggaagaagcatagcaaaatgtgtgagtgagagtgagtgctctcacacttttattgctttaactgcttgggtgagtgcctaaaatgctttttgtgtctcggctctccccctccccgtccaaggcttttcccctctcttccccccattcatcttgttttctctctaccctctccatttttctctttatccctctatatctcctctccctcccctctgccctttctctctatcttgctttttgtgtctcggctctcccccttctccaacaaggcttttccctcacttttcccgtgcattctctctctctctctcccccctctctctctctgtctctctctctctctcttgtcccctccaattttccctgtatctctccatccccccctcctcctctccaattattgtctctcttatcgctccgtcgcaaatccccccccccccccgggggggctgccaccgctcctccgtcctctctcccttctcccctctctccgtttctaaaaatagcttttctccgtctctcaaattgcgtttgtgccccctatttttggctccccccccccctcactttatggtgcacttttctcttcttttattacacttttcctctgctgctgctatggcgacaaaagaaaatggaaaaaagggaaaaatttgggggatttttttatttgcaaaaattggccaataaaaatttgcgtcgtttcgcggggggccaaccgagcgataagagaagaagaaaatggagaaatggtgatgatgatgatgatgatgatgagataaaattggcaaaacattggccaaaaatagaacagaaaaaagcgagaggagacgaaacgaagaaaaatggcaaaacacggacgggaaaatttacagaaaaatgccgcatttggaagtgccaatttgggaaatcagcaaacagagattactgattttaacatttgattggatgtgatatcgaagtgtcgagattgaactgtttcgggagtgaatttattggaatttattaaacgcattataattttgatttaattgtatagttaattaatgtgtttggctttttgacatttttggcacactgccagagggcaccaataccgtacttctgtttttttggagtgtgatcagaaaattcattttggcctctgctgtcgcttccgtctcttctgataaatctctctgattggtcatcactttttggcagattctcgttttaatttcttttagtttccccacttaaaaatttcacttccaattttatgtccttctcaaaaagaaggtaaaaaaattatttaattatatttttataaaatccaaaaattaattattttgttaataaaatattacatttaacgaccctacaaaataaaattgatcactctctccccccccccaaagtaatcaacttgaaatatttcttacaaattcccaaaaataaacgccccatcccttaattacccttaattatttttttaaattcgataaaataaattaaaaattttgaattacttttcttctttttacaatttccaatctctgtccctttaattacctctaattaattaattaattaattttccccctcccccaacttagaaaatctcttcagccggcgtgaccagcaaggacaacagccacacgcacacctgctacccgcacttcacttgcgcggtggacacggagaacatccgccgggtgttcaacgactgtcgcgacatcattcagcgcattcacctgaaacagtacgagttactgtagcattagcaacgcccacccgcctaccgtatgcggcaccaatgggaccgaccgtatgcgccgcgacggattaatgccaaattcaaaatcataatcatcattatcacgtcacatcattcaccgtaccgtatcactccatccgccgtcgcttcgtgcgcccgaatgcatcaatacaaatttaccgtagacccccttccccccacacaaccaatgtgcgtactgtaccattcttatagtactactaataacagcaacagcagtcagaagtctttatggtcattgattaatgggatactgtaaatcttttgatcagcaagctatcaaaaaggcatttcgggcagataaatggaaatgatcaagcctgatcagttgatgaaaggataaggctatgcttaccgaaccaattaaagcaaaggctaattccggtttttgatcattttattactatctctttttccgatcagggtttttgcctacaattttaattgatttagcatttattgcctaattagtcccgatcactagcatgctcagttcatttggttgtctgtgatcggcttgatcagttcttctgatcagtttctcccccaaattaaacatttctgctgttgttgttgtttttgtgcactaattactattatcattaatatatggcatagtgatccatttgttatgttgttggcagctaaacttttgtcctgtgtttttatcgttggttacagtattcccggccataccgtaaccggacttgtccattctaccgtctgtttgttgtacgatcgatcagtcgccctcccaaaattcgctagcaaaaaatgtctataaatgtatttaaatattaatttgttggctttatcattttttactcctttctctccgatcactcacaaaatgccattttttcttggctttttgccctgcagggaatttattaattgtcaaaatggcaaaaaaaaaaaattgcggcacaaaatttcgttttttttcaaaatttcttcaaaaatttcccaatttttcatggatttgtcgaaaattttcacaaattttcctgcagtttctgcaaatttacgttggattatttcatttttgttcaatttttgctgcacactttgacacgggtgctctcctttaatcccttactctctcttcgctctctctcaccaattaattgactaattaattaattgcttttcccaaatttctcattttgcaatttttcttttcttgtgcttgtgcgcgcaatttctcacctaacacaagcaattttatttttattgttgcttttcgaaccttggcaaatgcttttcccttttatgcagcgacaaattttgtttttatcgccgaattcaaaaatttttgcaagtgatcagacaaacttaatccgccgtgtcagcagctgatccgatccaatgtcgcttatcagttgctcttctgatcactgtaaatccctttggcaccagagtgatcagggatgatcagtgtagttctgtgttgctgatcacttaatactctgatcaatttccaccgacatttccgctagtgatcagaggtcatttattatcattaaattctctgatcagttttttcaatgataagtcaatgaatgcttttgccggttcgattagtgctaccacataatactccacaaagcttttccccacccttttattcatcattttgatcccttgtctctgttcaatttgattattttttatttttgttttattttaaataaattgacaatttttgtaacaattgttttttattttttgcgttctcacaatttctcgccccacaatttatacatattttttaacagcatatgagttcaaataaaagcatatgtatgaatgattaaggtgtaaaaatgttttaaataaaaataatttttatcttaaaaaattattcgctgatcgattgggtttgatcagtgcgatcggaggtacacattggtaacaagctaatcctctctgtcctcccaaattgatcaccgcttatcgatcagctgattttctaagtgcaaatcccctgctgatcagtctgctggtaatcattccgatatttgtacaaagcgctagattcggtgatcattatcgactcgacttaaacggaattaatccctcggtgatcgacagtgatcagcacttctcaactgcaaatacacactgattaggcgcttcgctgtatctatgctgtgtttcgattgagaataccgatcaaaaaaaaagattctgacaatgcatgggtctttaagggaaaaagtgatcagagagacagcgaatggcgccaaacgaatcaatcgatatgccggccatgcccgttccattatcagattaggtctctgcttcctatctctctctctctctctctctctctctctctctctctctctctctctctctctctctctccgtgtctcttactctctattcccttaatttcctttcattatctcttttgctccttctctctgtctctcggttctctcacttttttaccaactctctctctccgccgttttgtcccgctaacactttgttctttaaatggtaaaatgagaggaagcaatcgataaatacccgcaggcacgctcttaacagcagcttcatgtgaagctgccggcattggaatttctcggcatggccccacccaattgtcccgcggcacatccgctccaccgcggctggcagcaatggcattctctcaatattctgtcactctctccctctctctttctttctttctttctttctctctctttctctctctctctctcggcacaaaagggcatgtgaggtgagaggaagaagcatcattacgcgaacggcacacactctttctgcggcttttcgacacgacctcagagcaacgatgagaaaaagcatttttttttgctgggacactttcgcctcgggcacttttcaaaccgaaaaacgggcatctttccaaaaatggcattggcacggcaaattttgtttgtatgcatttgcataaattttgtttggttcgttccgctccctcctcgcatattttgttgctttttttgcaaaaaattcccatgccaaaaatgtgaaaactattcggcattggcattttgtttccctccgaaaagcattggcattttgccaccacatggttgaccaactttgcaatttgtgctatggtgttcctggaacttggaaatttaaatttcaaccggccaaaaacgcgtcaatggattttgctcaattttctgtttttgtctgatcagtgccaatgccaaaaaactcaccgaaaatggcactctgattggcgataacatcctctgatcatttcttctggttacagttcatctcgtggccatacagttttgtttgtttccaccatcgtgacagagaattgcttgtaaatgttcttcgattggctaccgtttcccattccgtgccacaatcatcgtcaccacagtaggcaccgtcaataccgtaaccggccagtgatcatccgcagcattagcagtaaaagcagcagaatctttttgttggtcgcagcattattcagcgcttttgtcgtcgtttgtaatggacaactgcagcaggtgaattttaggggaaaacaaaaaggaatgatcaactgatgtgatcagtggtcagcctgatcagtcatgggcataaacacagtttgtgcttggtgattagggatgccatttttaggcacaaaaaatcgtgaaatcggcattaaataggcacaaaaataggcaaataaaaggcgcattggcaattaagcataaaaagtcataaataggcaaaaatgatttggattatatgagagcaaagatttttcgagaatggaaatcgaaaaaaaaacaggcgaaaaagcaccgaaatttatccagtcgagagccaatccgagaattgtgcccacgagagtgttcgagaatgtaaaaaaaaatccgggaatttttcaccctgagaattgattggtggtggtggtggtgaacagctgattgttggcgtgccgaatttacaacaaacaaaattttaagtttggcgattcgtccgaaaatcgtcccggcgttggccccgcgccgacacattgcaccgaggcgtggcagttcccctgtgacgatggcatccattgcattgcgcgttacgacgaatgcgacggcatcgaacagtgcccggacgcgtaaattttaaattttaaatgtttttggaattttaggaatattgtttacaaaatataatagcgtataataacgaaagaatacagaaatttttagttaataggagaacagattaaggataagacagacaaagccaattaattagtgatactcgagaccgcaaactaacgaagactcgagaccaaaattctcgagcatcttttttagatcggatgaaaagcattgtcaagcaaatgagcgagcttcaatgtcacaagaacgcggaaggtagatcaaaaaaaatatttggattttttggaattaaataaattaatttagtattttataactttttttaaaatttccatttacagacattacactcaacaacagcagcatggacgagaagataatcagcagcacaagcagcaacaggcacagaagcaacaacaacagcaacagacaaaaagtgccgtgccaaaagtgagtcaaaatgccaaaagaaaaaattggaaaaatagcgcccaaattagatacgctttttgattttctgccgaagaatggcaggctttattcccccaaatttgcgagtcaatccgagcctatgtctctgggaaagtgtcctgaaaagtgccacagtctcaaatgaacagctgggactcttcaaaagcattgcttgatgtattcacgggcacaaaatttgaatattttagatttttggaataccgtactcactattaatgcattggttacggtattaccgttcttttcaagaccgacatttttttaaagacaaacgccgcgggcggggacaagcgcgtgccgctggaactgttgctggcgggtgctgctgccttcgtgctcgtctcggcgctcgtgcacgcggtgatgaaggcgacgcggcggcgccggttggcgcggcggcgcggccgcccgctggcgccaaccgacgcggcgccggcttccgcaagggtgaaagtctggtggacgaggaggacgacctgctgatcgcgcaaatgtacggctgatcagacgacgaggagaaacgatcaatttttattaaaaatgcattcacatttaaaaa

SEQ ID NO: 3231 - DNA, 1286 bp, Heterodera glycines
ggggggggcctcctacgattcccaaaggaaaagcattccccgcctaccccctccccacccccgcttcccaaaggaaaagcattcccgtccctgccctctccccctgccccaaggggaaagtattccccgcctgccgcccctcctactcccaagggaaaagcattgacagcccacgcccgggggcaccgttttgttgtgccctttgccctcccccccctccggcgtcccttaatcaccgccccaagacaaaccaatttagcaaggaaaagcgggaaagaaagtgttccttccgctctgatccgtccctttctcacttcgtcgatcatccattaacaaaacacccaaccggctgcaccaattgtttatccgccgccttttcaatggcttttcaatttgaaaaaatggaattttaattgggtaattatctttttttatatttaattttagctttttcgtttttcttgtgccattttccgcctccttttccatttccgttcattccttctcaaagcgagcgatgttctcgcccagcggctcgtcggagctgaacgagcatcaccaggacctgaaggtgtacatcacaacagtgaccggaaactcagaagtaaacatatttaaagccgccatcatccagcaatcagtcccatccgtaaatccaaaaatgccaaaaaagttgggcaaaaatgttttacttgaataattgggctgatcatgaagattcagaattgaggggttttttggattagaaaatctaatcaattaaaccaaatgcttcaatgataaacgaattaaatgcataagtcagtgatcaatattaaaaagaagagtttatcagaaccaaaaatgatctcacaatactgttctcgagatttggggcctcgagaaactttggtagattgaagattgaggggagcttttcaaatttttaaattaaaaaagcaaatttcggtgaattccaattttggtaagggcgcttccatttccaatgattaagcggcactgttttgtttctgttttaagatgcgcaaacaagtgcagcgcattctgatgacactggacgcgctcggcgtgccgttccacgcggtggatatcactgtacgcggcaatgagcaggagcgcgacttcatgcgcgagaaggcggcgggcaacccgcgcaacaacggcacggaagtgccgttgccaccgcaactgttcttcaaaacggactatttgggggtggacaaacaaaccggggaaaaagtgccaaaaagggggggcaaaagatggggaagaaaaaaaaggaaaaa

SEQ ID NO: 3232 - DNA, 1459 bp, Heterodera glycines
tttgttaacagactcaattacatttttataatatcattttaattaagtccaaagattgcctcaatattttttccgtggatataatttcaaattgtccgacttttattttgcatgatcctccgatggctaattcttccttctccagggaatcctccgaattttatttgtcacaaaaaagaccaaaaatgaatgtcagtctttcggtggttgcccatttagaggcggagccaacgtggtaatattgcgaatattatttgcttagaaatgccatttcaactcatttgactatgcttttcagcattctttccttcaaagatgagtttatcgtttgtctgatggatggctggctgcacagaatgagttggtctggcgttgttcttccgaatctttcatttaacgttcgttccgtttgtgcgacatccaatcacttgtccaaaagtaagtcgaaaaacaaaaaaccgcaattattgcaacattttagcttttagaaagtgaccgcctcttcggctccaattccctttttgttttggacattgcgccgtttcttggcggtatttgcgttgtgctcaatgacgggcgtggtgcccttttcagcagtccctccccaaatttccaacccgactcaatcagcgcactgtgggcggcggagataaaggatgcgtgttgttgtgctaccaatttcaaatatcgtctcatttattttggcactataaggtgagattctttcaccgaaactgaattaaacggtgttccagtggcgacgttgtgttgtattcaagagatgacattaataaaactcttgtcaaactttctgtgattcgtcttactttgaaaaacggcactgagtttcttggacgactcagcactgttcgacaaattcgaagtatccatccccatggaagtgctttcgcagttatttgggacgctgtcgatggttgggatttgagatattcggctgacaatctgaagcgcaattcgtaattttaactttttagaaattagcatgtctcaaaatggaacagagtcgaacggcgttgaggacagtcggtctctgactctgaacccgtccaatgagactccgcctgctttggcccttttcagtccgttcggtgcccaatggtggtgctcactcgaagacaattccgggaatttgaggttggtaatccgtacatttgtacccctttcttttttccttaagttcattccattatacaactttggactgggcatttgaaggtttccaactttggatgggcacaactgatggcctccagttgattaacattctccaatcggcggaggtttcactctttccgttctccgtagtgttttttcattgtgcctttgcttcatcagaatgcccattctcgtcatgttgtgatgttcgggtctgatcggctttacctttcgcccgtcatttctgctgatcagatgactgcttgcaacgcgccgcatttta

SEQ ID NO: 3233 - DNA, 3941 bp, Heterodera glycines
ccccccccccccccctctctcagttagtttcgtcggttggtgcctccccccctccaaaaaattttttctgaatccaagtactatacaacagttacaaaaggtcgacatcacaaaagctcattttaggaacaatctctgctgttgaacggcggactcgcaatttacgaaaattatataatttgttcggcctcaaacagcgaatttccggacggtgaaaaggagcgtatttacgtattccatgccgaaaaacaattggatttgtacgaagcaaattccatccaaacaaatcgaattttgcaaatggccctcaagtaaatggaatactaaacagaagttgaatccgtacaccttactcccgaaaatttgagtcgctctcatttgctcactttcgacgtgaattcgctgatcgccatttattctctgtcgctttccctcgaaaatgatcaaagcgcagattcgctctctttggaatgccttgccgaaattcgtattgctgaattcctgccccatccgaactgtctcgtctcaatggacctcacgaggctcaatttctattcgggttaagtttccacaatgctgttagaacatcgttttgtatagtaataacaaagtctaatatttatttatattttaattccattgtgtttctcatcctcctttaaacaaatgaattcttttatttgatataattgcttttttagatgctgttcccttttgtgatgatttggactcacttttggtgaatatttctgggcatttgctgttgctgagcccaatgcaatcccaacaacccaacgaagacggacattccgggaaaacgcagggggaaaacagtgaaaacagcgcggaatttcaagtgaatttgtcatttctcccctaattgaaaactgctaaaaaggggttaacaaaaaaggttttctactcaatttttcaaagaattttgctagagagaaaaaaatattttcacggcatttgccatactatcaaattaaaaacttttttcaaaatttattaagaccaatcgggtgtatttattttttgtcaaacatttaatactgcttgtgtgttcacccacccttcactaattcatttttcattctctcccctcttttaataaatctttaaacacaaaaattaatcactcttaaattgtttgctttgttcaagcttcatcccccaacattaatcgcttcttttgtggagcatttttgggccgcgttgccttccgatcagcacaaaaacactaaaaatgatggaagaattgcctttctcgaagacgctttatggattaatgctggttgtaaaaatagcaaggcaatccttcattattattattatttatttatttttgcatttttgacaattaattttccgtgtttttaggtttggcttcctttgtccacagatcaaaacttgtgcacatcgacagacccagatcaaatccggaggctcagtcgtcaaagctctcgctcgttcatttcccgtcgcattatgttgccaattgaccttggcatttatccgctttgtattactaatggttttgccatcactcggtttgatttaactttcaggtgttaacgatgattatttggcgtgtggtgcgagttgcgtttcttctctaccgaaatcctcgtccgccaaattgtccgacaacatttccctcgtcactgatgacggttcttcctcgctgagttccttcgttggagtcgtcaaaaatgttgactttttgtcgcgactttccgtccacactttggtcagagtcagtgaggtgtcttttctctttctctctgttgctttcatttaccatttgtatttcccaggtgtttatccacaaacttctcaagcaacttttgaaacgcaacctcggcgcctttgcatttgatttggccaccgcgtgtcggtccctgccttacttcgggcacattctcgagctgttgctgcacgacttgttggacgaagaagcgacttcgtcagaacccattccgggtaatggaatgttttggtcggttgtttcgacatttctcttcagaccctcttctcccaaccgccgtcgcatttcttcgcgagttccctgctgaatacctccgcaccattgtcttttgtgctcgcaaaacagaacccgctttctggagtctgttgttctccgtgagtcaccatcctcgccaattgttccaaatgtgtctcaaagaaggccaattggacacggccaccagttgtttgatgattttgcacagcatggaaaattttaaggagagctctaaggttttactttagctcgtgttcaaaatgtcagcatttttagttgtcattccgtttgttagaagaggcgttgacaaagagtaaatggaccgtagcccaagtaataaattaaattaattcctttttttaataaaattcgaggacatcatctgtttcatgcacaagatttcccatgcggttgatcaggaaattggcgtcagcagtgaggactctttgttggaaggagggggccaaaaagatcactgtatttattgtcggacattttcagtgcatttgattttcagttttcagattctcgatcaaaagttgagaaactcatcgacgaggctttccgggagaaaatccaagtatttctggacaattgtaagttcacgtttgccggaacatgcaaattccgattcttttagcacattatgattgggagttagagcagtcgagtggagtcgcaagtgaatatatgtgagtgatgtcttacgatttgttttcggaaactctcatttcctgtctttgttttagcactgatctgatcacttttctgaacaccactttcgtttcctttgccaaccttccgcccgttcttgccaggcatgtccgtatgcaggtcggaaactcaccaggcccttaaccagccgaaggcgggaaggggcaggaggagcttacctcaaaatgaaaaaaaattgaggaaaaatatacatttttttgaaaattaatatcatttttcttaatattcgcaaaaatttgttttctccgacaacatcgacaaaaagtcttcgggttcctccaccgatattcttttctgattaatgtggcctataaacgcacttaaaccctatttcatatgttttttagacgtgtaaattccttgccgatcgcatgagttcgatgttactttcgtcggagcatcgttcggtcagtatcggtgcacttgaacagttttcgcttgatgtgatgcaatgcgaacttttcactgcccaacgccccgtgcccggtttcgaagataatgctctcgccattactttcgcacatttgcgtcaattgttggatttggtgatggggcccgactggacaactttctttgccgaaagggatgaaggaaattcgcatcgcaagggcggaagcagcggcaccaaatacgcccgagtaaaggcgtcgagtgccgcggcacttatggaaaagtaaactttcgaattgttttgtgtccatatttaaaaaaaaatttagagtaattgaatttgaaaagaaaaacagcggcttttttgctaatggtcgagctgcgagttgcgataaacagaaactgtgtgagacgattttacggaaattacgatcatttaccgattaatttttaatggtttaaaagtttgttacctaaaaatttttaaaaaacaaatgaaaaatcggaatccctcgggatggattagtatcagggggcgtatctagaacattttttcgggggggggggcggcctgagaccttttttttcttttgctcttcaactaaagaaggaggtccggcggtgccgataggcgccgcgggaaaaattttttaaatttgagtgctatttgctacaaaaattttcgtttggggggcaattcgaaacaattttccattatttgctgtaaaatttttaaaaattttcatttcggggggggggggggggaaattcccccaaccccccccccccc

SEQ ID NO: 3234 - DNA, 2422 bp, Heterodera glycines
ttttacgcgtcccatggcattttacgcgtcccatcatttacgcgcgcatttttatctctttttcccgtcgggacaccaattccgaaggattacccttttttcgaaccgtcaatcaaaactttatatcttccgaatcgtataattgttcttgattgtatactttgattatcgaaatgtgcaaaagcaaccctaagcaaacttatactttggtttagtaacgaaatttttagttgaaaatttactaaatacacaacaaaaaaaataggtttcctcttagttagggatggcacggaattccgatttccgaaaatttgtggcttcggggcctcggaatgccatccccgccatggacacaaaaaaatgtcatgggacgcgtaaaaccgacttagaacccccccgattttctcgatgggttttggggtcacgaatatatggcatttattttggcgaattgcgaatccggaaaaggttagaataattgtacgtatgccttttcacctttttcgttcctatttcacgtgccgtttgtctgattaatggatttttctcagagtattttattaacagtaattgcaattgtcgtttggcctttgaatgtttccctgattgaaacaattataaacaattctcaaactggttgcctttcattcgctccggttacttttgttttgttttttcaatttttgttacccgaccattcactttcagccgcgcattttcccctcctccgtctaatttccccctccctcctcactcgtcccattaacatttttacttccttaaaagcgtttcttggcaaaagaagggaatagcagcagaaaggaaaagcaaaatggtggccattcattgtttggtgctgctgtttttgttttgttttgtttcattgtgcggaagcgaagacaaagggagggaaagtgaagaaacggacgaatgaaatgaatgaataaaaatgcgttccgtccctttctttgctgctaataatcgtcgcttttatttgtttctttgcccgaagcgaaaagggcgaaatttttaatggcaaatgttttaaaattcgctgtttttaatttaatttttccttggcttttccttcgtcagatgaaaagtgtcctccgtccccttttgccccgtgcctttcccttcgccctttgcttttcccttctcagtttggctttttccattattttgccttcgggtgagtgcccaatcgaaagggaaaagcggcgcattccttccttttaccgttccctttgaggcgctcacctgcagagtttgagcgcgacagaaagtgcccaattggccacggcgtgcggccgttccaccgaaagttttcccttgcgcgagggccgagctcacccgtgggccgtttccttcatgaccaaggtcgagtgaccatagtcacccaattggaccactaaactgaagttccatcttttagggccgcaatagactcgggggcacaattagtgagttaaacattgaatttgccgggggttggccctcgcacacaaaatgccccaaaaatgccggcactttgggcattttccaaagtcactgattgatttgccattcctttctccaaattatcccatttccattttcttcgctgttttctgaccttagtttcgccttggcacattttgaccgctgcccacgcctttctccgcttcgatacgattgctttcgacaaatgtaagttagtgagtcggcccctttcagttttatgccatcttttcgcagtgtttacggttatcgcaacttcgagacgattcggcacggatggaccgttgtttatggggacgattgcatttggcagcagcagcacgactatttgtgtgctcggcccaacctgacgcagaatcgggtaacacaaatcaggaagagggaccggtggaggcaaattgatcatttgcgatttgatgagtgatttgggggaggggaggggggggggggtcatcttagtaattacatggaagagagcggactgagacagagaaaaaggaaattggcacatattttccgtgttggattgtttcataaaacccaccatttagctatttttcgataaaacatggcataaatttgcttaaaatcaaaaagctggactattgaatgatatttagaatgtaaaatttgattggtccttttaaacaaaagttataccatgttttgtcaaaaaatagctaaaaaggtgggttgacaaaagagctatagcacacatattttctcgtgtctcattagttttttttcatttaaaaggaggacttaggtatatgcactagagttggttacacgggtcgggtattcgggcaaaaaccgagtctgggattccgggtccaggcccaagtttttcaacgaaggcgtctgcgacaagaaaaagaatactcaggaaaacaaatatatcaccgaatgatttgtaattatt

SEQ ID NO: 3235 - DNA, 1792 bp, Heterodera glycines
tttcatttttcggttgcgtcagtggccacgattgggccattgtgagctcgaagtgcccattgccttctccgaccgcgtccttcccatttgtttgcccgcttcgcccgcccttcagcaaatttcggacggcgaagtgctgacagtgacgagttggggacggcgcgatggtcagcagagggaaacggtggcggagggggggggggggaattccgaaaaagagaaaaattcaaaaagagaacagtagcaaaagtgtgcagaaaggggcccacccctcgtggagggataaaatttatacgaattgaaagtcgtttcgtataaaaaggaagctcgttgttttttttaaatgagctattcagttcttttccatcatttttatgaaaaaacctaaaaccgatgactgttcgttcatcttcgtccttatgatcgcttgttaactttagccttccataagggtgaccctctgatccgtgagattccgttgcggcatgacgcgggatgcaaagtgtggcaaaagatgggtggtgagcatggcattgagtggtcaaattttgttgtagggaaggccttggtcggacacaatgccaacgaatgtggaggattacctttgtgcgaaggcattaaatccgaaggattatcatgcggccaggacatgccatgtgaggggagaaaatccgatttaagtgaccgaaatgctcagggggacagcgggtcgggcatggaatggaaacggaggcgcaccgttggcattggcacggcaccgccgcggcaaaacgccacccgacaaagggcaaaaattgagccgcaacttcccccagctgctgctttgtcttccgccccattttcgcgttccgcgtctgatcagctgaccaacgtccatttggtgggcaacggatcaaaagccaacggaagtctaacacaacgaattgttacgatgccaataacagaaaaaagagtgccgttgaggatgaaacgccgaaaatcgaaaagtaaattcggacggatggaaaagcaattatcaaaaagttaaaaaattatcctttttgttagacttttcccattgaaaatgcaatgaattattgaagtctttacagtacattctcgaaatgtgctccgaacgccgctgataattcccgaattggaactgatgaaaaagtggcgaaacagtcgaagaaatgacgaaaagccaagcagagaattaccaagccaaggggaagatgaagcagtaaaattattgctgctgaatgatattgggcaaagtgcggaagagcgacgggaagaagtgatcggaagaacggaccgatcggaagtgatcacggaactgatcggggtcacctcgtatgggtctcgtcagtgcggttctgacgaggtattagttcaggagagagaaagtcgttgatgattcccctcatttgtcagttggcccgattcactcggattgcgcattatgtgaagaaagtgtgtgctttggtcggagtttgctatcaattggccggcaatgaatgataaggacggaacggcggatggcatttgcataaaggacaaaaacaaaacaaatgccaatggccaagtgaaaaagtgattttgccattgcctctggtggcacttcgtttcctttctcattttcatattacgtgtaacaatcgctcatatttttgtttaaatgattgttttatgtttttatgccataccttcggacaaaaaaaaactcataaacaatgggaattttggcatttaaaaaaatgatttttaattgtctaaatttggcaaacattaaaaacatctcattggcagc

SEQ ID NO: 3236 - DNA, 1106 bp, Heterodera glycines
ctactacgaagtgtacggaaggaaggacggaaaggggcgacactgaacgaatgtttaggaatgaccacgaagagtttgtggtggacccggcaaatgcgccgcttaaaaacgtcgtggaaatgggcgggggaatggcagcgatgggcgacgggggcgaaacgatggcaatggtggctaaatttgacgacatggtgggagggggggggaggggcgaaaatcaaatggcactttggcagagagtgtcgaagaaagaacagctgaggagggaatcggtggcacagaaacggtaccatttgtgctatacggtgaaactgaggacgcaaaaacaccaaattgaactcgtcgggaagaaggcaagcggacgaacgttgctttcccaatttggtcattgtctcctcattttgcataggtttccctcccattcgctattctcgtcggcccaaaggcggacgtagaggccaaactgttcatggaacggtcttttgcggatttcgtgcgaaggccggacggagagttgccgaaagtggtgaacggatttgaaatggtcaacgcattggagatgaaatttcaggtgaacaaaatgcaaatcgaggagaaagagagagagagagagacagagagagagacacagagagacagagtgccatgggaagaaaaaatgccatgtgaagagagagagagagagagagacatgggcaaaaagggagggaagaaatgatgccgtggggagagggagaaagggaaaagagaagtggtgataagagttgttggcatcccaaacgaactgtcagtttaggcattggtggcgatctctcaaaagtcagactccgtcgctttgcagcagccgcgccccttttccgcggtctctcgtcagcatttgctcaaccgattgaaaccaaacagaaacggactcatttctgtggacagttttcttaaggcgaaatcctaatccttaaatttcgttacaaaagacagcctaatttattattaagaaaatgtttagatgcctgcagcggaggaattttgcagggcaaaaagcaaaacgaatagcaaagagaacggcggagaaggaggggcccaatcgccgccgggaagtgtggcgagtg

SEQ ID NO: 3237 - DNA, 5170 bp, Heterodera glycines
tgccgagcagtgatagcactaaaaacaaaaagcttaatgtataaaattctgctttcgatacactatacatcccgtagctcagttggttagagcaaggcacgattgctggggtcgtgggttcgagtctatagatgcttctatgtatcgataatattgtttttttatgcacaaatgattagaaaaccacctaaaattcagtgatcacgagctgatcgtctgttacaaaaccaaaaaagtgaagcacgtggtcaacaatgaaattgccgaagtttgccaaaaacatcttggaaatgttgggcaacagcaggcgcacggatttcgcatccgcttttgtgccaagcgtaacgcgacggagcagctgatcagtgtggaatccattctggatttctcattctcggacaaaatgtaattattgacataaaaagtgattgtttttccaggacaaaggtccttttttgaaaaggatttccaaggactgtccttggcgattcgagccatattttttgaggatttttgccatttattttttttgtaacctatttttttaaaaattttcacgataatagagcaaaccttaaaagctaccctaaggtacaaaaatttttatcgttacagtatattttcgtcttataaaaataaataaattaaactgtatcatcattgtcaattaattatgattctcattaataaattttgcgttttttatagatacaaaagagagcacagttactcatacaaaccgggtggacacatcgcaatgaaggagaagatgccgttttttttcattgagttcggcaatgcgaagcagcacagtatgcttcgtggcacgggagacagtagcgaactgtcagcagaattggtaatttatttatttattataattaattaatcagctaattgataaattgcgttttgtgaggggaaagaacttttggcacaattaataatttatgaaggtttcgcctacccactcctaagaattgaacctaaaaatttaagcttcaatattcgggagggggaatcgggaatcaataaaaaaatgcaataatatgaaaaaatgcccccccccttccctattaaccaaaacccggaaaaattggaaaattttctcagaaattcatcccctaaaatttatttttttttttttgcttttttaacacttatttgagtttttgtgcctttttgagcgtctaacaattggcacaattttgccatcaattgcctcggaaccatcatcatcatcaccaaacaatgatggaggagcacagcaccgcacaaaactgctccattttgttccgccagctaatgaagaattgaaaattttcttccaaacccgattgcccttctcgcgattgatcactcgcaaaacggatttgctgccttatgaaaacaatcccaatatcgtaagcgataaaattaattactgcatttaacgaaatgaaatttaaaaagtttaatggcacacccattacgcttttatttagccgactaattaatgtaaaccccgacgagtgtcttaattttatggtttttcttaatttggaaaggagatctttaaacatcgagtttttttttttggaaaaaacgcagcaaaaataattaggcttactaatgaagggctaaaaatacgaaaaattatttaattaatgaaaaactaatgatccattaaacttaaatttttaataaaaatccgtgccttacttattattagggatgcgatttttaagcacaaaaaaccgcgaaataggcacctaaaaaggcattaaaaatcgcaaaataggcattaaataggcacaaaaatcatcaaataggcactaaaataagcaaaaaaaaaatttttattaatgctttttaggtagcaaaactctaaaaattaatcaaaaaccctattttgcttatatttcaattgttttaaagttgttttcgataaaaataattttttaacacaaaaatttttatgaagaaaaaataattaatttttggggacgaatttttgtgaaaattttttttcaattcttaggggggtgtattttctgaatttttttcagggcgtttcttaagggtgtattttctgaatttttttttcatttttattaaggatttttccgaaaatcctgaaaaattcgtcaaaaatggcgaaataggcacaaaagcgtttttcgtgcttatccaagcgtattagtgcgcaaaaattttaggtatttgcctaaaaatcggatccctacttattatcatttaattattttttgcttttgcgtagctctacccggacaaatgcgaacagttgggcgatgactgtgagccgactcgggaacttttactgaaaattcaagatgtgctgcagtgctgttcgccagccaacccgtggaataaatgcctttgtgatgggtcgaacagtgtggataaagtactgaaattcaaggaccccatatgggaagtctatatcgtgctcgtgccaaaacgaaattgcggactgggatcccgcaaaatcccgcgcgggatcccgtcccgcgccggtctctagtcctccatatggacaaaaaaaaaacactattttgaaaccattatggaaattttcacgacaatcaatccgtaattatgctgtagttgtagagctaaaagttataaaaccttttttttgtaggctaatagaaaacacttagggctatctaatgatatcaagaactaaaaatttagatgctttaagcaaatttatctgaaaaaatattttcgtttgatcgttttttgactaacgcccattatggtggtttttgactaacgccatagcacattccgaggcctcaaaaattttcgaaatcggaattccgacccaaacgatgtcggaaatcgtaattccgtgccatctctggtgcaaatcggtgaggaaaccgggtcaacattttcaggtttaccccgtctgatgtcccctgcgatccaccaaaatttataaaatagcgcagaaaaacaattgggagcttggttaacaaatttcaaaaagtaaaaaacaatattaaaatccggggccgaccaatcccgaaggttttggaaaaacgatcgggagcaatcccgaatcaggatctcaatgaaatcccgttcccaacactttcccgaaaatattggaaaatttatccctgttttgtctcaatatttttgtatttcatgtcattatttcgctattttgcatcaagatttttcgaaccctactaattgcaatactcttaaataaacatactcgataagcgctattgcacccagaattgcttcttcagtaactaaaaatggaattttgcaattaataaattgcaaacactcaaatttaaattctttttttctattttccaaaagaaataaattaaaaataaatgaattcgcagcttttgccctccctatctttgaaaaagcaatcggaaaatcattcaaatttttaacggcatcttgtcaaaagcaatcttttatgcatgtttgttttcataaaacgattgagagtaaataattcaaaaatacagtagccgattgttttttttttttttggcttactgttccaattttttacaaaacatttcaatcactttttggtgtgctgaggcgaattgcaatgggaaatttggaccatttcttcaaatgtgcattagcctgtcgtttcctccgattttttgtcgacttttcagcaggcgttgtctgttgtacacattgggcacaatcttaattaaatcacctaattgcattttaaaaatagacattaaaaaggcaaaaatggctgtaaatatatggtggtgctgttagttttccaacagtgattgattgatttcgacagtaaatttttgtttttaaaaaaaattataaattaatagcttggctaaaattcaatccaaattaatattcttatagagaacaactaaatctattgaatgattccaataaaaattaatttggttgaagttgagaaatttcccacgcaatttcagcagcttatctagtaaagtttttgtttgtttttttgagtacaatagtccatcaagagatgtctgtatagaaagtgaaagggataaacctttggacataatattcaatcattttttttatacaataattttacaaaacaaaaaaaattttcctttaccctccataatatcgtcgtatcttcgctgcgccatctctctgtcgtaaaaaatgtcgtctgcattcagcggatcacccaaatggccccatcggctgctgctgttgtttggcgtagtgtccggcgaggaatcttttttcccgggcggtgcggcgaattcagtctgaaaaattgacaaaaattattgtatgtacgtacatccctctaattgtccctataaattccaaaaaatttggggattttcaaataattgtaaagacaggactaggaaaaaatttggaattcttaaagcagcgcaaatttggccatttttttctacaaaaaggttttataacttttagctctacaactacagcataattacggattgattgtcgtgaaaatttccataatggtttcaaaatagtgtttttttttgtccatatggaggactagagaccggcgcgggacgggaccccgcgcgggattttgcgggatcccagtccgcaatttcgttttggcacgagcacgatatagacttcccatatggggtccttgaatttcagtactttatccacactgttcgatccatcacaaaggcatttattccacgggttttcaggcgaacagcactgcagcacatcttgaattttcagtaaaagttctcgagtcggctcacagtcatcgcccaactgttcgcatttgtccgggtagagctacgcaaaagcaaaaaataattaaatgataataagtagggatccgatttttatgcaaatgcctaaaatttttgcgcactaatacgcttggataagcacgaaaaacgcttttgtgcctatttcgccatttttgacgaatttttcaggattttcggaaaaatccttaataaaaatgaaaaaaaaattcagaacatacacccttacgaaacgccctgaaaaaattcagaaaatacacccccctaagaattgaaaaaaaattttccgcaacaactcggccccaaaaaataattatgatttcttcataaaaagtttggggttaaacaattattatctattcgaaaatatctttaaaacaatt

SEQ ID NO: 3238 - DNA, 2460 bp, Heterodera glycines
ttgcgggattaatcccgcggggatcccgtcccgcaaagaattttgagtccaatcccgcagcgggatccgcaaatttgaaatttccggtctctattttctattagcctacaaaatttcaaaaagtttcattaaatttcaagaaagttaggattaaaaaccttcaaaaaattttacaatccctgatttgcacaaaaaaccatttgtttttttcacaggaaagacacgtgcataaaattctttattgacaccaacaaaacggcggaccaaggcattgaagtggtttgggacggtggaacttattcctctattgggagaactggtgcaaaatggcaacgacttacgctgaacacgaacattgtttgtcccaataatggataatgacaatttcattaaatacatcgcatttttattaaacccaaatgcacaacaacagtgggccatttgttttttgtttgcttgatacaaaagtctagcctaatccctggcgagatattcaaaaaatatatatacctaggtagttaagataatactaaaatggtgcttgaactcaattttatataaaaatagagccctaattatcaccatgatttcaagcccgtttgtgctgaatttgaaaaaaaacaacttggcaaccctggcttattattggatggtgcttgtgcgtttcttaaatccaccaatgggttcgaaagcaaaaaatgggtaatatatatatataaattaatagcttgactccaattctacttaattaatatttcatggtagcattaaatagatttagttgttttctttcaaaatataattttccaaaattttttcccataagtttaaaaaaaagttataaaacattgaacattctaggttttttgcaatggtcatgcatatataattattagcatttacaatttttaagtctttaaaatgcaattgagccaaaattaatttatatatttgatagccctaggaattctcaatttgtctttaaattttcataaaattgcattgattttcaaaaaagttatggacaagaaatgctgacttaagactttttgaaatattatgacaataacttttttttatacttaagtaaaaaaaaattaggaaaatcatattctgatagagaacaattaaagctattttgaatgataccatgaaatattaatttggttgaatttgtgccaagatatgaatttatatacatattacccatttttttgtattcaaaccgattggcggaatttaagaaatacgccaacacgttattggatgcacgattaaattaattggtttatttgcagacaagctccattgcccacgaaattttgcatacactcgctctttaccacgaaatgcatcgtgacgacgcattttacttcctcaaactcaatccatttgatagaaacacggtaggtatatgaaacacatacacgcataattgtggcattaatttatttatttttactttaatttttcattttttatagttttgggtgaacaattatgtaccgctgaagaagaccaacaattttggctttacatacgactttgcatctctgttgcaatatccagctagtataaaaaatgggtaatttaacaacttttttattttcaactattctgatgctttgcccaaattattaacaaaaacaataaaaatgaaaaattcacacctattaatcgattctaaaataattttgcatttacacccctaaatgttaaagcttttgacaactattttcccatttttagagattctattttgggtttttttagaacctagaaatagttattttggcaatttttagcaactataaattgcatccctaatcttcagcatagaaaaattcaatgggtcgcgctaaattcgggatttttatttttatttaacatactaaacctaataaaatttagggtcgggatcagtttggcgccgaccgtttcggcgccgccaactttcaaatgccaaacttttttatttgtcaattaacgttagcaaatctggcatcatttgaatgcagtgttattaattaatagttcatgtaaaaatagaaatacacatcatataagggtaaaaaagtaatgacatgtggcgcacgccaaaaaagccaagaaaaagtaaatttttgaggattgatttttcagctactttaacatgatcacaatgagccgcttttatcagcgaacaattggacatggtggaatcctttcattcaaagactcggcaataatcaaccacatttactgtcgaggtgcggttactgtaaaacaggaatttttatttttgttatttgttataggttactgtaaagaaaagaaaaacgagtgccaaaacggaggctatccaaacccaaaacaatgcaatgaatgcttttgtccaggaggttatggcggtgcacattgtgacgatgtggaacagagttagtgcaaaaatataaactaaaattaaattcaggaatattt

SEQ ID NO: 3239 - DNA, 7570 bp, Heterodera glycines
  misc_feature (7436)..(7436): n is a, c, g, or t
  misc_feature (7475)..(7475): n is a, c, g, or t
  misc_feature (7532)..(7532): n is a, c, g, or t
  misc_feature (7542)..(7543): n is a, c, g, or t
aaaaaagcataacagacaaaattttaaaatgacttttatcactctcaaaaaattattatttttatattgttttgaaacaattgttttttccgtttaaaatgtttttgagaaatgcccaattccttcacaatttttttctgttttgtgttggccatataaatttttaaattcataaattcgttcaatgaaatttcgcgtttttcttcataaaaatgattttttaaatttttttatttaaattcatttcttttttccatttatattttgcgatttatgctgaataaattaccaatttcctctcaatttttatgtcattttttcagttggtattttcctttttctctcattttttctttaatttgtttcaaatttttgaatgatttcatttttctgttgatcatttgattttgttcaatttctatcgctttttcttctcttttatttttgtcccatccctcgccaaatttattttgtcaaaatttggttcggattttgccggatttaatttcataaaataacaaaataataaatattaaaagccaggaattgattttttacaatttatacacgtcataaatcaccactatttaattatagaaaccgggcgttcaaaagtggcatctatcaaaaaaccgtaggaacagtttgatgtttttgttttcaaaaaggaaaataaataacatgcaaaattaaaaaaaatgctgtcagtttacaaaaaagttatggccaaaaaacctcaaaaattgagtttttcttggcttttttggcgccgcctgccatatcttttttacttttgaatgattcctttcaattttggcatttaaatgaagaacacatagagttttcaaatgatgccagattgaataaagttaattgacaaagaaaaagttatggcatttcaaaattggccgcgccgaagtgccccgaccatttcgtttatggttattatcaatccgctcattccgcattgcccagctaatatcaatgaaatcagagtagttttcgagtccgaaaatttaccatcggaaataagacaaaaaaaaattggtctttttcgagtcgatgcttgagatagagactttttcaaaatatttcttgtacacccaaaaagaattaaacaagcaatttaaggttttgtttagcaaagtctcggcctcgggtctcgagaataaaaccgaaaaacccgagaccaaaaaaaaaattcagggagtgattactgttcataatatgtacaattttaaacatttatttaaaatagcatttttaaattataatattatataaagtcaataccaatccataattctaagcagtatgataattacgtaatttgcatttaatgcgcttcattacaacatctcaattgccactctctccgatgccaattttgcctctctccccaggtttgatgccgatttgtgtcggcattgcgtcatctcatttcatgccagttttgtctcccccttcccgattttcatgctaattttgtctctctcccatgtttcatgccaattttctttctctctgcctctctctttctctctctctctctcctctctctctctctctccgatgccaattttgcctctctccccacgtttgatgccgatttgggtcgatgccgatttgcgtcatctcatttcatgccagttttttctccccttcccgattttcatgctaattttggaaacgaatttgacaattggaaacaaaacgccaagcaatgacaaaatgcaaaaggatttgatgattgatagcaaagcgcttcaaagcaaagtcaaaacgaaaaagaatttgacaagtggaaacaaattgccaaacatttgactaatgatggcaaagtgccaagatcaggtaaaatatcaaacaacaacaaaaccgaaacaaatttgacgaatgatggcaaaacgccaaacgatgacaaaatgcaggatttgacaagtgatggcaaaatgccaaaatcagtaaaatgaccagcagaaaggaaaagaaaaataatttgaagaatgaaaataatttgccaaataatgacaaaatgcaaaatgacggcacagaattacttgaggaattcaaaggtatttttgatagaatttttttttttgtaatttaaattttcagcaatactgaagagtgacacatatatgacaaaaggagccaagtaaatttaataaatattcaaaataaatgtcaaataatttaaatttattagggtagggctccgatcatttggggtgagaaaagtcggagttcgtcggtgacatttaggcgagatcgggtggaccaaaagggtctgggtttttcaatttttgccataaattaaaaacaaatgcagccagaaaatttaggaattcttaatgaaattatatatgttttagacttttggacaaaaatcaaaaatttgacaaatatattttaaataaaattttgaattttgccattttaatttttttggcaaacggaatggaaccccaacaagaattaattaaatagtgtaatgcaatactaacaataagcacaatattatcgaaacaatactcggcgaaacaaaattatattttgattcaaaaactttcggccaaagataattaaaagcgaaaaattgaacaaactttttttcttttctctccgtcgttttcgaattccctaattgccttaatctcgggggcaggggtcctatccaaatattaaacaaagctcacttttgaatttaagcgttttggaaacgaaaatgttccaaatgccacccaatacatggcaaatgatttcaaagcatttctggacgaaatgccagaaacagagggcaaaagtgcaatcattgcacttttggcatcaaacccttcgtcacccattttgccaagcgatttgattgagcggctgctgatcaccaagccaacaacaaattcaaaaaatttggaaacaccaattgttcatagacgtcatgctcgtaacggtttcaaaatcagcgcgagtgacatggaaaaaattattaaaacaataattgaaatccgcgtaattctcacactgctgacactttatttctggtattgtgaaaacaattttattttggtaataattatattgatcttcatttggtttgtggtagatttgagagacgacttagagcagggagggagtgatctgaaaattttcaaaaaaatcagaacattttgcaaaattgctccatcaaatcaggacatttgtaataaatcaggacagatcacatccctgacttagaggagggcattattgagaatttgttatgctaaattaatttgtgtgaacgaattactgtcacttgcgatccgattattttggacttttttttgcgcaaaattcatttctttttcaactaaaaattggaaattttctcaaaaattcgattaaaatttaatcggatccttatctatcacaatttcactttcggtttcatcttttttatttaaatttcttttttttttgtggtaactttaattgctgtcactgtttcattgttgctttaatttctatatcaaaactctgtggttatcatttatttagataaaattgtttttattatttctttatttttttgataaattgtagtaacttgttccaatttcttttcaaaaacaattttgattttaaaaatacatatacaaatatgaagacaaattatttttggcacgtttaaaaaagaataaattaaaaaatgccaaaatactaagataatgtaaaccatttaaataaagtaaacacaatcaatctgaatctggacatttgcggcgccgacacttgcggcgcgacatttgcggcgccgacacttgcggcgcccagtcaaaaggacatttgcggcggcgcaaaattcaacgaccccaaaaatatttcaacaatttattaaagttaacagaattgttattttaatagtttattttttctttatttgactaaagcttatcttattcatttttattaataattaatttcttaggtggcataacagcttcagaaaacgtttcacttcgccccacccagcattttcaaagtataaatgggtactgtaataaaataatttcaataaggttcattatcgccatcaaaaatgaggaagaacaccaacaaaaccgtctgagaccttacgaaattgacccaactcgtggaattgctgaaaggccacgcttaaaaaaatatttgagaaatgatgaagcgatccgacgattagtcatcgattttgaccataaggaaaacaaaaaccaagctgatataattaatcacattcatgcgttgcaatatcgcctaaggatgaaaggctttgaagaatgggactgagagagtcattatcaatgtttttaatggaaataaattgttgaaatatttttggggtcgttgaattttgcgccgccgcaaatgtccttttgactgggcgccgcaagtgtcggcgccgcaagtgtcgcgccgcaagtgtcggcgccgcaagtgtcacgccgcaaatgtctgcgccgcaagtgtcgctttgactgagcgccgcaactgtctgcgccgcaagtgtcagcgccgcaaatgtcagcgccgcaaatgtcgcatcaccatttcaacacccagaaattatgtgaaaatttgggttccctttatagaaaaaaagtctatttataatcaggctccccctgattcaatttcaaaaaaaaagaatcaatttttgtcggccaaaaattatcatttcgaaaaaatttatttaagagcaaaacaaataggtaaaaaatatcacttttgatttgggccaatgatttcactgattccatcttcaatttttggtcatttgttttttaattatttttttaaatgaagctcagttaagttttggctggaattttattaaattaaagtaaattgtaacagattttaacctaaattaaattaagatcatttttgtaattttttcttctaaaaacaacaaaaaacatcaaaatgatagttaatgtaacacatctggtaggcttttttataatcatttttttaattccatttgataaaaatatttttattaaaatgtttcaattaagttttttttgcattttcgataaaattattaagaaaaattctttttgaatattttcatcgtatttaaaatttaggaaaatgatgttattttgattaatcaattagtttccgctgtgattttattattttgtatgtgcatatgagcggaaattggtcaattttattgaagtgtaaacaaaaaataaattcagagaatattttaattgaaaaatatgcacagaaaaatatttttctccatttcacagttggcataatccacctcgttttgcattgggcgtgcgtaaaattgggctgaaaatttgttggaaaattccttataaaaggggcatccgccggaccattcgtcatttgaaaacccattaacacaattaaatttataattaaattttttttttataattatgctgaaaatgatttaaattgtttagaaatttgattaaaatttattttaaaatttctggcgtattttccaacaatttgggctcataattaattcattttttagattagtgttctttctaattaaacagaaaagtttcaatgctatcaactttttctattgcaacaattatcttaataaatgttgtccatttcaatgcttttattataaatgaggcaccaacaaatttagcaaacgaacacaaaaagccaattaacgaaacaccatttcttaccgaacttaaaggtgattttgatgaaaattgttaattaaaatacaaatttaatttaggaattatcaaaagtgacaaattcaagacgaaaggcaataagtaaatttaaagcgataattataattaaattaaaaaaaagagttatttcataatttgaccttttcaatctcaaaaaataattaattaaaatacataatttgtaatataaaatttttccactaatttttaaggccattagttgaatgggcgttagaaattggttgcaaaattattattaaaaatttgaacgaaaatgccaaaatatgtgaacaaaatgaagagaaatgtccagcgcaaataacaaatttttacaaaataatgaccaaaatttgcatcaaaaatggtgacaaaaacttaattcttgatgaacatcgagaacaactgacacagctcaaggacattcttggcacacaaactttggcacaaatgaaaaaatatgagcaaaactttcaacaaaatggtccaaatgccaaacaatactcggcattgctccagtttggcgatgatttgaaagcatttctgaatgaaatgcctgaaatggagggcaaaagtgctatcatagcacttttgtcatcaaatccttcctcacacattttgccaagcgatttgattcaactgatgctgatcacgaacaaaatcaatccaaaaaatttgatcaccacaaatcgacgaggtcgccgagacatgcgcgattcattcgctatagcattcattatttggttcattatttatttatggtggtttgggtactcctttttggctggtttggtcaccggttttttgctcgctgtttggcttggtaggaaattttgatttttttagtgatgtaattttagagcttttgttatgctaaatttttggaaaataatttctgtattattttttttttaaatttatttatgtaattttcttttttcatccgcagcaacttttttttttgctattttctgtttttccttaactttcttttaggtatttgcacaaattattttctttttttttacacattgataaattgtagtttgaatttttaaagattcattaaccaactaataatttacatagttttatgcttacaattaactgaacaaaaaaaaacatgattaacttcaaacaaaaaaaaaataaaaaataataattaacgccaaaataacggagaatcaaatgccaaaatttgaaaatcagtgctctcatttctcaataaatgcgcaattattgcactggcagattctctcggttcgtgatgtagtcgaaaatctgcggttgcgtctgcactttgcgaacgaatttgacaattgccgggtatttgtccaaaatatttggctcaaattggcgcactgtcgtcatgtattctaaatttaatttaaaaaaaaaattgaatttgaatttaatttttttttttacccgaaatcacaaaatccacccaagtgattccgttggaagtgaaaaagccgctgcccgactgcttcaacaagctgacatagaccgggaaatgcttctccacatttggcagaaaaacagaattgcgcaacgattgcttaaaaaccaatttaaaaattagaattttaatttaaataattttaatttcaattttaaaaaattggtcgtttttagaaggctggattcgaatccgaagaaaatcgaaaaattaaagttttcgaatttcaaaattttagggtaagaaccgattanatttcttggaataattaatttttcgttacaagacctttncaaaaatttttatatttattcacttaggcttttaaatcacaagcaatttttcattanattttatgannaattatttctcactctgtcgccctgat

SEQ ID NO: 3240 - DNA, 2114 bp, Heterodera glycines
atcaaccttattttgttttttattaaaaagaaatgttatttgaaaactggaaaaaaaattatcatatttgactgaccaaatgttaatcattattaaaatttagaattttgccaatttttgaggcatttggaaatttttttttaaatcataaaaaaattttaaaaattcattttctacatctaatgacttaaaagtcattattttgggggtgctaaataatgatttttttggctctaaaaattttgaaatgaattaaaattttttaaaattaaatttacctccaaaattggcactttgccgtaaactgtgttgtcctttctaaaaaaataaattaaaattacacaaaaaaaaacaattcaaaactcacaatgccaaccattgttttcgcgaaattcgcacatcgtcaaatggcactttggaatagtgaaatatcagtcggatcggctcacagatgccacgcgcatcgaagtagatcagtttgaagttgggcaattttccaccaacaccaattggcatcggcaatgccatacctgctgacgattggttgaccaactttggtggtacctatgaaattaaatattttaattacccatcatgacattaaaattaaaatcatttctagaatgacaaaatatggtttccttaatttttctggcataatatttccgaaacataacgaattttatgaaattttcaaggcaaattagtgatattttttgaaataaatttattattttcctataatttttacacaaaatttccctgtaatttaatggcacacatttaattctcctatttttactttaggcattttgtttattttttttttttaatattacaatcacaggctgttgtggaggcggtgatgctgggggagcagatggtgaagctggtggctgcggtggcgccggcggagcagattttggtggtggcattggagggccttgcggaatagtttttacttgagattttgcttcggagtttgctaaaagaaataaaaatcaattttattttttaaataattttttacatgttcctcctgcttgtccctcttttccatcttcttttggctttgctgcagctgctgatgcaactgttgttgttgaagttgggggtgccgcagtgctggtggctttggcatcggatttttgcttttttgcatctattaattattttaaattatatcttttcttggtgcattaagctgtatgttttaaaaatcttacttaaaaaataaatttcatttttttctatttagcatttttgggaatgggaaattctaaaaatatttcaaatttccttaaaaattgttattcggtatcggtttgattttttgctgtaaaattgtatcttttcctaattaaaattattaaaaattcacttttcataattaccttctttgttcttttttggcgccgttttggccgaagcttttcgctcctttcgaactccttcaccttcatcaaccatgatcattttgtcaatctgttcaatcggatttgcttcctaaatttttcaaattattgaaaatatttttatttaatatgtcataccctttttgtcaaagtgattttgctaatttgggtgccaatttgaacatttgggtcgaacaaattggctccattctctcgcaaaatgccatctccaactttgctgctgtcgtttaatgaggaatccttaatttttttttttataattttcatacgtaattttatagttttaaaatctaattatgtgccactattgagtgtcaaaaaatttatgataattaggcaaattgctttattattaaacataggctcatttttttcaaaatttctcattaaatcggtctaaaaccaaaaaaatttatggtattagtttaattgctttactcttaaaaataggctaattttttccaaattttctcattaaaccgatctgaaccaagtatggcacccaagattgacaaattgttagaagatcaaacattttgtttgtttatttgatctaaccgcagggaagtaaagctcttgaatagtgccgactccaaatttgctgcggttgtttgctgtgtaggccttaattaattgtggtcaattttaaatttaatgtcaaaattaatttatagggct

SEQ ID NO: 3241 - DNA, 241 bp, Heterodera glycines
  misc_feature (158)..(158): n is a, c, g, or t
ctttttcttcctattctcattacttcccccctttttctttttacttcggcatttcacatttatccccttcttttcttctttccattcctttcccatcctttcattcctttgccatggctcttccatttttctctgccgtccttcccccccccagcccncccctcccgacctcgaacaactatagctgggctttttttacttagaaataaaaaaaaaattttatcgtgggacaactgaataa

SEQ ID NO: 3242 - DNA, 4241 bp, Heterodera glycines
gaagagaacgaaggttcttctctcgaaacgtccaccattagagcacttcaggtgatcggaagaagaaaaatggaatttactgatcaaaacccaatttgcctgatcatcgaaggcttttgaacaaattttcggttaatttggccattttaattggtttaaaaccggtttttttttgtttccattttatacctcgggactaaaagttatgggcattataaattaattagtaattaattacagattgattgggaatgactgattttgggggactatttgcggaccaacaaaaactttttcaaaatttttcctcaatttttaagttaattttctgggcagattttatagattatataactttttaaattaattttattttacctaatttatttatgattacactgaatttagctgctgatttggacaattaaatttacttaaaattctttaggacgccaaaatggagacatttatgatcgcggtaaggaaaattttcattatctttactaaaagataagtttaatttttggaccaatgaaaatgaaatattttttttataatttttccatttattttttacttaaatttaaacagatgctcgaacaacgcgacaaaatgcaggaacaattggtaaggcaattatttattactttttattggccaagggacgacggatgggccaaggccaagctgatttttcaaaatttaaaatttaattaatcattttttgattaggtgcgaatgcaaaagtgcgtcgaagaaacggaagagaaatgccgggaaacggagagagagcgagatgtactgagacggcaaattcaccagcagaccaaagacatgccattggtcggcgagcggggggggggctaagcttggcaccaattagttgggaaagtatggcaaaatttgacctggggaattagaaaggctcgcaaatgtttgaactgtttaaggagattccaaagactgggcccgggtgaaaaagtttgataattttttaaattaattttaataggtagctttaattatacattaaatttttttgctgattgttaaattttagaaaaaaggaattccgaactaggccggatttgttaaattattttggtagatgaaattaatttgaattaatttgccaaactgccattggacaccattttctgaaatgcatctcttttttaaaaattcaaaagaaattttcgctataagatgcaaacaaatgaggcattatattataaataaaccattttttggcaatttaggaagtgcaaaatttgacccacgaattggtccaatgccgggagcaattgtacgagaaggaggaggaaattgtggagatgaaggcggaacggaacaacaccagactgttgctgtcagtgaatttgttaaacacacttttaatattgttccccgctttagggaacacttggaatgtcttggtaagttgggcatatgccgaaaaattcaaggaggacgggttaatggcattttttgattttctatcggttttcgtttggcatttgactttgttttctaagacggaaccggtgccagttcgcgcctttacttagaaaggaccaacttcgtttctcgatgggtgttcgaattcgccaccctttcccgggttttcggggctctttttaaagcttgggttttttactaccaatgaaaaatggtagaaaagtcgtacataggacccgagactcctcttttagacttaaattggccctgggcttattaatccctttctgttctttggttttttcttaattggtaatgatacttttacaatattccccccccccccctccggcacagtgtccaaacatgaaaagtctctgcgaatgactgttgtgaagcgccacgcgcagtccaaccgcgacaacagcgtttcctccgaggtcgaagtgctcaaggcgctcaagtcgctgtttgagcatcacaaagcgttggacgaaaaagtgaactccgtaaaatgaataaaataattaattttcaatttaaatgtcatttttttaaatttaaaaattaactgcacattttccataggtcagagaacggctgagagtgtccattgaacgagtgcacaatttggagatgacactcagcgcaacgatggaggacaacgcggcactgaaagcgcagctggaactcagccaagaacagcagcagtcggcagcactgcaacaccaggcagaacaatgcccggggaggggataattaattgattagcccatgttattggacaccttttatgggaatgattagcccactttatggggtcccaattttattggccttgaaattacattaataaattcggctttattttaaatatgggcaaaaggggaagccgaatatagagccaataattgggctatttgaatgttgccatttatttttcagcgtgtgccaaacggcgatttgaaaaattctgtcgatttctgcgccaacggaggcgctcaatccgccgctgttgttgagctgcaaaaacaattggacaggctcagccaggagtatagcaccagcatcaaacagaccaacgaactcagctcgaggcaaaaattgttttaaaataataaattattacaattttatggccggggtaaaaaaagcgagtggaaaacaaaaattcaactcccgttttaatagtgattttaatgactaaattcaccaaaaaaagagatttaggttcgacaatgccgataagcaccgcaaaattggaattttaattgatttttttaaaggcatttaatttttttgaaaattccattttctttccctatttttactagctaaacaacaaacattaccaaattaatcctatatacccaattaatcctataagtcatccaaattatttttaggaattccgaattgcaaacggagctttcaaatgccgaaaaggaggcgcggcaagccaaagagaagatgcatagcattgagcagcaaatccaagaggtgggacataaatggaggaagaaagtatgaatatgcattccctggatcatcaaactcatgtcccaaccggtctttggcaaaaaaaaaactcgagaaaagccaaagccactaaataatgttgtgttgcagttacaagcccagcgggacgagcaggacacgcgcgtgtccgtgctggaaggacggatgatgggcgcgcagcgggagacggcgtgcatccgcgacctgaatgacaagctgatattccaggcaaaacggggaattttgaatttatttaaattacaatcaaaatgaattaaatccgagcatttatcttctctttaagattgccaacaaagacgcggccattcgcatcagtgaggagaaagtgcagcagctgaaggaacgcctcgaacttgcggaggcgcaattggcccaaagtttgaagaaggccgagtcactgccgtcggttgaggcaaatgtgtttttttgaattggcacaatggcttcatcctgccaaagcctctgagattgcttttaaatttgggagatttaccgctttttattctctgttttaggccgaactgttccaacggatggaggcattgtcagcagcggaaaaggtggacaaaacgccaacaaatgagaattaataattattaattttaaagaagcaattgtcagcggaggaacgcattcaccgaatggaaacgcttttggaggagaaaaatgccgaattggagcggacattgcaacgcgaacggattaatgagggacacaatgtgaagaaggggggggggggggaagacgatttgccaaaaattagtgggggaagacgatttgccaaaaattagtcataactagggctactatttatagctctaaaaactagagtgccacgggaccgggaatttttgccaaaaccgggaccgggacttgccgggacctgagaagccgggaccgggacctcgattttttttcgggaccgggaccgggaccgcaagaaaaaccgggaaccgggaccaaccgggaaattttaaaaattcaaaaaaattttaaaaatttaaaaaattcaaattttaatttatatcaagtgaaaataatacaaaattatttggttttttatttaataaattaaattaatgaaaattttcaaacaaattttcttcaattatttcaaacaattattcatcgaatattaatagaaattcagatttgattttcacatcactttttttcggacgttttttcaaaaaacttttgggaaagaaaggggtccggcgttgccaataggcgccgtcgggggg

SEQ ID NO: 3243 - DNA, 2321 bp, Heterodera glycines
  misc_feature (62)..(62): n is a, c, g, or t
  misc_feature (2193)..(2193): n is a, c, g, or t
  misc_feature (2294)..(2294): n is a, c, g, or t
acaaagacgcggccattcgcatcagtgaggagaaagtgcagcagctgaaggacgccctcgancttgcggaggcgcaattggcccaaagtttgaagaaggctgagtcactgccgtcggttgaggcaaatgtgtttttttgaattggcacaatggcttcatcctgccaaagcctctgagattgcttttaaatttgggagatttaccgctttttattctctgttttaggccgaactgttccaacggatggaggcattgtcagcagcggaaaaggtggacaaaacgccaacaaatgagaattaataattattaattttaaagaagcaattgtcagcggaggaacgcattcaccgaatggaaacgcttttggaggagaaaaatgccgaattggagcggacattgcaacgcgaacggattaatgagggacacaatgtgaagaaggggggggggggaagacgatttgccaaattttgcaataaatatcatccctagtcatagctcgtgccagattttaaaataaatgcaaagtctaaccctaccgattggtgggtgcctccctgggaaattattacaaaaaaaattatttattttttaataaattctaataatataattaatgtaaacctaaatttgctcagaatcgcctctccgccaccgtcgacaaattgttgagcgaatcgaatgaacgcctccaaatccatctgaaggagcgaatgcaggcgcaaattgacaagaacaaactgatgcagcagcttgaccaggccaagaaaatgtttgaccaggtggccatttgacacgaaaatccggccaattaattatatttaatgactaattaattattaattaatgccccttgacagacggaacggttcaaagagcggctgctgcgtgagaatgacgaccttcacaaggagatggacatgctgcgcaattccctctacacgcagcggacagcccaattttattcccggtaattttaatttatttatacattaattttatgattactatattacaatttgcctttgcttagtctcaacaatggcgcggttggcgccggcatttgcgcttttcccccaccgtccgctgtgtccgtcggtgccgctgtcggggtgccgcatcatccgctttatcagcaggcgccaatgccgccgtcctatcccacgcaaagtgtttgcgccatggacagcgaggacagcggagcgcccgcgtttaagcgacgcatgcagaagggacgcgtcacggcgctgcaggacgatccgggcaaagtgcaaacgctgggcgagcaggagtgggaccgcattcagcaggcgaacgtgttggccaacatccaacaggtggggactccaacagcaacaaggaacaacaatcagcagttggaaaattagccctcaaatggacccacaaattttattgaattttcaaaaaaaaaattccccgcagggcttttccatgttcgatttgcgacgtttcactattcagtcagtcacccataaataggattttttcaaaatttaattcaaaatccttttaatatttatgaaattggggtacatttcattcctccacaccttcatcattcggcactcccctttctccgttattttaatttatttaaaacatttttaggctttttccacctcttcttcaatgctcaatgtgaacgcggcaccgccgcctgcgctggaccaatcgacgactgatccccacacattggcctatttcattcaggaccgactggacgcaataaacaacgaaattcggctgatccaagtgaatgcgctgatttcaactaaatttactttaatcaattttcgatttgctattaaatttaattttgcatatattttttccattgtgaaggagcaaaagcagcaggcggaacgcgtcgctgcggaacaaagccaagaatggccaccgaacggcgccatttacgagtacggcaacaacaacaacaacgcgaacaacggcggatactcaccacggcaacaacatgatcaacagcagcaatattcgctaatttcaaaatacaacaatgtactgtatttcttgaacatactgtaccgagttgaatcactaaaacaaacaaaaactcagtcccggatttaatctgcaaaaacaggacaaaaatcctatagttttctaaggctttttacggacaagttgttcatgctattccaccggtattttcagggnataaatttattggagtgccacaaaaattttgacagcaaaaaaaaaagagaaaaacgtcttccttatttttgctataatttagctaatatctctttcagatntcccaggagcccaccacttcatatgcc

SEQ ID NO: 3244 - DNA, 2438 bp, Heterodera glycines
  misc_feature (25)..(25): n is a, c, g, or t
caaaaaatatatcaaaaattaattntgtaaaatattcaaatgtgattctaagcctattttggtcatttttatggcattttgtgcctatttcactttttacgaagaatttttttccaaaaaataaccattaaaaaaattttatttacatattttagtacatatttgggggtttttgtacatatttcatacatattttagcattttttatacatattttatttacatatttcgcaaattttgttacataaaattagcagccctaatgtttacatatgctaaggcaatgaaaagggatacagagaaagagaaaaagtgattaaatagagaaataatactataaaaacaaaattttttaataatgtgattattgtagagccgagtttgaaatcaaaaaatggcgaaggggtgtcatatgtgacggcatcattcgtgacacggcgattcaattttgggctccaagtacaattaagttggttttttcgtcttagtggtctgtgagttagtctacaaaaagggggtctcaggttcgaatccaattttaagttttgcaaagttttggcgttcttattcctaaataaataataaacttatttgcactgggagcccaaaattgaatcgccgtggtgaaaaggtagttaattgaaacgagcatatgattaatcataagaaaatcgtgcgccacttatgacgcgtcgcagatacgatatcatatcggcgatatgataccatgacatgcctaattgaaacgcgccaatgacattaggacacgtcatatcatacgtacttcgaagaataaaattgttgatttttactaatttggacatttcttgagttggatactttgtagcttagcgaagaaatacgttgatacaaaaaattttgaatttgaaagagttaaacattcatactccatcatctggcatcactatggtcaagcccaatgttagacaaaattgctgcaacgccgaatagcgtaattggcgtaagtttttgcgcactaaattcaaatttacactagtaatgccttttttgtattttttattttgatcagccataactcgcttcattcccaactacctaaactgaacaaatttgtatttaaaaaaagattttgaaaaggaaaatctttttctaagcgaatgctaagcaatttgacatctcagaaaaaagttatgagagtcaaatttttatcaggttataactcaactccaaaactgctgttttctaccaaaatgcgaaaaactaatcattttttattgattctaaatgtccaaagtagagttgagcggtaatcggtaattgtaaaaaaaccggtaccggtactgaccggtaatgcaaaaaccggtaccggtgccggtaccaactttttccaccggtaccggtaccggtaaaaaccggtaattttccaacgtaaaaatttttggacaacaaaatttttattcagttttcgcgcgagtgcctgttttttagcattagaattgttcagaagtatatgtatttgagggtgaccaagtttttttttcaaattcaggataaagaacactaaaattcagatgtagacctcaaaattcagattattgcaaaacaagggatcagcggccaatttccaattttgcgaaggggtctccggccatgtaaattaatgtaaatcaatgaccttttttgctttcaacaccgcttttttcgcggcacgtaaaaaatttctccttcttcaccattccctactcttttctcacccagacccccattcttaccagtgcaaatttttaccggcggtaccggtactagacaaaccgggtaccgggtttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatgggattacacacatgcacatgtggtgtagtggttaaactttctacctttcataatttttcgcctgggttcaattccccacttggatagaatattcctcacattttctttaccattattttaattaaaattttaattttaaaaaatattccaacttttttctttcatgttaagcatcctaaaaacccaaaacttaatcaattggtcattttttttacaaattctgttaacaaatcgcattaaaaattacaaaatttttcccggcggcgcctatcggcaccgccggccctccttgtcccccaaaagtcttggaaaaaacgtgccgcgtaaaaagcggtgttgaaagcaaaaaaaggtcattgatttacattaatttacatggccggagaccccttcgcaaaattggaaaattggctgctgaccccttgttttgcaataatctgaattttgaggtctacatctgaattttagtgt

SEQ ID NO: 3245 - DNA, 7142 bp, Heterodera glycines
tgaaccattgaaaagatgaaaaggcattgtgccattgtcctctagagagtctcggtatcgattctcgactcgagaaaagcttcgggttttttcgatctggtctctttttcaagactctaaattcaagaccttctagacttttttactccctaatgattgtcttttgttaagacttaaaattaaataatatttttgaaactttttgctttgctgtcacatcaaaagtttgttgttctcaaagtttttttttgtgattgtttttgtgttggttaagttcccctccaagaagttattttatttttgctctttgtttttatatgttttgagagaattaattttatgtgtttttgcacatttttaaatataatcacaaattattagaatcgaataggagagttttttgtttgaaaaattttactggcgtccggcatccaattcttttagactttttaaaatatttcactaaaaattatcaatctagggagcgctgaatttataatattcatttttaaaaatatgccaggaaaaaaattcaatttaaaacacccacattttagattaaagattggattggtaaatatgtaactaaatgaaagttcaaaaaagcaacaatttgttaggattttatgtgaacaagaaaatatttttgagaaaagtctcgtgctttcgatctcgcccagaattaatatgccactaatagaataattaattttaaatatttatgcgacaaaacttatttatatttcttgtataaccaaatttaaatatttattatccttgatacttttagcttttaccatttgcgatttttttttaggttcggtctagcaacttttgaaatatgtatatgatacctgacgaaattgtagctgatcgtgtcgaaggtgggcaccaaattcagctcgacttcggtgatgacgccaaaggcgcccaacccgcacgcgacggcacgcagttcggcactctccgggccaaaagaggcttcagtgccattggccagcacaattcgcatggaacgcacttgagtggccaagttggagttggtcagtccgctgccgtgggcacaagtctgagtggcaccggcgacggaaatgtcggcaattgcggccaaagttggcaaagcgaaattgttggcatctgtttcaagcatatgaagcataattacaatatttgcaagcactcctttcaactgacaaagtgtcggtgccaagtcagtgtaagtgatccccggctgcaccgttacggtcgatcggcttccactgatggcaatgatcgaattcattccgagcgttgacaaaagcgtgccgcaactgtccgcaattttgctgaaactgtgtcgagtgccgaacacgcgcaacttttgtgcccttcgcacaattcgttgcacttcggcggtggtgcgcggatattcgacattttgggagcaaaatttgaaattgccgccccaattgtgaagcctaaaaattgaaaaaataaaatgttaaaaaaaaattaattatgggcaccgtattgcatcgctttgtccgctgctttcctttgactctgccgatgaagatgcttcttcagatgatgatgatgcttcagatgatgatgatagatgatgatggataagctttcatcgctttttttaacaaacaaaaatattccgccgccgtaagttttgtccgccaccacaaataaaaccaaccaaaaattgcacaaaaaatgcatttttattttaatactttcaatgcttctcaaatgtcaaaatgtggtgagggaattgcctttcttctgattgagttccaattaatgcttaattaagctgatgaaagtgtccgctaattctctgcgcttttatttccattttttttgtcctccgtttttcttttccatgtgattttcaagtttaaattgccgttgaaatgacgcatttccgttttgtttgaacattcgtaaaatgaaattgcaatttcaaaatgtttgcacagcttaaaatgattagctcatcaaatgtgatgaacgttgaatccgattaaataaataaaataaaataaattaattaatagcttttattacataattatttgttttatttccagcaggggagcaatatgtctttttttaaagatttgtattttatttggctcagcgcgaaatctgaaaaaatcaattacaaaagcatccattattttaaatatccttaatttttgaaaaattggctcaaaaatttaattgaatctctcaattagtggaattaataataattttgaaagaaaaaattgcttttttacatttaaatttttgctttatcatttttaaagtacaactttgaattttttcaacaaacttaactcaaaattaaaattaaagttttcttataattttttagaaatttataaatttattgaatcgccggacaaaaaaaaactgatcaatcccttttaaacagagaaaatgggcgaattaaatgttgaagaaaataattgttgatggagactgtttttcaaattcaaattttttctgctagcacaacaagtggttgttcggtgcgaagcatttccgaagagagcaatttgggcggatatttctgagtcataaaaatggagattaatttggaaaatggaaatctcaccggtgtgtttgggccgggagagaagcgaagacggcgaacaatcagtgccagcgcaacttgcatttggaactcggcaaaacgcatgccaatgcaattgcgagggccaagcccaaaagttaaaaatgccaacgaatcaatttccgcttttcgctccggcaaaaatctgtcaaggatttcagcatttaattaatgcaaatttgatcacctcgtggggtcaaatttgaaggggtctgggaaaaaggcttcgtcgtgctgaatgacgtaaattggcaaagttatcaaatcgcccctttcgaatggcacgccgtttatgacacagtcggagttgcacacgcggttcatcctttacgtgaggatgatcaataagttcatcaaattttttaattaaggtgtaccaacttgggcgccaccggaaacattcggagcgtttcttggacaaaggcgcggaggtaattcattcgtttcaaatgctcgtaagtgatcatttcctaaatttaatttcgaaacgaaacactgatttaaataatattcatttttctcttattcaaattctgcgcacattctctcccagcacgtcgatcacttcctctctgagtttttcttgaatttctgactcaatcgccaacatataagcggcaaatgaaagagtggcgccagtggtttcgaaacttaatccaatattgaaccaattattgtgtttctcctatttctttcatttaattacagtaattaattacgctattacccggcaattaaaatgatgaaactttgcgcgaaaagttcgatcctggtcagatgctttccctgttgtttctgctgctgctcattgcttctcaattcgctgtgaattatttcggcgtcgtctgctgaaattgtaaattcctcgtcgtccaccgcattcatcaaaagttggaaaatgtcggcgtatttctgacaatttactaattaaatatgtattaattggttaattagccctacttcttttgcctcggggtcggcacggcgcttttcgtaaaggtcgctcatcatttccatgaaaaactcttcatccatggcaaaagcgaatgatttgccagtgatattttcgtataaaagtgagacgcatgggaaaaacacttaaaattttttttaaccaatgcgacaattaaccaaattttaaaattgctttgaaagcgaagcgaaaaaaatagccaaagaaaaagcaactcattgtcacctttttttattgttaagagacttttgtatttgttttgaaaagatacataaacagcacttttttgattagtgctgacacttttagaaatccgccaaaacagtcagaaaatgaaaaataaaataaatttaaaataatagaaataaattaaaaatttatcgctttaaaaccccaaaatgagagggatttcaataagatatagcaagaaatttttttttgttttgaacgcggatttaaaaacgcattagcaccttctctcaagtttcaaaaataatttcagcattgtttgtttatccccccgccccctttttaatttgttttaattatgctaattatgtcccccattacccccgagaatcattcgcaatttttgtcccttccgcgtaaagtcaaaaattgttcgcgcctgcttcacaaaaatgttttcctcgtcaaaagtgtccaaatccaatgaaaacccacaacgcccaataacatccaacagaaaacggccgaagagactgcaaaaaataaaattaattaaataaaaggcaaaagaaattcccaaaatttattaaaaaacttcttttttgtattactaacaaaaatcgcaactttatttactattttcttggctttttctacgtattttgtaatatttttaaatatttcgacattttttgtgaattttattattttggatattttttgaaaatttgtaaccttaggcagtttttcgtacatattttgccactttaacaattatgaaacataaaaattggatcactattaaatagcaatgaatcagaaaaagtgtaaaattctttttgatttttttaaaatacaaatcgctttttatttgttagcgatttttttaaattttcgtttaaaaattttcaaaataaaaaattggacaaaaaccgggacactttcaatgatttaataaactttaatgagtttgttttgccattccttttagacttccgctgtgccattcactcactctttcaacggcacttccttccccttcagtgcgttttccgtttctaacactttacaaagtttttcggtgctttcgcataaaatcggaattaactgaaattgaacaactgaattatgcacttaattaggctttcatccttcgctaatcacttttgttatttaaatttctccattttttactgagtgacccacttttttcagttttcccgtcgtaaatgccggcgttatgcgatttcgcacgcgtctccaatcgtcgtcgcgcagcacagtgagaatattgcgcatcagtgattttggcgcgtgttcgcgttcgggaatggcattctgtgtcatttttttaatttgatgaaatttttgagagatccaaaattttatttggcttaaatcgatttttaaattttcatccataaaattacataacggttctgaaagtgcgagaattctttgatgaaaatttgtcgtaacattttcgggtctttggtgcaaaattcgcgtcgctcaaataaaaacgagctgaaaataaaagaataatgaaaataattccaaataaaaaataaataatatttatttaatttattacccatatgaattcccatattttttgaacatttcttcgtcaacctaaaaatttattactcaatatttaattttatttttaatttcgtttttatgacctcaattacgccagtgcgaaattgtttcaatgtgttgccaaataaaatgtttgtatttggtcccggcactccgacattatgccaatgttgtttttggcggtattgaaagctataatttaaaatatgcaaaagcaattaaatatttttaagaataatcttaattttttactaaatccacgaagcgacgataaaagagaaaagggcaacaaaaacggagaatgggaagattttgtaaacaattgctgagctaattaggacaagcaaaaatcggtcaccgatgccaaattccattaggaaatgcctaaaattttaattgatttatttaaataaaaaatataaaaatcattctattatgtagaatagaaagaggaattcaatttttaatttgaacgtttgtttacctcaagaatttcctaattaggaaaaattatttggcttatcgtttttcgtaaatgtttgattttccgattcattgcgcaattaggaggagaaagaaaacaagtttcgagaaaaagataaataaataatcattttggaatgcacaaagtactgaccaactcacaaaattaaacagtaaatattataaacacattctgagcatttaaaaaaagacaaaaacacgcggaaagagccgagaaaacgccggaaatgtttatgtaaaaaataattgtacttaaaaaggggagaagaaaaaaatgttattgtttatatttgccatatttggtggaaatgccattttatgtcagtgtgccaatttgatggctatcactggccaagagttgacatacacgagaaagcagcagcaacccgagaaaacggaatgttaccgaaggaacagaacagagacctggaaattcaactgtgtagattccgctgcgggattggattttatttttgcgggatgggatcccgcgagatttatcctgctaagttccgcgccgatctctagaacataactggcaaaacacattgaaagagctgatttgaaaattaaggataaataaaaaccacgggacggcgaaacggcgcggtttttcgtaaatgtaacgggacataaaaagaatcaaagaattttattttatacaataattccgaagccattctcatggcatcaaaatgtaaaacagtttttaaggctaaggggtaaaagtcatttaaacaatttttgattaaaaagtcagccgacttttgcggattgagctgttaaaaaatctttaccagagaccgacacggaattataacgattcgatatttatttaattggctttcggcccaaatgcttaaaaatatataatattttttcaaagaattgaatttgttgcgcaattcctcaaaagatgaaattttttataaaatttccttcgttaatccaaggcgaacatatgaaaatatttacgagtgatttccctcaaggaatactcggaaatcgagttaagactaggagaaaggagaacgaactctgcatcatcatacttcagtcgtgaattaattttttaaacatttatataaaaaaactagctaattgattgaaaaaagttcagctgttgggaagaatattcaagatggaaacatacgccaacaaagtgaacaggtggtgccattctgtgttcatttgaaactacaatattcttacaaattgcatcatgatcattagtgatat

SEQ ID NO: 3246 - DNA, 2902 bp, Heterodera glycines
tttgcggattgagctgttaaaaaatctttaccacaatccgacacggaattataacgattcgatatttatttaattggctttcggcccaaatgcttaaaaatatataatattatttcaaagaattgaatttgttgcgcaattcctcaaaagatgaaattttttataaaatttccttcgttaatccaaggcgaacatatgaaaatatttacgagtgatttccctcaaggaatactcggaaatcgagttaagactaggagaaaggagaacgaagtctgcatcatcatacttcagtcgtgaattaattttttaaacatttatataaaaaatgattgaaaaaagttcagctgttgggaagaatattcaagatggaaacatacgccaacaaagtgaacaggtggtgccattctgtgttcatttgaaactacaatattcttacaaattgcatcatgatcattagtgatattggataccaaaaacttttaacgagtcgaagaatcgggatcgagtgatcaagagatctgagacgagacttaaaatcgtgactgtcgaccatcgctaatgatcagggcttagatttatatggataaaaaagcagaatatagtagaattcacaaaattcgttacaaattaaattaatttaataaacaaagtttgaataattaaattaattaaaatcacaaaattggttcaaattaaatcacgtaattactttgaattattgaacagattacaattctgtcaaatgaacattgcaaggaaaagcttcggaccgtcaaaaagaatggacaaattccgcagatcccttttttgtgtgcaaattcgacaaaaaatgcctttttgaatgtgagcaaattaattaaaattcagttaaaaaggtttaaatatatatatgcatatactcatggaaatccaattcaattgcaaaaaaacggacgcttttatttgctgggactgtcgaccggcggcacaaaatgagatgagttgccaattctatataacatatatttaataaataaaattcgattgatttttttaattgaatgcgtggcaaatataattaaaatccattctcagttttcccttatcattttataaatttgcattttcatataaaatttatgcccattcgagaaaagaaaaattgaaatttatacaatgaatgggaaaaaaatcagtcgctttaattatttttatttctttgtacttttaaattttacaataatttttgcgaaattgccgaaggcattgtttggtattttattttaattcattttaaatgtttaaaaatgttttccgtaaggcataaagctgaaaagtcttgaggatggatatatccgtttgctttttgaccatcaattggatgacaatgcgcgacaaaaactcagtgcccaattgacggctgttcaaatttgcatggaaattgaaaggtacgaaaattacttattaaaaattgaaatattattaattataattccattattaatcccggggttttccaatgtttgttcatttttttaatttggcaattattttcctgctggcaattttcattggtacttttttttgtgatcattcagactttaaattttgcacgcaaatcaggtgtaaataggacttctgaattagtaaattgataaaataattaatttatttacatattgaattattttgggtttaatttttggaataaaaatgccgttaaaagaaaatgacaaaaatatttttttcattcagaaatttaaaagaatttgattttgagtcgaagaaagtggccaatttggagagaaaaaggaagacaaatttaggcaatttggaaatgagcaaacattatgaggagttacgtacaaaaattgaacaaaaaattgacaatttgggaatggttgagctgtgcgaattgtgggacttcgcgcaaattgtgcaaaccgtaaaatgccaatttgagggacaacggacggcacagggaaacgtcaaagtgttgaagtcgatcactgtggagcgaaagtaagcaaaaagagaagcggcgaaaaagctttgtagtttttattttgattttgctaattgtttcattttaacattttaagctacgattgcgcggaattgcgccaaattggcaaaggaaatgagccaaattggatttctgactttaagaaggaaattgcactgaaccatttcgcatacattggctccaaattggcatttgatcaccacataaagtgcgacttttccgcatggtttggcgacgcaaaaatcgcaggcgaaagcgaattgtcgcatcgcttccgcacgagcagcacccaggccaattttgaacagattcaatttaccaaaacgatgctgcaaaagcatttgctgaatgtggccgatttggacaaactgttgcaaatagcgcatccgatcactttggctgctggtgagagaaaaaagcggcaaagacccaaccttcgggcaattcgggacggatttttgaaaaatggccaggcccgtagaccccttattatttattttgaattttaatttgatttttagatgtgttcacagaaagttcattcgcttttttggtcactggaatgtttggtgatgaaccgaacaatgcaatttggctcgaatatttttcatttctcggcagaattttggcattttttcggcactttaaaaatgatgaagccaaacgagcggagctaaacaaattttggggaaagacagccgcaatttttgggcgggaaaatgcaatgatcgatgagtcatacggcgaaatgaatttaattttaatcaaagaatttaaattaattttaaccgaattggtgcgcacttttggcactttagatgagacagtgccgtacacaaatttgataatgtcttatgaagaagacttttctcgccttatcttagacaatagccaatt

SEQ ID NO: 3247 - DNA, 1285 bp, Heterodera glycines
caaaaaattccacgacgacgactcgtataaccaataaaggccatgacgacgtctcgtataaccaaaaaaggccactacgacgactcgtatacccaaaaaaaggccatgactcaatgtagtgtataaaatgtgaattttggtgaaaaatgaattttagactttttttcgaattttgttcgaattcggggtctggagtcggattggaacaaaacagatgccaaaatcgatttccccgactctgaaaacccctaaaaacaagtttttatcaaaaaaaattttttttgaaatctggacacagataaccgtaaagtaccgaaaacttttcgcaaccctttatggttttttgaaatttttaaaatttaattgataaaattggcattatgtatataatattgttttgcttgtttttgcatgtcgctgacctcatctcactgttttgtgtttgaacttgcgaaaataatagaagtgttttgcgtttgttagagttagtttcgctggaaaaggacaaaattataaatctgctgactttcataaaagcattaagtaatttgaaaaagctaaagttaaaaaatgcaaaaaataaattgtagatttaataaaattggaaaacagtaaaagccaagtcgttcaacaattacatcttgagttctgcctgctgaatctccacacttttgctaattgattcctttcgaatgatgatgaccaaatctgctaccaccgatggtgggggtggcaccgccgctgcctcctctgtccaccgactccaatcgccacaaaaagtaccgcatccgccaccaaagaagaggccagcgccagaaacagtgccgcaaccggcggtcgccgaagtgccggctcttccgggagcaccgccgcctgccaaattccgaaaacggcagagcagtttctatgcacatgtgaatgtacgcgacccgctcaacctgggcaatgttagacccggtgagagaggcggcgccataggttcgggcaattgaggcattgaccgaatctcgaattttttgatcagtattagagagaggttaagctgaaatttccgaatttgttggctgagagacggacattgggttatcgaactcggatttggattagtaaaacatttacttccgaaatttactagagctcggaattttgaaaaaagcctacctgtattctgtacctgtatttcctgtagaaaagtacaggaaaatacaggttttttcgtgtttagctgtacctgtacctgtactaaattctaaaaatggcctgtacctgtacctggatccaggaa

SEQ ID NO: 3248 - DNA, 5876 bp, Heterodera glycines
atgacattttctggtttttaatgagtttgtgactaattttagcttgttttaatcaatttaggaacaaaactgagaattttgaaaaatttgaattttcgactttttgttcgaattcgggtccgggattcaaaattgagcgaaatggataccagaatcttgatcaacgacaacccggaaacccctagaaacgtgtcttgaatgactttaaattttaaaaatttccaccaaaaaataggggcaaccatcttaactattaccaaaatctctaccgaagtgaatgtgcaaaaattaagtaacataataatattctattttcgccggtagagaattttgtgctctttctgataggcttactaatttttcaaagaaaacttttcgcaccctttatggttttttgaaatttttaaaatttaattgataaaattggcattatgtatataatattgttttgcttgtttttgcatgtcgctgacctcatctcactgttttgtgtttgaacttgcgaaaataatagaagtgttttgtgtttgttgtttgttagagttagtttcgctggaaaaggacaaaattataaatctgctgactttcataaaagcattaagtaatttgaaaaagctaaagttaaaaagtggcaaaaaataaattgtaggtttaataaaattggaaaacagtaaaagccaagtcgttcaacaattacatcttgagttctgcctgctgattctccacacttttgctaattgattcctttcgaatgatgatgaccaaatctgctaccaccgatggtgggggtggcaccgccgctgcctcctctgtccaccgactccaatcgccacaaaaagtacctcatccgccaccaaagaagaggccagcgccagaaacagtgccgcaaccggcggtcgccgaagtgccggctcttccgggagcaccgccgcctgccaaattccgaaaacggcagagcagtttctatgcacatgtgaatgtacgcgacccgctcaacctgggcaatgttagacccggtgagagaggcggcgccataggttcgggcaattgaggcattgcccgaatctcgaattttttgatcagtattagagagaggttaagctgaaatttccgaatttgttggctgagagacggacattgggttatcgaactcggatttggattagtaaaacatttacttccgaaatttactagagctcggaattttgaaaaaagcctacctgtattctgtacctgtatttcctgtagaaaagtacaggaaaatacaggttttttcgtgtttagctgtacctgtacctgtactaaattctaaaaatggcctgtacctgtacctggatccaggaaaaatacaggcctggatccaggtacaggccgatctctaaaatttactaaccaaaatttcaagaaaattttttgtttaacaattgacagaaaatccaagatttttttttttaattttaaggggtggaggtgcagaaaaacagaggcttttctgattttttccttatgtttttcgttttagacaacccggacgacccgaactttgccaagcccatccaactgatcccgaccaatgtgaacgatccgttgaatttgcagaatttgtcgtccgccccggcagatgccgaagacgaggcattgccaacagcagcggacgcccaacagaggcgaaagaggtgagcaaaaggcacaaatttctgaggcactttgaccaaggttttttttttttgtaaatcttttacatttttttcacaaaattaatcgtcctttttcgagtcttttttgttcggaaaacaattaattacgaacgctatgtttgtttattagtcctctggaacactttcgactccttttttggctgattgagtgtgttcgccaaataagtactccgggactgaattggtcggctcattatttccacgtatttggaaaaacctaaaagttctctctgcaaaaaaaggcaagaaagacaatgcaatcattaagacctcttatcattgcaaaaacaaacaaacgaacaaaaaaacgcacaaccgaggacaagtgaaaaagacatttcagtaccaaaattagtgtttctgtcttttctattttatgggtacacaccaattaaaaaccaaaaacaacaaaaaaggtcaagcaaattcataatcgatgcacaaaatgaattaacatgttaaataatcagaggctctgctccaatttacgcgttcattcattcagtgaccatcctctgtttcttaggccacaactttttcttacttggtaaatgccaacatttctggtatcaaacgaacactgaaagtttatagaatttataaatataagaaaaatataaaaattgcaatgggaaaaacccgaaattcagcaattttctagagtatcttcaagaatattttttttctgttgatagcccagaatttagttatagagtaaattctgatgatttcaagctttacttgataccaaaaatacaagcattgaccgagtaagaaaaaaagttttggtttagaaaaacacgtaaaaaagtacggccaaactctttaaacaatctcctgaaattttaacccaaaaatctgttgcccacaggaagcgcattcgcatacaacagcccaaggacgaggcggacgagcccaccacgtcggacgacctcagcccgcctccgccactgtccgcgcctcaagagatgaagaaacactcaacgacccattgcagcctcaggacgcggagggcgatcactgatgagaaggcgggaagaaccactggtgatcaatcacaatctttgttgttctgcatattttcatttcatgttttgttattttttgtataaatattgcacgttttgtatttttttaggctccgattggattaaaaaacaagaatatgtttatcaaattaaatcatgacgaataatagggtctattcttcggcggcggcccaagtttttggaaaatgcatgcacaagggttcttaaaatttactaaattttaccgatttagcattttacatatttattgttttttaaatccttaatttggtgcccaaacttcatgtcgccctttatatatgtacttgaaaatcttcgtattttgtgcaagtctaatagaacattttcgaaaatcgttcgacgcgatcagacacatttttatttactttacgttttgaaagcgacaaaaaaacaaaaacataaaacaacgtaataagttaaaatttaaaaggcgataaattgtgtgtgtatatatatatatttatatgtttgtgtaagatgagttaaatgttagaaatccatcacttctccgaacaaaatatgcgatgggacgcggtgttttctggaagacgttcatttcttttcggtgtccttaaattaagaaattgcaaaaaattaagtaatgcttcttcggcggctaatttgggaaacaaattgacccatgggaaaatattacaattcgtatgttttggggacggaaccaattctggaccaaatcagggaatagtgctgctttttgcttcgtgcttaccaggggaaccaaaagtgtcgcccgtcttttgcagcaattccaaccaaattaggaaataattcgctttaaactcatttacctttcgcgtgttgcggcgagtgaagattgttggcatgcgaagtctcgagatgtactccttcttttgcggtgacttttgctcttccggttcgacaatttcagcgtaatcatcttcttcgacctcaacataatttttattagataaaaacaatttgacttttattccccaaaaaggaatgacattatgaaaatttgggttgactgaattcccattaaacccaaaattagctgtttgtgttttgattaccgcttcgattgcggggagagagggctgagaactcgtcccagcggttgacgcatcgcaaacgaattgcccagacggaagaagacggttgggagaagagccggccaaaccaaaagtgatttcttcgccttttttcgctgaataaagtcacagatttattggttaataatggattgtttactgataattgtcacctgctgattgtgcgggaggcggcggtgggcgacactttggtggcgatggaatgcgattttgctgcttaccactttcagtcggctgacgaatacgactttcagtgcccgaattgtcaattgaaacttaaaaattacaacaatgaattcttttataatcaatatgaactgttttaaaagcattttgtaagtctctcctttatgttattgctaaaaagcgatttcgaacctttcaaaggactttttgataaagacagatttattggttaatcaaatgaaagtaattgactgatcattgtcacctgaattacttttcgtatttgcgaggttttggcggttgacctgtcggtcgcgtttgctcagctttttccgtcggatggactgtacgagagggtacaacagagccaggagcgtcaaccgccactaaaatttttaataatgaatcctttttcaatcaatgcgcattgctttaaaacccatttagatcgtttatcaatcttagtgttaaaagcgatttcgaacctttcaaataatggtcagtttcggacgaccgatcagcgactttcagcagttccctctgagcattcacgtcggggccatcgggtggctgatcatacgttggctccgaatgaccggaagaggtggcgctcgtctcaaccgaattcggtggaactgaataggcaaattatatatcagaaaacacgtttagtttaatcaccaggcgggattgccaatgcgagattttcttcgttgagatacgtaaacgagtctgtaaaaaagaatcggttatgaatcatgttataaaatgcattataaaattaaattctttttcaagataagatattagacaaatactttctatttgctgaaaaagccgattaaaattcggaatcgtttcgcaaattccacgcaagaatacggcattctcttgctttatcacttcataggcgtcctgcacctcggttaacgcctaaacaaaagccaataaaacaattgtttaaacactcagccattttgcacatattaaactccccgtaaggacctacaataagcctaatttcagcccatttgttaagccgagggatcagaaaaaatcgaagcgtctgagaagaagcgaaaacgccagacaaattatgttccattcgaaaacatttaacaatttcatttaacaactcgggtggcaatctttttcgggacataacaatttaagggttaagggaattgggggcaatgattagggttaacaattggggacaatggacgggagaaaaagttgccggacgcgctgagccgctgttagcttgccttaaccgaaaggaattttggtcagttgagtatttttgacaaaacaatcgctgaatggtggacccaaccctaactttggtattgttacaaaatcatatttaaatgccatcaatactcaccttatacatttaaaggtaggccaatagaattagaaagttaataaaaaagaatgctaaagcaaacaaacaaatgcattagtaacaaacattcgattaaggaaagctaggtaattagtaaatactaattagtgcttgctctttcaatgagtccaatattttttaatgattgcgtcgcaattattgaaactaataccaaaaatgtgatatgttcacttctcaaatgcataaatattaagggataatgaaaggaaaactccatttttttcgattcattgttgagtgaattgagttgtgcgttcattttgggtcaactttcaacaaaattagtcaaatcaaaaatctacgccgcagttggcagaaaacgcaacgccaaaaaactcatttcaaaaattcatattcatgccaaaatacgggtccgggg

SEQ ID NO: 3249 - DNA, 3334 bp, Heterodera glycines
atttatgcaaagtgattggatgcaccagtgttctattcccccccgggttgctcagccaatcccagccgctgttacgtcaacttttttgtgtaaattcccggagggactgaggaagaattcttacccctaccaatcctctttattgtctacttgtggtgcccattgcattgttttcatttaccatatgtccgtgggatattcatttgagcaatttctcactacacttagcaattgtacaagtcctgatatgtacgcattagttgtatttaacaaaatattaaataaataaaaatgttttataacttgattgtttattcaattacgaaaaaaaaacttattcgattgaaaaattaaaatagtaggaaccagggtgttgagttgtttcaataatcattaaataaccaacatctcctttgtgatgcggattcatcaatcggtaaagttccatcccatcggcgcggaccagttgaccaaggccatgtgacgccatttctgttgccgggaattggagaagccgcgggaagtgttgacgcagcaaataaccgcctgcagtccgcttcttcatggtcagcgggtttgcgcttcccaagacataaatcagaattgcgccgaacagctctccaattttaattggctaaatattaaataataataatatttcttataattgtttgttttcttaccatggaataagtcacgattctcgtcgtagcggtggggccagatcgtccaaaagatagatacgccaaaaagtcggtgaaatatttggcgtcttccagttcatcttcgaacccgaactggatgaacccgaactggatgaacaattcgccacacggtaacttccttattgcgcagagcctctcgaaatttcgagcaagattgatctaaaaattcagatttattattattttaaatattaccaactatatttaagaagtaaagatgccgcttggcccgaaaaatttcgaacattcggttgataaccactattccagacggtggacgagtagtacctattcaactttcaaattaaaaaatatttaaaaaaaaatacctggctttttcgcaattcccccaaaaaggtacatgattggaattgaagcgacaatttccaaaagaagctccgctggtaaacgcttgttcatcgatgccattgtagtgaaaaaaaagaaatgaatgaataaatgcatgcataggttggctttaggatgcatgataccagaaggcgatgccgttccctcgggaatcagtgaaaatttgaattggctttgaaaattatcgattgtttgcaaacatctgttaccatatggcatttcccagagggaaatgcaaattgattcgccgaaaagttatcgattaatgggcggagacaccagctttaaaagcgagactgtacagagaatttttcatttgttccttacccttaattatattcttaataaaaattttccatttccaattttgctgttaaccagggcggtagctcgacctacagagtaccgtttatcctggcagcaattttgttaatttgttttttagatcttgaggtaatgcttttgacttgtctaattcccagagctgtttaggtgccctgtcgtcttgtgcttcatggatggcagtgcgcggctcatcaggccaagattggtttatttaagtgttaaatttcactcaatttcatcacttttccttccccattttgtatttgttacgagctcggctcatataaatatgcccttcctattgttgatttatcattttaataaagcattagattaaaaatggaaaaccgctttccccaacgcccctctaatttttcaattgactacatcttgtccattcctgcaaaaaagcctcgccgtggtgttcaagcgggagctggaccgtcatcggctaagcctgcaaaggaatacgttaaaaaattggaaagcagtgtcgagcatgtgccgcgcttccaatacgtcaaagccaaatcgaagttcagcattgaggacgtcccgacgaatcccgaaggattgattgccggcatattccaatgttgtattgatgaggccgtcatggaaagccaacagcgcggagtaaagcccacgcatctcggctgtgtgatcagcagcccgctgttgaccggcggcgacatacccatccccattcgccaaatcaccgacaacaccgtccacaccattatgaaccaattcaccaaagtcgcgcaaagcaaacaacagcaaaatatcacattgtggggcgagccgttcacagtgactgtgaccaccgtggaccgcattggccttcctaacaaaagaagcctgaaaggcggtgcgcggcgggcactggcacctgtgcatcatcgggtcaaggaaaactgcttgatcaaagtccgtcctgcaggaaaataagtatttattgtggccattttacagattaacaacccggatgagagaaattactgtcttttctacgctttgcaagccaccatggtggccaaaactcgcggatggccccgatggcttttttacaattatgtacacagccgatacggtcagcaaggatgtctgcggcgcgatgatttgcagttggtgcagcaaattggagctcgtcctgggttgaacgcatacgatgccgagatttttgttccgcgggtggtggattattggaacaacaacaacaaccaacagcaacaacaacaacaccgattttctgtgtttatttttggctcttctggtcagtacaagccgctctacaagtacataaaggaccattacgacaccccaattgttctttactttaacaacgaccattttgacggcgtacagaaaatccatggcttatttggtcaaaactattgcctcgagtgcgaaaagccatatgagcggccgtcgagacacctaaatgcatgcaaagcgcgctgtatgctctgctcccgcgtcgggcctcgctttccatgcgctcctttggatggatttttccgggagtgtccagggtgcaaaaaggtgtttcgcaacaacgactgtcaccaacatcatttgacatcaaacttttgcactcgatcaaaacgatgcaaagaatgcggtgtgatttgggacactcgagccaacaatttaaatggaccaagggtacaaaattacagcaaaataaattttacttattgttaaattcaggtccattaatgtgataaacgttatttccacacgtgtaacaattttccgcaacatggatcttcggttcattcattcactctattcaccccaaggaatataccctttcctcatagttctctttgatttggagacaatgcaccaccaagcgatgcccccaatcatccgtataaaagagagcacca

SEQ ID NO: 3250 - DNA, 7313 bp, Heterodera glycines
  misc_feature (39)..(39): n is a, c, g, or t
  misc_feature (55)..(55): n is a, c, g, or t
  misc_feature (145)..(145): n is a, c, g, or t
  misc_feature (177)..(178): n is a, c, g, or t
  misc_feature (217)..(217): n is a, c, g, or t
  misc_feature (260)..(260): n is a, c, g, or t
aaaaaaaacttattcgatgaaaaattaaaatagtagganccagggtgttgagtgntttcaataatcatcaaataaccacattctcctttgtgatgcggattcatcaatcggtaaagttccatcccatcggcgcggaccagttgancaaggccatgtgacgccattctgtttaccggnnaatggagaagccgcggaaaatgctgccgcatcaaatacncgcctgcagtccgcttcttcatggtcagcgggtttgcgcttcncaagacataaatcagaattgcgccgaacagctctccaattttaattggctaaatattaataatatttcttatatttgtttgttttcttaccatggaataagtcacgactctcgtcgtagcggtggggccagatcgtccaaaagatagatacgccaaaaagtcggcgaaatatttggcgtcttccagttcatcttcgaacccgaactggatgaacaattcgccacacggtaacttccttagtgcgcagagcctctcgaaatttcgagcaagattgatctaaaaattcagatttattataattttaaatattaccaactatatttaagaagtaaagatgccgcttggcccgaaaaatttcgaacattcggttgataaccactattccagacggtggacgagtagtacctattcaactttcaaattaaaaaatatttaaaaaaaatacctggcttttttgcaattcccccaaaaaggtacatgattggaattgaagcgacaatttccaaaagaagctccgctggtaaacgcttgttcatcgatgccattgtagtgaaaaaaagaaatgaatgaataaatgcatgcataggttggctttaggatgcatgataccagaaggcgataccgttccctcgggaatcagtgaaaatttgaattggctttgaaaattatcgattgtttgcaaacatctgttaccatgtggcatttcccagagggaaatgcgcattgattcgccgaaaagttatcgattaatgggcggagacagcaactttaaaagcgagactgtacagagaatttttcatttgttccttgcccttaattatattcttaataaaaattttccatttccaattttgctgttaaccagggcggtagctcgacctacagagtaccgtttatcctggcagcaattttgttaatttgttttttagatcttgaggtaatgcttttttgacttgtctaattcccagagttgtttaggtgccctgtcgtcttgtgcttcatgggtggcagtgcgcggctcatcaggccaagatgggtttatttaagtgttaaatttcactcaatttcatcacttttccttccccattttgtatttgttacgagctcggctcatataaatatgcccttcctattgtcgatttatcattttaataaagcattagattaaaaatggaaaaccgctttccccaacgtccctctaatttttcaattgactacatcctgtccattcctgcaaaaaagccacgccgtggtgttcaagcgggagctggaccatcatcggctaagtctgcaaaggaatacgttaaaaaattggaaagcagtgtcgagcatgtgccgcgcttccaatacgtcaaagccaaatcgaagttcagcatcgaggacgtcccgacgaatcccgaaggattgcttgccggcatattccaatgttgtattgatgaggccgtcatggaaagccaacagcgcggagtaaagccaacgcatctcggctgtgtgatcagcagcgggttgctgaccggcggcgacatacccatccccattcgccaaatcaccgacaacaccgtcgacaccattctgaatcaattcaccaaagttgcgcaaagcaaacaacagcaaaatatcacattgtggggcgaaccgttcacagtgactgtgaccaccgttgaccgcattggccttcctaacaaaagaagcctgaaaggcggtgcgcggcggacactggcacctgtgcaccatcgggtcaaggaaaactgcttgatcaaagttttccgtacaggaaaataagtatttattgtggccattttacagattaacaacccggacgagagaaattactgtcttttctacgctttgcaagccaccatggtggcaaaaactcgcggatggccccgatggcttttttacaattatgtacacagccgatacggtcaacaaggatgtctgcggcgcgatgctttgcagttggtgcagcaaattggagctcgtcctgggttgaacgcatacgatgctgagatttttgttccgcgggtggtggattattggaacaacaaccaacagcaacaacaacaacaacaccgatttgctgtgtttatttttggctcttctggtcagtacaagccgctctacaagtacataaacgaccattacgacaccccaattgttctttactttaacaacgaccattttgacggcgtacagaaaatccatggcttatttggtcaaaactattgcctcgagtgcgaaaagccatatgagcggccgtcgagacacctaaatgcatgcaaagcgcgctgtatgctctgctcccgcgttgggcctcgctttccatgcgctcctttgaatggatttttccgggagtgtccagggtgcaaaaaggtgtttcgcaacaacgactgtcaccaacatcacatgacatcaaacttttgcactcgatcaaaacgatgcaaagaatgcggtgtgatttgggacacttgcgccaacaatttaaatggaccaagggtacaaaattacagcaaaataaattttcattattgttaaattcaggtccataaatgtgatgaacgttattgccagacgtgtaacaattttcacaacatggaacgcggttgcttcattcaaccaattgagcccaaggaatatgacccttaccgcatagtgtcctttgatttggagacaatgcagcaccaagcgatggaccccgatcagccggagaaaagagagcaccaaccgaacttcatcgccgcgagagtttcatgtccctgctgtattgacaacgatcgttggagaagagggacagggggttgtcaaatctgtggcctgcaccggaccgtcgctttctgccagcgccgctttgtgaacaccaacgttgatcaccaagtggttgccgacaacccgctggaagcgtttgtgaattggctggtgtttcaactcccaaaaaaatacgacacctacgcctattcgcactttggtggccgtttcgacatggtccttgtcttccgggagcttttccggattggcttcaatcccgaaatgctgagacgggtacaattgtcttctgaatttttttcaaaaattctcaattttacaggggaacaaaatgtatgaaatgaaagtgaggaagcagaagcggcaaaatccaaacgtggtcttccgggactcattcaatttaatgccctgctcattggcagctctgatcccatcctacggccttgacgtcgaggacaaaccattcttcccccatttggccaaccgaccggagaattatggtagagcgattcatccaactcctgaggactatttggccaatgggatgatgccaggcaaaaggcggcaattcgacatgtggtatgagcagcaccgcgaggaggcatttgttttggatgaggcattagcaaggcacaaattttttatattttttcaatttttattttattttgttcagctattgcaccaacgacgttgaaattctgatggccgcactcgtcgcattccgtcgggaattcttcgaaataacgcgacgacaggagtatgtggaagggattgacgaccgcgagaaccatgatggaatagatgctctgcgtgaatgcatgacaattgcgggtgcctgcatgcgccatttccgtacaaaccatctgccagctgagcatctggcaattgtacccgagcgcgggtatgacaacgcgcagaatcaaagtctcctggcacttcgcttcttctactggtactcggaggagtacgatgtagaagtgcaaaccgcacactctgccggcggagaaaagcggattggtccctattccttggacggatggattgaggcggagggtcgagcaattgaagtcaatggtaggctttaatttgttcaaatttgaaaatcatgactttaaggttgtacatggcacggctgtaaaaaatgttaccccaacgacaacatggtacttcccagtggaaaaacggcagggcaaatacgggaacgtgatggtaaacgaatggaatacctaagcgcacgggtcaatcgcatagacgtcttttgggagtgtaaaattgacgagatgttggcgagaagcaaagcgatgcgtaaatgttttgctaattacgtggacgacggacctctggtgatacgcgacgctttcatgggagggcggacggggccattgaagctgtatcacaaggcggccaggggcgaaaaaatttcttattacgattttacttctctgtacccctatgtgaagtgagttttttattattaaataaaacataaatatgtaaaactttagcttcaccacccgttatccgattggacacccaaaagtccatgttttcaaccaacaagtggtgtggaccagctcggcggacaacccttaccctctagcattgctgaaagtttgggttgttccgccccgccgcatcgacgttccggtgttaccggtgaaagtggacgatcgcttgtgcttccctctttgtcttaaatgtgccaaaaagtacccgaccggcggtgtggacgacgactaccactgccaacacaatgatcaacagcgaggttgggtcagcacctgcacgtccatcgagctgaacgctgcgctggacgagggctatcgcgtcatccgtctgttccgtgtgctggaatatgaggacagtgacgaccaacttttccgcccgtacatcgcagagttcatggctcaaaagatccaggccagcggatttgacaacgaaatcaaagggaatgccgccatggaggaacagtttgtgcgagagtgtgcggaaatatttggcatcaacgtggacccaaccaagatggcgataaacaagggaaaacgttccatcgcaaagttgtgcttgaataacttatgtaagccatttgtttttcaatggattttaaattttaaatttagggggggcgcttttcattgcgaaactttggactttgtcagactctgattacggacagtcctgttgtgcttaccgaatatctggacaacaaatccgttgaagtcgcgtcaattgatcagctggatgagaagcacatcctcatcagctatcagcacaagaaggactgggtggatgagcatgcctgctcaaacattggtgagaatttttttaaaatattaccgtaatcaaaaaaactacagtaatatctttgtggacaacttccacggcgcgacttgtcttgttgaaggcaatgcaaaaagtggtcaggtcggaacggtgcgagctactgtacacaggtaattgaaaaaatatatattgtttagtaatttatttttaaattttagacaccgatagtctcgtccttgtccacccggaggggcgttgccctctcaaaactggcccacacctgggccagttcacggatgagtaccccgatcacgacatcgttgagtactgcagcggcggatcaaaacaggtaaatttacacgtttttcaaactgtcattttcacacaaattaagtatggtctgtgtctgcggcgtaagggggcagggcccgatgttgaaccggaatacgtgctcaaagtccgtgggatgacgctcaactatgacgtcatcaacaatcagggactacgctatgaacggttcaaagaagaagtcatcaattatgcgacaagaggggactatgagccgattatagtgacatatcccaattttttgcgtccgaacatcagggagggtggtagggtggtgtccatgcccatgcagaagtgttaccgtccatttgtgggcaaaggaattgtcggcccaaactatcgtgttttaaattttggtcacactttgtaacattttctcttatcagtatacgataaataattaacaaatgtaagatgtcatttttgggttggaaagtgcataattatcagaaaggaaatgaaatttcggttgcataattaattacggggagatgatgaattaaggggaaaaattgcgaaattaatccgcacaagacaaaattatgaatttcatcaataggacgaaaaattttgactacattcgttgcgtccactattttcaatcatctcttcatcaatgataaggtcaagcgtttgattcgatgagttggaggattgttgataactcgcgtcaatttctgtgaaaagacgaccaaaccactgttcattgttgttattgttgttgttgttgttgttgtctgtgttgtcgttgtcatcaatcagatcaagaagctccattgggtagtgacggtcctccccttcgcccgaaaatcgttcaattatgcacggtaaatagggaaagtgaagtcttatgcggtgccgtgcatagaaatgagcagccacattgatgttaaatgggttgcgcagctgtccatacgcgggaaggaatgcggcccctttagtcgaaatggagccgacaaaaaaagttttagtcattccattccgatcgttgtatgtggtgcgcactttgcgaccaataagatgtttcaggataagactccgatcctctggatgatttagccgatcacgcagagttttgggccgacagttgagcagtttagagcaaaattcagtgataagcaccatttcagaaagacaacaattgtgctagatgttaccctattttatactcaaaaatctgggccacgcccatcaaaatttgactccgcccattttaagcaaattgaaattacccgtccgaagccaaattcatttcctcaaaatgaagaaatccgttaccatctctgtccccgagcaaaaagaaattaatcaacaaaacactgaaatggagcccacaaaatctgacactaccaaaaagcgcaaggcagacgaccgggagctgtggaaattggcaaaaggaaaattcatgctcgcgacatacttatgcccaggtaaaatgaaatttcttatttttaatagcaaatttttttgaagatgattggaaccggctgttccacaaccaacagaaagtcacgcgcttgggagatgaccgtttttcattcagctttgaactctgcgaagattgcgtgtgggccaattgtcgcgcaactgacctcattgcccctatgaagaaaaagccaaacaatgcttgagactaaattttttgattgatcaatc

SEQ ID NO: 3251 - DNA, 3770 bp, Heterodera glycines
gctattctgcgtctctgattttttggcgccaaaacgaccctgtcgccaaaacggcggcgccaaaacgactctgtcgccaaaacggcgtcgccaaaacggcggcgccaaaacggcggcgccaaaacgaccgattcccctattttttaagcccaaattcgttgctataacttttttaatttaaaattttggaaaaaaatcaagtagttgatgaaaaatcatagataaaaatcaatgtgagttcatcgtgataagcgcattttttaagcctagaaaaaatagctgcgattaacatttttttcgtcgggacaccaattcttgaccattgccgtatttttaatggcgttcaaatcaatcaccacctttagtttcatacaatttgtagacaataacttttttaggtatgtaacttggtttcaaacgaaagcttgttgtgaatagaattacttctataattagttctgggctaaaagcctaaaagtaaacaaaaatgtatacctaattgatcaacatcaacataccaagtttcagattccaacatttcatttaattctatgagtacaacactgaattataatgcggagatcgctgaacaatttccaggatggccacacgcttataaacggtttaaattttaatgtttttttttttgctttattccaagcctcttatccacttcagtttagatagtcaatcttcttcctttttagaatcaccggaatgtatctgttcgaaggtgtttctaatgaattcccttatgtcgccgcgtgtcctgtcagtccgagtgtttacctaatccctgcttccatcggatttgtggcgtcgcttcaattgttgagcaaatctcaacgttcaaagtcacaatttcttaaacacggcccaccttctcttttaccgccaacgcctgaagaatatgcaagtttataatcgacttttactagtacttatgacccaaatcagaacaaaactacaggataaaatttctacttttttgtttgaatttgagtgatagtgatctgaaaatccctgatatacctaagtctaatcattggttaatgtcacagataaccaagagtattgaccaaacgcatttcttagggttcgagaaaccgcaagtctccagtgagtgtgatcgtcagcaaagatccgactgatttcatcgtcaaggttacggatgagtaatatcgtattgcctaataaattgttttaagcaaatgttttacgagtcgtttaatgatccttgtcatttcatccttatggacagggacggggttggttctgtctgattgattcctctagtcgcttttttcagatcgtcacttattgcctcgtttccgacgttcgtgagccggtcaggtgctacgtgtatggctattccatggcgacggtggcacaggaattgctgaacggcaccaagtggattccgaacgttgtgtacgaaggacgtgttcagtgtaaattcgcatgggatttcgacgcgcagaccgggcgagttacgaacttgcgaagtcattatgagttcaacaagatcatccgatttgcccagccgggtgacaatccgtaagaactaagaaccaacgaaatccagataagggtggggctaggggcttggaaaaagtgaaagaatctgatccttgtctgattcccagtaaacattgatgtggtttctttccattccgtcgtttcagacgtgcgtacaaagcactcgtcgatttggcagtgagggtcagttgaattgccacgagatttgaattggataagtaatgtttgtacgtaattcaggacgcgaagtactttgcgactacgtttggccatcccgcatgtgtcaaatttcaaacaaaacctccgaccattcgtttcaaggcagtgagtctgtggtactttggcgatagcattctgctgtcgccggctcgtccgcgccgtctgtcccgtgtttcgccgggtttacatgtggactgcacctcaccaagtaaacggttccttcgccatgatatgcgattatgggaacattcatttcagtgttctatgatatcgaaccggacatgaacgcccgaaaacttccattgccaccaattcgagagggccaacgaatcattgccaatttgtggcacaacagtaagaacaatggaaattgaaaccacggtcaatcaccaccaaaaccatcgacagaactgaacaacttctacttggtgcacagttacgtgcttgcggagaagttcaagcagccaggggaacgcgatgaccactaccagttgcccgttcgactccaactcggcacttcgtccgcaagtgccactccgagcacgtcatctgcaagcgaaacgaccagccaggtgggcgtgcgtaggatttacgaatgttttctcgaaaaaggctattgactcccatgtgaatcctccacaataaaaagtttattcatcttcatcttctgaagttcagtttctcgtcaaagtgaacaattccatcttcaaggacttctattcgtgtgaacaacttggctttgctcttatttctgatccgagacggtgaatttttcattataaaaagggatgaatttttataggttagtaatcttccgaccggattaacattctctgtttattttttcaagactgcttcgcaatgcgacgcatctcgaacatctcgatgggtttcccgtttggatttcagccgtgccggatgaatttcgtctcgctcgcttcgccatcatggcactggcctatccaaccaagaactattctcgactcgaaagatccggacggcatccggatgtctgtcatctgctatttggctcattgtcatttttttcatgtaacagattcatggccatggcattttgattgtgtcgtccactgggattgtcttcagcaaggaccacccgcaaactcgcatccgccttctgccagccgatcgccgctatgtcagcgtcggcgatcagttcatgttcaccgccaccttctatgaccacaatgagggctttatagtttgtgggattcagcttttggatgaggaagacgaagaacagttcgttggactcgactccatcaaattgggcggcgacgacattttggttagacaaatgtttcgtaaagtcaaaaaccatttcatgatgaagaacatttgcagtttgtgcagaaattgaagacacacatgcgacaatgggcggccgagggacatgacagtccgaactttggacctgtggcggacccgaaagagttggtcaccgactacatctgcagggaggagattcagtggccagaaaacattgaagttttggtctgtttcaaccccgagtggatgcagggagcggacacgctgatgaaggtgcactcattggtcatcgacggcgaatttgagcagggggtcaaagaaagggtgagtggtgactaacacggcttaacaacgccacccttttcggttaaatcgaattttcctcctacagattgagtccatgaacaatgatgagacgagcattgcctcccccgccacgctgtctcttcggcaggaggacaacgacggagcgcatgttcctgctcgaacccacttggaggaggaggaggaggaatgcaactgtttggaggtgtggggcattctgcgcgagttgttggaggacgagcgggcgaccagcgagttggagccggagatgatccagggaatggttgagctgcgaaaagcctttcatatcgataaccgcgccaacaattaaatttagtgatattcacaaatgggacaattaattatattatatacgggtcaaaaattaaggaattgtt

SEQ ID NO: 3252 - DNA, 2818 bp, Heterodera glycines
atcacctacgtaatgcttgatttgatgaaagaaaatttattttacctaatgatttaaaaaaatgttttttgttgctgctaaagccatttataataataaaatattcacttactgtcgcaaatccaaagattataaatctattaaaaatgtataaaaaatattattaaatccattaaataaatgtcgctgcactcagttttttcaatttcttttgggctcccggacatttgcacaatggacacatgatgtccactgtccaaatgtccggttaagttttttttttgcagtattaattttgtctgaaaaataattatctaaaatgtaaattaatgcacatattttagtataaaagcaattgaaaaaatctaataacccgccgcatcaatttaaacaaaaaaaaagagagagagtgaggtgaggatagagagagagagagagagagagagagaaaaaaaaagagagatagatacactgtgttaatttaaaataaagacaccctgttttttgggagtttgaccacttcccatgaaccgatcgagctgaatttttaactgtacgtagcaattctgaaaatattaagattctgaaagtgagaaaccgaaatgatgacggaaaaaagttttacgattttttttcaaaaatggggtgttaatttaaaatagagacacttgataaaaacgaacaaagtctcaactaccaaaaataaacagataaaacaaactaaataagaaagaataaatcttttttcacatttctgtttattttgcgaacagaaatatgtcttttaggcagagttatgttgaattttctaagttttcaggagaaattaagggccaaaaggctcaaatcgcctctaacatttgcccaaccgaatcaaactaacagcaatcagcactaagataacgtacagacatcctttaagcattttttattaattttatgccataaaaaaggcattaaacacaaaatttttgcgggtgaaaaaatacgaaaatctgagtaaattcgaaaaaaaattctagggggttgggaaaaattttccatagaagatgaatatgacgaacagaaagagcacaaaattctctacaaaatggcctttgaatgattgctctatagcaagtattcgctgaggggtgccttgtaaataccgattatccaaaaaatgactcaattcaagccatttttcctcatttttgagacatccattctcccccgccgtttccctcatgtttcgtcgctgtggtcgtctgctgtgttcgctgcagttgctgaaatgggtgcagttgagggatcagtgccgccacgttcagcagccgtttgatgcccgttggttgagctgcgaaactcctttcctgtcgcggaccgcgccaacaaccaatgatagaggcatataaattattattattattattgtatccaaactttgaccgtaaattcattaatttaatctaaactattagaattttgtcatattgataaactaaatttattctatatgagtttctttgtccatcacaaatttaattgcttgatctttatgataggatgggtaaatatttcatagttttattatctttttgtcttcttgcgttggctttcacttttccttgtcacaattgtggaatccctcgtcaattttgccatagcgttggatggcctcggccaatttttggtcctccgtcaaaagagtgaaacgcatttctcgggccttcaatgattaaatgaaatggcacattcatttttattgacacacttttcggcactgctctttccctttgtccattcccttggacaaaacatccaatggaacagtcagcgattgaaacagccccagctgaacgtggcctttgtcggacgaagacaatttgcagaagagtggggcgccggaatcgtccttcaaaaagattggaaatttcgcaaattttattgagtatttgacagctaaaacgtgattttctgctgaagcgcaggcgaaactttttcactttgattaggttaagagattgttttaaagaggaaatggttctccccaaaaattgaaaattttaaagaatttttttattttattagtcattatagtcattatcatttgattagattacatagcatgcggtgtgtccgtccttgtacactcggctccgataatggtggaaagggtcgtccgtcggcggctccgccactccgttcagatgcaaacggaacactttctcctccgtcagaaagtcttccgctgaattcgctgtttttcagttcaaaaaaaatgacagacctttttcgctggtggaaaaaccgatcatttggcattctgtcccggggtcggccaaatcagcgggcaaaggaacgaattgagaggacggcccattggcagcggaagaagatggacgaatgctgagacgggaaaagcgattcggcggacaatgcttaacaagacgcaattagttaatcagtgttgattctaccaaaactaatgaaaaataataattaatttaattaaaccgacggaaaaagccttttgatattgaattgaaaaaggattctgtagcataacaaaaggcacaaatcgcgtgggaactgccaaaagaataaaacagcagagtttgcttatccgatcactcccccccccccaaaatcgtttctttctttccattccagaatccacagtatcattgattccgaaggccaattttaaatttcagaaatatcattttcatcagtgaaaagtgtgtaaatcggagctgtggtgctcgcgttccgtggcacaatgcgcaacagtgtctatccgcccgcttcatcccattcgcgtccgccggtgaccaaa

SEQ ID NO: 3253 - DNA, 4809 bp, Heterodera glycines
  misc_feature (150)..(150): n is a, c, g, or t
  misc_feature (4737)..(4737): n is a, c, g, or t
  misc_feature (4768)..(4768): n is a, c, g, or t
caaatttgttaattaagggccagcgaataatcatttgctggattggtgccatccatttttcccaccgatatttaccctccccatccccggcagagacatttgaaacggcaaggccaactgaccgctaacaaataagtgctgaatgaagtntagaatcgacaatttcatttattcaatccttttttacacagcgataacaccaccaatcatcgcaacagcttaattgtttgtgttcattcctaatggatcaatggatgaataaagcgatcgttatccatctttttcccatccgtccgttctccgctcaaagtccgaacgccctttgctcagtgactatattttgcttcttaaaagtgatcggcttccgtttgtaaagaggcggcgaacgaagggggagcggacactgcggatagtcagccattcttggctggtatggtctggaagaaattgttagaattagtcgaataagcctgagcctcgctggtttgatgtataaattatttttccgttaaaaaatttgttaccccattaaaatgtatttttttttaaactaaacgcatttggttcacctctgaaaagaaatttgcatggcgtaatagccgcccatatcctcaaaatcggtcaacgaaacgcccaaatccttcagaagataagtgtccccagccgacagcacatcactcgtcgcttcctgacaatgagttttttagttgaatattttttcaaaaaatgcaaaagactgatcaaaacttaagctttcgttttatttaaatgcctatcttttgctttccaacaaataaatcccttaaaatttgaaattggaaatctgtagcgcaccatgaaatcgaaccactcccaattaataacgccaggacgacgatatattttcgtatacgaatgacagagaaaagacgtgaaaaggaaccaaatcggaataccaacacgacggtatctgctagttatgtcagcgacgaggccgcctttgatgaagatgaagtcgaactaaacggggaagggggcattagaaaatggaaagaaattggcgatgaaagtcgaaaaagcactggtaaaaatgataaaatttttacgaaaattggaaaaaagaattttgcaaactcaaaattttttaacgaaattggatttcattttcaatttcgtatatttttttttatggaatttggattatttagtgaaaataaatctgttaataaattgcagcatttttccggcggcgtctattcgcaccgccggaccccccccccgccccccttccgcaaattttttggaaaaagcgcgccacgcaaaaaaaaaggttaaaaaaaatgttgagcctttttttcaattttggcctctgatgggggatatttcttatttggtaaaggcaatttctgacccccccgtccatttatgacatacaattcagctccatttacctaataaacgacaaatgtctttcttgttcgttaaccacataatgaaaattccttttcattaaatttcaatcccgtcatttgttcgactcccatggacatgaaaatacgtttcgattcacttaccaactcgcacatttcgtagcagtgcggcccgacaaattcgtaggttttgcccgctgttgaggagtccatcgccactctgttcactccgtcggcaaagtcattgacctcaaaaaaggaggttttaaaccttttacttttaaaaagaaaatattgtatatgcattatttaaaaacggaatgctcacaaaaagtggcattttgtaaatgccttcgcccgcattgaaagtgtacacattgccgaacgggtcaacgcgccaacgggtgatcagattataaatgagacggtcaatgtcgccgtacatcacagagggccgaatgatggtggcacttgggaattcggcacggaccgcctgctcggccatgcctttgcttttcagaaaggcgcccttttcaaaaatgggggaaagagtgagcgattatccaaatttcacatacatttttgatgaattgtgttttgtacgatgggtccgcgttcaatgcgctcacatggatcagccgttccacgcccatttcccgacaaatgcgcgcaattctccacgcaccctccacattggcgtcataaatggaataattccttaaaaataaattgtgtcttttgtctcattttcccggccattaattttatttaaaaccgtacggtgtgtcgacatatgtgccgatcatattgatcacaacgttgctgtatttgactgccttccgaatgctttcatcgtcgtccaattggaaaggaaaaaacagaacttgaccaaggtcacaaggcactttcaattctctgagaaaatacgaatcgcagcggtacggcaaaattagctgatttgcgtgtctggccaaccgattgaccacccttcggccggtaaatccggtattgccaaaaactaagaaaaaaagagtattttcttttagtttgtaaaattttttgtgtgaaaaccagtttcggggggttttgggtttctgatcacaaaccgcacatctaatttaacaaatttctaattcttaaccagaacttgaacagaaatcgaaaattctaaatttctcatttcggtttttcagattccaaaaaatcaaatttacagagaaacgagacatttaaaggaaacacataacgagtggcaatggtaaaagtttttgtggtttcttcaaaaataaatttaaaaatttaagaagcagattttctaggctgaaaaaatgcgctgattacgaatctgagtcttggattttgcaaaatcattgcttttatctatgattttttttatcaagtacttgttttttccaaaattttaagtaattagtcgggcgtaaacgacacacacacatcaaaatgagcatttgaatgagctattgaatgtctggaaaagtcatatttttagttatttacgattttttgaaatttaattactagctcttaagggtcatatgagatgggggtggggttcgagcccgcttggctgcagtttatttttttattattgaaaaatcatagacaaaaatttgcaaaatctgagctcagattcctgatcagcgtattttttagtctagaaaatgtgtttctttaatttttaaatttatttttcgaagaaaccacaaaacttcccaattgctacgagtaatataataagaatgaggggacctgtaatgacattgcccgagaagctggaacgaccgcccgctcccttgcggaactgtgccatgttggaggaggaaatgaccggctcaggcacattcaccggcacattctccgtagtcgaatattgtagttttctggtgatcctatttctgtagcaagtcaaaagttggacggctttgctgctgataatcattttgagagatctctttaaaaaatgaaaacacttggtatcatttgaaagctcttgaggaggagaacctttttctaagcaaatgctaagcattttgatagaattagaaaaaaagataagggcattcaaaaatttgtttttttgaataactttttagctaacccactttttgctctaaaaattctccagttttgttcgtaattttttctctatcgataagcaaaatttaataatgaaattccggaatgcatcaaaagttatgcgcatcggaatgcgaatgttattttataatactgaaaatattagataatccaccaaaagaagagaaaagttagagaaaaaaagatattagttttttctctatactctctttctcactatgggtcaacagtagagaccgtcgcgggacgggatcccgcgcgggattttgcgggatcccagtccgcaatcccgcattttttggaaaatgcgggatgtgcgggattaatcccgcgggatcccgtcccgcaaaaaattttgagttccagtcccgcagcgggatccgcaaatttgaaatttccggtctctagtcaacagacaaaattgctcataacgccaaatagcgtaattggcgtaaattattgcgcgctaattcaaatttacaatgatcactgacatttttgattgtttattttgatcagccgtaactttcttcatttccaactaaactaaacaaaattggtatctaaaaaaagttttgaaaaggtgaatctttttctaagcgaatgctaagcaatttaactcgtttcaaaccatcaaatttttcgaaaatgttaaaaagatgaaagtgaggtgaaaatgtggtcaaaaatctgggtatttgtcattttctttgttgttctcaacgcctcgattgattagagatataaaaatagtacgataaaaggagagaaaaatttctttcatccattgactcgattttcttttttgaatcattaatttatgctatgcagtgatttgccacctgttagcaaagacacgtgccgaccgatggaaaataaaaatgcagcagcgcaaagaaataatgcacttaatccttctcggattaaacacataggttttgcgtatttgtccccttctccgccttcacccaattcgaatcggacatttcggaattccaaaacacctttccttttccaccttctcccaacaataattctttttgagaggttgagtcccaattccctcaatatattttctcaacatttatctctgacgtttttggttgtaaaggaaagagaagcgaaaggaacgaccaaccactgggctttatctatcccatttttgtggcatagctcaactttaaaaaaaaatattttttcagtcaattanatggaaaatgacaagacaaataacagaaggngcggcatgacgcggaccagttcatgcagcagcaatagcagt

SEQ ID NO: 3254 - DNA, 916 bp, Heterodera glycines
tgatgacagcccatctccgttctttggtgtccatcgacaaaattgtccacgcaatttcgtccgtttagtttttccttcgctgttctgccttcatttatgtttttcagcaattacacttccgttgagaagcgtgaagagccgcttgactgtatggacgccctccttttttggataaataaggcaaaaccgaataaactgaaaaagcaaaattaagacaatttcttcccttctcgtcaggtttgtctgctcgtccgggatgacattgagcacaacggactgtccggcgtggacaaattgccgacaattcccgagatggaagacctttacgaagatttgtgcgacggcacgtgtatttgcgcactcatttccttctaccgacctgacgcattgcctcttcgcggtacgtacggctaacatttatgtcaacgaatccccgtatttcgcttcgcttattcccctttagagatttgcttcaaagacccgatgagtgtccacgattgtcgcttcaatttggaacttttgtggtctctccccttcgttttacctttttacttatccgtttgccttttcagcaaattctgttcctcttctctcccgtgggaccctttccattttgaaacggaggacattctcttcctgcacgagtcacttcagcccaatatcaatgtgttcttggcggatcttttccaattcttcgagattcattcgctggttccgcccgcaggtgttctcatagtgataattattcatttacttaggactatttgttgggactgtgtggtaccaccacggaatggaaattataaatcttcgctatactgatttcgttaattaattcatgaaaatgggtttttcgaattatcggcatacaaaatctgaagcaatttatgtgtcaagtatatccataatttattat

SEQ ID NO: 3255 - DNA, 2642 bp, Heterodera glycines
tggttgatgggtggcatcggcacaaaagtgccgaagttgcgataatgtttccggcggggactttatctttcatcagccgtatcgtacaacgatttttgtgccttttttgtggttgtgtgtttaatacgttgccaagtgtggcggcacgtcacttttgttttcatttcttcttcccttcctaaaacgatggcattttcgcttattaaaatttgtgccctaaatggcttggtcgttgggattaaaacgggtaaagaatggacaagaaaaatggcgctggcctttttttaaagaggaaggagggggattaaattttgagacggaacaaacggtcaaaggcatggcaaatggggcttaaattttcatgtaaagcgccgctgcttttcttcattatcattcacattcccctgtattgtccatggtgaatttgtgtccccaaacttttaacagtatgccaaaaaataaatttgacgaaatattttttgtgtaaaaattcagacagacccaaaccttaatagaattcaaaaaattcttgtttgattactccgcaaaactagtacaaccgaaacaaaaacagtactgtacaaaaataattgttccggcatttgtcatccatttttctgttgttgtacattttgctgtcatttcaccggaaaattttgtgcccaattttccggcgctttttcaccctctgcgcctccccccccccgccacctccaatttttataatttgtacaacaacaaaaacggcacatgttccacccattcaatttgtttgttcctgttcacacacattttcattttttttgctcgtgtcgacgatccgtacacctccctctccccaaattcatccacccatcgtccgtcccctcattgtcagtccatccaacccgacaaaaccaaccgaccactctctctctctctctctctatttttggtccgctaaattagggggattttgtgtgaatggtgtgggagagatgtgacgactgatgagtgagtgagtggcggagagaagtgatggccttgtgcacatttgcgtggaatacataatttgtgtgtgtgtgcagtgcgctgttcagttgagtgcctggcgttggcagtggcggcgctggagaaaagcccatggccaatgctttttcattagcgaaatgctaataataatagtaatgtgcatttggtgtgttggacaaatgaaaaaagaggacggggtgtggctaaagatggcttcttctttcattagctgcttctgcttgttgtcagtgcttcaataaaactcaattaggcccccccactcccttctctgctggtgatgactctctgttctttgctctctctctctttttattttttcccttcccttcccttttcaattaattttgttttattctttttccctctctcttttctctctctcttcctctccctcacactttctctcctcttatcacacttctctctttttgaaattgttttttgctcttttccgcattttgtttatttttttctctgtttttcaagtcgcatttttctttgctctctgttttctcattgtttgtgtcttttattcgtttttcttctcttttttcctctcaatattatttttcctttttattcactcccttccttctctctgtttttaaaattatgtgtgaaaaaatcgaaaagcacaaaaaattattaaacgatttttgcataatattaattccttttttgtgatgggaaaatgaagtgggaaagatgaacatttcgtgctatatgtgtgacgtgtaaacgacgtaaaaaaaatcatgagaaaaaattgaacgatggggtgggcggggacggacgggcacgactgggccccgccatctgggccccgccgactgggccccgccatctgggccccgccgactgggccccggattaactgggaacccgccaagctggcacccaaggcacagtaatttttccaccattatagtataatataatcaaaatagaccgtggtttgaggacatatgccgttttcattcgataaattgctagttccacattacggaaagaagaaggtagatattactggaagatgagatataaaaatattaaaattagggagcatcattgacgacccagtggcccaaatattttatgtatcacagatcggagcccagatgggaaatccccgcttactgcaaaagctccgaaatgcgcacactaatcaatttttgtgcatataaaggcgtgacttcatactaggaacaatctttttctcgttgtaggataattaattatcaccagacgaaaaacctttaatgaatcgagaataaaatgatcttttagctttggccaaaaagtaattaataactaaatatggtgagaaaaaagcggcaacttgaaaaaaaggttccctaattttcatgaatgcaaaaatgcaaaaaaaccatcaagctgataaaaagagggcaaagggtccatattttaagcagatgacgatttggcctgccattagtcctaaatccccatctccatttatcacaccaccatcaattctgtccatgtcacacattttatcaccagattgaaaaatttaagaaatttctgacgcatttacacgtcccattttaaccctttttccccacatccccgacctacgtaatattttt

SEQ ID NO: 3256 - DNA, 1390 bp, Heterodera glycines
tgactcgacgctgctgatgatgacgaagatggcatttgcaaatggtgccgctagtggacaacaacaacagctgcagcaacatcagcagccgaacaggttcaccatggtgccgtcgccgatgccgcgcaaccatttgcgacgcgtgccgaccaggtacaatttaggacgggaattgttgttcaaagaaaagtctgagttgcacaatggagtgaaaatgccggatttcgggtgttttttttaccttcggcaaatgttacacgacttaccaaggcatacatggaaaaatgggttggacgtcaatctaaaatttttgggatttaagttaattattgaaaaataggagttttttgggccggcagcacctaggaaagattttttgttatgaaaatttaaaatttgcgaccccctcgaaactttttattttgctatcaaaacattgtataattcgcttccatttttacctaactttttcagattggttttggagcgttcggtgtccgacagtgtgttggacgacgcggcaattccggacgaccaattctccgccctgcagcactcggccgccgccgcgttcaacgcgtccattctgcgcagactgtcgtcgtcgtcgtcaacgatgtcgcccggtggagggctgctgggctcatttgatgaacagttggaggacaacattgtggacaacaagacggagcagttcatgcaccaacagcagcaaggcagcaacggaaatggcggcaacaattcgtcgtcctcctcttcgtgcccgtcctcgtgctccagcgagacaattggtgagtcttgttggcgtttttgggatcataactactctgaattgtttttttctcaaaaaatccaaattctaatgaaaaatgtaaaaaggccgtcgaaaccccgttgaatttttttatgatttattgcatttcaattttcattgtctggtttgaaaaaaaccctaacggatatatttttgggctgggatccgtaagaaatcgcccattgatttgaaatctcgatcattacagggaaatatcaacctcacattcccctttttaagacactgacggctccgcacagtccgcggcgcctgcaccgattgtgaagaagcgtgtgtccttctcggagtgtgtccatgccagatacttccgaaggtgcgttgtgtgggcacatggcattcaaatgcagaaaggggatttattgctaaaaacgaaatgccactaaattttcggtctaaaacgtcgggactctctagagaaaagcactgcggtcctaaacacaccctcccattttgatcaatggtccttcattttcgcctcggtttcagcaactcgagcattctgggacagaaaaagaagaccgagaagaagtcgcgcaagcggaccagccgtcgctg

SEQ ID NO: 3257 - DNA, 1648 bp, Heterodera glycines
gattttattttcgaattcgcttccgggttcgaaatatcgtaaatctaatttcatattcgtggtcagcgcactcgaaaatatctccacaaaaaaattttttgggtggctaaaaaagtgctttactttgtttaatggagaaatgataaggaactaataattagtttcatttttagtactaaatttcttgaccaacaaaaaattgtaacgctataaagacgaaacgaatattagacacagcgtccggaaactgagttcctgtaccaaaaaagatttgaatgtatggcgaagtggtttttgtaagatagtaaaggatgcaaaatttggaaaaatttcgttaaggttcgaaaaagttatggccaaaggaactgaaaaaactggttattcgtataatattttttccatccgaaattttgcaggctaatagaggacacttaaggctatcgaatgacaccaagattgttgaatttggttgacaatcatagccacaaatttgtgctcgtacgaaaacgcccccgacccgtctctgtctatttaaatcagggtttctatatgttattatttataagaaatgttctgatttggagggtccaaatcttacaaaataaaaatgttcttatttgtaagaaatgttctgatttcgggcgattgttcttattttgttttttatttcttaaaattctccagaagtttgtaatttatggcgtaatgtcacttgattttcaagaatttttcccggcggcgcctatcggcactgccggatctctcaactcgcacgtacaacgagttttttggaaaaagcgcgccgcaaaaaatagtgtttttagaagcaacaaatccttcgcttggccttaattggaaaattgatcttttttggtgaaaatctgttaacaaatcagaacgaaattacaaaaaaaatttccggcggcgcctatcggcaccaccagaccctcccccccccgcccatttcccaaagagttttttggaaaaatgcgccggaaaaaatgtaaaaatctggttttttgatcaccacatgcactgaaatttacgatttgcttatttcctcttcaaaattgctaaacacaccatcccaaaaaacgagatgtgtaccaataaatagagaatgccagagaaaaacattatctttttttctctaattttttgtctccttttggcgtactatctaatattttcattattaggaaaaacaacattcacttcgtgatgtttaactttttttctgcatgttcaatctataccaaattttgcatatcgatagagaaaagaattctgcatctttctatagtgaatttaattttgtctatggtcaaactcaaaagttacaagtttggaacacccatatcttttttctgattcatcaaattgcttagaatttgcttagaaaaagcttctcctcatcaagggctttcgaatgataccaagattatccaatttggttggcaaaaaccttcaaaaataattcccaaatatcgtgattttttaatattttggacaaaaataaatgaaaatattcatgttgcacaacggactcgaaccaccaccctttgcccctttactatcttacaaaaaccactgagccacacatgcaaatcttttctggtacaggagctcatttctgggatggtgtgta

SEQ ID NO: 3258 - DNA, 2789 bp, Heterodera glycines
  misc_feature (142)..(142): n is a, c, g, or t
gtatgtatgcatttttggtgcgtaaaaaacgagtgtaagcaattccgtacatttacataatctataatcagcaaaaaaaggaatcacataaataggagtgcgactctttgttgactttttttaaaatttattatgtggtccncaaacggaaaaataccaaaaattatagattaatggtgtcagatgtcaaatttgatgtcatgttcattctacgccccaataagccctgagtacatgccagaatagaaaaaaaaattttcttgtcctcggttcaaaattgaacagaatggatgccggattcgttctcaatcagtgacaacggaaactaattttgtttggaaagtgaaaaatattgtggggcctatgctgcatcatttttttttgtgggaccaatgttcttaaatatgtatataacttgaggtttacttatatttacccgccaactgaaaatggacaacggctggtctccagaggagttcggcaactgtgattggggcggtaacaaccggacggaggagttcggcaactgcgattggggagacaacaaccggacggaggaattcggcaactgcgattggggcaacaacaacaacaaccggtcggaggaattcggcaaccgcaattgtggcaacaaccggtcggaggaattcggcaatcgcaattgtggcaacaacaaccggacggaggaattcggcaaccgcaattggggcaacaacaaccggacggaggaattcggcaaccgcaattgtggcaacaacaaccgatcggagggattcggcaaccgcaattgtggcaacaacaaccgatcggagggattcggcaaccgcaattggggcaacaacaaccggacggaggaattcggcaaccgcaattctgggaatggcactgcccagcgacgggatgccaatggcagaaacaacggcggcggaccgtttcgggtgccgtcgccacccccgcagcaggtgaaggaggaagacagcggtccaaacattttttgaaacaccaggccagtcaaaaatagggcccaattttagcccgcccccctcccccccaaaaaacggaatatacggttgtttatgattgtaagtttgcgttttccaggtgccggtgccaccaccggtcactccgcttgacttttgttgccccggcactgagccttcgccgcctgttcgatcgaatatcgtttacgtggacggaattgaggattacaaacacagtttgcctttgatgcgtattgaggaggtttgattttttttttttgggcaaaaaattggttggaaaactttttctcctccattgcacctataatttcgaaaaattaacaaaacaattctggtcgcgaaaagcacaaaaaaattctttgttttcgatcctctgaaattttcctgcttacaataggggcttggttgctccaactacacttgaaaaacttacgctgggtttttttttttgagagcggcttaaattggccaattttttaaatatccataattttgtcttttttttttgcacagattgccagtgtgttttttttgcacatcaccaatgtgagcgtgttggatgtgaagcgcgttttgccctcggtctattcgaatcattttgccattgtcgagttgggtacagttcagcaggccgaaaaaggttttttttggggggcggggtgggacgggtgcaaatagcattagcaaaaccttaatttggatgaatcatttttttaggcgcgtttttcaaaaaaaaagcggcgcacaagggggggggggggtccggcagtgccgataggcgccgccgggaaaatttgtattttaacaaatttagttaagaatgacaaaatttttcgatctgacatcagcgatgggtcgaattcaaagaatcaaattttaaaaaatggggggggggtgactaaaaaatgagcaaaaattagattttgtatgtgctacttactctatgagctctgatgaattacctataaaaattgctcatttcttttcagcaatttcaatgctcaacgggattacgctcagtacgggacacaaacttttcgtaatatttcttttttttttttgtgtattattttccgaaagttttcttgaggcctattatattaaaaaaattttaatttgttgtgatacatttataaaataaaaaaatctcaagagagtttttactttttaaaattattttttcaattttcacaaaaaaatcgcggattttgaaggctaattgtacaattagggccatggatgggctgcgaaaagaaataaaattgtcatcatttacccactcccgaccccatttctctgaaggtatgcttcagcacggtgcccttttcatttgtgccgagcaatcatgcactgttgcacttgcgggcggaaaaacgtcggaacgacccgcgcaccgtttgggaggaacagccggtgaagggcgaattgttcagtgccaatagcaacgacacgcagcgggcggacacaacatcgaattgggacaatggagaggaggtattccgaatttataaacattggcagcgcaccaaaaattgaaatttatacaaaaaatatcatggagtttcttgaaagcaaccaaaatttttatcagctaagcccaacgcatttttttttgtgttaatttcatgcaaaaaattgaaaaaaccgatcgttcttaacgaggtcaggcaattcaaaatcacaaatttttttgttttttttattaagccaaattctcaaacaaaaaagtgtcacggcggcgccgtcggcactgacagatcctccgcctctccattcccaacctagaaa

SEQ ID NO: 3259 - DNA, 2888 bp, Heterodera glycines
ttattgtaatgttctcccatgtttatgcccaccattgccttctttggatggacagaaaatgaacagaaggaggaggaggagtaaggcgggggtggcggtgatggctctgtcccattgtgcgcattccgtcggacacaaactggctttttgcgcgccgtcgtccacacgtaaagggaactgtgcagaaaaaagggggattgccgcttgaatatgagaatatataatttattgttagtagaaaaatcgtttacctgacattaaaaatggaggaaaatgagcaaaaaagggaattataaaaccaaaaaagaattttaacttttttgagtccctttctgaaatttaaatggtaactcattcccccccccccccgatcaccaatccaaattgtcgagaaaaatgccaacccgtcaacactgccggacacaaagtgctcctcgttgaccatcgccacacagtcaatgctcacacactccgccaatccgttgaacaccaaatggctgtcctccaacactttaaacagacgacacgttttgtcctaaaagtgaataatatttggttccgaacatgaaaattggcgaccaaccattgctccgcaactgaccaaccggggccattggagaatgtccaaatgcagcacactgtcctggtgtccgtagagcgtgttcacaatgcccatttcatccaagttccacacctttaaatcgtcaaagacagtttagcacaaaaaataggaaatattcccaataaatcgtgttctttttgttacaaattttgtgaattttctgtggacaataaaaatgcaatttcttttctcagagagtgcaagaaattgcactggcattgaccagcaaatgcttttcctcacttctgcacagagaccgaccgtaaaattgggctggtctctcggcttattcatgagggttagtggactgtaaggtaaattttgcaataaattcggaattggaataaagtttcactgtaaagaatgggagggacagaaaaacacatggtgaagcgaacttcatgcattgaaaagttggttcgagtttttccgccgacaaaaaaaaccttgatggatttgtcggcactggcggaaaacaattccaacgcgacgcattggcgacgaaatcgcaacgcggtcacgcgcccgcggtggccgctgaaagtgcgcaccggcgaaagtgtgtcgagacgccaaacgcgaaccaacctaaggggcgagaaaagtagttggaatatatcaaacctggaaacgggtggacccgggatatttctatccatttttttaaaacagaaatgcacatattaccaaatataggcatgaatttcccaatataaaggttccttactttgcagtaaaaatgctatttcatggatttttgtattaatggccactaaccatcaatagatccggttacgagaaattgatcgtctggcgaaatagcacaacacaatgccggtgacaaatcataggcctttgttgcgccattgtcgtcatgctcagaatcgggccgttcccgacaattaacaccaatggcatcgtttgtttttttcccgaggtttttgatttttgaactgctggaagtcggacgaagaatcccagtacgacaccgttttgttaggtcaactaaactggaattaatttaagaaaaaatgttttaaaatcaattattcccaaacaactccatcaatttcggcttgaaaaattccgtccaatttttgcgatcgtccgtttttgctgctacttacatttgacaacggctccgtccttggaacagctaaccagcacagcaccgcttgtcgaaaagcagacgcaaatgggcgccaatcggtggccacggtgtgcgaccattcgttgctgcgcctgggccccgaaacggacgtgtgcagcaacggcccggtgcagtttcgcctgtttcgctagcgcctcctggcgaagttgttgcgccaccgagtcgccaatcccctgctggtcaacatcgtcctcttcagctccttcttcatgttcatccacatcgcgagtaccctaaaacaaagaaaattagggccacattaatttaatgaacccattaaatttgattcaaaatttcctaaaaaatttcaatttcccatttaaaacgagtcgataaagatgggttcgttaatgaaaaaagtagtgaataaaagccaaatgaaaagaacaccttaaggctttccaacaaccgtttcgcctcccggtacgccaccgtctggttgtcttcttcatattcgttgtcctcatcctcgtcatgtctctcaacttgttcatctccaatactttcttcctctgatgaggaaggaatttcatcatcttccggagctattttttcaattttctgtttttttccaccaaatttttgggctatttttgaattttttcgaaaattagtttgttttttaatcctccctctttggttgccgcgatgcacatttttaaagaagcccattaaatctgtaaaatgagcaaaccgaaggcttcaaaacataccacaaaatttttggtacttatatggttcgtacgccacaaatccaagattaatgtcgactaaaacggaagagattgtaagcgagaggagcaaatgggcacggcacagtttgagggaacggcgcaaaacggaaagggaaaggagagaaatcgattagcgagtaaccgatcaattaattaggcaattaattaatcaaataagtacctaattaattaattaccttttccacttcgccgcctctccatcgaaagcaattaaaattagggagacgggtattaatagtacaccactatgcttataaggcacataaaaaggacaattccgtgcagagagggatggagtgtttctgtttaaaacattaaatttggcggtggcaacggattc

SEQ ID NO: 3260 - DNA, 735 bp, Heterodera glycines
caactccgtctggccaactccgtcttagtgcctaaggggccaactctttctcagacaaaaaaaatatataagaaatttttcaacgaattttaaaatacatccctaagaaattaaaaattttctcaaaaactcatccgctaaatctacttatttatttttatgacaagaattattcattaaaatattgtctgacctaacattttaaagtaccattaatattttagcactacgaaaatggaaaatgctgaaattaaatatcaacgaaaaaaaaaactcgaacatgaagggagcgaaaaaaaatgaaagtaggaaggagtagccactagatcacatatgcatatgaacaaatgcttaaatgaaataaataatttaattttttttctcaaaaatttctccttttccaccatttccttctcttttctcaccagaaccccattcttaccagtgcttaatttagtcccgccgggaccgggattccgatttttccaaaaaccgggaccgggacctgaaaaaaccgggatttcccgccccggtcccgtgcagctctattttaaacttttttcggagcttttcaaatgctaattctatttttagcgtgccgtaatttttttgtacgctaattcaaaaattatactgatcattagggctgggaattttaggttttaactatttttttgctcaaatgatttgaagaaaggcgctcaaaaaacgcatttctacgtttaaatttttcga

SEQ ID NO: 3261 - DNA, 6169 bp, Heterodera glycines
  misc_feature (6091)..(6091): n is a, c, g, or t
  misc_feature (6101)..(6101): n is a, c, g, or t
  misc_feature (6145)..(6145): n is a, c, g, or t
tccaagtaggtacattagaaaagcatcattttatctgatttactgcggaaatcaaagtcggtatgctggaaacggagaaagagcctggcgtccactgccgaacgaagttcgttcagcttgagaaacacagtggcgttgaacttttggttaggtaattactctcttttgtgtgacagtataaaaggaatgttttactagtgtgttttttcacttccacctgcgttattcctttgtttttatagtttttatttttcccataatttgctcttataaaggaattcattttgacgtgttagtcattttctttttctatgttgaaagttttttacatttttaatgtgtgttctctttttatagcaggtcaatatgaatgtgaataattgttgtgagacaaaaaaaataactgttccgactaccgccaatctgattctgctccttgtccttctttccgtcattgcattagttgtcatcgtcacactggtgatttgttttatagaagaaaacgaattgcgtttcgccccttttagggagtgcttttctacaaaaaacataaacagaggcgccgcacgaaggctgtctcttcagacaaaaatggaactacgcaagtgcgttcggacttggctgacgaaggaatggtagagttttcgtacttttatgacggacatggtctaacagtgtcaacggatatgttatctaagcatggtggaacttcggcagtgcttgttttaatgatgaaaaaaaaattgatttcctctattagggagtggtgatctacaaacataaaaagaagcaccgcacgaaggctgtctcttcaaacaaaaatggaactccggaagtgccttcggacttggctgacgtaccggcggagtttttggactttaatgagcgccatgttggagtttcgacggtccctcccgacttggaagacttttatgaggcccatggtggagtttcgacggtccctcccgacttggaatcaggacgcaaataaatgccatgatggaattaggcagtcaatattgtattgttgtatatatcaagtggaagtggaaactctataactgtctgtgactgttcttatgcatcataattctgactgtatcgcccgaataaattgcttttcttatttgtttaaaaccattttctcaaatttcaatcttaattgaatttcacagtagggcatgtactaagcaaatcgtattttggcattggagcgaatattctttcatttttccgttttttctgttctctctccgtttcctttttggttgctattaatgataagaaaatggggttatcatcagaaataaatatgtttctcaattacatattattgcatccctaaacttgatcctacttctgtattacttttttatattcttttttcggtacttgtgaatttcagggcttggaaattgcacagcaaagacagggcatgggccagcattgtgactttcgaagtgcagcaaaatactcaacttttgcccatacatttcatatggcacagcgccccatgagacctttctgatccgctcaataaagtaccgttcctcgcccctcacagtgaactgtcaatgaattggcattttaattaacgcagtttttgctgagaatgacgaactcaccacgcagcaaacgtacagtccgacaacgacatgttcaaattctctgcggctaagctgcaacagttgcaccaaatgccatggggtgaccataatgtgctgagtgccaatcccaaattgtttctctaattccatttgtaaatttgttccgccgtcgttcttcggttgttccgttttgtcaaaaaaaccaatttctttgagctctttccacattttcagcaaatttattttacgatcaaaataatgtgcgtacagtggcaacggttcatcctttaaaaaatgaatgaataattaattattgctttgtgttaacggcacaaaaaacgcaccctcattactaattcatcgatccattgtcgaaaaactttgtcagtaatatgaacgtaatccaaattgtcgaacaaatagcgagtctccgagtgtttgaacatgacgtatgtttggtctacgaaaatgacttcatcaacgatcacctgaaaaaatttaagccaattttagggttttcagattttgagatttctactcacagtctctgtgagtttccgtttacatgctgccaaacagccgaccaaacattgtctaatcgttgcgtgcttcctcaaatgccttacttccgagaatgagaaaaccacttttttaagcttttccgtgcaatgcaccaatgagtccaacgggggttcctcctgtgtttcgtccttcggcaggagatcaatttcttgtttaatagacattctgtaaaggttgagagtttgaactcgaataaaaaactaaaccgaaaagatttggtgactgtgatgaatgcgtatgtattaaacaagtaaaatttaggcagtaattgtccgacttttagagagcaaaaattggagagaagtactgaaatagttttcgttttatacccctaaaacattcaacgcgagtgacactaccacacatttacaaatgcgtagataggtatataaataaggcacatacgcctcgataacatttattttttcgacatttataactaaactgttccctaacccaatgtgtataacacttttaacttttatacaatttcagactttgatttgcacaaaacaatgcccaaacaagtgtgggagtggtatgattacactggtccgttggtcgtatggattgtgttcttctccgttatttttgtcatctccgtcacgtgcattttgtggtgctgcatcaaaaaagacgacgaccccaccgtatttgcgaaggtcgtttttatgcaaacaaaattggcagcattatttaattttaccgtaattttttaatttatttttttcccttttcagtagtgcagaatcttttgaaggcccgaaggaacaaaaagaaaatgtggaagacaagaaatgaacaatggcattgcaatttcattttcgacggggttttgttgttaacaaattgtaaaatgttccatctggttttttaatgcatgtgagcccagatgataatttcaaaataaacgttgctatgtgcactaaaactattaatttgggaagttcttaaaactcagtattactcatcaattttggttgattgtttgttgatatttggttctcaaattgtattgatgtgttctatatgtgtacacatgtatgtatgtctggtcactccgtatcataaatctgggtaacaattgaacaaaatagtcttatcgcgatcggaattgtattttgatggtttaggtaggccgagtttaggtgtttgatggttctattcattgacttttcgactcgctctttttttaactagcacccgaactgccattaacccgtggatatatccctcctccgcaggtcgtgtagattaaagaatcatttatcggttgtatgaatatgaatgtgtaaaaactgtaacaaaccattcaacatcatcactgtagaaacaaaaataaataataacatcagaaccaacccaaaatgctttctacatcaaaaaaggtcggttttaagcagaaaatgatacccaatagatcaattaaataaatgataatactgccgatgtgccgcccctttttttggaggaaaatttcatttttctggggtgggttgggaccgctgatcaggaatataacattcattttgagtgacccccaaaagcatgtcttcacgactttttcaaaatccacgatcggcagtattgccatgtaaacataacaatgtcattagagtactcaaataccactcgggcataaaaaaagcttctttcctaatatgattttagcctttcgtagaagagaaattttccatattaaataaaagccactcgagcgatattttgtcgactttcgaaaaaccaattcggataaaataataaaagtaaagaaaaaaacaacattctttttcctgttccttacgctctctcttctcccttattaagtgtgaatgtcaatgcgccattcgcgcgacacatacgcccccggtttgcgaatggtcagaacacgattctcccggtcatgcgtgaattccaagtcgtccggcgtgtaatctgtttgaatacgaaaatagcagctaacgtaaggatgaacaaacagatttccctggcttttctttacattttctgtttcaaaaatttaaaatccggaaaattcgtaaatgcgaggaaaaattggtaaacaagcacagagcattggttatctcattagggacgaaaacaactgaccctcgtagtacatgtgcacgtttcgtgggtaatagcgcagtccgcgaatcacaatgcgctcaatccaaacgtccgggtcaaaagtgccgcggctgtccaaactcttggcgagaattgagtaggtgtggtcgctcacttttttgtaagtgaatccctggaatcattcatcatataaaaaacatttgtgtgcgttggcgctcaattcgaatccccaaaatcggctacctttcattaaaccaaatgttatttatcataatcaccactgacccagtaaaggtattcatttttttcccggtaattgtgcgtttcgccgtcgtccaagtacagtgtgccgttggcaaattcccgatccgccatggctgcgatgtacagagttatggggtcgttgcgctgcattttggatgaacggcgcggtctctccctcaacttaataaaaaaatcaatttaaattgaacccaatctcaagaaaaagcacaacgcacgggaatgatggtgccgccacgctgatagaccgggattttctccagcggtgtttccgtgtaaattgcgccgggagaaagataaatgcgatgtgtgtcccaatcgaacctaatgtgccaacattaaaggatccgcactgatttgtcagttaccatgtttgtgctttgcccggcaaatacagcgacacttgttcaacgtcgggctccaccactggacgcaccaaaaggcccggaccgaccagccactcgcgctcctcatcgtaggaagcctcgtcctccggaaattcggaccacacggggcgcatcggcggcacaccggtctttgtgtgctcgtagaacaatgtgtacctggacaaatggacacaaagaatgccactgttgtacaatgccctcaaaacccgcatattttttaacgcaccaataaggcaaaaaggagtaacgcattcgaatcgcatcgcgcatggccgctttctcacgctcaccgaacagccaaggttcgcgccgttttgtgtcaatgtgtgcatgggcctaccaaaaaagtgattttaaaaagggatggacaattaaaagagttataataggctgttggaatcgaataaatagcagtaaattttgagaaaaagtaaacaggacaaacaaacccggaagaaaggctggaaagcgccggcctggtaccaccggaccaacagttgcgcatccggatttttgaagaaaccgccaacatcagcgccaacattgggcatgcctaaagtttaaaatttatatttgagctatttaaggcaaatattattcacaggtaatatctatttacccgaaatggacaccgacaaaagcattggaatggactgcttcagatgggaccattcggccacgttgtcgcccgtccaaatggtggcaaagcgttgggagccaacgaaaaaggaacggctgagcaaaaaggggcgcaatcggtcgcccgagcgacgccgctggccatcaacagaggccatcgtctgaaaagcagcaattaatgaaccaaaaatggagccaacttgcacagaattgttacaaaacgatggttaacattcagacacctgcataaatccgtagctgttgtgcacttcgcggtgttcccaaccgccggcgtgcaacgcgtctttgtgcattgttatttcaggccctgtgaacacgctgggctcgttcatgtcattccatgtgaaaacctaaataaaaaaatgtgataaatggtcagaaccgacaattaaatccttacaattagccctcccccatcacgcaatttattcaataattgccccaatttaaaacattttttanactccgttanatttctcattggatccattttttgtttgtatgatataattattntgacacatcatctcacattttctg

SEQ ID NO: 3262 - DNA, 743 bp, Heterodera glycines
ccccccccagacttagcctatcacccaaatgttccaaaaaatttcattaaattttcaaaaaaatcgacattttttgatgaaaatctcataaaaatggctcaaaagtgcaaaattcgtcacttttttggtcaaaattcgttaacaaatcgcattaagaaatgtaaaaattttcccggcggcgcctatcggcaccgccggaccccctgtccccaaaaagtctttaaaatggtgacatgcaaaaaaaaaggtcctcgccagggcggaggtacccccccccccccaaagccgaaatcctgggaccgtccctgatcatgtcgtgaaaaattccaaatcataaacacaaagtcgaatagaaagtcggatagttctttcgaattttgactttttcgagttcttgaattggtcatattttaaacaaatattcgaaaagtttctgtttataaatttcccaacaataagatcattttctgatagaattattaactacaaaaacttaacaaaccttcgactcaatttcttgaatcatctccaaggagttggggaacttcaccgggtcccaggtgaagtactttttgccgtccgtgtgctcaatatccagccaaagcacgtcgacgggaatgtcatgttcgtcgaaagcacgattcacgctcagcagatcgtcctgatcattgtaattccaacggcattgatggtaggcgatgccgaacaactgaaagacgaaggaagaaaaacgatgcgccaat

SEQ ID NO: 3263 - DNA, 1089 bp, Heterodera glycines
  misc_feature (221)..(221): n is a, c, g, or t
tttctttttgtatactcatggctttcctatagacaaaatatgattactcatagtttttttaattgacacatttttatcatttttttaaatgaaaatccgtacaaattgttgagcctattaatcccgaaaaccagccttttttgttgaaaatctgttaataaattacactcaaattttcaaaatttcccccggcggcgcctatcggcaccgccgggaccccncctcttcaccaaaagcccgccgaaaaaatttatatgaaacgtaaatctgaatttctaataatattcaatcatttaatccaaaaaatggttaattgtttgaattattttcactttaaaaaaaattaaaatttgaatttgaattttttaaaaatttaaaaaaatttttttaatttttaaaatttcccagttagtccaggttcccggtcccgaaaaaaaatcgaggtcagggtcccggtcccggcttctcaggtcccggcaagtcccggtcccggttttgcccaaaatttccggtcccatggcactctaatttaaacaaccttacaatttttggatgatcataaacatatgacgcatttaattccttagtaacttttttcagaaaataccaattttcattttctttatatgattagatagcataaaagctcctctattattttgttaaatttcaaaaaatttattgagttttaaaaaagtagggataaaattagtgatccaaatttttcgaaatattttggtttttgtaaattttgatagtttattatttagcaaataaaataaaataaaataataattaaatttaaatatttctatcattgatattttgtaacttcgtcccagcaccattttaaatattttcataactttttatgaatttttatttatctcataaattaaatccctattaggtaataactttttttcatttgtatggcaaaaaattcaaagattttgaaaaaaataggaaaatatctggaaaaataaatgttgaaatcgcaggaaggaaaacgaaaacaaaaaatgcaaagacagaccaatggaaaaaaggttggcattggcatcatttcctggcaaaaaattttgaaaa

SEQ ID NO: 3264 - DNA, 2842 bp, Heterodera glycines
  misc_feature (2808)..(2808): n is a, c, g, or t
ttttaaattgtttcccatccgtcgttatttattcacaatttattcatttcgtccgtcggcgatcactttcttttgcccttttcattttgccaacggaataaaagcatttccattatttatttatttatatgaaaaacagaggaagaaacttcacagtttcttttctgtcccattttattaaaagtttaatcaaattttgatttgcttttcccaaacaaacttttgtggaaaaatgccaagaataaattagttgttgaattgttaatgaattttatttggtaatgataatagtgccccgccggtggtgcttctctcccccccccccctttggcaaaagatatgttccagggaattttcgaagccgcttatcacgaatagagaaattcatttcgacatatcaaatcccgatcctgaattcagacaagagtcggatattcaatttcgaatttctcacatccaaagttataatgcattttggctgatcttcgagtggagaagtcattaaggccttattgagaaatagaattttcagttattgtctcaattcagattcgggattcgaacttgtacgaaatgaatatattcgtgttcagtgctccgaaaccccgaaaacattctcaatttttttgccagagacaccatcggcacaattagcattttttgataggaaaatgtattttacgagcagcaattcatcatcaaatgacgaagtcgaagaacacttcacccattttgcacctgatcagtgtaaaaatattaaaatgaataaaaaaatgaaaaatatcccaaataatttaatttattttagcaatttttccaaatttgagtctgtccgaggaattgcgcatcattagggctcggatggcgcgaattttggagaagaaacgaacaaaaacaatgggaacatcgtcaagaggcacaagcgatgatgtgaccgaacagaacaccggtaacaaaaatatgtttcattagttaaaaaattctttggaattactaacggaagtacaaaaatatttggtcaaaattcgggcaataaaaacataaaagtttagcctcttttataaattattattttcgatacttttttttgccatgggaattattgtaaaagattttcattaagaaatggacgatgatgatgatgataattgtgatgacgtgagcagcagttttcacgaggataccaagcagcaacagcaatacgagaagagaaaaacaacaaatattggtaaagcaaatgagaaaaagaagttaaaaattaattatgaatacggtaccaaaatatacatatacggtaaatcaatattaggacataattgatgattactgtacccaaaactatacggtaaatccatcagtaaaatttgaattaattgtttagcttttgacgttcaattcaaagcaattttgaaaagaatcactgagttggagaagaagcaacacaaacaaaatgaaaaagtgacaaaaggtaaaggaatttcgaattattgaaaattaaaaatgagtttttatttagcattggttggacaaatgaaacaattgcaaaatgatcagcagaaacagttggagagaatcagcgaattggagaagcagcaaacggcgattgttgatcagctgcacaccgcccaaaagcaaattggtaattaattaattaatacttgaattaataccttaattaatcgataggaatcgaaggattaatatccctaatgagcagtataaaacctagagatcagagaaattccgattttatgtcctggaaaaccaatttgttcacatttttttcagatgatcgcatttctcaaccccaaactgatcagcaaccgatggaactttgtgccaaaattagcgaattggaaagcaacacaaatctattgtttggcaaaattttggacgagttttcagagtttggcaattttgtgggcattttgaaggacagattcggaagaggtaaacaatcagattaataactgatcaccaacaaaattaattgaaaaaattaaaaataaaataaatttttaataaatacaaaattacgagaaaatcaatgaattcaatgcatttaaaaatgaaatatcatataatttttactcattaagagttgctaaattcggtccatcccaaaattcgtgcgaaaatttgtgaggtgaaaattttataacaaaataaacgaataatataaaaattcttttcagaaattttcaaatgttcaatcaaattgttgggatgcaaatgcctgccacaaaaacctccaaatttttggctccgaatgtttgataattcattataaagaagctgaaagtggtaagattaattctgcttaatgattaattaccgaatttcttctcatttacttaattgttttttcagcttgggtttctgtgttcgctaaatattccgtcccgagcagtgaaatcggcggacttttctatttcgaagtgaaaatcattaatttgagaaagtaggcaaatttacggggtaaacctaactcatccatgcccaactcatccatgcccaactcatccatacccaactcatccatacccaactcatccatatacccaactcatccatgcccaactcatccatgcccaactcatccatacccaactcatccatacccaactcatccatacccaactcatccatagcacgatacgagtcgtcgccgtggcatttaatgccacgactgagaccgcataatcaaaaatgtccacggtcaagaccacaagcagaaaatgccatgccacgaccacataagcagaaaatgccatgccacgacgatgactcgctgcgttatggatgagntggggctatggatgagttgggtatggatgagttg

SEQ ID NO: 3265 - DNA, 2071 bp, Heterodera glycines
atccatacccaactcatccatacccaactcatccatacccaactcatccatatacccaactcatccatgcccagctcatccatatacccaactcatccatgcccaactcatccatacccaactcatccatatacccaactcatccatacccaactcatccatgcccaactcatccatatacccaactcatccatgcccaactcatccatatacccaactcatccatgcccaactcatccatatacccaactcatccatgcccaactcatccatacccaactcatccatacccaactcatccatagcacgatacgagtcgtcgccgtggcatttaatgccacgactaagaccgtacaaccaaaaaatgccacgactgagaccgcataatcaaaaatgtccacggtcaagaccggcataatcaaaaatgtccacggtcaagaccacataagcagaaaatgccatgccacgacgatgactcgcagcgttatggatgagttgggtctatggatgagttgggtatggatgagttgggtctatggatgagttgggtctatggatgagttgggtatggatgagttgggtctatggatgagttgggtatggatgagttgggtctatggatgagttgggtatggatgagttgggtatggatgagttgggggtgactccaaatttacattaaattattattaattaaatatttttaaaaaaattggagaaatatgtaattaacaaatattgtccatttatatgcgtaaaattaaaatgaatcaaaaattcttatatggaatcataagaagaaaaaatgtgagatgtttttcaataacgaaaagttgtattgtttttcattttgaatataaaaccctaaattatacttattattttttcttattaattttcaaaactctgaaaatatggacgaaaaaattccgacttttttgttttcagttgtgccaaaattggattctccaccaaagcaatggcattttgtgaaaaagcggagggactgaactgctatgtgtatcgaaacgaaggcgaattttggacgcattgcacaagcaaaaaaggaaagccgaaatactcacgagacgatgtgatcggatgcggcgtcaatttggcctcgggacggatcattttcacaaaaaatggacaaccgttgggttggcaaaaacaataaattacttaatttaattttggggactcaaatgccttttaagacaccgccgatttgtttgtttgtccatcctctccttctgctaatgatgctgttgatcatcggttgtttccatgcgtttctttggccgactcgggcgatttaattgaggcaaatttcgggcccaatttcaaatttgaccctgccaatgccgaggtgtgtatttctgtgttgagcatagcctagtaaatttttatttcaggaattttcgaataccaaacaaagaaattgctgggatttagccgtttgtcacaatgaaatcacaatttctggcccacacaatttgattgtccgtcataaaggaagcggaaacggtatgctcctactgtatttacaggaaatttaaatatttgttaaaatttaaatttttcacaaaggttggcgttctgtgtttgcaaaatattccattttgcacaatgttgcaactgagtccattgacatgttttactttgaggtgaaggtcaaaaacatgaaaaggtaagggcagcttgtgctaattaagaaaaaaccctatatagatatttcacctatatatctctaggattaaattttggggatttaaacgataatttcttttttttgattactttcttacaaaatttgatttttataaatttaaaattttgtaacatccaaatcgaagctgcataatgccgaaataaaaaagccggataaaatggtcggcattgattgttgactgttaattcggctcaacattgccaatttttacaagaattcaatttacttttttccacttttatctgtgccatcgttggatttgccgtcaaaaatcagacatcgctggatggaacaattcaaaaccgcaccggtacttacgcattcgataggaatggcact

SEQ ID NO: 3266 - DNA, 3093 bp, Heterodera glycines
cactctgaaataaaaccctatttttgaagccgaagttttctcttaaattatttcctaataatattttgtgataaaattcatgatcatatacacaattattgacagggaaaagggaacagtgagagacttaattatttttgcaacaaaaaattaaaatattttatcttttaactaaaatgtataaatattttttgcaattcgaaaaaaaatctgtgtaattatcgcatttataaattttaaagaatatatttttttgttttttaatatttgttaagaaattttaactttgccttttttgcagtttttttaaacttttacaaattcctaaaaacatgaatgaaaaatgtattcctcaaattaaattgccaacaaaaaaagctatggtgctattttggcatttgttccttttttagcatggcaccatgccttctaaattaatatctgagtaatggggaggccatggagaaatgaaactgggccataccttttaagaaaatgccaaggacgaaaatagcacaaagcatatttcaatgctaaaaaggaataagtgtttccgataatgaagaaggatttacttgtcgaaatttcgggtgcaccccaaaatcaggccgccgaaataacgccagccgaaatcacgcctggacaaaaccacaccattatgaatatttttttaaattttcaaacagaattttttcatgaaaaagctcagaaaattttaagaaaagatttgttgaaaaatttcagaaaaatttagtaatttatcataaaaatccaaaaaaaaatcgcagaaatttttaaaaaattttcttgaaattttcttataaaaaatttcaaagattttttcattaaaaaatttaagttagaaatttaaaaaatttcaagcggcgtgattttgtcccgttccctttcctccattatttgccttaagaggtgttaatctgtgagtgcatggataccattcctattctcatagtacagtacttttttccgctttttacataaaggcatcatcagcaggtgtcgttattgagttttcaatttttctttaaaaattgatcggattttccagaaaaatccatcaaaatttcttgcatatttcaacaaaatttaaatttccctgtggtgatttcggcaccgcctcattcccccatacaaaaaataaataaattatttatggaatccaatcagtgatgggagactggattaattattttataaaaataatttttgataagttttggaaaatttttttatgtcaataatgcgataacatttaaaaccaatttgaattattatatttgtgcaaaataaatatatttttttaaataatcataaaattttgcaaatttcaaaaaataatctgtgactgttaggtctgaagacgtttcttaacaaataatcaggcaatttgtccaccctcttttgccgatttcattttattcaattttggcttcaaaaagaaagaaattaattttgtaattaacaaattaagaacggaaaatgcgttttttataaataacaaaaatattccaaaatattatttttttatttaaatatttttagctttttgtttttattttgttaatttttgctttattcagcgagaaaatggcttccgcggatgagtatcttcacatcttccatttccttcatccaaaattgcttggcgttgatctcgctttacgctgcaacctttttgatgccattgttgacgcgcattttttgtcaagaattcggaccttgggcaccatggaaattcgccaagcaaccggagaaaacggagccgacgacatgcaaattctcaatggcactggggaattgctgcccattgctgacagaccagtgccccatcgtgtggttggattcgaaagcattatgatctcgtaagcacgaataaattaagaatttgacctacaaatatgtgtttttttttattttcttcagttacattagcccaactgtcgccacatttctgcaaaatttgggacatcttttcgcctcatgtgactcttatttgttgctcgaaattgttaatggacatgtgttggaatttgtcattcacgtccttttgccgctcatcaaacagaaagtttatcgcattgaattcgatcctaccggacagaatggtgacgcattccataaattacgacaatacgttcctggttttctcaacgaatgtccatctctccgtgtcgacttcgagaggtgaactgtccattttttggtttttataaattaattttatctcttttttttagctttttttgagtggtgcttcgtccgcagtcaatttcattgtgcttatgacgttaactcgtggttctgtcaagccgtttacgatcactaacgatgtcaccagggaggagttgaagttggaatatcgtaaggaccacggtctgttgcttgtccggtgcccaatttcgcgcgacaaagcaaaatggaaagcatatgaggatggggcgttggaaggagcgatgaaccgaaacactatttatgttttaaaaaattgcacaggcggctggtcagttttatgaagttttatgggacaccatcagcaaaaactttaaaacccttgtgcttaaaaatgtgtattttcttgaaaattaaaattttatgtattgaaacctggaatcttattatttagtcaattcttacagctgttttaacgtagacctacaaattcctgattttctcccaccgaaaaaatgctaaaagatcacaccgcataaaaatccgatcacttaagtcatcatctcttacaataatacttggaaaaatactatttaaccttgtaatgccttggtttcaaatacaaaacatttgatgaaaatttatataaaagcaattttcaattttatttaggtctcgtgatgggaaacccggcccaagcaatcaacaatagaagaagaagcaattttagttgatcagaaaaagaccattaaattttatcatatttttattatctttctcaatatgtcttgtcattttgcaactttgtgaattttggaggacataaaaattcaattcaaaatttaccattcaaatagaagaatattctattgtttgttcatttatgaaagtttaattgagcaa

SEQ ID NO: 3267 - DNA, 4227 bp, Heterodera glycines
ccggccctattcattatttatttatatatttttttacattttttttttgcgctccaacgccaaaatcttctagaaaatttaattccaattcatttggttagtttttttctttccaattgttttctcggattttgctccccgttttgttggccatcacgaccaaattactacattttttgcttgattccacgttttcaattctgccattcgactgtatcgtattcattttttgataccttcttaattatttgttttgcttttttattattaaatatatttttaattaattttatttttgcttttttattattaaattatattttattttttccatttttacctcgcttctttttcttttccaatggcattttgcagttgcgtcaaagtgtccaaaattgggtttctcagtttttcgtgcattattctgagcccattgtcttggtaaaggggcaaaagaggtaacagtaaataattttgcattataaataagaaatttgacaaaaagtctgaagaaatttcaaattgctttaaattccctaaattaaccgtttaatttaatcatttaaaaaaagaaaattgacaattgacaattcgtcaaattcaacttttaaaagaattaattagagttgagcgcgaccggggaacacggacaactgagtaccgaagtcccggtcccgggtttgcccaaaattcccggtcccgctcaactctagaattaattattatccaaatttgtacatataccaatttttaacgtgaagagtttggtcaacagaactccaatccttaacagcataaaaatttctcagaatccaaaaaacaaagaccgacgagaccaagaattgaaatcaggaaatttcccgggtcgggaactcatgcaacaatttaaacatgacatatttttttatattttgatggatcgtcctttattcttaacatagattctctaattcttgaaacgagccgcccagaagagagggtaggataaggcgagaataaaaacatttattttaccatacattaaatttatattcaaatttattttttttaaaaacttgtgctttgaacatcgaccacttcgccttttttgcatttgaactgctttgagcactaagccgaactttgccaaaccctttatccatgtccctgttcaaaatcagatacagatctcggctttcctggtccaagtcaaagccctttaaccggatgataaaaaaggtataaaaggaaaatttaaattttatttttaaaaaatattttttggctttcttcaatatcacttgcttaaattatattttattagaatggaaaaaaccatttttaaagacaaggacaacctaattgtattgattgccaataaataattgatttttattgcaacattctcttatatcttatatttacaattttatttaattttatttttatgttttagtaatataataacatttaataatatttaattattgttaccctttcttataaactttcttgtaattagccattttatttcttgaagaaaaagaaaacaaaaaataataattaataaatagcaaataaccaagactaatgtaattaaaatctttttggcatttatttttggcaactttcataaaactcgaaaaaaacacattctggtaaaaaactaaccatttgaaaaattaattttttatgattaatttttgaagtatcgttggaattcagaaattttttcccttacgtcctttgaaatcacaaatcacttaatcgttattactattatttataagacaagagattttaatacttatgccatgtttgagaatgctttcatttgattctcaaattggaatgaaataaatgaaaatgaaaatggttattttttacctaataatataaattttagaatgtataaatatttcgataaacaatccttgaaattttctctttttttcttcgcatgttttatattgtgttacgactgtttttgggttgatatacggaagcaaggtaattaaaaaataaaaatgaaagttctaaaatactgaaaaataatttattaagatttaaaaagcctaacggagcctaaatcatattttatcaatcacttcggatacaactttcaaaaaggtatgaataattaataaatgtagtttataaattaaatcttattgaaagcaaaatgaatttaaggtaaaatttacgaaaaatttcgaaaaaatgaaattgaaaaactaaagcaaaagaaaaagcgaaaagaaatggacagtgaggaagtgaagaagcataatgaggaaaaggagaaggtgaagaaactgatggcagaatataagcgaaaggtgaacaaacaaatggaaaagcatgtcgaggaaatggagaaggacgaaaagctaaaggaagtgctgagggaaattgaagaagcgcaagcgaaacacccgggggagaagagaaaagcggcgaaatccatcacagagataaatgagaagcattgggacgaattataccagggggacattgagttgagcgtggaacaggcacagtatttgctggatactgtaacaaaacccgaaaacagagcgttgatgagagcgaagcgaggggcagccagcaatgctagaaaatttcccaatcacaaatggcctattcttgtcccattctcttttgacggctcaatttgtaagtttcaattaagagctgaatcaacatttaaatacctccgtgtttcctcgattattggcccctccattagaacccctactcccacttccattaaagccctcagaggggttgaaaagagaaccttcgggactcgaataaaagaaaatgtactagattatagaaataaataaacgatcaattttttaagccagcgaaatgaaagcgcatatatatgaagctgtaaaattatggaacgataacacatgcttgaatattgttgaggatgacgaagtttctcctagaatccaattcacaaatattaagggcatgggatgcctttcaaaagttggaatgcaatcctcggatacataccaagaagttaaacttgaatacccaaattgttaccaagtaattagtaaatcatttacaacaataatctttaatattttcaaaagcttggaacaattgcgcatgaaattggacacgctttgggattttttcatgagcatgagagatatgatagggattcctttgttacgttttacgctgataatgttgaccccaaaaattattacgctttcgaaaaagaaacgattgagatgacagacaattatcaagttccttatgaccttggctcagtgatgcactataacgcaagtaagcacaaatttaaaaaaacatgttttatgccgagacctattttgcagaaacattctcaatcaatggtgagtatacattggtgcctcgagtgggtgcttcgtatataaacacaattggacaagaatatggtcccagcctcagtgattatattgttataaacaaacattactgtggattagagtttctcccggatggatcaaccataaacacaggcatttacaaatttgtttattgtacattgtttttgtaattaagaagcgtgtcatgttacaatgaactgtgacaatgatgggttccagaacccggacacttgtacaacatgcatttgcccacagggttatatcggagcgaaatgccaagatgttgacattggtggttatgcccctgccagcattgcaaatacttgtgaagggaatattttatttgcaacatcaaattggcaatatgtaagcatatattagggtgcaccatttttacttttcactgatttccatgtcatggtcgctaaaagctttaatttggcgaacccaaagaatcaatgaaataaacatttaatataattattaaattattacaagcaaacaaattttatgaaatattaagaaacaatcaaaacaaagaaagaaattcatgcattcactagcaacaactcctatgtgcaaatcctatatttttaaacttctcacattttattatttcaatttgtcatcacttaggggcttcctatttgtaatgtagtagtagaactctcgatccatttcgttttatttcacatttctcttagataattggacaaattggatccagtaacttggactccaaaatcgattatgcctactgtcattggcaaatctttcctgacattggcaagactattctcattgaagttttggatgttggtgtaatttgtggagatgggtgcatttgggg

SEQ ID NO: 3268 - DNA, 1766 bp, Heterodera glycines
  misc_feature (1723)..(1724): n is a, c, g, or t
  misc_feature (1731)..(1732): n is a, c, g, or t
  misc_feature (1751)..(1751): n is a, c, g, or t
ctactgtcattggcaatatttcctgacattggcaagactattctcattgaagttttggatgttggtgtaatttgtggagatgggtgcatttggggaaacacagagattagaacagcagcaaacagaggcaccactggagtacggtatgttcagcagagaagacaacattttgttttattaacctgcctctgatgtttttagattatgttgccgctctgatctcggttcatccggaaagcttaaaatcacagcaaaaaatggatatgcgttgatcagtctttactcctttagtgatatacagcgctttgatatacgcttcctgcagtattaacctaaaaactgttgttgtcccgagtactgtggctacttttcatcttgtaatatgtatatattttggcatttttataaatcacgaaaacaagaaagtctgaaaaacattgaaaaataacatctaaataggaaggaccccacttaaaattttatgcattgtaaaatgccagttaaaaacctaaatatttcgcgaaattaccttatattatcgcggacatcacctgtgcgaagagcagataatgcttgaattttctcaactcctttctcaatcgtttatggatgaattattaattcaaaatctatcaattaaataatttcagaaattaattaataaatggcctctgtgtgaattctctgatgattatcgtttaattattaggggcagcagactttttttttgaaataaaatataattttgaacgattaactaaattatttttttggtatagttcgactttactaggtcctctaattgcctgaaaatttgaataatttgcaaaaatctaaaaaatttgtaactaaaaaaaattacgacttattaattttttgtcttttttaaacttaaaattattgaagttattcagaataaaaaattgttgtatcattctatcttttttagaattttggacatttagtggtgtttttgctactttggacttttcgtggcttggacaatgatcggcagaattcggttttttcgttaatttaacagtatctaattttaaattttcgttatgaggcaaatttttctgcaaaaaagaattacaagcgattgcaataggcgacgccgggaaaattctcaaaatttttgattttattaattgttttcaccaaaattgttacttttggatcccagctgagaaaaaatcgttgttactttagagaaatatacaaaataagaaagtgttagaattacaggcgtaagcacttcattcttagaaacctgtacattttaattttaagatttaggccttcaaaatcggtataactagaaataagtgcacttggcatctctgtaataatagaaccaaatttcaaagtcggctttacaattgataaatttgagcttggcactcaaatgttcgctgaagtttttcgtaaaatttccaaaatttcatttgacttgctaaaattcattttcataattgccaaacatgcagagcagtgatggacagaattccgttgtttccgttagttttactgtctttgtttcaaattttattatgaggccattttttgttaaaaaggaaaaaaagcatccctcaaattggaattttagtcattcatttacaagaaaatttattaaattttccatctaaagaaggtaattcttttcctgaacattttgggcgaatgaaatgattcgtaaatttaaatttatttttccaaaaannacaaaanntgtttcttcacccattgantttctttatgctgca

SEQ ID NO: 3269 - DNA, 4736 bp, Heterodera glycines
ttccgatttccgacttccgaaaatttttggggcctcggaatgccatccctgatagggaccgccggaccccctgttcctagttttttgaaaaattgcccgccaaaaaagtggttttgaaaagaaaaaaatagtcaaatttatgaatcgttaataatttgatttccgatcaactttttaccgtcggatccaatcgaaaaatcttagtcgacccatcagccccttttaatgcatcccgccagcccttttttggaaattctttgaatttaattgaaattttttcgattttccaaaatcccgcaatcccgcacgggatcccgcaaattttaaatgcgggatttgcgggatttattatcgagtctttatcaatttcgcgaaaacaattgcaaatcagatacatttcgaggtgttcggggtaaaactcattcgattatcggccaaaattgagaaagtcgaaatttaggggtctatttttcaattttttgtattttccttaagaatttttctcaaaaatgccaaaataggtgctaaaaattcgaaaaatgccaaaataggtgttaaaaattcgaaaaatgccaaaataggttgtaaactattttaggtgccaaaacgccaaaataggtgtttttaggtgctaaaaagtcgctctaaatcgaaaattgttaggagaaaatgctatttttgggcttctctcatcataactaagccgcaaaaaaataggtaaaaacctaaaaatcccagccctagtaattaatgaaatttcatatttatttggcataaattattattttttcacatgtgatcagcacagaagaacaaaggcccaaatcgctccaacaaattcggttccattgcacatgcaccgatcgaaagtttaacatcacaaaaggcacatttaaagcacgaaatgtgcactaaaatatggaaatttattttaaataattttaaatttattattttttactcgtatgcttctcaactatcagcttctccgttggctttatttctgtctcgcaaatttcacactttggatttggcaaaatgccactgccaaagttgatggccatttttgtgcctgatgagaagatggctgatgaatttggaataagacccgaaaaatatttaaaaaatttaaaacgaatttctagttaaataaacatcgcatttaaagcaaagagaatggagggcttttcaattttaagttttgatcgatttgaagacaattaaagatgggaaaagggcccataaagaagcaattgctgcgacatatgcttgctttggttcacttcaaaaaagttgacgaaattattttttgagactaaaaaaatttaattaatgaaaaaatataaaaaatattatttaattcgaagaacaaattttatttcattgagaaaaaattaatataataataatcaaataagaattatgaacatgaaaatttttgatgaaaatgccgaataaatggagaaattttgaaaatattgacacaaggtgaagaatggaaattaaggaaataaaatattccagaagtttcaaaccaagctgaaaatatttttagtaagcattttcggctgaaaaaagtgtattaatatgaaatccaataaatttgggccctaataaaaattttaataaaaagaaaaattgaaaatatatttttttgccttttcttacttaaaaattctaaaaagtattaatagtaaaaaaaggttcattaattaatagagagaacttggcaatggaccgggaaaaggctcgtcaaaatatttaaattttctttaattttttccaatgatgatgatacacactctttttgtctttaaaataacacctattttggcattttcgaactttagcacctattttggcccttttccagaaatttcatagcaaaagtgcaataaaaaagaacatacacccttaagaatcaatccaaaaatttcagaaaaatacacccctaagaatcgacccaaacattttcaaatacacccctaagaaataaaaaaattttgtttaaaaaatatctccaaaatttattatttattttccttgactagttgccttgtgcaagcatagttgataaaaaaaattggtcacttttggatttttgtgcataaagacactggatatttccaatctttaacacctatttacgctgattttggcatttactgcgtttttagcacttattttggccttttttggcaccaatttcagtaactttagcacctaaaaatcttttagctgtagtaattaaagaccaaaaactatttattttagagacatttactgagagaaagtcattttaaactaaaaacaattgatcacttaattaatgaccatttgatgaagcggtggtagcaaatggcgaattggcccatcattttggcctttagtttaatataaaagcctgatgaatatagccaatgccttctgcttctatttggagttgaaaaatgccaaatgaattcacaaattctaaacaatcaaaaaacggtgtaaatatcacaaatataatttatgaaacttatttttggagggggtaaattccatttccatcagaaattcacgatccaaacgcgactcagccatggccaaaatgagtacttttcttaacattttgctttttgattttttgatccagaaaactatggccttttaaatttgtccttttgaaaagtattggtaaaaattgtcgcgaattttaaattgacgaaatttcttttattaattatcaaacagatgcaattaattgttccgattttattgcttctgacattcgtcgtcagtttgccaatttgccatggaatgaacggacttccgggcgaaaagggcgagccgggctacccggggatgccggggatgaaaggcgaaaaaggccagacgggcgagccgggcgcgccgagctatccgggccttcccggatggccaggcgaaaaaggcgacccgggctatccagggcttccaggtaaaaaatccgactttttttaaattttctttttatttattacaaaaaatttagaaataaaatttatatttgttttattttcaggtcttcctgggccgattggagaaccaggtccaaattcaatgaaacgaacacaattaatttttggtttttcaatacttgcaggatattaaattaacaattatttttgaaaatgaaaataatttattttcttgaaatatctgaaaatattctcgagtcgaaggaatggcgacataaaattcgggcactgggaagtttaggcactcttataataaaagaattgaaaaaagtaaaaaatagttatagtaaaaatgaattaaattaaaataaaaaacaaataaattttaatcaagttcgcaatttagttttaaggagtttcctgcccatttaattaaccattcttttttttgttttaaatttttattttataaaataggtaactatgatgcccaaattcgggtgccgaaaagcttccccctgcgactgctacccgaattaatataaataaaattttttggatagaagaagccttaaaccaagtaggaaattatataatacaattatccagagtaaaaatttaattgataaattctttcgttctaattctccctgatttatatgaattgaagacaatacaatacatatatatgtacctagtaaaataaatgaataacagaaattataaactggaagaaaacaatttccatttttgccatttttaggagtttgtgccgaaaattgtgaccgaacaaaacgccaaggcgcggagaaccaatgggccggcattgcagggacaatcagcgaacggagcgcaaaattggaagcggaactaagccaaataaaagaacgattatcaaagcttgaaaaagcggaggaaattccaaatgagtgatgctaatgaatgataatgatggcacttatactcataatggaattgaatattcatttgatcacaaaaagacaatcgtttacataatttgattggagtctccaattattttttgttccgacttacagagttacgtaccggaaaaatttcctaggggctggataaattcttcgtggaagtcgaaaagagggacagaaaggggagcagctcgttcccccccgagaaattttttttttaaatttgctaacagaactttttcaagaaaaaaaatcttagaaagttttttcataagaaacttctaagaaaaaaaattttcgaaaatttttccaaaaaatcgctgagaatttctcgaaaacgacaatcttttgaatgatccgacttccgaaaagtttgagggctcagaatgccattcctgcgctataaacttaaaataaacattcatcccgttcaaacattttattgagtggactataaacgacctaatattattatcagagagaataaattgcaaattgcatcatctaaaggcataattaggtaatttacataatttattttgaaaacacatcaaataaaatgattgattccttcgtccgtttgtccattttcaataggtcgtccagccaatcgctgaaaatccgagccgactcgcctctgaaaatgaggagggtttttaaaatttttcgaaattgcaaatcccataattccagggggggacgggacgaaatctcgctggccgaaatctcgccggctgaaatctcgccggccgaaatctcgccgcagaaatttcaaaaaaaaaatttcaaacttagaaatttttcaagaaaaaaattttagaaaattttttttataagaaaattccaa

SEQ ID NO: 3270 - DNA, 7186 bp, Heterodera glycines
aattggcactgatttcgccccgtttcgatgttttagtggacaaacatttcgatgggcaaacgcgaattttttcaaatttcggtaagtcttttgtttttgctttttttgtaagtgattggtttttttttgtttacttaattgaagtcgtaagtttcattttttcaaattggccatgaaaatattttctatctaaaattttgattggattcggtgcttaaaaaggaatttgtaaatattttttaagaaatttgcgattttacttatgtttcagcatattttatctatgttttaaattattttatttgataattaaaaacggtaacaccttaagggaaacttttttctcttaaaattaaaattttttttggaaatttgatatttttaatttagttttatggccctttttactcaattaagactaaaaatggattttctatgaacaaattttctcatttaactaacatattttttcaaattttcagctgggtttgcaatgatgtttggatggaaattttgccctgttttgaccatgctcaactcggcctcaaattggcactgtttttgccccgttttgatttgctggtggacaaacatttcaatggtaaacgcgaattttttcaaatttcgataagttttttgtttttactttttttgtaaaagtgattgattttttggttacttaaactaatagtgttttaatggaatttagtagccccaaacctttcttggtttcaaaaaatggctgaaaattattattttcccaaaattcataattctttttgatttttttgttagagtgtcgggtttttttagggctttttgcttatgtaatttttggaatttgaaatgcataaaaacggtaacaccccaaaaaattgaaccttatgaatttaaaattggtctctaaaatcgcagaattttgaaaagtttcggtggcaaaatcataaattatttaagaaaaaatcaattacaattagctgaaaccttgctggattttaaattatcacgtaattatagaaactttaatttttagaaagtttttcattttaaaagataatttagcaattttttagtggaaaaccccataaagccagaaagacaaatatatttttactttttttcatttaaaagtaccaaatttttttgttttttgttactcatttttaaaaatttttttggattttaggagtttttccctttcttagcattgctcaacttggcccaaattagcactgctttcgatcggtttcgatgcgttggtggacaaatatttcaatggcaaaagcggattgctgcgcaagtttttttgcactgctttcgctcggttttgatgcgctggtggacaacatttcaatggcaaaagcggattgctgcgcaagtttttttttcacaaattaaccggtcaaatattttttatgctctaaattttttgattgcattcggcaattaaaaattgaaattttcaaaaatttgtattttcaaacctatgaaaatcaattattgtgaatttttgaaatctcaacattgttgtggtgatgctgtttccatcccgcaaattttttgtgagattaaaaaaattctctcaggaaactgctgtatttggccgattaaaatttttaaaattcatcgatttgaccatgatttgaataaaataagaaaaaattttcagatgcacatatatattaaattatggcaaagtgtacactaagtaaatagttttagtaacccaaatctgaggttacttaggaaataagtttcatacactttggcacgcataagctccacaatagtttttaagaagcctttactcttgattaataaagtaaacatttttgttttcaaatatttgaacaatcacttgtaaaggcttctgtcctcttattcattttgagattcacatttcttatttgtatcaaaatcttatcggtctgctttgcgaccatgataagattgtgcacatgccggtctgcttcgcgaccatggcaaatatcggtctgcttagcgaccatgatattagtgtacacgccggtctgctttgcgaccatggcgaggctggtctgcgttgcgaccatagccaaccgtgtcggtctgctttgcgaccatgacacagtgccggtctgcttcgcgaccatggcacccatatcggtctgctttgcgaccatgatatggaaagcaagcccagacttgctctcgccaagagatgcatgtggctgggccgctcaatggtggcgccatgaattccttatcgttgctggccaacagccggtgcgaagctggtcccgcactttgtcaagaccagtggactggtgagaagtaacgtaggaaatctgagttcatcgaatgaatgtggactgccttttgaggattgtggttcaatggccagtcccttaaaggacgaccatggctaggctggtctgctttgcgaccatagccatcagtgtcggtctgctttgcgaccatgacacagtgtaaaattggttcgctgactggcccttcggggcttggtcgcactaatgtggttcgctgacaggcccttcggggcttggtcgcactaatgtggttcgctgacaggcccttcggggcattgtcgcatcaatgtggttcgcagacaggcccttcggggaatgtatcgcaccaacttttgcatctgcattcttattgagatgtgtgagccctggctgatggatttcagcacaggacgactacactccacggcgaagaatgatgacagaataacctttttgcgcaattttaaataaatatttttattttatgtgcatcatatggttattttcctcatactttgtgccacatttgcaacactttctgatttgttgtttcagatgccttcaaaacaaaagaatttgagaaagaagatgaaagatgtgtatcggcgacaggcagagcgatctgtcagtcgggataactcacccgtctcagacgggagtgcagatgggaatggagaggcatcggcatctctccgaggtaccaccaccccaagcttaagtgctttacaaataagcacgccggcgtcttccattggaagtaaaaaaagaggcaggccctcgaaagccggagcgaagccaatcttggctacgcaagaaagggtgtctctcattgacacacctcgaactgcggtcactcaaagtgaccagggttcgccgtgcaaaaaaaggggaaaggtcgccgagtgtggccaacccatgttttccaatgaagctattgctttgacgcctgtttcgactcaaagtcgtggagggcgtcctgccaaaaaaattggaggcccaggccgaggcagactcactgattccatgagcaaaagctctgaaatggatatcaatcttgaaaatgccccaattccggcaccctcgcacattgtgtctgaaaaaattgacttcagcactgtgccaattaatttcgccacatcgcgaaatatggcctgtaaaatttggagatgggcagcaattggcctttatgagcgtgatggcgaaacagcacttggcccacgctctggcccaagattaattgagacctgttggaacaggccaaatgaatggctaaatgacagctttattgttgcctatttagcttacattgcaagcatttcacaacgaaaaacagtagttgtggattctttggcatcgagaactgatgtttctcgattttccaacgtgaagaattacactttcggctatgatccgaatgctgttcctgaagttgtgcttatgccgcttcacttcccaaatcattggactctcatcgtctacgatgttgcacatggtgcatacttccttgactcgctgcatatgagcagcttgagtgatgagagaatggcactcatccagtcaataattgctgagatagtgcccgggaatgcgtcattcgctgttgaatacgtgcagcaattgacaaagcaaaatgatggtaacagctgcgggtacttcgtgtgcctgtatgctgaatcctggctgatgaacaaccgtacatttgttctgccggatttgaacatcaattatgagaagaagcgcattttatggcacataaatgagctttatggctcagatattgtgccgtttcatccaagggaaggtgtttcaacatctttcgctgttgtgtctcatcacaatggggatgtagcgcaaacttcctccaaggtcataatgccaatggaagtggatgattcagcagtgcttccttcctcggaagatactgctgttcttgcgcaagcaccagtgatcggcgaaaatcaagctgacacccacggtgttgttgcggacacaattgtccagcaagaaccaattgcgcaggctgatgatgtaattttcatcagacctaagacgccaccaaggcgatcaatgcgcgttcaaaaaaggctttcagcttctgttagccgttcgccttcaccggcgccgaaacgccccccgccagcaaattcgatgggagtggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaccatttgctgccggaagggaagagttgtgctgccaatgcttaacccgcatcctgatgagctcaaacagctgattgtggggaataagcaatcccgtgaagggaaagaatttgtgcgacacatgtcgcgttataacaacctgttccaatttgcgagcgtttccactggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgtatcatcctgctgcgcaggcatataagcaggcgcgtgagcagctcactgagcttctccaacaacaaactccggaagagcttcgcttctttcgcatgactttgttgaatgagcgcagggctccagctggtctgaaagacccaaaattgcacccacaccaaataatcaccccttctacgggtgaagggatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgctcagaatgcatctggcctatttgactcggaagccgagtcagataatgagtcgtgcgagactcagtcaattgcatcatctgatgctgggtcagtcgcaaattcagatgctgaatctgtagcatctgtttcatcgcagcaccggcggattgacaaatccaaacaatttatctccctgcgagattattgcaagtattatctcgcaataagggatgaaaatgtggagttgcaataccaccacatcctttcatgtggtggaggacttggtcagcgctggatccttgaccaggctgcaaaaattgattggcaaattgcaacatttttgcgtagacctgacatggacctgcggatcagcactccaaaaaatctgctgcagtatttggtcaaccaatacaacaggcagcaggcacggcaaaaccccaatgcccaacagaaaactgttgatgacattggcagtgttgttcggctttccgaacacaacgtaaattctctccaatattggaagaaaatgtatgaggattgcaacaccgtttttgcacggtgtcatgacgcgaaaaaggcgcgtctcttcatcacattcacgaacaacagggaatggcctgagttcaaagagaatatatataaaaacggtcaagtatttactgaccgttttgacatgtggatgcgtgtttggaccagcaaaatcgctgagttccgagaagaactttatgagaaaaagttctttggaacaatccttggttacggtgaatccatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatacatatgcaactgcacagatgcagtgatagttggtgtggtcctagcgacccaatttacgggcggtgcaagaaggggttcccagccccttactcaaaatgtacgattttgcgcccggacaggcccgcaatgtatttccggccttcaccaactgatggtggtgcccaattagaggtaaacggcctgatatacgacaactcacatgtcgtgccgtataatccttatattctgctgcgttaccgagtacaccataatgtactgtttgcatatggtaacaaagcaaatattaaatacgcactcaagtacccttttaaagggccaggacattgttatgtcgagtgcaaacaagagtccggcaataaaatcggaattgatgagccggctcaatatgccaagatgaacttccgtggtgcaacggaagcatatgccattgttcattcactgccatttgccaaactttcacatcaggttgtcaaacttagcatccatatgcctaatcaacaaccgattgtgtacagggcttttcagctggtgagcaaagctcaacaaatccagcaaggcaaactgccagagacgcaatgttctgcctattggaaacaatggcaaaatgaatggaagcatgatccgaagctcaaggacatgctttttgaaaaagtccctgagcattttatatgggcgaaggacaaatggaacaaaaggaaatataacctaacaaagagaccaccgatcggtcgaattgtccctgttccacccaaggatccggaaaggttcgcgctctattcacttatgcgccactttcccggtgaccctgaccatcttaaaatggtaaatggtcagccttgtacctc

SEQ ID NO: 3271 - DNA, 5380 bp, Heterodera glycines
  misc_feature (4009)..(4009): n is a, c, g, or t
  misc_feature (5308)..(5308): n is a, c, g, or t
  misc_feature (5315)..(5315): n is a, c, g, or t
  misc_feature (5339)..(5339): n is a, c, g, or t
tagatcactaataatttttgattcagggaaagttgaatttttaattgtgtacggtatttttttgttatttttacctagatataagacggaagatttttttactgaaaaatttaagccccatgtttcagcccaattaaagactgaaattagagctgtttctaaaactttacgttgggattcatttgaatagcaatgataaatttttgtatcatctgcaaaaagtttaattgagatttcttttggaatttcttcaggcaaatcattaatgaaaattaaaaataaaataggtcctagaactgacccttgtgggactcctgatttgacaggaaattcgtttgaaaatttttgatttattcttactttaaaggttcttccaagaagaaaatcccgaagccaatttaataagttgcctgttattccgggttttttgagtttgtatattaaaagatcatgcgggacttgatcaaaggctttttgaagatctaaataaattatatcaattttttggtttctaagtattgcattgtaccagtcttccagtgaggagattaattggagggttgttgatcttctttttaggaatccgaactggtgttcagagataagattgtttttaagtaagaattcagtgagtttttttgctattaagcgttcaaaaattcggcaacaggaacaagtaatagatataggacggtaattgtttactaaatttttgtctccatttttgaagagtggcaaaactaatgaagttttccagatttttggaaggttgcccgaacataaagataagttaaacagatctgtcaggtgcctagctaagattaagtgaaaagttttaagaaatttgaaactaatattatctggtgaagtgttatgtatttttatttggaagatatattaaaatttcaagaacgtctaatacattgaattgtatattcgaaagagtcggtaaattggaactatttgagaaagttgtgggcggttgtggataattactggaattttggaaagtcgatgcaaaatgtttggcaaaaatttctgctttttccccgtcgtctatgatagttttgttttcataaagaattaatggggtttcccatctttgaaaatctttttcgatatatttgtaaatatttttgggatttttgtcaagaaattttttttcttcgcgctcctgaaattttctaatctgaatttttatgtgtaggctaattgaattatataaaggcttgtatttgttcgggttttctttaagctttttccagatttttgccttttcctttatagaagcttggagtgaaatgggatatttgacatttttttattcttttttgaaggttatttttggtgaaaataagtccattgcatcaatggattctttagtgaacctattatatttatgatccaagtcaaattcagtttgcaatgagtcatttagatgaaagcttaggaaggaatttatttgatggatattttttgggccaaattttctgtaacttattacagtgggattggttttgtgtagaaagatagagagatttatgaaaagagattcatggtctgaatttattagactgtctttaatttcaacatctgttaccagcctagaataatttgtcaagcaaagatccaagatttcatttcctcgggtgggcccggtacaatgcatacttagagaattttttgcgaaaaaatttacaaaatgttggccaatttttgaaagtggggttggtttaccattttcccattttatacatttgccattcaaattgaaatcccctaaaattaaggtcggtccattgattttttggtccaaataagaaaaaagattttttgtcttcgataaattaatatctgggggtctgtaggccccaattagtgaaaagttttttaaatttttaaaacgtaatacgacaatttcacaaacgaatttggaatccgttgttgaggagtaaatgggatatttttttcagttataattgaaacgcctccacctttttttcggcccttatggcagaaaaaatttgataattgtcaggtaaaattgagtttaaaattattaaattttggttcttaagccaggattcggtaattatgaggaagttgactttttcagtgttgagaaaggctaaaagaaggtcagttttgtttaaaattgaccgggcatttgttaaacagcctttaaaattttgtgtttttttgaaatttaacattttaattttgtacagattttgtgggagatctgacttttggggtaattttggatttggtatttacggccttttccctagaataaataaatggtgaaaatgtaaaagaaatatcgtcatgtgaggtaaatgatgtcatgggtatcgcagatggatgagcaatataattaattttattgacatgggaaaattggtggtgaggtttaggggattttctgttttgagaatatattttttggaaattttggctacccccaaacctcagaacattgctgtcatgaatgagttttttcgatagcgtgtcagcagagagtcaatgtgaggaaaaggcccgctcaagttctctccgttcatcctccttcctttgatttcgcttcggagcacaagcatgccgttgtagatgatccagtcagcggatgtttcttttcgcttttcggcacactgcgcttgaagttcacgtctcgatttcagttgttcttgagtgagcaattccctgatgttcagcgaatttccaatgattttttgttccattggtgaaggcatgtgcgctgaaaagatgaggcggggagcacgacttttatgggacggcaggcaccatttcttgctcggtctttgctgtaccatcccattctgtagctgactatagaatgggtctcaaccccgagctggtcaagaaagtcaatgtctgagacagaattgttgacgagggagacggcgattttgaggagattgcttagttgtgaaatgatgacacgggcagctggagaaatggacgggtcgtcgtcaagtgtgtcaatggccaaatttgttgaagtcacttcgttgaggaaatgacgtttttgcggaatttgattaagagagttagaatttaaggggcgtttaagaagggaatgcgacatatttaatctcaaacttgggtaattaaaccttcttactttttctttattaaattttcgaaaagcttgcccccagctgactgatcctgacaagtttaaaaatatttgggaaaatatgtacataatccgctcaaatttttaaaatattagaaatatgaaacaattcttctctttcttcatattttcctaaattgtcttcaacttttcatttgtatgcccgccctccctcttcaaattgcataattataaactcttttatgtaatttttattttcttttaattataaaaaggagggtcaatctgtaaccctagccgagttataggccccgaaaagcgcataacgacaaccgaaatgttgaatcaattcaaccaacggttccattttttctgggtgctaaaatttgaagtagaacctagtgaaattgttagctgtgaatttattatattttaaaaattttaattttgctaaaaacgcctgaaaagattttcaatatgttttttatgttatgtagtatcattatcattcaagtccatattgcttaaaatttttctgaaaaaatgctttttaataaagaataaaaattttttgatttttatgcataaataaatttgatttttccaatttttttgcatacacatattttgacatttttggggttttagcacatatttgagcatttttagcacatattattacatatttcaggatttataacacataaaatctgagcttaggccaattttttaagaaattaattaaaaataaaaatattgatgatgacattgactttgtaaaagcaattcaaactgttgcatcgctgaaatgaattggtggctctgaaaagggacaagtgacaatttggcaaagaataaattagattttttcaattgtttttctcttgngcagctcattgaaatgggacaaaagcaatttagccatatattaattgaataaaattattatatttttataaatttgactttaggtgctttttcccgtttcctttttttacaaatattttgttgcttattaactcgagtttccaacacttattttgtccacatcacaatgtgcgcccgtttcaacttccatcgtcacgttcaccgcgttctcctccgcgcaataccacccattgtccggcaatattaattgctaaataaaaattggccatttaattaaataaaaaggagctcaaccagaaatgattcagggaggggtggacagaagtctaacacgcactaaaaatggctatttgtgactttcggactgattttcggggatatcctcaaatgtcggatcttcaaatgtcaaatcctcaaatgtcgggtagccttttgcatatttcaagatttatatggtttaataataataataattttcgaagataataaaaaaataattttctaaaaatttctaaatttatttcaaaaagcaaaaactggcaatgttcaattttttgattatgattatctttatatttataattcttaaatgctttttaataccatatttagccattttttaatttggaaggaattttggaaattttacgctcaatttggaaattttatatacatagatctacaatttttgatgcatattataattgttagccttaattatgtcaataaattattaaacgtaccgacaattgaatatgcccaatataacaactgtggtagggatcatcggagctaattgtgccttgtccacttcggacataatcactttttccttccctttgcgaaacaattcgaacggttgccgtataagggcatttgtaattgaaagcttaattttgaaatagttcacattggctttggcttttcatattttggcttaattaaccgctgttcgtaaaaatgctgacgcgttgaaatgccgacaaaactaaaattagtcgaaataccaacaaagctaaaattagtcgaaattccgacaaagctaaaattagtcgaaatgccgacaactttaaaaatataaaaatcattattcctgttaaaatataaaaataaaaacaatttaatttgttttacattccaaatcaattttctttttaaattttcaagctaatagagcatattacggtgtcatgacaactcgtacaaaggcaactagtacaattacttaggctaggctaagttttaggcttaggccttattttctaaaaacaatttttttttgtacaaatttccattaancccattntgataaaatgaattctgtatttanaatcctaaaatgtaatactcacctaatttatttactaattt

SEQ ID NO: 3272 - DNA, 4583 bp, Heterodera glycines
ttatcggcatttcgactattttttagcttagtcggcatttcaaggcatcggcatttcgatgtatcagcgttttgacagcgtgcctaattaaccaactcattttcattttcgtcgtatcgtattgcgcgtaaaacctcaagctgtatttgcttttgtgtacagctaatctccatggaagtgcttggatgtacaccgctctgctcacatgtttgctgttgttaaggagcaaatcggacattttgattttcattgccaacattccatgggctttgttagggtctgaaaggtgcatttagcaattttaggcatcaaccgtggaagtattggtagtgaagttcgagacatgaaacttacactagaggggtaggtcgaccaaaatttgtgggatggcatggaattccgattccggagttccgacgtttttggggtccttcgacatttttggggtcggattccgtctccagaaaacctttggggcctcggaatgcaatagttggtctggaggggaagggcggggttggaaagggggtcagcgaccaaatttgtgaacggaatccaaccatgcaaattattaatcgtatcgtactgtacatagactagccaaggcgtctccacagaaaatttgctatattaatgaaatttgttgaaaaattagtcaaaaacaattttctcttttctcccgtcacgcaacctccttcatgtcatttcttgaaccccccgccctacaaatggtgcgagatggaaatttttcgagaccaaaacatgacaagcgactcgagacctttatcaatccaatttttcaaatataaaatcggcagttttttcgttgggcaatttttacaaaatttttgaaaaactatactcattgtaccgtcataagttgaccgtctgttagtggggaattgcagttcattgttttgtatgctcggcattggttggttcgggaggaaatggtacaaaatagcatctatttcaccaacagtcaacacatcggacggaactgataaataaatttttgaaaaaattaatagtatgaaatctttattcatacccacagagtgtgtcgattaattggcaaatcccacccagtatggctaccagacatttgcggacggacatttgcggacggacttttgcggacggacatttgcggacggacatttgcggacggacatttgcggacggacatttgcggacggacatttgcggacggtttctgaataaaaaaaattattttttaagaaaattttttggaagagtgggccttgtcagtacggtctcttccggttaaaaagcaactaattacgtgtgtttcggcccaaccgtagacacactaacttaaaaagcgcacacaaacaaacaaaaaaaagcaaagcaaataaattttttgattaattaatattttaaatttattaatggcttgccaaaggcccaactggcaatttaaatataatcagagacactcaagtaggtcaagttttttgtcattttgaatggcatataaaaacaatgttgtcagtccatgcttgtcagattttgctctttttatttgtccatcggtcccttaatagctattctatatttatatttcctatacaattattaccgaaaaaacatatttccttaagtgactcacggtccatataagaagcgatttttttgaacaaatcttcaacgcgaaattcgtcttggcttacaaaaaattctgtatccgttacagagaatttgagtgggaaaaacgtggcagttatagatgattcttaaggcgaaatgtatttctttttaataaaaaataagaccttcgtttaaaacatcaaataaatcgtccactattaaaccgactaatgccccagctccgccaattaagagctcagatttttttaatagccgaacttcacggaagagtcttcccaaatttaaatttggccgtgggatatgaactctagcaatgatttcaacagaaagaaaaataatgaaaattagtatggttattagcttcatcttaaaaactacatattgtataggcttaaataaacgaactttaaaatgaaaatgaaaaaagatatgattctaataatagtttaagtaaaaatatgtttttaatcaaaaaatgtttttgcttttatatactctaaacgcggttccgccgaaagataatgcgctgatcagctgtcagataaaggaaatgcggttccgccgaaagataattcgctgatcagctgtcagataaaggaaatgcagttccgccgaaagataattcgctgatcagctgtcagataaaggaaatgcggttccgccgaaagataattcgctgatcagctgtcagataattaataataagcacaaaaattactataaaaaccaaagataaaagctaattattcaactccctagttcttcttactctcaatcgtcacatttgcacaatgtattcaatttaacggctaaaatattttatctttttttaagataatgccattttttattttttccatttttcttttgtttaacggagggctagcaattaacacatctaaaaatcgcgctttaatatattttggagggtacgaatatcgtcaaaaggggacgagtgtgatgggcaaacccaattttggcaatgtacacaaaagaattgtccaggaagagcacatggtcctatcggcactttggatattacacgtattgtgtctgaacataaccatccccaagtttcttctcagaatactgtaagagaaattctgttagtcggccttacctaatttccgggtaggtcagacaaagaaaggaagacattaaagcggctgcactaaataaccctgtcgcttctgtaagagagattaatgtgcaggcaaggcaagctttatcagacgaacaactgatgatgatgccaagctccagtgctgttcaacgccaaattaacagactgcgagaaattcccgcaagacaagcggttgacgtaaagtcaattcaagaaatagttattgaggtgttttcattagctcagggctcccatttttttgttttcgttgatcatttccaaatgctcatttccaaggaggtccttgccattcaaggtctaatgggagccctgcattagctgtttttcttgctaaaattctattaatcaagggggaatttgctcttgactatcgtgggcaaagatttctattgtatgattctcgtgcaactgaacccgacgaggttgttttttttatcttcgcgacagaacttgggttaaatagactgtcgacttataacaaatggtctgctgatggcacttttaaagtgagatatacataaacagcctgagacttttataattctttctttaaactatttggctatataaattagcagtgaaattttatgtaggctaaaattattaagattgtgccgctttcatttttgcaactatatacaattaatattttgttggaacactcttctgttccatgcgcatatattttaatggctaataaggcagcaagcacctatatcagatcgttagaggtggcttattatatatttttacatagtcacacaaaattttcaaggtacttagaacccgtcttcgcactaatccagagtctgtttttattgatttcgagctcggttttttatttttgaacttttgaatttattgaaataattaggagccagaagcgcatttaaacatgtttggcctcaaattcaaattagaatgtgcttatttcacttgtctcaatcggtattacgttatgtacaggtaaaaatacctgtttttacccctattattttacctcagagacatggtcttatccgtgaatatgaagctaatgaagaacttagaaaatatatacgctcattagctgcactcgctttccttcaacctaattgggttgaaggttctctggacatattgcatgcacgggctctaattgtagctcgtcctgtttttgaatattttaggaggtaatgttgttaattatgcgtttgtaattaggtgttagaacatatataatcagggataatggtccattatttccggttgatagttggaatcatcaccaggcggttatagatgatttatgtagaacaaacaatgcccaggtatcctcaaacttgaggtgtcaaaccgctttgttataaaaataataaagaagcatttcatattacattgcgaagaaaattccaaaatatgcatcttccattatcaaagcaactattcaattttttaaaaataagacacaaagtacacatttttatattaattttacttttgaaagaggaagaaagaattgctcaagacaaagttaggacttatgagttggaccccacaagcggtttgaatttgcaacctaggcgaaggacatactataataatgatgtggccatacgcactcttgtcactagatttgatgcacttgcaaaccccaaaccagaccaaattgtgcatcacttaagagcccttcaatatcgcttagcatccaatggatttggcaatttaatccatgaataatgattttatatttatcgattaataaatttaaaatattaattaatcaaaaaatttatttgctttgctttttttagtttgttggtgt

SEQ ID NO: 3273 - DNA, 956 bp, Heterodera glycines
gggcaaagatttctattgtatgattctcgtgcaaccgaacccgacgaggttgtttattaccaggcggttattgataatttatgtagaacaaacaatgcccaggtatcctcaaacttgaggtgtcaaaccgctttgttataaaaataattaaggaagcatttcatcttacattgcgaagaaaattccaaaatatgcatcctccattatcaaagtaactattgaattttaaaaaataagacacaaagtacacatttttagattaattttagttttgaaagaggaagaaagaattgctcaagacaaagttaggacttatgagttggacccaacaagcggtttgaatttgcaacctaggcgaaggacatactataataatgatgtggccatacgcactcttgtcactagatttgatgcacttgcaaaccccgaaccagaccaaattgtgcatcacttaagagcccttcaatatcgcttagcatccaatggatttgacaatttaatccatgaataatgattttatattttatcgattaataaatttaaaatattaattaatcaaaaaatttatttgctttgcttttttttgtttgtttgtgtgcgctttttaagttagtgtgtctacggttgggccgaaacacacgtaattagttgctttttaaccggaagagaccgtactgacgaggcccactcttccaaaaaattttcttaaaaaataattttttttattcagaaaccgtccgcaaatgtccgtccgcaaatgtccgtccgcaaaagtccgtccgcaaatgtctggacgcgaataattctgccttcttctgtaaaagaagaaattgaaattaacatacaacataaggaggactcgaacctgagacccccttttggtgactaacgcacagaccactaagacgaaaaaaccaacttaattgtacaaggagcccaaaattgaatcgccgtgt

SEQ ID NO: 3274 - DNA, 2343 bp, Heterodera glycines
ccttccgattgtgaaacggtggtgaaagcgctgacaggactaccgtgttaaaacaacatacaaagacagaaatggatacaccaaaagctttgcttttggtggaattacagcacaaggagctgcaataactatggcttatggacgtctgggtcgtcctttcaatgttaatgtggccgcacatttctacgtccgtcaccgcattaaactccgacaccctttccttcactgtgctgttgagagctttccggaaggacaagaggatcgcttctatcctcttgaattatgcgaaatggaggatggttcatcggaaccagattggcttggtcgtattttcacagaaattcgtaacgacaactacacagaaaccatgagctctgcaaaccgagaagttttaacgccagaagacacgtcaatgtctcgtgaagggcgtgatgagtgcagtcaaaatatttcttacaccttatggtaattaattttttttcaaaattgtctcttctcttccttaattttgtacttttccagccaaaaagtactctttcctatccttaattttttcgaaaatgtgttttagatgatacttacactttctggtattgattaatattttcaaaattgtctcttctcttccttaattttgcacttttccagccaaaaagtacactttccaactcttaatttttttgcaattgtctctttgttttaattcaatttaatgttttttgtaataaaaaaatcgatcgttaatgtgcaaaatttatgttcaattaataatcacaaaattatggtgaaatgtgaccaaaatcgagaacacgaaaatgctaaattttaaaaaatgcagcgcgatttatattggtcttttacctttgggaactcgtcagtgagttgtcccaagtgcacccccgtctgaagtgggtttgagtcttccgggtgtacaagaaacaatgaatcggtgtctaaaatttagaataataaagaaaattattgtatgtttacccgtgtataaaagagtgcagccgggacttctgaccactttctgcattgatttcagtaaatgtagtcgggctgctgatgttgtgaacagtgaaatcacaacatttgaacaaggatgctctttgatccaatcttttttcaattgataactgatcagaattctttccggcgtcagcatgtcaaggccgctgatttcaatctttttgttgtccaggtaatttccaagctcagatgggtcatctgtgatgagcgtctgcgaaagaccataatttcgaagtgaaaatcggccccctaaattttttgtttataatattttcataggacaacgaaaaaaaaaacatacataaattattcacagccaattttgccaatgatctctttcccttgttcggaaccatttttgttcgatcaatttttattccaaattggtcccagcattccgcaataaattgctcttcggcctcaaaattgcctttgatttgctcatcaaacccagaagcatggagtttttcaacaacgaactcgctcatgtatggcctgaagagtttgttgtcacttttgtggtattcgagaacgcgaagcagctctgtcactcgatatccctcctctagtgccgcatttaactaaaaataatttgaataaaatattaaaaaataaaactttacttccaacgaggtgcatgtactaatccagcctctttgtcggtcatcgtgagtacaactgtatgatgatttgacggcaccattcggaaattttttgcaacatttgatgcaaagtggaaaacaaagccgatcgtcaactttgaccggcaaaacggggatgtcgatttgtcgcggtggaatgacgaacacttttagaatggcgagcgggtatgggttgtcctcgggtcggcgccaatcaacttcctcgcagagcacgtggagagttggatgtccaatcggataatcggtcacacaactatttttttttaaatattaaaaatgttacgacaaatattcacttgataaaaggatagaggctggtaaagtcatagtagctaattttctcgccccttgccgctttgtgataaagcttcaaaggaccagttctcccgcccatgaagcaactgcgaatatcgattggtcctccatctccattgaattcgctgaatttctgccgcatttgcctgtcacgggccgagcattgcctcgatttcgcattgccaaaacacttcaacattgggaatttttccgagtataaaatccgtccgcttttggttgagctctcggaatgcggcccgcggattttccaccgatggtaaaacttcgcgcgggcgcggggtagcactttgcacatgcgtgcccatatacatcc

SEQ ID NO: 3275 - DNA, 6582 bp, Heterodera glycines
  misc_feature (7)..(7): n is a, c, g, or t
tgtcgcncaaggaatgggaaactgctgctcacaatggagaagaccgtcggagggtcgaaacgagcagtggcgacaggaatggagcaaaggcgaggagtgcttttgctggaaaaatcactgaaggatttttcctttcgtttggaataaagaaagaaagttttttgtttttgtttatgggaaattaggagacaaggatttgttctggtttggttcgactcggataaaattcccttagggacagggaagatcctagaaaattggctttggaggccttaagagtctgatagaaccgagttagttagaaataccaactttactaaaaaaccaaagcaagaataaatgtgaaaaaacaaggaaaatgatcaggtgaaatgatcacaaaagattggtttgatcgttttgaaggcagtagagggaaaagcgaagaggccggtgaaggtgaagaacatcgaagaccgtcctttcttttataggctcttcggtccatgtgggcggtgcagggggcggttccgatgaggcggcaaaatgggatatatgcgggattaaggggattttagggaatgggaaattggcccgatggaaaaaatttgaattggaaaggctgggaaaggggcttatgagagaaaagggataaaaaattttgaatttaagtctagagaggaaaaaaggaatttttaagaaaaatttatgatgatcaacgatgaaaattaacaattctgtcagtgacagcgacagagatccccgccgaggaggaaattcaatcatccttctgtccgttttccttttcgacctccccctcctcctggtccgattcttcttcctcctcctcctcttcgtcatcaccgtttggcaaaggcggggggatggtgttcttctttacatgggcgaagaagcgagagaattgaccagcgaagtgcgcgaattgaccagtgaagttgtgcacttcacccaacaactcggtcaggagttgttcgactcgcggagtcggagcgcgggctgggacagccttggcgccgggctggtgggcatttgtgccgtttgccggctgttgaccgcggttgcggttgttgcggcggtaaggagccgcgcctcggcgctggggaaaggaaaaatgtttggaaaaagtgggtatggaaagaaaaaaaaggtgggggaaaaatggttataaaggggagaaaaatttggtaatgaggaaggggggtataagcaacctgttgctgttgattgccattggcattttgttcaacattggggcggaccggacgaggaacgtgacccccaccggacggctgttgcatcggaggagcggcattaggtggcaccaccatttgcatcaacggctgtgccggctggtaagcctgtccattcgccgccggcagcacattctgcacactctgcggctgctgctgcggttgtggggcaaccggaatatatccgtaatgctggggaataagcatttgcggctgttggacgtgttggggttgttggaagttttggggttgttggaaattttggggttggaaattttggggttggtactgttgggacatgctttggagaggttagaattgagtaatgaaagggagaactggttggaaatgaaatgtgggtggaaaagccttgcttttatggcgccgtttggctccaccttttgatcattggtgatcagaaatgtgcggattatgtgggtatttgggaaaagttaatgtacaagggaaaatttacatatacacaaagtctcgcctcgctctccattcccaggactaatgccgaaagtcggcaattctacagctctgaggctgtattctgtcacggcggatcagtaagtgccgcagccatccacgtctccatagctgctccttcaagattatggcaatggcataaatgtcaaaggcaatgatgattgcgcaaatgacccacccgaaaatttgaccatactgagaaaaaaatattttaatcctcatgctgatcggaggagcggttgacatgttcattttattttcggcattagcccatgacagattactgagcagaaaaatggtaatccaaattttcctagccaaaattctataaccccaaaaaattgggttaaatttgagaaaaatgtaaaaagcacaaattccaacgagaagcactcccaaaatgatgatcagctgggtgccgccgaagatccatttcaagacgtggaaaaggtctccaatttcaggtaggctaatgcctcctggactatttttggttttgtctccagtcaaacgccatgatcttctgatcgatgatacataggccaaagtgccttccatttcgaataaagtgtcacccccagggcacgtcaccttacaatttgtcttaattttggctgtgtcgaaagacaaagaggtattgtgctgcgttggctgagcggagcacggaattgcccaatttgctccattttcacacacaatttcagccaaaggtgaaccatagctggccgtacaggtataggaaaaacggctgccgattcggcatttatagcaaccttttaaaccctgtggtcttatcttacatgttgccatttggtggcgtattgctaggcgtaatccttccattctcaagaccatctgaattggtacaaagtccgagtcgacccaaacttcccgtgggttacggtagtttaagactaatgggccgatcgagagggggagtttagtggaggggtcctcgagtaatcgttcgatgtccaattctcggcaatgacaccgaaccactccttcactgtgatccggacggcatttggcgcaggcatttaatgccaaatcgcatttcatcacttttgccgagtcctcgtcagcacaatgcagtgctggatcgagagaagggatcaatgcacctccattcgaaccgccaatgaattttccggacaatgcgggtgctgctggactcccaaagacggccggggtgatcgacaaattcgctgatgggaggcgaaaggtgtgaccggagaaaaggatggcctcttcatttcggattgtctcaccatgcaaattgatttttatcccggtcatgatccgaaaatcccacgtaggacaacgaaacatttcatatgtgaatttatttccgggtcgggttggtacggcgtaattgcggtaaaatagacaggcagaatttgtgccaccacaaccgttaaaccaaaatgacccgctgtccaaacagtaggaattgcccgggtagccgttcgactcagctaactcattcaccgtttcattggttaataggttttcacaggtcttacctgtacaagaacccattcccgggcaccttttgctggccatagtctcaattttataagaacgaatgaatcccaaagactcagggatacattcctggtataagcctttcaaagtaaacgtaagagtccctaatagtatggattcgggacccctgatcataaggtccaccgattggccgactgggagcaaattcaacaaagtcacagagttaaatcggcattctgttccattttcattggattcgcattcttcagtattggccgttatagtggtagggactccatttcctagggggatcccttggaaccaacaaattaaggtcagggccatgcccaattttgtcaaaggcctaaatctccgattattgaatcttttgtgccgacggttttcataatcactttctgaatcactttctattggccgtttttgcttccttcctttcagatttcggaacatgcgacaacaaattgttcgacaacaacgtttaactgcgcggaagaaacagtttgtccaactgagaaggcagcacaaaacggttgatacaatgcctacaacaagggcaatgcaaccgatcaaaagagcggagaaagtgggggagcagtgaaagttgaacactctttcccagcatacatagcaatcgaccagcagacagatgtccactggggcgcattgggccgagtatgaagtggaaacattgggtcccatccaaaaaatagctaggcaggaggtcccaagtaataaattctcctctggaatcggaaaaaagaatggtcttctgtattcccgatgaccgcaaataccgtcacagcaaatatcaaccttttcggtttcggggagtccctcgagcattatccccttggaaacacaggaaaaaatgcctgtggcgtttggttgtgtggataaaagtgcagcggagagtacaggtgctgataaaactgctgttccgctgaagaaacacaacaccagcagcatcgttagccgagtactcagaattgcggccgaaattgttgggcgaggagggcgttctgcccatttgaatttctgccgaaagttgccacggggtggctcttttgcccatcggaacttttcttttggattttctttaccgaccgattctgaaatttgctcgaccacatccatcagatttccctcttggggatctcccggggggcgcgaaagagtctcacacacaatcccgggtggttcttctaatggcaccaatttcgaaacgggacgggacaatacccgtccatttgccattaaaatgttggcactccgagggtttccttcggggccctggacttctgtaatttttcccataggccaggtattcctaggaaattcctcattttcaaccaggacaatttgatccacttttggtaaagatttggatacaattctaggtcctttgtgtttcgtctgattgcgttgtcttaacaacaacaggtactcctgtgaccatttttcccaaaactgccgaattgattttgctgtcccccaccatcgggcggctaacttttcagctgtggaaggtcgaaaaacttcgtctgacatgtccggctcatcaaaagcgaggtttgcttttggagacaaaaaatcgattggtcgcaatggaaaaagaccatcagcttcatctgagacgaaagtgatgggtcgcgaattgatcgcggcctcaacttcagtcaaaaaagtgctaatttcctcccattttaaaattcggcgtcccaaaattcgtctgaaacaattttttattagcgcgtttaagcgctcatagacaccgccagaccaaggactaaatgcgggaataagtgtccattttatgcaaaaatcagtacaattttcaagtacatttttcgctaagacaaactgagtcccgtgatcagataaaatcgtgcggggtaatccgcgtctcgccacgaatcgcctgaaggctagcaaaaaatggtcggcagacaaggaatttacaatttctaaatgtacggcgtgggaggccaagcaagtgatcaagagaatccaagctttagcttgttcaacgttagtcattttatagagagttgggcctaaaaagtcgatcccgatctgctcaaaaacggaagacggtcgtgtccgtgatttaggaagaggcggcatcggtggcagaccaaattaaaccgctcagtcttttttgcacaccgggcattcatttatgattttacggaccgtacgtctcgcccttttacaccaaaatttggacagaaaatcggtgagggtggagtccacacccgcatgaagcaagcggatgtgcgagtgccttatgagcaggacaagaacccacgaatccgtcggcacaaaaactggatgctcaaaatctttatctccaattccacagagccgtgatttgagcctaatcaaaccgtctgtgtcaagataagtcgagacgggggagagcattcccctctaaatttgtttgaataaccaatttaaaacgaatttttggttttcggggtccaaaaaatcggaatttctcatattggggaacagttgtttgcttttccctattttggacaggaatcgtaaaacgacgaaagcagtaccgagaagttttcgccaagaaccgaatcggtcgaattcgaaaatgtctggcccaattttcacaactgcgaccacaacaggatcgggcgctgaactttcctccggtggcagaattgccgtcaattcgtctggccaaaggtttgctggtttttccaaccattcgggtcctttccaccatattttggcggatcggagctcatttggactggtcgggtgggttgccaggtcggcagggttttcagcggaacgaacatagtgaaaattaactgaacgatttgttcggatttcacgtatgcgatttgacacaaaaactggttgtttttctgtgctagaaatccatgctaaaacaattttggaatccgtccagagatggacactttctatgtcataaaataaatgtgattggatgaatttggctgcactggtcccgatcagaacccctaagagttccaaacggggaattgtgagctcgtcaggctgattttcacccattcttttgggtttaaggcgagaacgggcgtaaatgagggagttaattacattgccctctatttctgctctcagatataccgccgtcgcaaaaacattgggtgaagcatccgaaaaaacatgtaattgaatagccccattttttgtgcggggcgtatttcttgggatcaaaattgtttgatcaccccactgacttctgatcaaatcccatgcacgttttcggaattttctatgggctggtcccaaccgcgtgact

SEQ ID NO: 3276 - DNA, 2224 bp, Heterodera glycines
  misc_feature (44)..(44): n is a, c, g, or t
gacagaaacatgttctgcaccggctgactctgcccttggccacnttgggcgcatttgccctccggctttttcacgtttctcagcgggattgggtcctccagcatttcctcctcgtcccccgactcgtgcggcgcctgagtgatgtagtaattgtctctgttgtcacagatgtggaaacgtctcagtgcgatgtcctgcaaatgtgaagcgtaacaattggcaaggacaagactttgggtatacccaattacgtctttgtattcaaggacaaactcagttttgtgaaaatggtttcattaatcgcacctaatcattctcattcattaccgacccctgcacttttggcatggcacccttacccgaatttgctccaccgacgccgtcttcggcacggaagcggtccgactgatttggttacgcaacgagctgttcccgtcgtagatgcgcagtagcaggtagtcctcgctctccttgtcctcctcccggcccggtccgcctgccccaggccatccctcccgctcgtccgctgtcattctcgacggggaagacactttgcgacttccctcattgccgatggagcccgtgtggatgttgagcagcatgtccatgggcagttcggcacgtgggatggtcaccgaattggggggcagcataatcttgcgcaatacgccgaagtcgcattgggagcgaagctgccggaagcaggtcgagtgcacgctcaggttgcaccactgacaccggaagcccgagaagcactccgccgtgtagcagcctttcctgcataccgcgcacttggcgtcccttgccaaattaccctcgcgcatgtggtgctgctgtttgtgagtgacgaggtctaacgatggcacgtaagtggacgcctcgcgacagtcggccaacgccaaatccttgaaagttgcgccgatttatgccgaagggcgaagttcacctgacagtcgacgtgcacataacagttgcacatctcacactccgaggacagtccgccgtcctctgtccttttacggcacacacagcagaagtggcgtctgaaggaagtaaagtgacggacgccatttctaattgcatcccctcatttgtcaggccaacttaatgtgctggccatcagtccaagtgtgggccacgggatttttgatcagctgcaattgtaagcccgtgcatttggacacaatcgaacgcatgcatttgtcatggcaaacgaagttgcacactttgggaagaggggcatcaccagcgagtgcttctctcccactaattaccttcgcaggcaaatccttgggaaagcattccccaaattttgtcacagcaatggtggcaataggtgggtttgccgaaggtcttcttggcaaatacatgtccgagatcggtggacacttccgtcgaggcggtggaggaagtcgcggccattgcggccgaaacgcttgcggtcgccgcggcagcggcgccgcttccgtccgctgccatcgacgagcaaaaactttgtgtggtggtcgatctctgctgctgctgctgatgattgttgatcatggcttatcaaatgaaactatcagaaataatttcagaggaagacgcaaagcaaacagaaggaacacaaaaagcggccatgggaggagggaccggcggaaaaagcgacggcgaagagctcaaagggcgaggaacggcacggagacgcagcgacggcacgggcggaggggacggagttggggaagaaaaaggaacggtggaagagaaaagacggggaagaagtgaagatgagcaaatttgggagtggtcggggaaagtgagtgacttgggggcaagctggagaagaagagaatgaaaaggatggaactaattaatttgttcatttaattcattatgaaccccactgaaagcccccgaaagattttgtagtacgcgaattaacgaagcgactaaatccctgataaatgttcagttatggattcgttattggattaggaagggggagggaatcaatttgtcgacgagaaaatgaaaatgccgttgaggaagacaacggctggatggttggttggttcagattggcatttctttcacttgccagtccttcttagggttctgctgaggaaggagaagcagacagagagagagagagaggcgagagcaatggcccaagaacgaactgctgaactgaagactagggagaggaggagggcgacagagggagagagagggagggagggggaag

SEQ ID NO: 3277 - DNA, 2373 bp, Heterodera glycines
  misc_feature (2273)..(2273): n is a, c, g, or t
cacccgcccagccgagcaccaccccaggcctggccaggccaactcattgcattgccccgcccccctccttgacgttgcccactccaaaagagcattcccaccttgccctcactcactcttccccctttcctcccctctccctctctcccctctcgcccgccccctttcctcccctccttccgtttcttttgtccctttccgactcggttattgaaagagaacaacagccgagctgttgctgcttgtggcggcgtagaaaagagaattggcaattcgttgagataagaagtggagaaatagcatatgaggaaagagagggcgaatagagagagaagggggatgagagacagtgggagagaaagagagaggagggggggaaagggaatgaaacaaaaggggatgagagacaatggaaaagagagagaacgagagagagagagatggtagggagaaagggggggggcgaaagagtgagaggaagcaattgattgaaatgcgtaataagagaaaaagcgaagagcgaagatggacaaagtgcagcagacaaagcggaagcagcagaagatccggtaattttcggtcaatactttggccatccgtattgcgcagatcatttaaatatgtatttgtttttcttccaccgaaaatgtcgaattcaattgttgatggcgtaagaaaaatgaccaattattgtcgaaactgattctgtcgaaatcattttttttgaatgcttaacactaatgaatttaatatgtattggaagacataattaaatagtgaatactcttatgattagggatgctgagtttagtggcgaaaaagtccaaaatagggacctaaatggggggcaaaaaattcgcgaaataggggcgaaaataggggcgaaaaaatttcaaatgtaggggtgaatttattaaaattactgttttctctatgtaaattagttaaaattaagtcaaacaattttatttactgattacagttagaaatgaagtacatttagaaattttcaggatttaagggtcgattctcaggggtgtattttccgaaatttttgggtcgattcttaggagcgtatttttttgaaaatttttaggtcgattcttaggggtatatttttccaaaatttttttgtcgatttttaggggtgtattttcgtttttattgcatttttgttaataaatttccaaaaaatcgagaaatagggggaaaataagggcgaaacgccaaaatagggataaaaatttattttaggggcgaacactcaaaatagggatttttaggggcgaacatccaaaatagggatttctagggtcggataggggcgtgaaaacgaaggttttccgaacaaaaaatgtgtttttcgtgcatttctcgtcgagttaaagccgcagaaaaaataagtaaaaacctacataagaatcccatccctacttatgatgcgtattttctcagttttaaaatattttatagaattccaattttaattgtaagcctttgctaattgtaagcatcagtaatcacttaacagcccaaaacaaagattggcatctgctgattgaccaaggttcaacttcaattcatttttagaattgtgaaaaaagtctacggaatgtgtgttcattgttcatatttttatctgaagcttgaaagagccgtgcagacgaggctcgctcttaccattcattttcagaagaaaataaatttttcaataaatttcaaattaaacaaaacaataaagtcccaattagcaacggacagtgaacgaattaattaattgattgctggtggcttcaatgggccagcagcagcaggttccaagttttgagctggtaattgcgcatggaattcacaaaaacagtccccgccgtgctcactttcacttggtaattactttccaatcgaagttcgcccattgatcggtcttttggttgctcgactttcttcttctcctccaataaatcactttcatttttgttttcgcttcttttctttttgccttttcctccgtcctttttctcctttgtccttccctttttcggtttatttttgtcactttatttgtccccaaaagcagaaaatgccgcgccaagtgctcgaattgtccgattacttcgctccattagctgccttaattatggtctttcatttgccgcttttcactttgcttttcatcccttccccccccaaagttcgctttggccatcctcgtcttctctttcttcgtgatcaatttcttttacatcaccgatcgggacgacttgacagtgttntgagaaagtgatcagccaatcaaaagaacatcatcgaatttgatcatgagtttttcagtttggtgccatttgcacctctgtttgggccccattcgatgtc

SEQ ID NO: 3278 - DNA, 2975 bp, Heterodera glycines
gatttttaggggtgtatttttcaattttcttgtatttttattgcaatttttctcaaaaatgccaaaatatgtgcaaaatatgtgccaaaccccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaatatgtaaaaacataaaaatccggtctctacttatgatgcgtattttctcagttttaaaatattttatagaattccaattttaattgtaagcctttgctaattgtaagcatcagtaatcacttaacagcccaaaacaaagattggcatctgctgattgaccaaggttcaacttcaattcatttttagaattgtgaaaaaagtctacggaatgtgtgttcattgttcatatttttatctgaagcttgaaagagccgtgcagacgaggctcgctcttaccattcattttcagaagaaaataaatttttcaataaatttcaaattaaacaaaacaataaagtcccaattagcaacggacagtgaacgaattaattaattgattgctggtggcttcaatgggccagcagcagcaggttccaagttttgagctggtaattgcgcatggaattcacaaaaacagtccccgccgtgctcactttcacttggtaattacttaattactttccaatcgaagttcgcccattgatcggtcttttggttgctcgactttcttcttctcctccaataaatcactttcatttttgttttcgcttcttttctttttgccttttcctccgtcctttttctcctttgtccttccctttttcggtttatttttgtcactttatttgtccccaaaagcagaaaatgccgcgccaagtgctcgaattgtccgattacttcgctccattagctgccttaattatggtctttcatttgccgcttttcactttgcttttcatcccttcccccccccccccaaagttcgctttggccatcctcgtcttctctttcttcgtgatcaatttcttttacatcaccgatcgggacgacttgacagtgtttgagaaagtgatcagccaatcaaaagaacatcatcgaattgatcaatgagtttttcagtttggtgcccatttgcacctctgtttgggcccccattcgatgtccgacatttaccgagggggaccacgggattatccgcagccccaaggaacggacaaggagatgaacagctgaaaagtcaaactatctgattaaataaacgattgtcaatacgctaaataatgtgtgtcgtgtcgtccgttccaattccgtaaattcggacaattttacttttcatttccttttttttctttccaatttcaaaattcaaattccgccatttattcattaaatggaagaagctccaaaaaatggacgtcatcagcagaagaataaaaatgagcagcaattgaccgcttccgagcttcgtcattacgaggcggacttcgacgagtccgacccgaaatggaagtgctggcccgaaaggaagcacgtccaggtcagtcagttgcagctcagcttcgtccgtctcacttccgcttctgcagaaggtcgctttccacgcttcggtggcgaccgtcgtgttggctgtgctgctgctactgctcgcgcttctcctcctccgtccgctatttctccgtctgtccttcgttagcctcggcgtcgtcctttgtgccgtttccgccatggcattcttcgctaatttggcccaaaatgacttcctcttcgtgccttaccttttcgttgtggtccgtttccccatttttttcgttgtttaacccaatgcaatcgctcagtggttgctgactattctgagcttcgccttcttctttttcttggtgccaatgttcggcgtgcccgacttttggcagaattgggtgctcgtcgcgttcggcatcgcccagggccgccattcgctgtccggtcagtccccctcccctccccctctcccattccctccttaaagtcgtccgtctgatcaccgttttgggcgcagctgtttcattcgcttcgatttgtctgctcactttgttcaatttcataatgctccgcgcaagaaacttcgcaatcgccaaaagagtggcaattaaaaaaggatacaaaacgcatccgacgggagagaatggcgagagaaagcagcggaaggacgaaacgcgaagagtgcgggtggtggagatggagacgagcgcatgacgaagaagggacaaagcgaataaaaaagagggccaccaaaagaattcttttaaaggcatttatgcagaatagataaaacgtgtgaataaattaataatgtggtcaatcggaatcggaaaggggcgcccgacactccgccgacacttttccctcaaaaaggggcaaaagtgcggcgtcgtcgctgatcagcaacagttggtaaggggcagacccatcttcgcaagaacttttgaagaagaatctgaaatggtatgtgaaaagcggggaagcaagcggaaaaaacgcactggcgacgatcctttgaagaaatggacaaataatggcggaactctctgaaggtgagcggccgttggggcacgtgcgccacgacgagcactccgtcgccagaagtgtcgcgaaaggaaatcggcattttgggcacttttgaagacggagaagcgatttgttggagaggtcgaccgaacgaaagggagggggcattggccagctgcggagagtggctgaacgatttgggaaataaaaagaattctaatgattagttcgaacgcaaaagcgaaagggaaagcattcctaaatctgggatttgcaatggcgtttcccaatttggcatttgaaatggcatgcaattccattggcaatttgcattcgaattggcactccccgatttggcatttgcaatgccattcctca

SEQ ID NO: 3279 - DNA, 2889 bp, Heterodera glycines
gcaatgccattcctcaatttggccatttgaaatgccaacttactcgcttggtttgccatcggccatttgcggctgctccctgcgcgccgtccgagtcagtccctgctgttgatgtgcaccactcctttcgcttcgtccccccgaggacagttcccgtgccctgcggaacatcgccgccctttgtctgtcgttgtcgcccctggccgaattgcccgaatgtgtcgtggtcattgagccgattcccgaagtgtctccgtcgttatcacaataaacactgagattaatttatatagccattgcaatttaaatgcccggagggaaaagcgaaaagcaaaggaagtcactgagtaactcccacgggaggggcacccttcggcttgtgcctgcctgccttgtcatctgcttcgtcggattgactggggacgacttcttgggcaaagcgggcgccggaaaggccgacggacccgcgagatggacggactgactaagagcggaagaatgaggaggaggcgggacggaattgtggtgatgagaagaggggagcagtcggggggacgaggacgacggcattccgggtaaagcagcgaagggcgagcggagctgacaaggggcgagtggtgggactgaaaaggttggcgatgagaaaggcaatgccaaagaaaactggcgacctttttgtactccattttgaggaggtgcgaaatgcaagtcgaagtgctgctgctggtttagggacgggtggtagcaggactgactcatcccagtccgactcatccccggctgactcatccccagctgactcatccccggccgactcatccccggctgactcgtccctaattcggcggatgatagcggcatgtccccgacttgtgaacagtgtctttgctgctcagcagggggccccgttctgttgtccgccgctgtcggtgaacatgacccgcgcgactttcgacgtgttttccgcgcgctgagaatcaatggcggcggactctgttgtgccgaattgttggatgacgagtccatcattcgccgtcggaaataattctccacgtcgtcgtccgcgtcatccgccgcggtggcgtccaacagaagcggatcagccgcaacgccggcaatgatcagttccctcgtcgatgtttttgtgtctctttgtcgtgccgaatttatccgatcaatttgtcggttgacagactcatcttgctgatgctgtaactcaacatggcgtaatttttgggccaacttttcggcaaattcgcgccttccctgcgctgtttcatggcaattgggcggcattccggcggagttttctctcaggaaaatgtcaggcttctgaaaatggcgaaatgctttgatttgcatcggtaagtaagaccgaccggaaatgcactgagtaaatgcgttttttgctgttggttcgcgcgtcgttggccttcgcgcaattgccgcatcgaatgggtccctccccctccggggacatttgcgccagcggcgacccctcgtcggttggcttcgctggaaaaggaagaggacacggcggagtcctttttgctggcattggtctgtcccatataggggaacttgctgaccggcttaaacaacctaaaaaagagcaatgaaatgccaattcgtcgtcagtccatcgctattccttctcttacccggcccctcccaccggaatgattgcctcgcgctcccattgcgagcgcaacagcgaatcggctgtcaacggctgtggcgctttgccggcgctatcccttcgtcggctccttctgatcgaattttggtgccaaatggtcgcgggaaggggcgaagaaagcattggcatcatttgctcatcagcagaggtggacggtttctgctggttgcggaagcaaaattcgttgaagaagtcgagaaattcttgagattggactgaattggaaagattaaacggagagagaaacagggaaaaggagaaagacaatgagaaaaaacaatggagagacaatgggaagagagagggcgataaaagaaattctttgccaaggcattccctcaaatgtaccaaagactgcgtgctgtctccttagaaaagtgtccagcggggccaaacactcgtcgaaaaggtcctcgtccgcctgctctcttttcagccgttgcccaattcgctcgcggatggacgcaccgataaaatcgcaaaggccaactcgcggcagcaaaaatttggtgaagatttccttggccaattggaaggaccgcgcgtccccggaggcgctcatttcgcgaaaggcaattattgcgaagtgaaggcgcaaagggtgctcagtgctgtcatcatcgacgccgagccacgattggaagcactgaaatttgcattggcagtgatttgcatcgattgttagcttttgcttgggtggctttatctgtgaaatgccccgcttcacctgcaaagcgtcaaagtcattcagcacttcttccagccgaacagcccaatttcgacatttattctcagagttaccaatatccatgctgcaaattagacgaattcagaagttttactataataataatattccaggaattcatatgagcggatgaaaacgacggaagggtcagtggccagcggagaatcccccggggggggggggggagggcacagggccatgccatgactctgtcccccacccccgcttagtccatttgaagtggatgaatggagtggtgagcaagaaagagagagagagaagagagagggaaaggaatgcgtacgatggatgtgtttattgccaaaacaccctcttcctctgcacacgttcttcttcacatctctcttccattttcaactgccaccgccggtggtggcagttgaaaatgaggcggaaaaatgtgggaaagaataaagaaaca

SEQ ID NO: 3280 - DNA, 2108 bp, Heterodera glycines
  misc_feature (93)..(93): n is a, c, g, or t
ccatttgcagatgacagggggagaaatgtaaaaaagaaaggctttaagcgtcgtgctgaaaaatggaaagtacaaaaaaacttactttaattnttcacttattttgcctaaagaagctaaagtgccaattttacttgacaggagatttaagggatgtcgaaaaacttcagaatggcccggccaaaacacaatacgaacatgtatgcatatgcattttaatttgtcaatggctgacgcgccatatgaagaatcgaaatgatttttggcatcatgcatgaaatggtgaaggaaatggcgcaattattaaattttttaaatattcctcatgaaatgtatttcgactaataagtaacagcccacttgaatcactttattgtagaaagaagctcaataaaagccatttgcagatgacagggggagaaatgtaaaaaagaaaggcttttaagcgtcgtgctggaaaattggaaagtacaaaaaaactaattttaattttatcacttatttttgcctaaagaagctaaagtgccaattttactcgacaggaattttaagggatgccgaaaaacttcagaatggcccgaccaaaacactatacgaacatgtatgcatatgcattttaatttgtcaatggctgacgcgccatatgaagaatcgaaatgatttttggcatcatgcatgaaatggtgaaggaaatggcgtaattattaaattttttaaatattcctcatgaaatgtatttcgactaaataagtaacagcccacttgaatcactttattgtagaaagaagctcaataaaagccatttgcagatgccagggggagaaatgtaaaaaagaaaggcttttaagcgtcgtgctggaaaattggaaagtacaaaaaaactaattttaattttatcacttatttttgcctaaagaagctaaagtgccaattttactcgacaggaattttaagggatgccgaaaaacttcagaatggcccgaccaaaacactatacgaacatgtatgcatatgcattttaatttgtcaatggctgacgcgccatatgaagaatcgaaatgatttttggcatcatgcatgaaatggtgaaggaaatggcgtaattattaaattttttaaatattcctcatgaaatgtatttcgactaaataagtaacagcccacttgaatcactttattgtagaaagaagctcaataaaagccatttgcagatgacagggggagaaatgtaaaaaagaaaggcttttaagcgtcgtgctggaaaattggaaagtacaaaaaaactaattttaattttatcacttatttttgcctaaagaagctaaagtgccaattttactcgacaggaattttaagggatgccgaaaaacttcagaatggcccgaccaaaacactatacgaacatgtatgcatatgcattttaatttgtcaatggctgacgcgccatatgaagaatcgaaatgatttttggcatcatgcatgaaatggtgaaggaaatggcgtaattattaaattttttaaatattcctcatgaaatgtatttcgactaaataagtaacagcccacttgaatcactttattgtagaaagaagctcaataaaagccatttgcagatgccagggggagaaatgtaaaaaagaaaggcttttaagcgtcgtctggaaaattggaaagtacaaaaaaactaattttaattttatcacttatttttgcctaaagaagctaacgtgccaattttactcgacaggaattttaagggatgccgaaaaacttcagaatggcccgaccaaaactctatatgaacatgcatgcatatgcattttaatttgtcaatgtctgacgcgccatatgaagaatcgaaatgatttttggcatcatgcatgaaatggtgaaggaaatggcgtaattattaaattttttaaatattcctcatgaaatgtatttcgactaaataagtaacagcccacttgaatcactttattgtagaaagaagctcataaaagccatttgcagatgacagggggagaaatgtaaaaaagaaaggcttttaagcgtcgtgctggaaaatggaaagtacaaaaaactaattttattttatcacttatttt

SEQ ID NO: 3281 - DNA, 993 bp, Heterodera glycines
tcgacaggaattttaagggatgccgacaaacttcagaatggcccgaccaaacacactatacgaacatgtatgcatatgcatttaatttgtcaatggctgacgcgccatatgaagaatcgaaatgatttttggcatcatgcatgaaatggtgaaggaaatggcgtaattattaaattttttaaatattcctcatgaaatgtatttcgactaaataagtaacagcccacttgaatcactttattgtagaaagaagctcaataaaagccatttgcagatgctagggggagaaatgtaaaaaagaaaggcttttaagcgtcgtgctggaaaattggaaagtacaaaaaaactaattttaattttatcacttatttttgcctaaagaagctaacgtgccaattttactcgacaggaattttaagggatgccgaaaaacttcagaatggcccgaccaaaactctatacgaacatgtatgcatatgcattttaatttgtcaagggctgacgcgccatatgaagaatcgaaatgatttttggcatcatgcatgaaatggtgcaggaaatggcgcaattattaaattttttaaatattcctcatgaaatgtatttcgactaaataagtaacagcccacttgaatcactttattgtagaacgaagctcaataaaagcaatttgcagatgacagggggagaaatgtaaaaaagaaaggcttttaagcgtcgtgctggaaaattgaaaagtacaaaaaaaaaattttaattttatcacttatttttgcctaaagaagctaacgtgccaattttactcgacaggaattttaagggatgccgaaaaacttcagaatggcccgaccaaaactctatacgaacatgtatgcatatgcattttaatttgtcaagggctgacgcgccatatgaagaatcgaaatgatttttggcatcatgcatgaaatggtgcaggaaatggcgcaattattaaattttttaaatattcct

SEQ ID NO: 3282 - DNA, 3931 bp, Heterodera glycines
tatgcatatgcattttattgtcaaagggctgacgcgccatatgaagaatcgaaatgatttttggcatcatgcatgaaatggtgaaggaaatggcgtaattattaaattttttaaatattcctcatgaaatgtatttcgattaaacaattttggatcaaaatttgaattttcgaacttttgttcgaattcaggtccgggattctggtcgccgaaaccctatagttgacttcttttactctgaaatgtaaaaaattttatggggcctaaactactatgagcattctggggcgatatttgtatcggcgatatttggagtgcacagttcccaagtttattttttcaaaataagaaacaatggctcaaaaactaagagccgagggtagttgacggagtcagaaatccggcctcaaaaaaaaattacgaattgttgaaatgttattcatttccctgttttccacctcttaaagcgtcaaatttcttaaaaaattaacaataacaatttttcaagtttttaaaatggaagcaaatgtcattttttaattttttttaataacaattattggcattaaaattgatattttcataaaaattgggtggtccggaattcgatcagatcccatctctgggtccaatttatgcattcattattataaatgtttcactgtttcaacattccgtgcgttcagtgagtaggacacgctgagctcacgcccctccagctcccccctcgtcctccccaattgtggacaccgtcactgagccgattttgcctgaaaacggaggagggacactgatcagtttgatatcgaaaattttgaaaaatatttttttaggcattcaaattttgcaaatatttgaattttaggactgaaaatgaactgaaaatttgagatttaaaaaacatttttaatcccatccctaaaattttcaaatggccttattccagaggctcaaacacttgccaggcgacaatcgccccggaggtcatttcaatgttgagcttttcctcctcaactgtgaactttttcatcattgttttttcaataggcggctggaaaatgaaaaattaagttaaaaaagtggggggggggcaaacgttctcctcgaagttgtcgtcgcgcattatcaccgtccacgactgtttctcagtcagcaaaaaaaaaaaccatctccacacaaataattgcaaaactgaacacgtcgcccacttttgtgcccgtccgattgttttctcgcaaaagttcgggcgccgtccacaaaaggccttgtaaatgcgttaatttaaaaagtgtggcaaatgccaactttccttcggcatcggctgactcagtccgatcatgttcagtcctaagtcgctgattttcactttccatcggtcgttgatcagacagttttcggaggacaaaagaccgtgggcgccgatgaatgattggtggatggcgaccctgaaaagttatcggagatgggagatggatgagatgagttatcagtggtgatataacgaatgatcagcaaagatagggggatttaaataagaagacagggaaaattggaacatttaaagttaaaatgatcagaccgacttagccattgatcagttgtcattttgtaaaatgatcaaaatttacacttgcaatgtcgcgcatcaaagcaaacattacgaaattgtcacccacatattgctctatggcgatcagctcctaatttgttcaattatcgtaattacccccaattagttaattgcgaacttttaatgtcccgcgttggcagtgtttccaaattcagtacaaaaggggcccatctgcacaaacgccgtaaaacttgttcaaattgtcgtggtcaaactgacggagctgttaccgtaaagaaatgatgagagattactgtattgcgatttttggaataatcggaagcaattgcttaaaaaatcgcagtcggcccattttttggagaaaatctgttaagcactcattttttaaatttttcccggcggcactcaagtttttcctcatttcttgtgttttcattggaaagtgagtacttgataaaaaatcaaaaactttctcagaatttccctttgcgcctttcgctacaatccctccccccgccccgccttcttgtaaacgcaccgtcactttgcgcccatccctggtctgcgagtcgaagtgtctgttcagctcgaacccacagtcccagctagtgaaagtaattgggttcgacttgatctgccatttttggcatgcgtcgtcgacgacgaattccagcacgtgtttcacaaatgttgcaacaaaaaaaatgttaaatttaaaaaaagttatgggcaaaaatgttcggaaaaagcaacttattgttattgtagtattttgtcaggaaattttggcactattctttttttttaattttgcaactgatagtgaacattcatagtcacatcaggctttttgaataagaccaaattcattcaattcgtgtaattacgaatggagttatacccctaaaaaaagggctgtctcccaattatccctttccgccgtcggagaacacaaatgcaagcagaacaaaaaatgggccaattttgccccatcaatgggctaattttcacaccttcaaaattatggctactcacttccggttctgttgttccagcccctcccggcgtcgtatgtacaccgtctcgcccaggtaacagaacgtttttacaaccgtcagtttggggtcgatcacccgagcgccgtcccagcaacgcaacggcatccacgcgacggaagtgtcaaaatctgatcataaaaggaaggcacattgaaacggtacactacctttcacgcctggagtattatcaaaaaaagttagaaaaatttaaaaaaaaaaattaattaacaaaatttttcaagcggtttttggaatttatggtaaactaataattttctaaaaaattattttttgaaattatcttataaaactaccacggaagacgatagacggaggaacgaactgctccacgttgaaacaaattgcaagtcgagtaaaaaaaaaaatttatttttcaaaattgaaaaaccttatgaatcggtgactgccgtggcgcccgaagagtcgccgtccgtttggttctgctgctgttgaagaaaagcgttttggtaggcggccacacgccaccaattctcggccagataaatctttaaaaaagttaacaataagcctccgaaatttggtttttttttgaggttgccaaaaagcaccaaaatgccaataaaccgccccgtttggtgagtgaactcgcattggacgcattcgcatggcgacgcgtcgccctcctcctcgtcgcccgccgccgctccgttcgtcgtcctaagccttctcgccgtccgagtcgctgctggccgcgcccgaattggacgacggcaccgcggacgaatgcgattggctaccatatcagaatgacgtccacttttggaagactgtcacaaaaatataatttatggaaacgccaagttttggatgcatttgcctgttccgctccctctccgccccattgtccgctttctgccgccccttcgctttcccgcgccgttgcgtttccgcgcgcgtcctccgctgctgttgaacaacaacacgtcgttccgctcgcctcctcctcctccgccaccgtttcattttcactgtccctccgttgcatttttgtggtcaaaaagcagacaatgtttggccgaacacaaacaagcaaagtccgcctggcgcgggtcctcgtctcaattgaatggttgggcaattcaaacttgtgttggttcaaatccaaagacatcgccaggtcactctggttttgagaaatggggcaacataactgcctagagttccaaacagaaaagtcaggaaatagccatttcgccgccagaagattttcaaaaatttaaaaaattttcttatttttcaa

SEQ ID NO: 3283 - DNA, 2092 bp, Heterodera glycines
aaaaacaaaaacgaaattttaaattgaaatggcgcgggaaaagcaacaacagcagcagaaaaagcaaaatgagctccgcaaagatatgacaatgttggatagagcgattgtggcagttgaaaatgcacgagacgcagcagcggaaaatggtgggcaaaaaaaaaatgggaaaaaattgggaaaaatattaattgtttattttttctaaaaattagagtagagcgggaccgggccgggaattcccggtcatccgaggtcccggtcccggatttttaaaagctcaggtcccggtcccggtcgcggtagggcaaccgggaaaaacaagcactggtaagaatgggggtctgacaaaggaaggtccccgggtgtccgtgggatttccgaatgaaatttggtgggtggatagagcacccatgggttcttaagaaaagtgtttttattttctgcgaaatgagtctgagtgccgagttatgacgtgccaaagttttttttattgcaataaattaaataaacatttgcactgttttgtgttgttcggtggtgcggaggttgtgctcctgccttccctttttgccctcgcaggttcgaatccctcatatgttaatttattttccccgttttatttttgattttatgcaaattaatggccattgaaatcaattccatcgggtcaaaaatttttattccttctttttcattcaattttattcattttcacacaaattgtaatcattaaaaaaatggttaaagcataaatataattcacaataagcacaccgtaataaaataaaacattcacaatttaatttctgacacatgtcattttttggcacttcaaagcagtatttaacgggatggcaaaaatttggcagaggctcgtccccgtaataacccgattttctccaggcaaaattaatccatcccatgaaaacgttctgcttgaaactgattatggattaacgattgtaatttaacaatgttatccctgtcgtgcaaatttattttcacatcataaatcattacaaattccgttatttttctcgtaaattgcttacaaattctaaaactattttttattttatttttggcaacaaaactaccggaaaatgtaaacatctaatggttggcatattccagttgcatgttttgggatttgcttcacttttaatttaacattatccgggagtcgaaaatcattccaaccattccaactatccaccaacaataatgattgttctccagggcgtaaaactgggaccaaaacattgaaatgaacttcgtgatctaaaataatttattttttggactattttatttatttttaacctttctcgaaactatgcgatggcgttttttaaaagcagtgacccatttttttgacgctttaaaattaacaattttgttgtccccgagagtgttgtttgcggaaattgcctattttcggaggatttgatcagataaacttaaatttaatgccgttttctccacaaattgccctttaacaatgtcgtcaatttgctttaatgcttccatttggtttttaagattggtttcgaatcttaatactatattttacagaaaaaatatttcattatacctccggagcatttttaggtcagattcactcttgataaatcgaaattttgaccgcatacatgaaagtgaccggtgtcctttttcagaagaacggtaaaattgaacggcttttttcttatcagaatgtgaaatgaagtcttctcgagccatttttttgtcggttgatgggaaaaaactcgatccactcgacttttcttaattgaaatattttaaatcttaaaaatttcagttcgttaggatttgtagatgttgaatactatccgaaacagtacggtcacatttacattttgccaaaacaatcggccttcagagtcacgtttgcaaggacaacaacacccgcagagcgtggctccgccgatcaccgtcacttttctgctgtttgtcactgccagctgattgtgaccggcgtacggagagtggagcacctcgacgagacttgacagaacatggagacgatggtcaacagaagcacttacaggtgatagtcgaaatcccc

SEQ ID NO: 3284 - DNA, 7377 bp, Heterodera glycines
tactcaattgaagcctttcgggaacattaaaggggtctatcgaatcccctaaatgattttttcttctacggttatatgcactccgtactgtctgccaattcgggtaattaaatggtattccagtcgtatcttcaatcccaatatcctcagcaatatcatgttctctggaccggtctgatccctaaaatgttctatttgggatttattaaaattttacaatacttctcgccatatagatttaggatccgtagaacattgcgctaaatctcttctttggcttctatcaatttgttcagcagtaagctgttcaagcggaacaccgttacaatgctggttatgaattattttgtgagttcggtctaattgaccttctcttattattgcacttgcgatgatacttaatataatttataatcattaaaatatgtaaagctaacaacccatcagaattttgtttcctataactttcacatttcaggcaataaatataaattgcgccgtttctttcattagtctgcttaaactttcgatattcatcaccgtgaccaattatgaagagaaacttattgtcaaattttgaaaaacattgtgacacttctgctttttctatgtcctcttgaattccttccgattttctacttcttatttttgaaaggtgtctatctaacgcccttaggcttaggtcgacaccaatttcttctagtttttccaacaactctcctcttgtttttatttcttttttaaggtattgatcaaccaatcgctttgcgctttcgtttatattttttggcagttttaagaaacgcgctggcagttttaagaaatgcgctggcagttttaagaaacgcgctggcagttttaagaaatgcgctggcagttttaagaaacgcgcatggttggcagttttaagaaacgcgctggcagttttaagaaacgcgcatgggtggcagtttttaagaaacgcgccagcacggctaacaactagctttttgagagacatggccattgtagatttgcgcgcgtgatcacatgacttattgtgctgttatagtttttgtgcactttttttgaaataaatttgcaagcccatggatttgtagatgttgaatactatccgaaacgtacggtcacatttacattttgccaaaacaatcggccaactgctttctcgcacaccgaattccgtgcgatggcaacgcatggcatctgtacggagtacgcgccgcgacgcttccctgccatcgtgttacgcattagaggctacaacagcggtgacgacgccgttgagcccaatggagtggccacagatctgctgtttcgcagcggacgtgtcgtcatgacaggtgtgcgcgctcccgcgtgcggtctttgctcgacagtcaacgtgatggcccatcgggtgtgccaccgggttggggcggcgctccgtggggctggactatcagccgctgcactagccttacgcataggggaagtgagtgtgcggaatctggtgagcagcgtacgcttgcccttccgagtgcacattggcgtttgtacaactcgttgatgagccgacactcggcaattgaccaaaagcacgacgacaatgttctcgccgacacccaatttgtcggcgtgcgcagctgccgtctggacttctgtgccttcccagcgctacgttgcacgctcagcatgacactttcagagtcacgtttgcgaggacaacaacaacaacaacgcagagagtggctccgccgatcaccgtcacttttctgctgtttgtcaacgaccagctgattgtgaccggtgtacggagagtggagcacatcgacgaggccttacagaacatggagacgatggtcaacagaagcacttacaggcgatagtcgaaactcccccaccccctcccccataaagtgcgaccacactttcacttatatttttgcgcataaatttaaaaaattatccaagtaccaaaaaatcaacatcatcatcatcatcatcagtgtcgctttcgtccgagagttccccatcttcggcttcctcctcctcagcatcgtcacggtcagcgtcgtcgtcgtcgtcgtaccagccaaacggtctggtgaagtaggcatttccggcgccgccgccagcctcccgggcgtcaagcgcaacgaccagccctttggtgtacacgggctggtacagcttggtgccgcggcgcgtgaacacctcggcacgcttcgtacgcacgaagcgggtgcaggggacgggcactcgctgctccgcgtcaggcatcctgctcgggggtagcatacacacacacacattccattgttatcccaccccaccccctcgtgctcaccggccgaagaagttgagcaccagctgacgcatgcgctcgaacgggagcagttggctggcggtgtaggtgagctccagcccgcgcaccttgcgctccgcacgttcgtccccgccgctcgcggcgcaccggtgccggaaaccgtagttcttagggccagcgctgaagaattggacaatgcgccggccgggccactcgcgcatcagctgcccgaacgcgtcgccctcggatcgaaggaactggtgttgttgcggaccgggtggtcgccacgcgcgtacaaagtacacggagtcggtgtcgcagtacagcatgcggccgcccgccaaccgcacctcctccagccgcccgtgcagatggaggcgggcgtgcgcggtgacgaagcaggcgaccgccaagttgttggtgtccggcgcgcgcacaaagggccaccggcgccgcaccacgcaccggtccagctgctcgttgaggtggacaaagtcgaccacatcttggcgcgggtcgcccaacagctcgtggaactcgcgcgcgctgcccgtgtagcacacgtcgtcccgctccgcgcgctgggccagcttgccccacagggagttcagcaatgccttggcgaccgcgcgcagccccgggttcggctgcacgcggcccgcctcgagtcgtatgccctcctggtccgcgtagcgcgcaacgtagcgcgcgcgctgctccaccgtctggcagtcggccggccacccgctcgcctccaccttcagccggagcatcgtgtcgacgtagccggcgaacaggctgttgcccgcctccaggctcgcccagcggtcgtagtgccacacttcgtacagcgccagcacccggtagccgagctgtagcgccgcgttcagctccacatcggtgtaggcgtgcgtccaggcgcgttgcgccgcccggtgtcgacagcggggcaccgtgcgatggtggcgctgcaccttcttgtccgcgttggcccactcggcgcacgcggcacacagcggaaaagtcagccgccccgtgcgcgtccggtagggcaacagggcgtggcgctcgccaagctcggcgggccgaggcggcagcacgcggcagtggaggaagccgcggaaggggttctgctccgcgctcgtccacggcaaccgcacccccgcgtcgtggtcaagctgctctgcgctgagcacccgcggcaaacccacagggaaggcgcggtacttcatcacgaacgggtacagcgacacctttacaagcgggggagagttgtgagagttagcacagccacaccccccccccccgccccatcacttacaatgtccaatgcgtctatttcctctcgctctgtgcacgtgtagtggagcgcgaacggctccactcggccgccgaacagcgcgtcccggcgcaggtccatcgggccgggcaccgcccggcacacatccgtgtacaggcgccgcactcgggtgggctggcggcgcagccaccgctggaaggcgcactcccacaccgtgcgcaccgcgaagccgtggtgctgctccagctcccaggcacgctgccgtgtcctggcacacagcgactcggcggtttggccgcccgccaacacttgatggcgcctcgggtagcactcggggcaaccttggacgaggcaaatggaaaaggagcccctccacccccgtccttaccgtgaaagaagcacccgttgaactcgatgacgagcgggcgcagcggcaccgggcggtagagcagcgcgtccagccggtacccgtcgtcctccacgcacgcttcgccgatggaccagcgcgcagtgcgcagtcgaccgcgccattgcgggcgcagtctctccagcagcgcgaagaagtggcgcgaggcggcggaagcgcgtcgtccgcgcaggaagccgccctccggcgtgtgcaccatcagatcacggggcagatgttgttgccggtagatggccagcgccagcccggcgatggtggaggcggccaggaacggctccacgccgcccgacagctcgccgaccacgtggcggaagcgcagacaggcgcgccgcagaatgcgcacgtagttggcacagtagcggagcagctcccggcgcagcacgaacagtcggttgggtcgacgctgttgctcctcagcatgccagcgctggaacgcgtcgcgctccgccgggcgcatccggtccgggtcgtagtcggcagccggcggcaatcccacatgcgccacatccatgttttcggccctgatgtagttgtaggggaagaacggcttgtccggcacgccgtccagcccgaacatggccggcagcttggacagggcacagccgaaaaagttcagcgagtccttggcgaccacgctgcgctgatttcgtccgcccagctccagcgtgtagacgcgcagcccggtggcgaccagccgccgggggcgcactccgcgccgctggagctcctccatcagcaaatgcacatcgtaccgcccctacaaagcgtatatggtagcttttcttcaactacgcttttgtacacccccgtaccccgttgttagccagcatcacggtgcgcacattcacgggcccgtcgtggagcacaaagtctgcaaactgtgccataggcgtacgcccgttcgccgcgtcgtggaagaaacgcaagcggcgcgggttcggtcgccgccaccgccgtcccccgtccgcgttgtcgtcgtcgtcgtcgctgaacgcgtcctcgcgcgcacgcatcaaccactggcggtgttgtccgtctcgccaagccgcaccgccacagcaacagccaggcgcccgtcggtccggctcgcgctccaggtccacgccagccgccacacaccgctcacagatcacctccgcgcacaccagcagcggcacatgtttgagcactcgcgccggcactccctcgtccccctcttcattttcgtccgccacttgggcacactccacatcccagaacagaaagcgcagcgggcgccgccgtcgattcggttccgcatcaccaccggtcgtcgttgtcgtcgacatcgtcagcatcgccatcgttatcatcgtcgtcgtcgtcgtcgtcgtcgttgtcgtcctcgaggccttcccgccggggcggctgggcgctccgcgtcgttggcgatcagctgacactgcgcccgcttcggctggatgaagtggggggtccactgcgcgtcgtgaatgccgaaacaacgcgcgcactgctgttgtgctgcttgctggcggtcgttgatgttgttgttgttgttgtgggcgcacgcgtgcgcgccgtgacgggtccacaccacctgacgacagcgggcgcacacgcgccgctcttcacacatcggacgatgcggccggccgcgacgacggtcatgttgccagccaggcggcggcgggtccacccggcgccggtgcgcctcgaagcagtccgcgttctcgaacacgaacaggcagtcggcgcagcgcgacggagcgtggcccggctcccgcgcacagggacggccccagccaaagcgaagacactgggggcacagcgcccgacagccttgcgggtgcgtgcgccggtccaccggctgctcgcagtccacacagtactggcgcgcctaaaagcttcccatatttaaaaataatttcacaagtaaagggacattgacaaacatggaatagctgctccgggcactgtatgtacccgtagtggccgtcctgtgccaccaagcacaggttaaagcgtgccggccgcgcgcccttccacgccacgcggtaggccagctcgcgggcgaagatgaccagccgcacttggtgggcgcctaggctggcgtccagccagcgctggactcgttgcgcctcggcagccccgtacgttgggcggtccagcggcaccgctgcgtcctccaacaggcgacgtgcctcgggcgcgcccgcttcgccacgctgcgccagacagaaggcgcggaagtggaccacgttgcgctgctccagtacgcagatgcgccgctgggccagccccagcacgatggcgcgtgccatgcaccagcggtcgccgcccgcccagttcacaaccggcacaaaggattggagcggacagtgccacgtgcgggcttctcgtcctcggcacatgcgccctccacgcgcgcggctaaacggtggggggaggggtcaaattttgtcgagggacaggggtgggggatgcggaggacgagctcaccgggcaaggcccaaaccgccgacactttgaagcagacgtcggcggagaacaggtcgagctcgtcgtactgcttcgcgaatgtttcgagggcggccgccagcgcgtgcactgttctgctgtggtgggcgcatcggcacgtgagtagtattagggtaaaaatcttgtccccccctgggaagagagatgcgcattcattataggagagagaagagaattagagaaaaagagtaattgcaaaagcaaagaaaagcgattaaattgtaaagggatccccggccattaattgtaatgcaaaatccccagcccattggtattctcgggtacccctctccaatgcgcgggtgcagtgctttttttttgtttgtggtcctccaattaatcgaaccaagggaaagttattgattgtgaatgcaaaaaatttttttatgcttgggcaaataaaatcacattttaaaaaaactaattaaaaaatatacccctcttctcttttgaccacggcgattttttagtgtggtaaataagaactataaaatgtttaattttttattaatatttatatttttctcggttttatattataaaaatttttaaaaaaatcatagattttaccctcatctaagctaaggtttatatcttttttttgctgttaaaaattcgctcggattgtgtgggtgtgataacatcctctttttcggagatggtccctttaatcgatgacaaagtaaaagagagaaattgaacaacaaaaattaaatttaaggacaaatccaaatgcgcgaaaaaaatgctaaacaaaatttatatgaaaaatgctcgaattttttagtttttagagcgggaaataaaattatttaatttttaaaa

SEQ ID NO: 3285 - DNA, 1059 bp, Heterodera glycines
  misc_feature (1026)..(1026): n is a, c, g, or t
  misc_feature (1037)..(1037): n is a, c, g, or t
catcttccattcactaataatgcacaaatttttattacattttaataaaatggcataaaatgtacacaatttgaggtacaaaagaaacagtcatatgtgtgtgtgtgtgtgatagataatgtacaaattacaatgtgtgtccaaaatccaatacattgaaattggccccgatgattccctttcccacaaacgggcgataacatttttgcataggcatggaaaccacccgacctccctccctgatgtttggacgaaggaagttggggtatgtgatgattatcggctcgtattcaccacttgtcgcgtaccggaccacctcctctttgaagttctcatagcgcatcccctggttgttgatcacatcataatttagcgtcagcccacgcactttgagcacatgttccaattgggctccctcttccgcgcccttgcgtcgcagacaaaggccgtactagagtgttaattttcattaattaccgcaaaatgagccgaaaattcacttgttttgccccgccactgcaaaattccacaatgtcgtggtcggagtattcgtcggtgaactggcccaaatgggggccagttttcagtgggcaccgctcctccgggtggacgaggatgaggctgtcagtgtctaaaataaatgtttgtgcacaaaaaattttttgtagtttaacttaccagtgtacagcagatcagagcccggtgatctgaccaccttctgcattgccttgagtagaacgaggcgcgctgctgaggtggtccacaaggagatgactgaaagttgcacacatttataacattttagtgtgtgtgtttgtcaccaatgtttgagcatgagtgctcatccacccaatccttcttctgcagataggtgatgaggatgtgctgctcatccaactcgtcgattgatgtcacttcgatggatttgttgtccaggtactccgccaaagtcgctgggtcatcagtgatgagtgtttgagcgagaccaaaattgcgaagcgaaaatcgtccccctattttttttanatataaattanataatggacgacaaaactcaca

SEQ ID NO: 3286 - DNA, 4285 bp, Heterodera glycines
  misc_feature (4276)..(4276): n is a, c, g, or t
acccaccccccctgttctgtcattgtgctcgcagtggtagtcgttgtccactcctcctgtcgggtgctctttggcgcaagtgatgcacagggggaagcaaagccgctctccaactttcaccggtagaacggggacgtcgatgcgtcgtggcggcacaacccacactttgagcagtgccaaagagtaggggttgtcggctgcactgcgccaatccacttcctggttcaacacatgcacgtttggctgtccgatggggtaacgggttgtgaagctgtgaaggaaacaatgttaatttgttacaactttaactgtgctcactttatatacgggtagagcgatgtgaagtcataataggagattttctctcccggtccagctttgcgcagcagctttagcggtccagttcgccctcccataaacgcgtcgcggatcaccagcgggccatcatcgacatagtcttcaaatgccttgcgcatttccttgctcctctccagcatccgatggatttcgcattcccagtagacgtccactcggttgaccttctctctcagaaattccatccgcttggcatcccgttcgcgcacttgtcccgcagtcttcccactggggagcagcatgttgtcgttggggtaacaccttttgcacccgtgccacgtgcagccttaaaattgcccattttaaaataattttgcataaaattcagttaccattgacttcaattgcgcgtcgttccgcctcaatccacccatccaaggagtagggcccaatgcgcttctctcctccaaccgcgtgggctgtctgcacttgcactccatgctccttggcgtaccagtggaagaagcgtaaggcgagcaggctttggttctgcgcgttgtcatagccgcgctcgggcacaatggccaagtgctcgtcgggcaggtggttggtgcggaagtgccgcatgcatgcccccgcgatggtcatgcactcacgcagcacatcaatcccgtcgtggttctccttgtcatcaatcccatcaacgtagtcttggcgccgtgaaatttcgaagaattcccggcgaaaggcgaccagagctgccatcaatatttccacatcgttggtgcaataactgaaaatcgagaacaaaattattgttatagcaaaatatttttgcagtacctcgctaacgcctcatccaatttaaagggctcatggcgatgcgcggcgtaccactcgtcaaatttctgtcttttgctgggcatcattccactagccaagtagtcttcgggcgtcgggtgaatctcacggccgtagttctcgggtcggttggccaaatgggggaagaagggcttgtcctcgacgtccagaccgtaggaggggatgagtgccgccagcgcacacggcatcaaattgaatgagtcacggaagacaatgttcgggttgcgcctcttctgcttgcgtaccttcatctcatacattttgttgccctgacatttttaaaatattttttagaaaaaaaaattcttaattgagtacccgtcgaagcatctccgggttgaacccaatccggaatagctcgcgaaagaccagaaccatgtcgaaccgtccgccaaagtgtgagtaggcgtatgtgtcgtatttggctggtagttggaagatgagccaatccacaaacgcctgcagtgggttgtccgccaccactcgtttgtccacacgagtgtcctcaaagggtcgctggcagaaagcgacagttcgatgtggaccacaaaatcggcagcccgctgttgccctccgccaatttccgctctcaatgcacttagggcacgcgactcgggcagcaatgaagttgggctggtgctctctcttctctggctgctgggggtccactggttgatgctgcatggtttccaagtcgaaagccacaatgcggtacgggtcgtgctcctttggctcaatgggctgaatgaagcacccccgctcgggattgtgaaatgtgttgcacagctgacaataggtctcgtggcatttgtgaccctaaatccatcaagaaatgaaaattttattttatttttatgtttacttttctcccatctctgttatgtactcgtgtggcccatataacgccgcagtccttgcactgctttgactgggcgcaaaagttggatgccaaatggtgttggaggcacccgttattgcgaaacattttgttgcagcccgcgcattgatggaaaaatccgcccgatgggacacacgggaatgctggtccgacgcgtgagcaaagcatacagcgcgccttgcaagaattgaggtgccttgacggacgctcataaggcttttcgcagtcgaggcagtagtgttgtccaaacaagccatgcaatttctgcacaccatcaaaatgctggttgttcaaatagagcacaatgggagtgtcgtaatgatcgttgatgtatttgtacaacggcttgtattgtcccgatgagccaaagatgaacactgcaaatcgatgctgctgttgcgtgttgttccagtggtcgaccacacgcggcacacaaatctcagcatcataagtgttccgaccggtccgtacaccaatttgctgcatcagttgtaaagcatcccgcctcagacatccctgttgtcccctccgactgtgcaagtagtcgtaaaatctacaacggggccaaccgcacgttttggccaccattgtcgcctgcaaggcgtagaagaggcaatgcccgtccggattgcaaatcttaaaacaaattgtcatcgaatagttttgatttgatggcgcgacacgaccttaatcaaacaagtttccgtcaccctatgatgcacagatgctaggcttcgtcgagcaccgcccttcagcacccttcggccgggcagtccagtacggtcaactgtggtcaccaccacagtgaatggctcgccccacagtgtgacgttttgctgctgcttgctctgagccactttggtgaattggttgaggatggtgtttacggtgttgtcggtgatttgtcgaaccgggatggggatgtccccgccggtgagcaacggactgctgatcatgcagccgagatgcgtgggttcaattccacgtccacgactctcctccatcgctgcgtcaaggcagtactggaagatgccggccaggagtccctcaggatttgctgctggcacatcctcaatgctgaaccgcgacttgactttgctgtactggaagcggggcacatgctcaacggtgctgtccagctttttgacgtattcctttgcagactttgatgatgatgagctgctgccgccgccctcttgaagcacctctccaagcaattcattgatgagaaagccgcgacgcggctttttgcttgggaccgatagaatttggtcaatggaaaacaaaaagggatgcttgggaggctgattttgcattatctaattttacagggaaaaataatgaattgaatggataaaatgaacaatcttgacacatatttttgaggcatggaaattgtcgttgtgaatgcaaattaatggataataataataataattttaaaaattttaaaccaactatgccctgaagagcagcgcactgccacccatgaagcacaagacgacagggcacctaaacggctcgggtaattagtaaaggtcacgcgcacaaccccaagccctaaaagacacacaagtgctgccaggataaacggagcccaataattggagcaaccgccctggttaacagcaataaaataaaaattttattacaattttattattaaagtgagtaaggatatgagcagatgtgaatgaaatgtgatttggactgagtatttatgaagtctaggggcggggtgtccccatccgaataccaattaattttctcgaactctccttccttattgtcggcaaattcaaatttcctttgaagttatctccttcactattgtcggcaaattcaaatgtcttttgaagtcaatattaactattgaataattaatgagcccatgagaaccgggcacaaaaatattttaattcactcttcattcattcattcaaatttcatgaccaatatgatgcccaagcgattaccagccgagcttctcttcgaaattatctactcactgcccataatgtgcttatttggcggggtatcacccaagccaggtgggaaaaaaaaattcaaatttcaaatttttcgcaaaatttaaggccgtccaccatccggtatcgcagtggtcaatcgaattatggaaatatttcgggacaagcgtcacccaaacttcacccaaattgntaataataa

SEQ ID NO: 3287 - DNA, 5005 bp, Heterodera glycines
cagcaataaaataaaaattttatacaattttattataaaagtgagtaaggatatgagcagatgtgaatgaaatctgatttggactgggtatttatgaagcctaggggcggggtgtccccatccgaataccaattaattttctcgaactctccttccttattgtcggcaaattcaaatttcctttgaagttatctccttcactattgtcggcaaattcaaatgtcttttgaagtcaatattaactattgaataattaatgagcccatgaggaccgggcataaaaatattttattcactcttcattcttcattcattcaaatttcatgaccaatatgatgccaaagcgattaccagccgagtttctctcccaaattatcgattcattaccaattatgtatttatttggcggggtaacacccaagccaggtaggacatgtgtttttaaaattattgtttcacatttccttcacaatttaaaggccggccactctccggcattggtgtgcttaacgcaaccgttgaggtttttcgggccaaacgccaccaaaaatttgcaataattgtaatgcaattttctgttttttcattttaaattttacacatttagaaggaattggcttcaaaatttgatgtgatcagttcaaaagggtggatgtcagacggacagctctacctacatttccgttacaacaacaatgagctgtgtgagccggcctttttcaatgagttcgcccaatatatttgcttcggcaaatctgggcgcatttgttgcacccgcattttggtcgactcgcccaattcgcgcgtaaaatttttgaactattttttctttttcaattttgtgataaaaaaattaaggaaaatggtgctctttgcaatgtggtgctaaactgcttaacaaaaagcgcgaatcctttcacaatgaaaaagtgcacgtccgtcgatctggtgcaccgcgacaactttccggcaatattgaaggcatcgccgagcgtaatggctgaaagtggaattgtgtcaacggagcctttgtccgctaatgatgatgatgaagcatatattttgaagaacccgcattttggtgatgatgaaattggctaccttgacgtttatgcccgatcatcgggcttttactttttctttttttcaaccatttaatttatttatttaaaattttgtggagtacaaccgtggcatataaatcaggatttgcacaagaattgagtcgactgagaaattgattaaatgtttcgcctaaggataagtggtaaatgaaaacaatgcaatgggcggcacaagtggagacaaggggggactggtatggacgagaattcttcattatgccccctgggaaatagcgtaaaaaggatgacgtaatggtgggcggaatgggttgagcaagactgtcatagtagagcactggcgcttccactccctttgcgtaaatggcgcaccaatgagagccttccttgtggcgggggtccctgttcacaatgagcgcagcgggatactgtatcgtggaggggggcggcaactggtcactggcgaagcagccccgaaacactcgctcggtctgccgattttcgctcaatatctttataatttggaggctgtccattctttagccaaaaaattgaacaaagttgatgaagaatcagactgaggatgagcattaaataaagggcgaacaatgccccgcaaatggctttctgcgcaaagttgctttccgctggtagatccttacacagttggataagcggtggaagaacagcagagaaatgctcatcaattaacttgtcgctttttggagggattttggttgtagttgttgttgttgttggtggtggtattgttttggttgaaaaataaattttagacaaagacagtcttctcaaatattcactgtaggaatattctgggtggtgttgttgccgagacaaagtcaaatttttcaaataagcagaatatgtattctctggcggtgacttttgcggttgttcatggaatgttgaaacaacaggaatagaaacgcggagcaagaacaaaatgatacccaatttttttgaatacattttatgcaaatgaaatggcacaatatgatgcgcgtttaaatagtggtatcagtgcttatcgatcgatttttgtccaacatcacaagagagtcacattcgcccatcaccaccaacattattcctccctcgggcactggatggttaaatttgatgctcaccgctgtagtgccattctttatcaaatcaaacagtgccgcttgatcatccccgctgttggtcaaattgaacacgtaaatgcaatgggtttttccgtattgggcaaaagttatcccgttgctctccgatgagtttgcgaatcccaccgcttcgttcatgtcattgaatgggcgaacataccttccgctggggtagtccaagtcatagggcgcttgtgggtacgagcgaccattagcaacaatggaaatttcgcgaacattaaatggctgaaaattgaatggactgcgccgaattgagccaacataatccgcattcgccaccagacccattgtcacacgccgggggatttggtccatgaacaaattggctgtgaactcataccgacccggactgatgaacagtgatttcatcattgttttcctcacagcgtagcgggcaggcttcacctccaactttcgcgcaatgtccagcgccaacccatccatcagagacaccttcttcacatacaatttcagtcccacaacctcgaaacggtagcggggtgcacccgcgagcggcgcaattagcacaaattcgttatcgttgggcaaaatttcaatgtccagctcacaaaagttgatcagataaagcggctgattgaataggtcggtgtcaattttggcaatgaactgagcaacgttgctgagcgcaaacaaatcgcgtcgcgctgtgcatccgtctcccgtctcaagcacatcacccgggtcccggtagtagcccgctgcattcaggtgtgagtcctttgccgtcgttgaataggagagctcatgtgaaaagtatgttttataagccatcagagcattggcattaaatatttcgcgcccgttgatgctcattttaatgttgcggatgaaagtttgaccgatcatttgaattggcgcaatgtttatatcatcagcggttaggtcaacaagttgtccattaacgttttccttacggattcgaaactctgtgagcaaatagcatttggagaggtcaatgaaattttggcttgagtggagtttgaagtggtagggcgtgtcggtcagagggttgctgggcagaagctcgaatacctttgaagatgaaacactcacatttgttggcggaatacgaaaaaagtccaaagcattggtgattgagttcacggagtcagtgtcgattttgtgaaatgccattattatttagtaaagtccaaatgcgtctgagcgaacccgttttcttgatggctttgcaactggtcgtccaattattgtttgatgaccaggcacacgtgttctctttctttttatacccgttcgtccgcttccaaactgtttgggcaggccgcctttctccagcacagtatcaattccccgttttccctcactgaccaacgcctccttgagcggcaccccctcatgcccgactcgctccagcacccgctggccagtgctcagcgcctccgaccctaccgtagttccaacacgacgaagaatgggcaggaaaaagcgccaaagtccccgaaacacatcgccaacgcccgccccgcgttggataccgtagcccctctgaaaagggctggtgccccggaagtagtcgaattcctccttctctaagccactaccgtactgcacgtactcatcatacccggcaatgcttgggtcaaacacaatatgaaccatttttatattgtcaaaacaaaatgaatgatgaaattagaaatttatcactttcttaaatatcaacacgaccatcgttgtcccataggcgaacggcacgagacggcctttgtccattgtgcgcagctcaatctcaatctcattgatctcccgtggtaacacacgagcaaaaatgggcgaatcgtaaattttctcgttgtactcccaagggatggcaccgctgatagacacaacacgaagcagcgaactcagtgaattgccaattatcatgttttcggtcaatcctttcgagtagacagcaaagcttgagatgcctccgcgcaaatccaccggatactttgatagctcatttgacacgacatgttgagggttttcaaagccaagcacatagcccaactgcggtgagaaggacacatgactgacgatcgcctcattgaacaccagcttgaatcgttccatgttctcaagatattgaattgagacggaattgggtacatatgagagagggtctatttgaacgctgagggtattttctggtaaattcaaatctgctagtgttaaagcagctgatgttggcgggggtggtggctgctgtttctgttccgttccttcaaaacgctgtggagagcctgacggctttgcgggaatcgaaactggagctggtggttttacgggcacttgctgtttttgttgatgaggcgttgccgagctttttagttgcgccggaggcgccgtaattgttgtcttaactgaaggttttgcaggggttgtaggcttctgttgctcagttccttcaaaacgctgtggagagcctgacggctttgcgggaatcgaaactggagctggtggttttacgggcacttgctgtttttgttgatgaggcgttgccgagctttttagttgcgccggaggcgccgtaattgtcgtcttaactgaaggttttgcaggagttgtaggcttctgttgctcagtttcttcaaaacgcggtggagagtctgccagaggagcgcgaggagccaattcagcggaaaccgaagctggaggtggcgccttggctgtcgatttaactgagctggaggtgtcaaattgttggcttaa

SEQ ID NO: 3288 - DNA, 2786 bp, Heterodera glycines
actttaagctaatcgttggttgaaatagaattttgaaataattttagaagggttcgagaaatcaaagaaacgaaaaaagagtgaccgaaagcaaattgagagagagaagagagtcaaagagataatggtaaaagcaattaagaagcccccccaatcggcaacggtcccaaacgcttctccatttgccattgtcgcggaccgaaaatgccgccaatgcgaccattttgctgacgcggacgcaacgcgtgctcatcgagaacagttggaaaagggtcaaaaaagtaaacaaaacaaaaaaacgaatgaaacggacactttccctttttttgttgccattttaggcggcggtggagggaattggcgccaaagttttccataatgtgctcattgcccagccggacattaaactgttgtttggcttggagaaagtcccgcaaggcgagtgaaagaatgtaaaaggaattgtataaacggcaaaaaggccggggaacttttgaggggaaaaaattgggatgagacggagtgaacggcccggccctctgggtgtacgattttttcggcaatttacaaaagtgcggcacaaaagtgtcactgtcttttgtcgtgctgcggtgtctgctactgtccatttggttgttcaggtcgcctgaaatacgaaggccaattccgccgccatgccgggctgttgaaccgaactttggaatatgtcgtaaagaatttacaatacacagacaaattggggcaacatttcaaagtgaaatggcaaactcaattaattaattaattggttaaactaattgaggcacttggcaagaagcactgtcagatgaacggaggccgagcctttccagcgaattattgggacacttttttagagtgaattgcctcccccccacttttaatcaaaatggccaccctttcagatgcattttgcagtcagtgctcgagacggacggctccaccagcggacgtttccaccgctgtcgcgaggctgcgttttcctggcgaaatttggttagtccgttgcactttggcattcattgtttgctcattttgcccattttcgatctcatttattgtccaacaaatgcgtcggggctttgacgacgagcggttaatgcgcaaacgcttctccgcttcgctgatgggcttaagggggtccgcgttgagagatgcgtattatggcggggacaaagtgccgtcgctgaaggctatttccggtcagtgtttctctgtttttcaaattttacatttgccacaggtcggccccgtccgtcgttgttccaacactcccacggctccttgggctcgttggagatgatgtccggcttcttccactcccatcgtcccaaccatccgaccattgctttccatcagaccgatggccttcacaatgggaggcaacgacagcgagcagtatcagcagtttctgcccaaattagccaagtgcagcagaatttgcagcaaaagcaaagcggaattggcaatttgaaagatgaaaagaaagagcagcgaacaagtgaattgatgaagaagcataattaattaagcattcttttcattgtctcaaaaaggctctcggcttcagccccggacggacggctgtcccccctcggcgaggagtgcctcgtggtgtgccgaagagagtgccgatgaattccgccgactcaatttgaacgatggcgcaacaaaaagagccactcgaagcgaattgttcattgacgacaaattcgaagaagctttttacacaccgcccacaaaattgaagactgatcggcaaaaagcgacagaaggtgataatgagggcctgctgttggtcactgccaattagcatcttccgcttaatcactgcttccccaataattttgccctaattgatcacttatttctcctttttccaaataaatcactttctcccaatattttgctccaattgatcattttccccaattcactttctctcatctttatttgtctttccccaataattttgcccaattggccatttccctccacttttaggcttgtcttccagcccttcttcctctcgcctttctttctctccctctcctcgcatcatttccacggttcagcttctgctaagtgccgccaattctgaacccttcgacgcaatgactgcttccgagcggacactttcgtcgttggaacttccgaatgattgcggaaaacactcaaaagggcgccattcattttccgaatttgcaaatgccgggagggaaagattagctgcaattgaagcatcgaagcgaatgttggaaatggtgaagaagaatcagctgcacgtggtcggcggagagaaaagtccgacggaacggacgagacgcctctcggccatttgaggacggattacagaacattggattggaaattgttaattattttatttatggcaatcgattaaaaatattgcataaatctaatatcggttaaccaattaattaattgattataatttaattaatgcgttggtcggcaaatgttcctttgcttatgcttcgtcccatcggcggttggtctctctttcgcttcactggtggtggtggtggaacttcttcatgcgtctgtacccgctcggctgttgcggctgcggctgcggcggaggctgtgccggggtgggagcgtacggagctgcgctctcagagacttccacgacaggcgccgcagcagggatgggagggggggacatctcttccggcgctggcgcaggcacagcggctgctgggcccccgtacgccatctcggctgctggcggcgactgtgccgcg

SEQ ID NO: 3289 - DNA, 1823 bp, Heterodera glycines
  misc_feature (22)..(22): n is a, c, g, or t
  misc_feature (116)..(116): n is a, c, g, or t
tggccctttgcgccgctcgtcngaatttgcttttcccgggcccatctttctccctccctctcccaatttcagcttacttcagtctcaaatgcgatgtcttccgatcagaatttccncagaacacttcgctttccgctgattttgcttctttccttttcaaaatcgttgctcgacggtgccttgttggccaatgttcagccgagagtcaattccatcgtcgacttccattcgtccattaatcagttggaaccaaccgtcccaaactattgcaacgagtccaagctgatcgagcagtccgggctgatcagagcgccgatgggacagtttctaggatttccatgcaggtgacagaaaaacagaaaacagtccttgaaaggttaattcagcaacgaattttaccattgtcgttggcaaagcgatggctacagaactcataaaaagaattgccgagcaggtgagtggaacatgaacgagaatggctggtcttgaccaatcatttctgtcaaaaggactcgtctacgatgtgatgggcacgcaaaattgtaattacgactacaatgtgaaagggtgcgcaatgggtccatccgccggaagagagggtttgttggaatagcatttttggtgaggaaggcaccgaattatgagccaaattggcaagcaaatgccaagtgctgaacatgagggcatagctgtggccaaagaacgaatgggccagatattctctcggaaaaaacggaaatttaaggcccacatgaagaggggatgccagaccctttaaaattagccacaattggttaattatcattaaaacagtgaccaattgtacgcggaaggaccaattcgaatgtccgttgtccgaggattgtgtgccgttgtcaaagcgatgcgatggcaattacgactgtgtgttggaggaggacgagcagaattgccgtcagtcaaagccaaaataaggtggcaactgattgagtttgtatttagcaatgtgcaaaccaacgcattttccatgtgttgtttctgaacaatgcattccggtgagtgggaaagagaagacaattgaggagagaagacaatttgccactgtttgatagcttggccaacgctgcaacggcatcaaagagtgtcaggacggaactgacgaattggagtgccaaagttggtcattcaagggaaacaaacagcgaactactgaccaaatgcaaaaccaatcacagattgtggagctggaaaattcttatgcaggaaatcgggcaaatgcatttcggcaaaggaacgctgcgatggatttgcgcattgtccgcacggtaattaaatgaacgattagtgaacgaatgtttgatgaagaatgattaatgatgatgaacaccaaaggtgaggatgaacaattgtgcaagaaagcacgaattgtccttgggccgcggatgttcgtttgcgaggttttcaaaaacattaataattatatttaaaaaatatatttctaaactacaactgataatcaccacaaatgttattttcagagtggcaaacatcaaatccctcaacaaaatgtgtgtgacggcgttgtgcactgtccagacgatgcatcggatgaaaaatattgccaagtcggaacagcgacagaaacaatgcgcaaaatgggagcaaggacaatgccaaggtgggaaggcatgttttcaatctcatttatgcaccaacgcggaaattaaacctcttaaatgtttatgactccgtaattaaagtaaaaggtaaattcaaaaaaactaatttggcagaccaaacgctcctcccaatcagttggccactcccgcaatcaacttttaaaa

SEQ ID NO: 3290 - DNA, 2818 bp, Heterodera glycines
  misc_feature (2751)..(2751): n is a, c, g, or t
  misc_feature (2761)..(2761): n is a, c, g, or t
  misc_feature (2787)..(2787): n is a, c, g, or t
cggtaattaaatgaacgattagtgaacgaatgtttgatgaacaatgattaatgatgatgaacaccaaaggtgaggatgaacaattgtgcaagaaagcacgaattgtccttgggccgcggatgttcgtttgcgaggttttcaaaaacattaataattatgggcaatttaaaaaatatatttctaaactacaactgataatcaccacaaatgttcttttcagagtggcaaacatcaaatccctcagcaaaatgtgtgtgacggcgttgtgcactgtccagacgatgcatcggatgaaaaatattgccaagtcggaacagcgacagaaacaatgcgcaaaatgggagcaaggacaatgccaaggtgggaaggcatgttttcaatctcatttatgcaccaacgcggaaattaaacctcttaaatgtttatgactccgtaattaaagtaaaaggcaaattcgaaaaaactaatttggcagtccaaacgctcctccaaatcagctggccactcccgcaatccaactttcaaaaattgcgtttgatcagcctatcactgcacagcaacagcagatggagcaaataaatgccggaaaaagtgagccatgggttggcacaaacggcggaatgacgcaaactgatggtggaccaagtggcaaaccgccgcagaaagtccgttcaatttggtcaattaaaggcatgaaatgctttttagttttcactgagtacggcgaaccaaccgaacaaaattggcaatgttagggatgaaacatttccaacctcaaactttggaccgatgagaaatgcgatgaacgcgcagcaaatgatgggcatcagcaacgggacgaatcgactgatggtggaaatgccaaggcaacgaaagccgacggaaaacaaaagcatgcaaatgaaaacggaggacagcagcggggcaaagactttggtggagggccacttccaagcgggcgtttggaacggaagcgcactccaagcgcagcaccagcggaacaacccttacgcggacgaatggtatcagcaacggcagaacagtggcaccgaaggaaggcaatttcaacagcaaatcgggcaaaacaatttgatccaagaggaaggcgaccaattcgtaatgagaatgggaaagtaaggcatgggaaggaaaaaacacattcagaaatggctaacatttggtggccaattgccacaaccgcaacccgtggtcattacgagacaacagcaaattgagcagagaagggcaattaaggaggagatgggcggagaggacagaaaagggggcgccgagggggcaaacacggcgggaacggacagaacggcacaaccgcagcaaacagcgggcgaggaacagaaagcggcggaaagcggcagtgccggactaaccgcaacggaaacaacgaacgaaggcggcgaccagcagagggtgacgggggttccgctgatcactgtgggattgacaaaagccgaggagggcgccaaagaagtgagtgatggcgtaaaggaatggaaaagcatcggcactgactacgccttagaaaaatattttgaatcgaacaccgaccaatgcccaaaattcgacgattgataatcctttgcaaatgttattttcgattagcagttgtcgtcgcaaactctggccacggttggaggcgcggaggacgagctgaaaaaatcagcggaaacgaaagcaacggaaatggtggcagaaagtggtaagtgcgacaacgccggagaaaagacagacgaaggaacgactggggccacagaagaacagcaaaaggcacaatttgggacggaaatgcccgaattggaacagacaaaaacggaggtaatcccttaacaatgtcagatgaacaaaagggaaaagtgtgttcattgtcagcagaatgagcagcaacaaattgagagagacggcgggacggaacgccaaacggaaaagaaagaagaaaacgatgggacgaaagccaacccaacgggggaagagcagcagctgaacagccaactcacagcactgaaagggatcggcgaaatgggaggtcagagagtggaactgaacacgggagacgacagcgaggaacaagagcaacaagcgatactccggcgattgtacagcaaatacgggtcgaatgcgaggtaaaggcggacaatggcaaaagccatgccgatccaatttcgaggccgcgtttgtgcttctaacagggatttgcttcaacgagtggagaatttgctgttgttagccgaagatggaatatcggcaaaaaagacggtgaacgaacccaatgatagcggaaaaagccaaaaaatgaagagaaggcaagcggaggaggacaaagggctgatcagaaaatatttggagcaactcatggacagtgagacgggaagaaataaaaccaaataaaagacaataatgtacataattatagattgtatgaaaatatctatttataaatttaaagttaaatttgggaattagtgcaacgaatgattgggtgaaaaggaaataatgtcaatcaaagagtggctgtgattatggaaaggaaacaaaaacagttaaatgggagggcgattaagaagaattggttgtaaaaatcaaagctagtgaggtccatagggtttttgtgattggagtggtattagacacacaaaagcagaatgaagaaaggtcccaaattccaaattttacaacattaattcagtccaagaaaaagtcctcacaaagtccacgcaaaaggctcttcaccatccnattctgcatngtcgacgggatgtaagactctctganaatgcgtccatccttgtgctaaacagtgttt

SEQ ID NO: 3291 - DNA, 1685 bp, Heterodera glycines
ccccccccccctgcttacttgagatatgcgaattccctcctcgccgagtgcttcgcttcgggttagcacaatcattttgttcagcatctgatgtttgaaaatgaaagaacccctagaaaaagcgaattaatgccaaaacattggaaaaggaggcaacagactcgtcctgccgactgttgcaatgcagagaaagacgacggccgagtgaatgcagaaattggacttcgtgaaaaagggaaaagaccgggcgcggagtttcgttgttcatggaaaggggcgagttgtttgtgagagtacgatcggaggaagtgtgagaggacaagtcgaaagtgagcactgaagaagccggcgtctcgtcgtaactttgtccatggtccgacggagtggaggaagtggggaaaaagatggtcccattttggtccacgtgttgcgcgacgaggggatcagtggcggtggtcagcgaagaaccgaaagacgtgacggaagccgaactctgacgaaaaacagaaataaacgcgcaaaagtggtgatgagtgaaaaccgtcggagagggactttgtccatcggagtccgtgtcattcgaagttggccaagtggagacggattgcgacggattgatgtaacagttaattgcctgaattttgactccagatgactcctattaggcaataaggatttgcaaggttcgtggttaaggaaggacctacgcacttttggacgaacattccttccttttggggcatttgtttctgtcagtgaaggccctttggctaatgaagaacagctaaatgaatgattgaaaaatgagtactccgtgcaaagtttaaaaggcccgacttgtccgttttgtcttcgaaatcggcggctgtcattccaaggccaaaacggggtttggctggtggaaagcgactttccaaaggctgtgggaaaatcaaactcttctctccgaatgtttttttgttttcacagcaaacctttcgaaactttcttcccattgtgggcactgcgtttgtggcgactccaaccgggggaatttcgctgggaagaacaccacgccgaatttgtagctgccgcatgaaattcgcttttaggttaagccgcctctgtgctgaatttaaaaacgataatttgtaaaactgaattgtcgcttaccaatactttcttcagtggcaatgtctttcatttatttaaattcctttgtttgcttccagcttaatgttaattagttttgtggtttaggccgaaaacgaaatgaattaaattttgttaaagtattaaaaaaagcttttggacttttgtgcttacctaattcatttcgccaattttatgtttgtttcgccatttttagcgtttatttttattttcgaaaaattccttaacaaatgcaataaaaatgaaaaatacgcctctaatttgtaagaatagaccggaaatttcaaaaataaattaaaaaagaatttctcaaaattaatcccctaaactttttttcttggtaaaaaaatttttgattttacaaattattctaatttcaaaaaatttagaaatatttaaattaaattggactgatcactagagctcggataaaaaggcaccaaaaatcgtgaaacaggcactataataggcacccaaaaattgaaaaaaaggcatgaaaaggcacgaaaatcgcgaaaaaggcatgaaaaaag

SEQ ID NO: 3292 - DNA, 6430 bp, Heterodera glycines
gtggggctgcgccgcgtggaagggtagacagtaaacagccgtgtgctcgctgtgcagcagcattgtgtgtgggaaaagggaagaggtgagaaaaataaagaaggaaatagtgcactgtctgactgtctggttacgcttttgaaaaatttgacccaaaaccgggacccaaactgaatgaggtaccctaaattttcccaaacatgtaaaatgtgttgagtgttcatccaaatttttcaaccaaaattccccatttctcgcttctttacaattagatttgggtaaattgcttatttctataccattattcgacttcaaacagagtttattaacgacatggtaattttaaacaaaataaaagacaaaattctccgcttttagccaggcaatgaaacaattcgaggccatttggaaaaacggaaggattggatccgacggacgagggaccatcaggaaaagtcggcggatatcaaaaagttgaagagaagcgcacgggaacggaaccccgacgaattccattttcatatgttgcggagtcaaatcggagtgagttggccattaaaaaaatgccaaaggatttggaaattgaatttccattttggcatcccttttttgttagtttgttatgttaataatagggttgggctcccgaccgtcggggttggaaaagtcggggtcagcaagttcgggggcccaaccctagttaataattcaaattgagtttgatggaacacatcgcgacttagagacggaagaggaggagaaaagcgaagcgcaacgccttttgagcgatgtcagcgatattaatttcgtacaattcaaattgggcatggaacgaaaagttagcaaagataaatttgtagtaaaaattttgttttttagaaaattgaaaaattgaaagcggtgctccacttttgtgatgagacggaaaaaccacagaacaaacacataatattcgcggaggacgaagaagaaggtaaagggaaaagggaggaaccgaaggggcggaaggacgaacaaattcagcacgcaatttcgaccctcggcaatatttcaacacttccgaacaattcttggcacggactttcaatagaccaatcgaaggcgacgcgcggaaaagcctcagcgtaacggagaaacgaaaattaaaagttagcgcgggtggggaataaaacgataattaaacactggtggaatgctgtcaaggaaacagagaaggagcgacgccgtccttacgccgaactttgcaaacgcatggaaagggaacgcgaactgacggtggtgttgcaaaagttggaactgaagagagatttggcactgtcaaaaaagtctgagttaaagccgaaactgatcaaaaaaggagacgcacggagggcagccatttacaaatggcagtacgaaaggaagaaatgagttgataaggaggaaggcaaagtgtactgggattgaaaaattattgtttatttgaacacgttgtttttgtctatggaatatatttatgcactcttttggaacggacaatgacttgggttggttttaagttggggatggtccttcgtctattttgcttcctctttctctctctccatgtcatcctctaaggtctgcgttcgttactcggaaatggtaaaagtccatcgcggtgatcgaaacgttccaaccggcgcttgtggcggcaacgaagaaaatgaaaaggaaagtgattgggtagaggaagaattgcgtgtttttcagcgtgggaagtgctgaaaacaaacattgttaaatatatttcaattgatcattaaaatacaaccggtatagccgaggaaagtaatgtaattataataaatggtggcaatgcaccaaatggaattgccaaaaaagcgggcgagaaaattttggtaatcaaccaatcctaaaaaatattttgttcaaaaaaagaaaaaaaagagggaccgtagaaaagcaaaggtaaaatgacgtggagaagaatgagcaacgggaaaaaagcattcaaatggacatcgaagcaataggcccactcgaccacgtcgcaatccctcgtccgacgcaaaaagcgatttgaaatgaacctaaaaagggagggacacaaaaatatgtgaaatcggagagtaaatatcgcaaaatagcgaccaaagtgcggttgcaatggcaatgccaattccgatgcaatcgatgaacacaacccaaaggaaaaaggcgcaaaacgaagaaaaggacaaattgagcgctaatgcaaacagaacactcgagccgagcagagaaagtgccaaaaggaggagaaaggcggggtcatcgcgggcccattgatctttggcttctgaacgaaattagaaattaattgagagggacaacaaactttttctgtacatgaaattcctgtacaccttttgcggattgaccagcaggtaaagcatttgccaagcagcgaattcaaagtccatctgtcggacgtgcaccaaacggcggaagaaacggctgagttttgccgctgcggtcattttaacggcggaaaaacaaccgacgtttgaggacgaactgcgaaaggagagaatgatttaacatgaaataaataacacattgaaagcaataagcttattgtaattaacataaactaaagcgacgcaaccgaaaaatatgccaaaacgaacgcacaatctgctggtgcctgaagtgattgagccgggggtggaacatccgcttctgttccaataataatccttcctcaaacctcccgaaaacgaagtggacggagactgatagccggctgaatggttaaaatatgttttagtttaattaccaatttctttcttttttctacctcttggaacaaagcttttcttatggctatcggcgaagctcattcaaatttcatcaaacgtggaataaaaggataataattaaatgaaaggaacaaagtaatataaaagaaaaggaagtgaacgaattattaccagccaaacaaaagccaaatattgaacaatactctcctaaaagttttagcctcagctaatgttactaagaaaactcatcgacagaatcatatgatgaaatcatagataaaatcgtgattttatattttgaagctagttcttgatcagcgcctagattaatctagaaaagttaaaaaagttaaaccaaatataaccaatcaactaatgtatgcaaagtattcatgtaggaatgcatcaaagaacatcagacaaagtgtaagggcttctcgacgtatttccctcatttacttattcccattagccattattagttcaatgtttttttcaaacatgttttccctttcctttctaagagcactggtttgggtggtgagccgattgctatacctgaggtcgagggttcgattcaatcctaggtatatatttttctctcttattgtttttctttggcggcgatttagataagtcaaataaattggactccatacccgactttccagaaaccctgatcccgttcatcccaaatttctatgtctagtgagattttgtccatttctatttaatcaattaggtatgggtgtcatttgatcacagtgaaatatcgcgttggttcataaaacacatgtagagactgcttcaactttaatgacttctattaaaaagagaatcgacaacaataacatttgaaacagttcattgagtccgtagtctgtttgtgtaatttgctttcactccgttgtaaagcccaaccgcaagtccgacgttagcccccaaaaagaggcttatcattacagtttgcaagaaccgaagtgagatcatccgaatggaacgaggaccggccaaagcatttgtcaaaccaatggcactgccgacgataagaccatatctgaaaaggataaagcatgatcagaataaccgacttgaaaatgtataactctactttaagccttttttagtcgtttttggcacttctccgcggaactctctgaacaaattattcgtctcttcgagactcactggcaaaagcatgctgcgcttatatctcagcaaaacttcttccattcgtttcctttcccaggcggcttttcatccttctcggcctgttgtaatttccgttgttcgttattttgtactaaaattcaatgctccattaatttttgttggttgtcgacgaaccatcacagtcaataagtcgcaaaaactccgcagtttctctctcccttttcagttcgtccgccatcatttttgctgtttaaatttgcttcgatttcattaaaaaaggcacgaaatgggaagagaagagaagagtattgaccaaaacaattggggaagaaattccaatgaaaaaatgtaattttattcaaacaaaaaaggagaaatgttgtatcactcacaattaaacaacacacatttggaggattcggtgcaacacgaggggattcagtccgtccttcgaaaggccatccgaagggtcgacgtgtcggacggtgttctgttttttggtaaataatgaataaattttaaagatgctaacaaaccgttgccggatcgaattcatcgtacagtttgaagggtccattaacacaacaaaaattggaccgctgattattgaagcctaaaaacaatttcgacatggacaaattcattagtttgataggttctgtccattcaccttcaacatcaatgttaattgcaagagtgttgagttgaccgagagcgaaataaaacaattgcaagccgtcagaaagtatcaattgggaactcaacggggcgacaatttctgtgtattgagtgtgtcctaaaaatgtgtaattccgaaaatcttgacgcacattttaaatgccaaactaaccaagacaatgcgcttgtccattcaaccaattgaagagagatacgaccgccgttgcggccaaacattctctgagcacttcctttcgctcatgttccgtgtcgcaacgccaatgagtgtccagacgagtgatcagcggagtaatgtccttgatagccaaccgaccgtacttatgcgtttcacctaaaaatacgaacggagtgaaaataagcacagataaagtttaaaattcaggtcttattgttggaaatgggggctttattttacacaaaagtggatagtccgaatgaattgaatgtgcaggttctgctgcagagcgatgatccacgagtcaggatgccgggagtcttaaaccgataggaaacataaatgaatttgtggaaagacaaaatcacacaaaaaagcacagaccattgccgaaagcacaaaacgagcccttcggcactcactttgatttcgattccgtaattacgcgccgtttccgacgggtaaacgctttcgcactccttcaggtcgatggacaaaagtgcttcgaaaagtacctttttttgcaccattgtttgttgtcattttgggctcacattttcaaaaaatcatggttcaattggtgccgataggcgtcgccgggaaaaaatgggcaattttatatttttaaaaataaaatttttacactttccaaaataaaatacgcaaataaaaacaaaaataaaaaaatgtacaaaacggtgtttttaatacccgtcgataacatctcctttctcgaaccaaatcctaacttcacgttcatattcttcgacggagtcggacgcatggcacacggtgtcccttctgcgtcccaaaatgacggaatttgcgtatgttgcccgaatcgttcccactggtggcacacgcacatcagcacctaagattctgcgaacggatgaaatcgcgtccggtcctaaaccagatgattgatagaaaaataagtatttgggcagttgattaccctcaagtgcaactgcgataacagcgccggacgtcatgtacgcaatcagttctggttgtgctccaggataatgatggcggatcgtccttgccctcggttgaaccacctcaaataccaatttgttttcaaattttttaaatttttaattaaaccatttgcattccaacgatgcgaaaaaaaggcggttcctccaagcgcttcaaaatgtctgtggctgctttttggaggacgctttcgggtttaatcagaaccaatgtgcgttgcatcacgacaggatagcagccttcgacgtgatttctcgtaacacgtgaacggttggcgcttatggacaccgaaccatcgcaaccgaggcgggcattcaaacagctcccgtgtttgaaattgcgtgttattttcgtcacataatacatacgttcgtcgaaaaaaatatactcctcgccagctatagttttatcaaacattgccatttctgctaaaagaaatatacaaattaggtattcaaaaagttcattggaatgaagggttggatttcagaggtggagcacggacagaaaatccatcggaatggctgagggggctaaagcccccccccccccccgccccatgcacatatgatgccggtaccgactccgttctccagca

SEQ ID NO: 3293 - DNA, 1862 bp, Heterodera glycines
  misc_feature (9)..(10): n is a, c, g, or t
ccccccccnncccgaaacccaaaaaagtaaaaaaatagtaatttttttcaaattttaagcaattttcttaacaaatttgctttaaaatactcaaaaattttcccgacggcgcctatcggcaccgccggaccccattttaccatatttttgaaaaatggtggccaaaatggcaaaaaaagtagtagtaattttttgacgaaaaacggtgaaaatttttgtaaaatacaccccctaattcgggatttttgaaatttagaaaaacagatttttaaatattggtagtgaaattattctgactacatattctgatacatatttatgttcaattaaacatacaattgttgactttgacatggtgtaattttccatttgatttttcaaatcccttccctttttcagagttatccgtacactttccaattttgtgtgttatgccaaaagaatgtccacagcagtaagaatcgcttcctcccaccgccttcaccgaattttcgtccaatttaggcaaattgccctgtcacattcgccagtgccatgtcggcaaaccgatgttccaatgtccggtgtgcgatttcacttcgacttactcgaaaaacaatgtgaaaagtcacatggtttcgcttcacggattggcggtaacattctccaaagaacaatccttcagcagatacagccaatttaagggggatcccatcagttacatggaccaatacgcaacacaagtggaggagttcatgaagcagtgcttcccaaatgtccggggtcggtatgatacattaaaacctcaaacttgaggggtcatttcatttgactggacgaattatgtccattctttttaatgaccctcaatttttaaggccgtggacgtcctcttcacgggcgacagtcaccgaatgccaaaaaccaattgaccatcacttcgactgttgtgagttcgacacggccgaagccaactgttgcgccagggaacggaaccatcgctccgatggcattcggtcagtcgcaaagccaacagagacatttctctcctccgttggcggggccttcgccgcagcaacggatcggcggacgaccgcaaaaggcgaccacaaaaagcacaaattgtcaacaaacggcggacggacagccgacggtgagaaaggcaaagagagaagggaaagaatgaacgaacaaaccgttacaattcgtcgctttctttcgttcattttgcaatttgaaatctgtccatttcccttttcagatggccattggtcgtacggattccctttgccttccccccttctccaccaattcaactgcaaacgatgccaacactttgcttccattcggtgtcactgatttttatggagcagccatgggaatgctgaagacgacgcagggccacagaacgcccacatcactgctgtccagcagagacggcggtggggcagaaggaaatttgcccaattttggcaggggaagcggcgcgtcgtttgggccgatccttcagagggacagcgggtcgacttttggatttatttccgattttattttttgcctttcattcattccattatttaaggtttctgtccgccttcaatcccttcctttatctgcaacaaatcaacaatttgttcgccgttaattctgtgaatccgaacgcacattcgcagcaaatggccatggaaacattgggaggcggcgaagaacggaacaaaatggaggtgaacggaagcgaccaaaatgacgtcaatttttaaatttgggtttcgttgtcttagactgaaatggacgtgtcagttggagaagaatcgcctcatcagcaacggtttctggaagaatgtctgaatttgagtcaaatttctgaaggagatgagtaaaga

SEQ ID NO: 3294 - DNA, 1167 bp, Heterodera glycines
ttattcatttagtccgcttttccagtgaaaaatccactcttccgctttttccatattaaattctcgatttaatggtgccgcgtttaaaaaatcaatagattatttcggtgattaaatcacgaaaacatcaagtcggggatcagaagaacctttgaaaggctgctgtgctccaaactccaccacgatttgaaattggaaaatacttaagggattagggaatgggataaccaccggatttaaattttatgacaaagggcaatttgccccactgaaatccccatgggaccattcttaaatggcaatttcaatattaataagtgaaaagattactgaacaacaatttaaatctattattagccttctattttaatattaatttatcttttaatacatatttttatccattaaacaaattatgagtaaaaatgctaaatttgtttatgattttaaaaaaatataatttagtcttaaattaaataatttcatttaaatatctaaattttttaaatattctcaggattgcgaaaatttcaatatctttataattttaggttagtaataaatcataaaaatgttttagataggaaaaataactaactttttattaatttatttttttcatttattttttagtttaatattttaagaaatactttactttacctttactttaataatctttgttctttcgtttaaattcttgtcccagtgcttacaattgtagaagaaaagattgtatcatggctaattgtattaaaaaataaattagttaattaatatttttccatatttatttgtaatttttgattacaattatgaattaaaacaatatctaattagtcgaaaatataataaattttattatgctttcgccatcctcgcaagcatcttttctcgtttgttctttttgcatattatttttttttcttaatgatgaatttttaatgaaactttaaggcattaccctttgacgaatccgaaagaatttttttgcggcaaccaatccctgaagagttacagacccgggactgaattggccaaatgcctttgggactgaaccgtccaaaacatatgaaattgcgacaaaatatatactaatcgattcctctcggcataccaaccacgaatctgaaagaatttttgagcaacaaaagaaattgaaaaagt

SEQ ID NO: 3295 - DNA, 2515 bp, Heterodera glycines
aaataaactagattaaaatgaacatttctaaaatattcttccaagatgatttgtgataatagaatcatcaaaatattgtataaattatttaaataaattatttatacgcacataaattctcgtaaatgaaaatttcatttgggtctgattccttcaatttaaaaaacgcaattaacgagtaaattgaattaaaaacaattaataaaatggataaaataaaataaataaattaatgaaaatatattctgaatgtgtaagagacacaatatattaaaatataatatagatcaaaaagcaagaagaaacacaagctgctcaagaacaatttgagagaaacgtgagacttcaactgcgcgattcgccgcgctttcacaatgggttagcttcatccgttttggtgccaccgcgccaactgttttgggaaacggaatgcgtgatgtacaccagattgaataatgatgactaatatattaacataatacagaaaaaataaataacgcaatcttgcgtttctctagcaaagacatatactggtgcatcggtcgggagaagtatttaaaagttaattaaattaaaccaaaagaaaatgtttattaaaaaacaaccaaaaaaatcataattatgaatggaaacatagtaaatttaaaaagattacaaaaactaagaactgacgttgcgaggaattcgaaataattgcgattactcacaagagataattaaataatatttaaaaaatattattataaattatcaactatcaaaatcacttaatttgcaaagatttaaataaaacaattttataaaatttttctaaattattataaatatttattaattaaattacataaagacaaaaaatattttaagttttattttgtcaattttttctttaatattgtcgtagtaaatattattgtgaaacgaccctaacctaacataaagaagagtgtctcgaaataataaaatttttaacctttcatgcaaaataagaataaaaaacaaagccgaaaagcataaaaatcatataaaatttctatttaccgatgataattaaaattatattttttttattgaaaacaactaaaaaccatcactaagaattaaaataaaataagaaattaaaaaaactacggcaataaactcggacatttgttcaatagggccaaaaaatttaaaattattaaaattgcattttttaaatatctttaaacaaataattaagaaaatattttgctgagttaatattgtatcacgggtttttctatttatgcaaaaaataagctcgaaataaagatacaaatactgaacaaactttttatgaccatgtttcaattcggttttactgtgttcgagacaatttttttagaaaaaatatttgaataaagaacattatcttttgcttaaaaattgttaccttcacaaagttgtcaaaaaataatgacagtttgtaaaaacgttaataaattacaaaagtgaataaactaatgctttaaattatccacattaaattgcatttatttaatagataaataaataattgaaatttttgagggaaaaatttaattaaccaaatctgtatgaaaaccgagcaccaaatgcacataatgcaatactaaaataagtttaaaaatataaatttactccaataaagagtaatatttaataaaactggaataaaaattaactgtaatttcgaagtgaaaatgctatcagaaagcaagcaaagaaaaagaattatctttgcctttgcaccataaaaatgccgaattctttgggcagtgtgggcatgtagactttattaaaatttaaaaatattcataaatttgttaaaacaatatttaaaattgaaaaagtgaaccggaaaattctatcacaattaattaaaatactattttttattgaaatttaagtttattattgttttataaatttacgtggaggaaaaaacttagttttaaatgtcagctacgaattatgctgaaaatttaaaaaatgattacgcaagtttggatgtcgcttaaatttgaaattaatccgctgtttagtgaatgttttttatatataattagaaattcatttcaaaaaacaataacaaacaaaatattttaaaattaaaacgttttgcaaagaatattttattaaattaaaaattaatccgctgtttagtgaatgttttttatatataattagaaattcatttcaaaaaacaataacaaacaaaatattttaaaaataaaacgttttgcaaagaatattttattaaattaaaaattaatccgctgtttagtgaatgttttttatatataattagaaattcatttcaaaaaacaataacaaacaaaatggctttcactaacaactgaaataggcgacgggtccctccccaaaaatcccagcggcggcatttgaatatgctctttatttcagtaatgtgcgcacaatacaattatatatgatgagtaaatgtgggaatggggaagggactcccagttcggtctcgggataattaggggag

SEQ ID NO: 3296 - DNA, 5168 bp, Heterodera glycines
aaccctttctgggcctgatcgctcagttcgcgctccttttctcggattacgaggagcgtgtccatcaccacacgtgcttccttcgtgttttggtccatctctgcgcatcgacgcattttttcgccaaatttcgaacttggctcatcgggtaacgccggaggctccagctcactccaaactcgctttttggagcttactgtgactcctacttgacccgtctttcggttcatctctctcatttctgccacgtctttttttgcctgattatacagcgttgattcccaaaaagccatgcgctcacttgttaccttcgggtttaggaacaattcctgttctcgttcctgttcccgttcttctgtagagtccacgattgacacgacttcttctccgaccgtcaccgcacttgcgcttcgtttttcttcctccgcctttttcctaggcacttccctcttctccttcttttcctcctttttgttttccttcattcctttctcttccttcttttccttcttttcctccttttcttccttttctctccactcgtccattagtggtgctacttggtcttcgtcctccaccggcattttcgacccctcactttcagccaaacttttccgaaccgctaacaactgcgattgtagcgatttttccagtgatttgagaacgtgctcttcgtcttttgtcaagagttccatttctgtatgatcaattgttttaaaaaaagaatggctctcgtaagtaactccatttaatttgctggactcgtttaatctgccttttttgttcatattttccactttgtctaaaaattgcttatcattattctccatttctcccatttcttcatttcgcccgctatttatgatatttatacccattctgaactcgttttggtcgtcataattttctttttcacttatgaaaatttctggaatccggtttatttcgtacattactccatttattcccgaaattatttcccaatatgattcccgttcattttctgtttttaatgaccatttttccgcaaaaagaaattgaacttccatgcccaaaacgattctgtcagttatactgctaatatgcatttcaaaattttcaccaaaaatccaacacatcacgtatctctcgccctcttggttcctataaatttcccaattctcatcaacttggttttcaggaactgacgaagtaaggggaattatggtgggatttaaccaccctgtgcatgccgtaactattgtaccattcaacacaatgtctaacaaagttggtgtctcatcattttcaaacacaaaatttctgttctcaaagaaaatttcgggaccctcatcgtcacttatatcttcctgattttggacaaaagcaatagtactaccattctcctcctcttcactgctttcaaaactaaattttgaaaattttttgctcttgccaatcatttcctcactcattgctttctctttacttaagacaatctcgaatccttcctcttcactttcttctgcttcttcctgttccaaatttggatcatctacatatttttcccaatttatcggttcatctgcctctcgcaaaggtaaagttgctggaccatggaatttcttcactttttcttgatgtactcttttaaattttccctttccatctaaggtctgtaaaatcaaattttttcgctctgtctcaattccaacacacctcaatggtcccatccacttctgatcaaatttatgtttcatcacttcctttttaaccaaaactaaatccccaatttcgaattctctttctgtggccctccttatggcatcatttccctctttatttctttcctgtgctttcacaatctcagttctcacgatttcccaagctttcgctgccttttccacatgtgtacgggtatagaccgacacatcagacaaaagttcgtcagaagagggcaattttaacaattgatccgtcggtaaacgaggattacgcaaatgaataacaaaaaatggtgaattttttgttgccgtattaatcgaggtgttataagcaaaaattgccccttgcaaaatctcatcccaattatctcctccttcgttaatgctctgagaaattatgttagccacgattcgcattgatccctctgctaacccattactctgttgatgatatgccgtactcatattgtgctcaaaaccgtaaatcttgctcaaattttcaaacaattgagacgtaaattgtctcccttggtctgtgacaacgatttctggggttccatgctgatgtatgaccatctcgacaaatgaatttgcaatagtctctgccttctgatcggaaatggcctttgtcataatccattttgaaaagctgtcgattgccaaaagaatgtaagaattttcattttttgtttttttcagtgggcccataatatcacaatgtactcgctgaaaaggtccttctgtcggttttatcggaatatttggtgccgcttttgcctgtccgggttggactttccttttctgacaaccctcgcatgtttcggtcaacaaactcacatcatccttcattccaacccaataaaatctgcttttaatctcaggccaagtcttatcaaacccaaaatgtccctgatcatgaattaaatggaaaattttctcccttaacgagtatggtatgaccaatttcggtttttctgagttacttttacctctcttatagtaaatcgcgccatttactaagtcataatcttgaatgactctcttccattttaaaacattctcagggaatttgcccgtttttaaaatgtaataaatttttgccaattccttcacttttctctgtgcttcaattatttcctttaaagaaattgcctcttcttgtactcctatctgttcattttccttagtttgcttttccgccttatcctcggtactcagaattttcttattttggctatttatttcctcctctcctccactgtcaattcccggaacattataccttgataaaaagtctgccgccttatttttctttccaggacgaaagattatctcaatgtcgaaactttgcaaagtaatctgatacttttctagtcttcatttcaactccttcgctttcattattcccgtcagagcactacaatctgtgatgatcttacttattcctgatcccacaatataaggtgaaaattctttcactgaatagactactgccaaagcttctcgctcaatcgatgggtaattagtctcatgccgatttaatgcgcgggaaacaaacgcgacaggccccttttcttggagaagtacagctccaattgccttctttgacgcatcacattcaattgtgaatggtctcccaaaccttggcgattgcaaaactggtgctgtggtcaacatttccttcaaaatttttaacgcattttcttgctctggtccccaattttcttcaatttttccttcgaatttatcctgagttagagtctgtaatggacgtgcgatatgcgcaaaatttctcaaaaatcgccggaaatatgttaaagcccccagcaatgattttaattctgttagacttttgggggcccgaaaattttgaactacttgtacctgcctcgggtccattcggacgcctttctcacttaacaaaaacccgaggtaacgaatctcagcttttccccaatggcatttctcaattttcagtttcaatccgacttcctttaaaagtctcaaaaaattctcaatgtctaccaaatgaatttcctccgtttcactcccaatgattatgtcgtccaaataaattaacattgctgctgtcaatcgtcttctcaacgaattcattaccctctgaaatgtgtccggtgctgccgttaaaccaaaaggcatcgtgataaattcataaatgcccaaatgagaaataaaagctgtcttttcaatgtcctcctttgccatggggatttgcataaacccttgctgcatgtccatgcatgtgtaatattttttggctcccattaaatccaaaagctcttgaatatttggaagatgaaaaactctctttttggtcattttatttaacgccctgtaatcaaccgcaaatctccatgattttttgtccgctttcgggaccatcacaataggagaagcgaactcggattccgactcacgaataatattctggtcaagcatcattttaatttgtctctcaatttctttctgagtctctggggggtaccgataaggtctaaaatggaatggtaacgccccgggcgtcaaatcgattttgtgaacaattggaccattgtaacgaccaattttcccgtcatcaccgacaaatgcatcggaatatttgtccacaatttgctttaattctcgctgtgccttttcacttagtctggtctcttccaaatctattctttctgaaggaggccgattcatgtcatttacgggtaatttaggcaaattttcactccaccgagtttcaggtggaataaaatctttagccgcaatctcatcgccaggtaatgcattaatttgtaatggctccaaatctgccaaatgtgagttcccgtaaattttaattggtgcgtttcccgcattcataagtcttattatcacttctttggtcgcgcctggggcaaccaatgtccttccaatgataatcccagggtactgatgctgtataccccttaccaagaaattttgtccagttggaaaaatttcatcaattctcgcattaagaatattttccgtccgtggttcaaacgtgtcattttttggtaaaattactctcggtagttttggtggttctgtgcctatcactgatactatgcttgtccaaatttcacccaaccgaactttcttttccccaagtgcaataactcctttcaaatccataagaaaaggtaaaccaagcaatactggtccaggacagtgcttgtcgggtgaaacaagcagtgtcgcttcccattctccaaatttacccgtcactgagtcttcaattcgaattttcgcttttattttcccaacaatttttatgtttgaatcatttgctgcggtcagttctgaattttctccctctaactccaaaattttcagtcccgctctgtgtactatattttcccgacagtaagagacgcaggcacaagaatcgaaaagtgccgaagtcaaaagtccatttaaatgaattcgaat

SEQ ID NO: 3297 - DNA, 5756 bp, Heterodera glycines
atttagtgatgacgtcattgacaacgacgacttgcttcttacggtggtggagcacatcgcgccatccgcgtctcctttccgcagattgaccgtaacgtccaggccgacctcttcacccgggaggcccacaaggactaccggcccttctacgctaagggacgcgtccgccctgggatgcaaacgcgcccatttgggtacgtcgaagatgctccacagccaatggatgtcgaacagcagcccccgccaccgccaacagaacgccgaaagaggactttgattgaagccgatcccaccaagccgggtcactcgcgatggttttaattttttttacattgtgtttttattcgttttttttttgttacgagaaaataaaatttaccgaaaataattaggaacaattttagacaagtaatcaaatgaattttttaaattttctacatttttcaccccagtaagaataacttttccggaaatgtaaatgagacacgtggctccattatctaatttgcaccgaagggctgggaagatcgtaggatcatagatgccacccagagattgttgtagtttctccactcgaattctttggtcaaacgttaaaactccaacaatgttgaccacacgtagctcatagattgtcatcgttctgcattgcgtgtattcaattcgtcgtagaacccttgctgcaaacttttgggcttgatcagggtgtggaactccagtgaggacgacacgtgccgattgaaatatgagtgcagccacagtttttgctccatatcggattcgcatgatgattgcgtggaaacggcgtggattatattctgtattaattccacgttgtgcaatagccaaaaactgttgcgtgttcaaggaatttattttaaaaataacagtacagttagaaattttcatctaaattaaaatggacaaaaattttacgcaacaaatttattttaaaaacaacaacaattaaatattgaaaaacatctaaaacataatagtgagaatttcaagcgggaaaaaggttttgtgatcaccgcctccaaattctacgacacacggcaagtttggatgatgcaaacggattccatgttttatgtagtaatgcattcgtacctaaaatctttaattatgtccaccaaattgccaaaaagtaccgtaattcccaagaagccgcggtaggccgggactgagtgggcgtcgagaatggagaggtcgttacagcgcaccgggaaatttcgaacaaaagggcgcaggtgggcggtccgcagttgagcagagcgcaagtgctcgacaatgtctcggcgcttctccaagtttcggaacaacacgtgcagctcatgcgcgctacagttgaagcgcttgcataagtgctcgacgagcgggatcgggcgcgggcgttctgcacaagcacaagtctttggggtacctaaattaaccaatttgtttaaaaaaaaaaaaaaaaaaaaactgaatacttgctcttggcggctcatcataaattggggtgaacgggtcctgcttctgctcttcgtcaatgaggctgatccagctaggctccttcgtctcctcctcatcctcctggtcttttttcggcgtttcattgttatggtcctgctggtccttttttgtcgtttccttattatggtcctgctggtccatttcgggataagcgttgtttatccaatcggtagcaagaattaaatccatttaaaaaattaatctgtaatgaaatctatatatatatataaatgaaatctatatatatatatatatatatatatatatatatatatatatatatattaaatatcaacgcgcaataaaaaaaaaatggattcgtttccaagctttgaacacgtggacttgcaatttcgtcatccattcacaatgattgtatctgggagtacatgcagtgggaagtcagagtgggtaatgagtcttctacgcaatttagagaaaatgatctctacccccattgagcgcgttatttatggctacggagagttgaacactaatgttttgaatttgcaacgcactggaaaaattggcaaattgccagtaactgtgcacagcggggtcccatctgcggaacaggtacgcgattgcgccaaaaaagaaaaactcttgctaatattggatgatttggtagtggggatgagtcaacagtatttggactcgcttttcacacgcggctcacacaattggggcgtgagcgtaattttggtgacccaacacctgttcaacaaagagttgcgcgtcgctcgcacaaattcacattatttggtattaatgcgaaacccagcgggtgctcttcagatccgtacaatagccacccacctcttcccgtcaatgaccgcccactttatgcaagcctatcgcaacgcatgcgcaaaaaattttggctaccttttggttgacatgcaccccgagagttcggaagagattcgccttagaacaaatatatatgaacaaaaacaaatagtttatatgccaaaatgaaagggtcgcaattgattgcaagaaatgaatcctttttggagacactgtctaattccaaaaaggcgaaaattgttattagagacgcatccgatgaacaactattatgcctggtagaaatttgtctcaacattctaaagggccgagttccattgcgtccacgtcatttaaagaagctgaaagctcacgcacagatgcttcgtcgtctcgcccgcacacgttgttctcgctctgccaaaaacgttttgctacagcacggagacggcctcccagccattgtagggctcattgcatcgattgcccttccgcttattgcgaacgtcattgaaaattatacatagtgcttgataaagtttaaaaaaaaaagtaaaatgcaacatacaaagcgctatttgttggtccccgaagagatttatcagagtttggcaacactgtcaccgtctgacggttcaccaattgggctggtccgtgccagaattaaacaaataaaaaatgatgacgccataaatgaggcggaaagagcagtcaaatatgagcaggaaattaagcgtctcaacaagctcaaaaaggacgaggatgaacgccctgtcggtgttaaattagaaaatttgagtgatgtggttgacgccatgccaaaaccattcaacattaaaagaccgattgttgtagctacgcgtcgccatctcaaggttgggcgtgcgcgaaaagaaaatgttgaacaattagaagatgatgatgatgatgaagatgattatgaaactccacgcgcgtcgagtacaaataaacgtcaacccacacaaatggaaatcttaaatttaatttataaaaacgcccaatctcttggggtgtcggaggaaggacaggtcttgagagcgggtggacggccatttataaccagcagtgtcgatgatattgttagtcacctgctgaataaggacaagcgtggccaaaaagagccaacagcattcaaagaatttattgaaagggcaaagcagaatcgacaattaagtaggtatttatttcccgagggccaatccggcaaaggaatttataaaagcactttacttaagtttaaaccatccctatggatttgaaaaaatttcgtttgctcgagttcttgtacaaggacttaagttcgcctgtctcattcacgagcgttgaaccgcttctgaaagaggcgcgtaaaagtcaaccaaaaattaatagaattgatgtccaaaattatttagctacccaacgtacatacacactgcatcgccaggcaaaacggcgctaccgccgtttgccaaccttggcacccggcttgcatactgaatggcaggccgatttggctatttttgaccgaattactaaacaaaatcgtggctacaagtacttgctagtctgtattgatacccttagccgacaggtgtttgtcgaacccgtaaagaccaagacgagcgctaacatgatcaatgcctttgaacatatattcaaaaggtctaaatatattccttggaaggtgttaacggatcagggaaaggaattcactgcccgcgcagtgcaacagtttttccgcacaaaagacgttgaacacttttgtatgctcacttctccccaatttcatgccggaatggctgagcgtgcgaatcggagcatcaaagagcgactttatcgctactttacggagcataacacgtacaagtggataggtgttgtgcaagaccttgtttacgcaattaaccactcgcaaaattcgagcattggaatgtgcccagcagacgtgaactttaaaaacgcagaagcattgagacaaaaattacatgatgcagctgcaaatgttctccgacaccagccaaaataccgtgtgggggatcgtgtgcgcattgaaaagtataagcacgtgttccaaaagggttacctcccacgcttcagcaatgaactcttcacggtggtagaggtacactctgagcgttcaccagttgtctatcggttgcgtgatgacaataatgaaattattagtggttggttttacgcaaatgatttatgcaaaacgctagaaaacaaacagcaaaaaatgtatgaaattgaaaaaatattaaagaaaaagaggcagaacggtgtaaaatatgcacttgtgaaatggaaaggttacgatactcgcttcaatagttggattcccgcacactcaattagcgaaaaatctatataaaaagcagtttttaataaattttaacaaaaaatgccttcaaattctttttatgttgtccttccgtctaacaccaatatagaagggaataggacaaattctttccgagtgcgtttacctcgcaagttgcaattcaattcggaatgggaggtgggtcttgccgttattgtgtatccccactcttggccctccataggcactgtggagcaacaatttgttcagattgagtggcagacagggaatatggtgcggattgagcttccatcatcaaatgtcaccaacccccacgagcttagcaaaaatttatacaggctcctggctgagggaagtgatcccttggcaaaaaaggtacgctcaacacagaattctttcatgcttgcaacaaacaaggctcgccgctgggccagagaagagtacattaggcgaaaaacgaaagaaaaactgggcgtccgtgacgaagagctgctcctacaggccctaatgacagatactggaccattggttggtctcaacaccgtgacgcaaggccttctggcacgcgaaaagcatgccgaaacaagcaatatcgcgttgagaacaccaactgacgataacgattcgtaccagaaaaaattggatgactacttttctaaattaagtgagaaaaatttgagcattgttgatgaattgggtatgataaaattgaaagccgaaatcaaaaatttgacagaagaggaacgtgtgatcctcgaagccacaaaggaaatgggaacggaagcatggattcaagcctaccgtgagatacgtctagtctgccaatttaattatgacatcagtaggaatcgttttgttctgaacactgacccacggtacgttaaaaaggttgaaatctcccctcaacttgcttacattctcggcttcaacaacacagagtttacacagcccaaaaaggaggcaagattcatgccagacatgagcggcggtgtgtcatcctttcacgtttacactccagaccttattgaaccaatgatgattggcgacgtcacggccccaaaaatgcgcattgtaaccatacggggagaccccgaccaag

SEQ ID NO: 3298 - DNA, 3397 bp, Heterodera glycines
ttttaaataatgaacactttggaaattgacaaaatattggcaaacaacaacgtaactcgccactactatattggttgttttgcggcagaccaaataccaaccggtgtcattgtcaaatttccacactgtatggtagtgaatattgaccccagcacctcgcatggctctcattgggtatgcatttattgtccttctcctttgaatttggaatattatgactccttagggatgtggccaccgcccagtgttcacattgtggattatttgtctcgttgcaaacaaattcaatataactctctcccccttcagtctcccaactcaagtgcgtgtggtcgacatgtaattttctttttgtactgtcgatgtgttggagtgacctttgagaaaattgttagccttttgcactttggaaaactgcaacctgataagctcgtaaactattttgtaaaaagcataattttcaaagaatataaataatgaaaagaacgtcaaattttaattttttaaaaaatgcatgtagattttgatcctctacaagtggattggtccacattctcgtccgagtatgtgcaatttggtggatacaacatttaccggggattaccctatcagcgtggagcgggagttggcgcagtgttcaggagccttatgagatacttgctgccgataggaaagcaaattggctctgcaattggacgtcagggaatggaaagtggaaaccgcgtcctcaccaatgtgttggagggaaaagacctcaaagattcgctcgtcagtgagagtaaatcaggactaaaaaaccttcttgaaaaagcagccaacaacataaccactcagaagggccaaggttttgattttaagcgatacaaaaaagactcgactccaaaaattggaaaaattaggcgaaaaaatataaataaacttcagtcatcaatcgggccacctatggttgctaagaccaaaaataaacgtctgcgtattgactcattaggaacctactaaaaaaaaaaaatgacttgcccacaaaaaatcagtgacaacagtccactagcaattaacagtggtctgaatattttctcagttccacctaccaatgtgtctgttgttcgttcattctttcgtcaggtgcttccgctcgcaacaatcacgcaagaatcgccttacctatttcggctttacagtgacaatttgtggactgatttatctcggatatatctttatctcgaactgtccattgaaaaaccgggagcaaacgataaatgggttgcgatagaggacgcggatactagtgtctctgccattcaagggattggtcaaacatttgtccagcaactaaaagttacggttggcaacaccgaagtatacgatagcgggaacctatacccattcaaggcctatatcaccaatgagttaagctttccaataaatgccaagaaaaattttcttggttcaacagggtattatcacaccttaaaccaagatgacttaacagacgaggggttcaaagagcgttgtaaaatttttaagggtggtaaaaatgcgcaattcctctcccgtctcgactttgatttgggaaaccaagagctttatctcttaaataatttggacttgctcttcacaatttacaaggccaaagatgtctttcttttgcaaacattaaaagcaaatgatgcaacgaaatatcgtttggccgttcatgatgtcaagatttatgctaaaatggttgagttacaaccctcactaaatatgagcctttacaaaacacttgaaaaacaacccgccacgtacgctgtacgcaagacggaaatcaagtcttcattcatcagtgttggtcgatacgaatttgagtacaatgtattcagcgcgaccattcctcgacgcgtaataattgcgttggttggcaattcagcatttcatggtgactacaaactgagtcccttcatgtttgagccgtttgatttacgtgaaatttcaatacatgctggagggattgtctacccagctgttccttataaactaaatttttcaaaagatcactatgtctacgcctttgttgacatgtatgaggcactgggtatggctaattcggagcgttcatttgacatctcaatgacccagttcaaaaaagggtgggccttttttgtcatcccattgacatccacacttgacgacagctgtggatttgagctgttgagaagcggcacaacaaacgtacgagccacatttaattcaccaattccagttggtggtgtggagatgattgtcatgggagaatttgatcaaatgattatggttgattacaaccggcacattgtgaccgattcaaagcttggataaattataaataactttattattaaatttagtttaaaatgaataacactaatacaacgaagccagccatacaaattttgaattcacctgaagagcataatgaaacccttttgcatgtattacttttttctcattatatcattgcatttcctgtgtttttgcttttttggttcgctttaattaggtggcttaaaagccacggtcatctatcgcccagcgaagcagagacagtaatggaagagattaaaaaaatcccccgccagccaccaatatttttcgcagcaaaataatgcaaagaacatgactacggtagattaatgttttacggtagatgcgtgcgtacgcatccacatactcacgatattcaatgctccagaaatgcgtacgtccatcaacacatatttattcttgatgcctacgttgtctacatgactatggtagattaaggttttacggtagatgcgtgcgtacgcatcaacttactcacgatattcaacggtccagaaatcgtacatgcgtacgatgcctacggcagatgcatcgtacgcagaatcccattacggtatcatacatgagtacgatgcctacggcagatgcatcctacgcagaatcccattacggtatcatacatgcgtacggcagatgcatcgtacgcagaatcccattacggtatcatacatgcgtacaatgcctacggcagatgaatcttacgcagaatcccattacggtatcatacatgcgtacaatgcctacggcagatgcatcgtacgcagaacgcacgccacccaatggtaccgtatcaccacacgcacaccacctcaagggtaccgtattacatgcgtacgccatcccaatcgacgcgcacgccacccaaatgaccgatgcgtacgccatcttaatgtaatgcggccaggtgagtaccgccctcttcgatggacccctcccgttgagcgaaaaccttcgacgactccctccaaacgcagctgcggactcccaccgccgagcgcgcgggcagctccaccgacggacctcttccctccaaacaaaaaccttcgacggaccccct

SEQ ID NO: 3299 - DNA, 1717 bp, Heterodera glycines
ataatcacaattgtgctgccgacagtcccttgggcctcttcctgggttcattaaatcatcattaaaaccataatttatcgtcaattctactggggattaatggttaatttatggaaattgtacactttcatttacgcatcattagataagcaaaaagctttcttcttcaatgttatttaagcaaatactttttcactcattggcacggcattcctttgaattgaaatttcaaaaatttaataaccgacatttaaaattcataaaaaacgaatggaaaaagtaattagttcgttaattaaaacttttctgacagatgacttcattcggttcccccttatttttcgtcgtccttttttctgccttttttgttgccctctgcaacaatcagccaaatttgtggcaaaatgtccaagtaaattttgaattcgtaaatttatgtaaaaaataaatattttagggttcaaaattcggtgccatgagtgttggccgaagtccgttcagtgcgtacctttcacggggcagcatcaactgcggcacaaaatatctgatcacattgcgaaaactgaacacatttctcgcagtcattttattcaaatataaatataaatattttaatttaaataatatttaattaaattattttaatttttataggaagcccacgaggaaatggaaaagtgcgaaaaattgacggatggaaaaacggatgaggatgaagcacgaaggaaagcagatgccaaaatgaaacaatttgaagcgaaaatggaaatgattggcaaaatgttcgtttaagcagtttcttttttgaatgcccattcaacaaaaaacatttatttgtaatttgtttcaattattttaaatcatttaattgatgacaaatcacttgaaagtagagaccggacaagagggtcggtcgaacggtttcggttaaaaaccgaaaccgaaaaaaaccgaaaaactcaaaaagttctcggtcgaacggtttcggttaaataaccgaaaaaaaccgaaaccgaaaatcgaaaaataccgaaaaaaaccgaccggtccgatctctacttgaaagcattgaaatattccaccaacattttaaaatttacagctttagttccgggttcattgaacactattccattttaaaagctcaaaatttctcctaattaaataaaagcactttaaaaaaattaattaaaataataataaaatttgttaaagtcgcaattttccactctttttttaaatctttatgttgcttgctacgctattttttttggttgttcttcctaaaaaaataataaaatcttcgggttgagcaaacgcgaaaaaaaagcaattacaacggcactaataagggtggcactggacggaagggggagctggcaagtcaaataaaagcaaccataaaattagcttaattagagccttcctgatgacagacaacatcactatgaatttcagtacatttccaattcaataataaaaaaaaagaagacttcctttacattataaatattttggcggtatgggtcaactgcgtctggccaactgcgtctccgtaaaaaatcaattacctaatacccaaaaatctatgtataaaattcgataaataacacttagccttatcctgttcagttttaatgtaccaaatggatattagaatttttcattttcttatagtaccttatttagacttagtgctttcgaatgataccaaaga
